United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 3

SEQ ID NO: 4198 - DNA, 1614 bp, Pseudomonas aeruginosa
tttcttcgccttgctcggccccaacggcgcgggcaagtccaccaccatcgggattctctcgaccctggtgaacaagaccagcggttcggtctcggtgttcggccacgacctcgacaaggacccggccggcctcaagcgttgccttggcgtggtgccgcaggagttcaacttcaaccagttcgagaaggtcttcgacatcgtcgtgacccaggccggctactacggcatcccggcgaagatcgccaaggagcgcgccgagcgctacctgacccaactgggcctgtgggacaagcgcaacgaagcctcgcggatgctctccggcggcatgaagcggcgcctgatgatcgcccgcgcactggtccaccagccgcgcctgctgatcctcgacgagcccaccgccggggtcgacatcgagctgcgtcgttcgatgtggagcttcctcacagaactcaaccaggaaggcatcagcatcatcctcaccacccactacctggaagaggcggagcagctctgccgcaacattgccatcatcgaccacggcgagatcgtgcagaacaccagcatgcgcgacctgctgatgaccctgcattcggaaaccttcctgctcgacctgaagaacgtccaggccctgccgccgaccctcgacggctatccgacgcggctggtcgacgaccacactctcgaagtgcaggtggagaagagccagggcatcaacgacctgttcgcccaactgggtgcacaaggcatcgaggtactgagcctgcgcaacaagaccaatcgcctggaggagctgttcgtgtcgctggtggagaagaacctgacgaggatcgcccgatgagcagcgaactgagcgccaacctggtcgccctgaacaccatcgtctaccgcgaggtgcgccgcttcacccggatctggccgcagaccctgctgccgccggcgatcaccatggtcctgtacttcgtgatcttcggcaatttgatcggccggcagatcggcgacatgggcggcttcacctacatggaatacatcgtgcccggcctgatcatgatgtcggtgatcaccaacgcctacggcaacgtggtgtcgagcttcttcggcagcaagttccagcgctcggtggaggaactgctggtgtcgccggtgtcgccgcacaccatcctcctcggctacaccatcggcggcgtgctgcgcggcctggcggtgggggtgatcgtgaccctgctgtcgctgttctttaccaagctgcaggtgcaccacctgggcatcacggtactggtggtggtgcttaccgcgaccattttctccctgggcggtttcatcaacgcggtgttcgcgcgcaacttcgacgacatctcgatcatcccgaccttcgtgctgacgccgctgacctacctgggcggggtgttctactcgatcaacctgctgccgccgttctggcagacagtgtcgctggccaacccgatcctgcacatggtcaacgccttccgctacggcatcctcggcgtctccgacattcgcatcggcgtggccatcggcttcatgctgctggccaccgcggtgctctatctcggctgcgtaaggctgctggtgagcgggcgcggcatgcgccaatga

SEQ ID NO: 4199 - DNA, 822 bp, Pseudomonas aeruginosa
agatcaatccggcgatcagcgagaccgccgccgtgcaggcggcgaacagcaggctcaggcggacgccgagggacatccgcgagccgaacccggcgctcattcgtcgcgctcttcgagaacgtagcccatgccgcgcacggtatggatcaggcgctgcgggtagtcgtcgtcgaccttggcgcgcaggcggcggatggccacctcgatgacgttggtatcgctgtcgaagttcatgtcccagacctgcgaggcgatcagcgacttgggcagcacctcgccgctgcgccgcagcagcagttcgagcagggcgaactccttggcggtgaggtcgatccgcttgccctggcgttgcacccggcggcgcagcaaatcgagttcgaggtcggccagttgcagggtggtctcctgcaactgctggctgccccggcgcagcagggtgcgcacccgggcgagcagttcgacgaaggcgaacggcttcaccaggtaatcgtcggcgccttgttcgaggccgcgcacgcggtcctctacggcatcgcgggcggtcaggaacagcaccggtacggtcatcccggcgtcgcgcacgctgcgcaggatctgccagccgtcacggccgggcagcatgacgtcgaggatcagcaggtcgtagtcgccgcccagggccagttgctcgccctcgttgccatcgtcgctcaggtcgacggcgaagcctgcctcggcgagcccctggcgcaggtactggccgatgcgcggttcgtcttcgacgatcagcagtttcatgttcatccctcgttacatttgccggccatgccgacctgtttctga

SEQ ID NO: 4200 - DNA, 1611 bp, Pseudomonas aeruginosa
ccccggccggcaagccggtggtggcgatcggcgagttctcgatcccggcggactcgccgaacatcatcgagtcgaagtcgttcaagctttacctcaattccctcaaccagtccgccttcgatagtcgcgaggcgcttcgcgcggtattgcagaaagacctctcggccgctgccggggcgcccgtgggcgtgcgcctgcgcagcctcgacgaggttgccgaggagggcatcgggcgtctgccggggcgctgcatcgacgagctggacatcgccgtcgacggctacgagcagccgcgcccggaactgctgcgctgcgacgccgggcggatcgtcgaggagcagctctacagccacctgctcaagtccaactgcccggtcaccggccagcccgactggggcaccctggtggtcgactaccggggcccggcgctggacccggccagcctgctggcctacctggtttccttccgccagcaccaggacttccacgaacagtgcgtcgaacgcatcttcctcgacctgcagcgcctgttgcagccgcaggcgctcagcgtctacgcgcgctacgtacgccgtggcggcctggatatcaatccctaccgcagcctggcggaggtcgcaccggacaaccgacgcctggtgcgccagtaacgcctcgcaacacgcggatacgaaaaagccccggccatgccggggcttttcatttcggcaagtcgttcagatacccatgttggccaggctctgcacgatggagcggagcgtgccggcgagggtcgggtggctgacctcgaagcgctcgacggcgaggttgaccccatcgaccaggctgccttcgttgagggcgtcctcgttggccagtttcagttcgatgtccctgatcaggagttccagttcggcgcgctgctcttcgttcagcggcggttgttgctccagttgctcgcgcagggcggatagttcgcgcagcagactctctttcggcatggtatttccctcgacgtacaagtcttcggtggacctccggcgggcgccgaaaggtccgtccatgccgaacagattaacctgtcgggcgcagatgtgcgcgatccggatcaatccgcagcaggcgttccagcagcgggaagaagtgcgtcagttctggggtgcgcatggccgggtccttggccaggtcgtcgaggcggcgcagggtcaggccgtcctgggcatagggcgccttgatgtaggccgcggcggcacgctcgtcgaacggcccgccttgcagcaccaggctgtgccgggaggccggcgacaggctggcgtggtagctcgggtccaccgcgcagaggaagcgcttggccgatacgtgcaggcgcaccggctgccagaccgactctgggaacagctcgcgcagcaggcgtgcgccgaattcctcgtggcgcaggtcctcctcgtcgatctgcgccgggtcttcgtagaggtggccgatatcgtgcagcagggcggcgactacaaggctgtccgagcaaccggcgcgctcggccagggtcgcacactgcagcgcgtgctcggcctggctgactgcctcgccatagggctcggcgccatggctggcgaagcgttcggccagttcgtctag

SEQ ID NO: 4201 - DNA, 735 bp, Pseudomonas aeruginosa
atcagcgaggccgtcatgccggtcgatcaatctcgtcagtacctgcgcatccgcgaccagctcgccgcggatatcgcccagggtgtgctgcaagtgaaacttccctccgagcgggagttggccgagcgcttcctgtgtacccgcatcacccttcgcgaagccctgcagcaattggaaaccgaaggcctggtctatcgcgagaaccgccgcggctggttcgtcgcgccgccgcggatccgctacaacccgacccgtaccaccggcttcatggaatacgtcagcgcccagggacgccagccgcgtaccgagacgctgcacgccgagcggcgtgcagccggcgcctggctggccaagcggatggggctggaggacagcgcgccggtgtatttcctgcaacggcgccgctgggtggacgagcgtccggtgctgatcgaactgatcgccctggatgccgggtggtgcccaggcctgctggaccacgacctcgatacttcgctgatgagcctgctgcgcgagcgtttcggcctgcagccgacgcgctgccaactggcgatgcacccgaccgcgctgaacgcggcccaggccgagccgctgcaactggcgccgggttcaccggcgctgtacctggagcgactgagttacgcggaggggcagagggtggtcgagttcgaccaggagttctggcgcccggacgccctggagatcgtgctcgacgcggcctatccgggcgcctga

SEQ ID NO: 4202 - DNA, 516 bp, Pseudomonas aeruginosa
tatcgccttgctggtgttgagcaggaaccttgcatgagtaccggtaaaatccagtttgccgaacagaacggctccttcgttctgaaattcgtcggtgaggtccgcctcaccctgtgctcggccctggattccaccatcgaaaagatcttcgctgcgctgaatttttcggcgatcatcatcgatcttacggaaacccagagcatcgatagcaccacgctcggcctgctggccaagctgtccatcctgtcgcggcagaaaatcggcctgttgcccacgctggtgaccaccaatccggacattacccgtctgttgcagtcgatgggcttcgatcaggtgttcaatatcgtcgatcgtccgattccgtgcccggaatgcctgtccgacctgccgccgcaggaccagtcggaagatgtggtgcgcgacaaggttctggaggcgcaccgcatcctgatgggcctcaacgaatccaaccgcgaagccttccacgacctggtcagcgccctggagcgccattaa

SEQ ID NO: 4203 - DNA, 1278 bp, Pseudomonas aeruginosa
atcctccgctgcgccggaacgggacgccctgcatgcgcgtcccgccggcagcggcgatcagtggcgggtcgccaactggtattcgagcttttcctggtcgcgtgcgaacaggcggatgccttcggccagcttttcggtggccatggcgtcctcgttcatctgccaacggaaagcgctctcgtcgagcacctggcgcggctcgccttcgcctggcagcagcaggcgcggcagctcgccctgggcgtcagccagttgttgcagcaggtcgggactgatggtcaggcggtcgcagccggccagttgctcgatctggccgagattgcggaagctggcgcccatcaccaccgtcttgtagccgttggccttgtagtagcgatagatgcgcgagaccgactgcacgccgggatcctcggcgccggcgtagtcgcggttctcgctcttcttgtaccagtcgtagatgcgcccgacgaacggcgagatgaggaacaccccggcgtcggcgcaggccaccgcctgggcgaaggagaacagcagggtcaggttggtctggatgccctcgcgttccagaatctcggcggcgcggattccttcccaggtggaggcgatcttgatcagaacccgctcgcggtcgatgccctgttcgtcgtacagctcgatcaggcggtgggcgcgggcgagggtggcctcgctgtcgaacgacaggcgcgcgtcgacttcggtggaaatacgtccgggaatgactccgaggatgtccttgccgactgccacggcgaagcggtcgcaagccagtccggcgtcgccgccgctacccgcggtagcctgtcgaaggtgctcggcgtagcgcggcagggcggcggccttgagcagcagcgacgggttggtggtggcgtccaccggcttcaggcgggcaatggcatcgaagtcgccggtgtcggcgaccaccgtggtgtattgcttgagttgttccagcttcgaagtcatggcgaggtcttgtcaggtgggttcttgggaagaagaattccccgaccttacccgagccgcaggcgcggctcaatgggagctatcgccccgccagaagttccagcgcctggtcgaaaacccgcagcggatcggcggccttgtgcacgtccaccgagagcagttggcggaatcgccgggagccggggaagccctgggccaggccgaggatatggcgggtcacgtgatgcatcgcgccgccttcggcctggtgtcgctcgatgtacggacgcagacggagcaaggcctcgctgcgactga

SEQ ID NO: 4204 - DNA, 1335 bp, Pseudomonas aeruginosa
tgcttacacctggtacatctggatactctccgaagagactggcgtggcctcaatgcgcgcgggattaccactcttccggatgtgcacgtttcccgagcctggcctgccagacaacgccgatcccaacgcctggaggtctgcgtaggcgtagaaccaacgagggccggcgggccgtggcagctcctggccctgccggtgtgcccctgccgacctagtccatttgaaatattgcgatcctggcatgggccagtaagatgggccgttcgacgacccgcaccagcctctatcaaggatcgatgcatgagactgccccgcccgcgttttgccctttccgccgccttgctgctttgcctttccggttgcgtgtcggaactcgattcgggcgcctatggcagcatggacgatccgcgcaacgcgcagatgctggacctggtggaccaggcgctgaaggggaacatggccgtggtactggtggccgacgtgatgccgcacaagtccctgagcgatgccctgaccatgacccagtggacgccaacggcgatctgggagtacgagaaggacccgaaggtgaccttcggccgcaagttccagaccaacgcgctgcagcggaagcccgacgagacctatctgttcaaggccttcgaggtgcatatcctgccgcccggcaagtacctgctgaccggcggcgacgactaccagatccatggcttgctcgaccaggtcggcgcccgcagcggtccgcccggttcgggccatggcgccaacggcaccgcgtacctgtcccccgagctgtatcgcgagtactaccgggaagaagtctggaaagatgccacctatggcagcgagatcaagaccgagaaggtctgcaccgccgtgcatgtggcctcgggcgcctgcgtgagctggggcgagcagcaatacacgcagacgacccagggctcccaggccggctattaccagcagaccgactcccgcgacgtgccctcgatcaaggtccaggcgcgcctgccggtcgacaaggcgctggccagcttcaccgtgcagggcgggcaattgctgctggccccgcgcatgcacctgaagacccccggctacaagtaccagcagtcgaagtgccgggcgatcgatccgaagaagatcgaatgcccattggaaaacctgaccgtctacacctggccggcgccgatggacttcagccagtccctgatcgcccagcgggccctgagcgacaagcaccggcaactgctgtccagactccagcccctgcagatcacgccgctgcgcaagcagggcatggaagacccggtctggggcgtgccgctgtcattgaaatag

SEQ ID NO: 4205 - DNA, 618 bp, Pseudomonas aeruginosa
accatgccatcgctggcgaacaatcgcgcaccggcggggaagtcgatgtcgtcggcgcggttgccgatcgccaggctacagccttcgaaggcggcgggacgcccgtcgcgctcgctggcgaaggcgatttcctggctggcgtcgcaacgccagccttcgatctcggcgactccctcgccacgcaggcgcagcgaagtgggatggacgccggtggttttccatgggtcctgcgggttgtcctgctcgctctgcagccagcgttgcaggtggcgggtggcgacgccgcggatcgtcaccggggtggggaattcggcttctcggaagctttccggctggtgcttgagttccagcttcagccgggtgccggcaggcatctcgatgcctccgaggcgggtagggcgctcgagcacggcgctgtgcgcggcttcctcgcgtgcacgttcgcgctcgtactgccagagaccgatctccagccaggcgcgcagtcccaacgggatcagcatcagcaggccgcggctcggccagcggcggcgcaagcgctggcgcgcgcgcgggctgaaggccaggagcgatagccagatcagcagccagatgccggcgacgaacgacgacaggtag

SEQ ID NO: 4206 - DNA, 1851 bp, Pseudomonas aeruginosa
tttcaagatcgctgcatccggcctggagcgctccgcaaaatcccccccgtgcctgccgggggcacggagggaagcgtcctacttctgcaccaactggacgttgtcgatgaacatcgactcctgctggttaccgctgaggatcatcagttcagcacgcttgatcggccccttcggcaattgcacctggccgcgcaggatggcccagcggccattctcgaccaccttgtagcccaggggcaggtattcgccgggccgaccctggctttccaggtagaggtaggcataggtcatggcctgcgagccgcgaccgtcgccgacccgtacgtccgcgctgaacgcgtaggtccggcctgcttccaggttgcccagcaggctggtgctcgcgccggtgccggcgtagcgccgctggtaggcttccagggccagccgcccggcgctggcgacgcgcgtggcgcgggcgctggcatgcacgccgctccagccgccgatgccgctctcgaagtcgtaggcgatgcgtttcggcgccggcggtacgctcggcggcgcggcctgggcttcctgcaggttcatctcgtcgaccagcaggctggcgccgctgtcgctccagaccgccacgtagaggttgcgctggtcggcggcgggacggtagtcgaaggtcttctccaggcgactgaactcgttgccgctgaccgacagttcgacgctctgcgccgggttgtaggccagggcgccatcggcgcgttcgctgagcagcgccatgcgcacggtttcacgggtattggcggccttgaacatgaccttgccgctcagccggtagccgctgccggcgcgcaggggggcaatggggcggaccagcagatcgaagccacgcacgtcgaccagcaaggcattgtcgcggcagcccttggcgacgttcaccaagctcaactgggcgttgccggaccatgcgcgccagccttccatgctggcgaactcgccatcgccgagcaggccgccgagcttggctttcgtgcaccatggcaggtccggcggggtctgcgtgtctccgccggagcccgggttgatcgtgccgggtaccttggtcgggcaaaagtcggcgatctgcgtggccatgctgttcagcgcgcgtacggggtccgcgtgttcttcccggccgcagggctggttggcgcatccggcgttgaccatgcgcgggttggcgaaaaacggtgcctgcttgttggtgccgaaggcatgcgggtaggccatcacggtggcgaagcgcccttgcacgccgtagcctcggatccattcgtaggtgccgctgtgggcgtagcgcggatcgtagtagctggactccaggtcctgctcgtaggagtggcgcaggcccatgttgtggccggcttcatgggcgaaggtgttgagcccgcagttgaccccggtgaggttgtaggcaatgtccttggcgttgctgtggaagcgcccgctgttcttatcgcccgagcccatgtagccgatgccgcaggtgatgtagccgttgccgctgttctgcgagcggttgaccaggctgaccaggtcggcgccgtactgctcgcgcaggcgctgcacctgcgggtcgcgcatgaagcgatcgaggttggcgccggtcaccgtcgggtagtcggcccagtccaggcgctgcttgtgcaccagacgcaggcgcaggttgacgccgctcttctcgtaggcggtgttggcgaactcgatgtagctggcgatccgcgcatcgatgtcgcggccatttgcggtctgggtcgccgcggtggtgtagacgaccatgatgtcgacggtcttcggcgcggcctgggcggcacaggctaccgccagggctag

SEQ ID NO: 4207 - DNA, 609 bp, Pseudomonas aeruginosa
tcttcatcatcaccgacatgctttgcgccacggatatcttcagcttcatcaaatgcatcaatcggtgaggcggctggcaggggcactgctggtctccgcaatgctcggcggctgcgcgcagccgccgagactgccgccggaaagcgcggcgctgcccgcacgggtggagctgcgcgaagtgccgttcttcccccaggaagcctaccagtgcggtcccgccgcgctggccacgatgcttggccagcgcggcctggcgttgacgccggggcaattgaaggacgaggtgttcattcccggtcgcgagggcagcctgcaattggagatggtcgccgcggcgcgccgccacggcatgctggtctatccgctgcaaggcggactggagagcgtgctcgaggatgtcgcggcgggcaacccggtgctggtgttacagaaccaggctttctcctggtggccgcgctggcacttcgcggtggtggtcggtttcgatcgggagcgccgcgaactggtgctgcgctcgggcatcacccggcgctgggttaccgacttcaccagcttcgagtcgacctggaagcgttcggggcgctgggcggtgctgaccctgccgggtga

SEQ ID NO: 4208 - DNA, 369 bp, Pseudomonas aeruginosa
cagcgaggaaaccggccaccccaaggttgcccggcgcgcctacgaagaaccgtgcgacgctggcctgaggacgccttcgcctggtttgccctgggcaacagtcgctacgccgcaggcgattccgccgctgccgaacaggccatgctcaccagcgtcgagcgtcgcgtggatttcgccgcgggttggttcaacctgtcccagttgctggcggaacgcggttgcgcggcgccggcgcgccaggcgcaggcctgcgcgcgggcattgcagcctggggaagcccgcttcgctgcggccttgccgcaggccgtcgcacccgcggctcggtgcgccgagctgccggcctgtcccgttggcgcaccgccccgctga

SEQ ID NO: 4209 - DNA, 1038 bp, Pseudomonas aeruginosa
ggcggcggagccgaaggttgtcggaaccccgttccagcgagacggctctatacctgggaggaccccactcaggtgcagaacatggccaacgacaagcggacttcgccccccaccccccggcaaccggccaagggcggtgcggcgggcaagcgccaggggcatgcggcggagggcacgcgcaagccgcgtgcgcgcggcgaggagcggaaagagaaaccggccgacggacgttcggccacggcgctgaccgccaacgagcggcgggagatcgacgacaagcagccaccgcgcgccgctgtcctgcacgaggtgattcgcgtccagggcgaacacgagttgcagcgcacgctggcggcactctggtggtcggcggtggccgcggggctgaccatcggcctctcgttgatgggcatgggcctgttccgcgctgccttgcccgagcaggagtgggcgatcatcgtcagcagcttcggctatcccatgggcttcctggcagtgatcctcgcccgccagcaactgttcaccgaaaacaccctgaccgccgtgttgccggtgatgaccgagccgaccctggaaaaggcctggcaactgttgcgtctctggagcgtggtgctgttcggcaatatcgtcggtacgctgctgttcgcctgggcggtgctgcatctgccgatattcaatgaagcggccgacgcggcgttccttgagatcggccgcgaggtgatgcacaacgacctggcgcaaatgttcgccaagggcatcgtttccggctggatgatcgccaccatggtctggctgatcccggcggcggagggcgcgaagatctggatcatcgcgatggtcacctacctgatggcgctgggcagcttcacccacatcgtggtgggctcggcggaggtaggctacctggcgttcgccggggaaatcggctggaccgagttcctgctgaagttcgccctgcctaccctgggcggcaacatcgtcggcggtagcctgatcttcgccctgatcagtcatgcgcagatccgtagcgaaggttga

SEQ ID NO: 4210 - DNA, 498 bp, Pseudomonas aeruginosa
cagcgggggcggtcttttccgaccctagcgccttcacggatgattcaggcgacaaggctcatgacgacctcttccggttcgcgtatcggcggacttcttcacgcttcccttttttccctgctcggactcggtctcctgctcgccggcggtttcaagaccgtcgagcggtaccatttcctgcgtactgcgcaggaagcccaggggacggtcagcgccttgaatgccggcggttcgcatccgcagatcgatttcaccagcgtttccggcgagcggatttcctatccccagggcggcttcatcttcggctaccaggtgggcgagccggttcgcgtcctctacgaggctgggcggccggcggccagcgcgatagtcgacgatgccggcgcgctctggggaaccagcgctttcctctgcggcttcggcgcactcttcggtattgtcgggttcaggggattgctgggcctgcgttcttcccaaccgacctcaaaaggacattga

SEQ ID NO: 4211 - DNA, 300 bp, Pseudomonas aeruginosa
gatttgcgggttttattcaatctgggtgaatgcgtgcaggaaatctactctgaagaacagatgcgcaaggcgctgggccttgccgaaacgcgaccgaaaaaggtccggaccgaggccagccagccggtccgctacaccatcgtcgaactgagcgtgcgcaagggcggggcgggattgccgctgcgtttcgaacatcgctcgcgctccatcagcaaggtcaccgcgcaactggaagcggagaaggaagccaagcgccagggttaccaggtctgggcgctgctggatatccgtcagatctga

SEQ ID NO: 4212 - DNA, 843 bp, Pseudomonas aeruginosa
atcgaacgcttgatcaggcgcaccgcttgcggtgagcgccgggacaggcgttgcgccagcgcgtcggcggcttccagtagctcctccgctggcgccagcccgttgaccaggcccagcgcaagggcctggcgcggctccagcagttgcccttccaggcacagctccagggccctggctacgcccaggctgcgcgccagcatctgggtgccgccgcctcccggtatcaggccgatgagtacttccggctggccgaggaagcgttccacttggtcgtcctcggccatcaggcgcaggtcgcaggccagcgccagctcgcagccgccacccagggccaggccgttgatcgcggcgatgaacaccttgtccatgcggcgcatgtgcgcggtgacctcatggaacaggttcatgtcggcgacgcctgccagcagggtgcgccgcagcagcttcctcgccccaggcaagtggcgcaggaggctttcgctttccagcagcaggcgtgtcagccaggccggcatggaaaaggtgatgggggcgacggcgcgctcgatctcgtcgacgtcgaagtgggtcaggaagaccccgtccgccgctccggaaaggatgacggcgccgatgtcctggcgttgctcaaggtcttccagcaggtcggccagctcctgcatcaccgccgtggtgaggaagttcgccgggggattgtcgagcaggacttgcaggacgcgtcctcgttgttctatgcgcaggtgtcgcggtgctagagtcattgcggcttcctcattggataacgagcgttatataaagatcattatccaatgtgacgacatcgtctccccaaccaacggatag

SEQ ID NO: 4213 - DNA, 330 bp, Pseudomonas aeruginosa
tcggtcggtcgggttcgcgtcttttcggggcacccgaatctgaaaaaatcttgcttctcgccataccgggggagcggggcgggtagattttcttccgaatccttcactttctacccggtcatggaaaaagctctgaaattggcgtcatgcctctacggcctgctgatcctgctcagcctggcgatggtcgccttcctcagccagtttccgtttctcctcagctcgggagcggaaaacctctcgatgtcgatcctgccgctgctgatcccgctgatggtcgggctggtcgtctgcgaggcggtgcgggcggtggtgccgaagaagcgctag

SEQ ID NO: 4214 - DNA, 330 bp, Pseudomonas aeruginosa
caaagtggaatgaagttttgcggcaggcgtaacaattctgtccgaatcgtcattcttgcgtcaccgccgggacagagcggtttcggcagactgcgggggagtcgccgaaggagattcgtcgtggacgatacgctcaggttcgcctcgcgcttgtgcaagttcatcgtcgccgccagcttcctgctcgtggcggtcgccagcctttgcctgtggtggacgggccaggcctacgaatacgcggcgctggcattctttccgttcgccgtacccatgctgctgctgatcatggtctgcgacctgctggcagcgctgaatggcaggcgtcgctga

SEQ ID NO: 4215 - DNA, 426 bp, Pseudomonas aeruginosa
gcggatgtcgaacccagacaaccggcgccccgcgcgtggccctatggtgaggcattcatccactgccttcctggagcgaccatgtcagatttcatcaccgtactgcgcgatacctgtcccgtacccgtgctggacgccaccaagtggaagcggatcgacggcgatccgcataccgtcaacctcaacgcatacgcctcggcggacggcagcaagctgatgggcacctggatctgcacgccgggcaagtgggaggtgaactacgaacgctgggagttctgccacttcctcgacggctactgcatcatcaccccggaaggcgagcaaccggtgcacctgagggcgggcgacgtgttcgtcatcgagccgggcctgcgtggtacctgggaggtagtggagacggtgcgcaagtacttcgtcttcgcctga

SEQ ID NO: 4216 - DNA, 1455 bp, Pseudomonas aeruginosa
gcaatggcaagcgagagcgaatgctatcactggctttccgaagctgtacggctctacccgataaggttgaactggcgcacgaaacgcaaaaaagaaaaccccgggactggcccggggttctcgtcgcgctcgcaggttcgatcagaacacgctgaacgggtactcgacgaaggcacggatttcgttgccgtcgtcgttgtacgagcgggcgtcgttggagacacgcaggaacgagctgcgcagacgcagggtgaggtccttggccggaccgctctgcaccacgtactggacctggttgaagatctcgcgctccttgccgttgctggtctcggcggtcttgatgttgtcgccgcgcacgtaggctacgcggtaggtcaggccgggcacgccgtacttggcgaagtccagggcgtagctgacctgccaggaacgctcgtcctcggcgttgaagtccgaccagtaggagttggccagccagatggtggtgccgccgtcgccgatgccgccggcattctggtaccagccgtagttgtagccggtgtcgccggtgttgcgctggtgggcgatcatgaaggtgtgggcgtcgatggtgtaggacgccgccaggctccagatcttgttgtcgcggttaccgttgaagttctggtcggcgaagtcgctgtccagcttggtgcgatagccgttgaagtcgaagttcagcgactggtcggcctgcagcgggatggtgtagttcaggttgatgtactgcttcttcagtacgtcctcgacgtcggaagcgtacagcgaggcgttgaagtgatcggtgaaggcgtacttgccgccgaacacgttgatgctcttcaggccgccgctgtcgcgcccttcggcgctcttgcgggattccgcggtgaagcgaccggcgttcagctccaggccctcgatctccttggaggtgatcagggtgccgctgtagctttccgggagcaggcgcgagttgtcgtagctgagcaccggcaggctgggcatctggtcgccgtacttgagcacggtgttggagatgcggaacttcaccgccgcgccgcccttggacagatcgtccgccgcggagccgctgtcgccctgcttgaagaagtcgataccggcggcgccgctacgacccttgccgccgtccaggcgtaccgcgtacagaccgaacgcgtcgacaccgacgcccaccgtcccctgggtgaagccggaggtgaaggtggcagtggcggcctggccccattcggccttgtcctgccggccatgtttgtagtcacggctgatatagccattgcggaagaacagatcgaggtggctgtcctcgacaaacccctttgctgcttcttggtcattggccatcgcctggcttgcagtcgcgatgcccagtgccagcaggcaaatccttttcttcaacatcttattgttcctggttgttggcttgatgtgcgctga

SEQ ID NO: 4217 - DNA, 318 bp, Pseudomonas aeruginosa
agtccaggcgtaccagccttcccgttgccagcagcggcgcgacccgggacaacgggaaattgccccagccgatccccgcctcgaccatttccagcgccgtgcccaggctgtcggtgcgccagcaggcgccggcaatcagcggacgggtgtcggccaacggtaggtcgcaactggcgaccaggatctgccgcacgttcaccagctcttccaggtacagcgcctgccccggcttctgcagggcgggatggcgcggcgagatggtcgcgaccagcgattccgcgccgacatactggaagcgctcctgcgggttcacgctga

SEQ ID NO: 4218 - DNA, 225 bp, Pseudomonas aeruginosa
caagctaatgataaccggagtcagcctatgtccagaatcgaagtcgccgtgctggtggggacgtccgttcccgaatcgctgcgcagcaagggattgctggcctgttggatcctgatggtggacggcgccatgtgggccggccccttcaccagccgtgacgaggcggaagccttgaagggaacctgggaactgagttggccgctggaggcggcgatctccgcctga

SEQ ID NO: 4219 - DNA, 1110 bp, Pseudomonas aeruginosa
tgcagttcatcgcccagctgcgcgaactgtccggcggcaagccggtcggcttcaagttctgcctgggccatccatgggagttcatgggcatcgccaaggccatgctggagaccggcatcctccccgacttcatcgtcgtcgacggcaaggaaggcggcaccggcgcggcgccgctggagttcaccgaccatatcggcgtgccgctgcgcgaaggcctgctgttcgtccacaacaccctggtcggcctcaacctgcgcgacaagatcaaggtcggcgccagcggcaagatcgtcagcgccttcgatatcgccagcgtcctggccaccggcgcggattgggccaactcggcgcgcggcttcatgttcgccatcggctgcatccagtcgcagagctgccataccaacaagtgcccgaccggcgtcgccacccaggacccgctgcgccagcgcgcgctggtggtgccggacaaggccgagcgggtgcgcaacttccatcgcaacaccctcaagggcctggccgagatgctcgccgcggcgggcctggaacatccctcgcagctcgaagccaagcacctggtgcgacgcatcaccgacaccgagatccgcctgttctcgcagctgcactacttcctcaagccgggcgaactgctttccggcaagatcgagggcgagttctacgagcgcatgtggaacatggcgcgggccgacagcttcgacgcggcggcctgagccgccgccctcgcacgctagaaaaagccggaggcatcgctgcctccggctttttcatgtccgcgtagatcagcccagcaggatggtcgcccaggtcacggtgatcacggtgagggccacgaactgcgcggcgctgcccatgtccttggcattcttcgacagggggtggcgttccagcgagacgcggtcgacggtggcctcgatcgccgagttgagcagctcgacgatcagcgccagcaggcacaccgcgatcatcagcgcgcgttcgccgcgactgacgtcgaggaggaaggccaccgggatcagcaccacgttgagcagcaccagttggcggaaggcggcttcaccgcggaaggcggcgaggaaacctgcgagggaatag

SEQ ID NO: 4220 - DNA, 882 bp, Pseudomonas aeruginosa
ccctgtacatcgtcgagctggagaacggcgagcgcctggaaaccctgctgcccaacgccacgcccggccgggccaagttcttcgaggtgggcgacgcggtggaagccgcctggcgcttcgatgccggccacctggtcagggcctgagacgatgagaaagaacctcggcaagtggctgctggtctggccgccgcaagcgtatctgctgttcttcttcctggttccggcgctgatcatgctgttcgcctcgttccgctttcccggcgactacggcggcctggcgccctggatgtacagcgaggacgggcagaccgtctacgacctcagcgtggagaactacacccggctcaccgagagctgggtgtacctgcaactgttcgtcaaatccttcggctacgccctggtcaccaccctggcctgcctgctgctcgcctacccggtggcgaccaccctcgcccgggccccggcgaagtggcgcaacctgctgatcctgctggtgatcctgccgttttggagcaacctgctggtacgcgtctacgcctggatgatcatcctctcgccgtccggtgccctgacccgcgggatcaacgccgcactggacctgttcggcgcgcagccgatcagcctgatgttcaccccgttcgcggtgatcctgtgcatggtctacgtgcacctgccgttcatgatcctgccgctctacgccaacctggagaaacacgacccggccctgctggacgccgcccaggacctcggcgccggtcgttggcaacgcttctggcgggtgaccttcccgctctcgccgccggcgcggcactggtattcatcccggtgctgggaatgttcgccatccccgacctggtcggcggtaccgacggcatcatga

SEQ ID NO: 4221 - DNA, 837 bp, Pseudomonas aeruginosa
ccggctgcatcctgctgctggtcgccctcggcatgggcgccgcgcgcgcccgcaagggaggcgcccatgcgtaggccctacctgctctggagcgccaccgcgctggtgtacctgttcctctacgtaccgctggtgatcgtggtgctgtactccttcaacgactcgcggctgaacgccgagtgggtgggcttcaccctggactggtaccgcaagctgttcggcaaccgcgacatgctccaggccgccgccaactcgctggtcatcgcgctggtttcggccagcgtggcgaccctgctcggcaccctcgccggggtcgccctgcatcgcttcaagctgcgcgtgctgcccctgctggtgctgaccccgatcgccattccggaactcctgatgggggtctcgctggtgatcttcttcatcggcctgaacatgagcctgggcatgctctcggtgaccctcgcgcacatcaccttctcggtcggcttcgtcgccctggtggtgcaggcgcgcatgtcgggcatggacgaaagcctcaccgaggcggcccgcgacctcggtgccacgccctggcagagcttccgcctggtgaccctgccgctgatcatgccgggcatcgtcgccggcgcgctgatggccttcaccctgtccatcgacgacttcgtgatcaccttcttcaccgccggcggcggcttcgccaccctgccgacgcagatctacaccatgatcaagatcgccgtgacgcccgaagtgaacgccgtctccaccctgctgatgctgctcaccctggtgctgatcgtgatcgcctcgaaactctcccccagcgccatcaagggccattga

SEQ ID NO: 4222 - DNA, 1647 bp, Pseudomonas aeruginosa
cggaggaggctcgatggcatcactgacgtttctaggcgccgcccaggaggtcactggctcctgttatctgctggaaaccctcgatggcgtgaaggtcctgctcgaatgcggcatgcgccaggggcgccgcgaagccgacaacggcaaccgcgcgcccttccccttcgatcccgcgagcatcgacgcggtggtcatctcccacgcccacctggaccacagcggcctgctgccgcgcctggcggccgagggcttcaagggcccgatcttcgccaccgaggccacctgcgaactgctggaactcatgctgctggactccgcgcacatccaggaaaaggacgccgactgggagaaccgctggcgcaaccggatcggcaagccgagcatcaagccgctgtatacccaggccgacaccgaacgcgcgctcaagctgcgccggccgatcagcctcggcagcaccgtggcggtcgctcgtggcgtgcgggtgacctttcacaacgccgggcacatcctcggctcgtcgatcgtcgaagtgcaattccacgaccaggtgcaaccgcgccgcctggtgttttccggcgacctcggcaacacctgctcgccgttgatgcgcgcgccctcgccgctgagccgggccgacgtggtgatgctcgaatccacctatggcgatcgcgatcaccgcgacagcaacgacaccctggaggaactggcggcgattctcgaccaggcgcaccgcgacggcggcaacgtgctgatcccgtcgttcgccgtcggccgcacccaggacctgctctactacctcggccgcttctaccaggagggccgcctgccgcaacaggcggtattcctcgacagcccgatggccgcccgtgccaatggcatctacctgcgccacagcaacgagttcgacgaccgcgaccgcgagtacattcgcggcaccggcaccacccgcctggaggaatggctgccggtgctgcgcgtaacccgcagcgccgacgagtcgatggcgatcaaccggatcaagagcggcgcggtcatcatcgccggcagcggcatgtgcaccggcggccgtatcgtccatcacttcaagcacaacctctggcgcccggaatgccatgtggtattccccggcttccaggcgcgcggcaccctgggccgcaacatcgtcgacggcgccagcgcggttcgcgtgttccaccagcgcatcgcggtcaaggcgcagatccataccctcggcggcttctccgcccacgccgggcaatcgcagctgctcgactgggtcggtcacttcgcccaccgtccagcgctatacctgatacatggcgagcgggaaaagatggaagcgctgcagggcgcgatccgcgagcgtctcgactgggatgccgagataccggagcccggcgaacgcatcgagatctgagccgccgtccgcaactgtcacgcagtccgtggcagtatgcggatgaccgcctgtccagggtggttgtagaaggagtatgcgaatgccctacgaagccgatgactatctttcccggcacttccagaccagcggcaccgacctggcgcggaaggtcgacgaactggcggcccttgcggctcccggcgacagccccaatctcgcgctctaccgcgagatgctcttcaccgtga

SEQ ID NO: 4223 - DNA, 489 bp, Pseudomonas aeruginosa
ccgctcggtagtggtggccttgacgttgacctggtcgaccgcgacgccgaggtcctcggcgatcaacccgcgcatggtctcgatgtgtggcgccatcttcggcgcctgggcgacgatggtggcgtcgacgttgccgaccttccagcccttctcggcgacgatggcgaccacgtgtcgcagcagcgcgcgactgtcggcgcccttgaaccgcgggtcggtgtccgggaagtgcttgccgatgtcgcccagcgccgccgcgccgagcagcgcatcggacaaggcgtgcagcagcacgtcgccgtcggagtgggcgaccagcccatgtttgtggggaatgcgcacgccgccgagggtgatgaagtcgccctcgccgaagcgatgcacgtcgtagccatggccaattcgcatgaaaaaacgccctggttggaatcagggcgtgattctaccccggatcgggacaggcttcaggtatcgcggatcaaccgttga

SEQ ID NO: 4224 - DNA, 1395 bp, Pseudomonas aeruginosa
agttctcgtcggtacaggtcagtccggacagccagtacagggccggcagcgccgcctccggctcggcctggggcggcaggtagatggcgaagaccatctcgcagttcagggtccgggaaaaatgacggtaacgctggtgccagccgccgaaggtcttctggctgccgatcagttcgagggaatccttcacgtgacctccgtgaaacggtcgtggcgagccgcagggcccgccgcgacggcttgtcagtaatgaatgacggtgcggatgctcttgccttcgtgcatcagctcgaaggcctcgttgatgtcctccagccccatggtgtgggtgatgaaggtatccagcgggatctcgcccttctgcgccttctcgacatagctcggcagctcgctgcgcccgcgcaccccgccgaacgccgaaccgcgccagacgcggccggtgaccagttggaacggccgggtgctgatttcctggccggcaccggcgacaccgatgatcaccgactcgccccagcccttgtggcagcattccagcgcggcgcgcatcaactgcacgttgccgacgcactcgaaggagtagtcgacgccgccatcggtcagttcgacgatgacgtcctggatcggcttgtcgtagtccttcggattgatgaagtcggtggcgcccagttccctggcgatatcgaacttgcccgggttgatgtcgaccgcgatgatgcgcgcggccttggccatcttcgccccgatgatcgctgccaggccgatgccgcccaggccgaagatggcaacggtagcgccctcttccaccttggcggtgttcagcacggcaccgatcccggtggtgacgccgcagccaagcaggcagaccttctccagcggggcatccttgggaatcttcgccagggagatttccggcagcacggtgtattcggagaaggtcgagcagcccatgtagtggaagaccggctcgcccttgtaggagaaacggctggtgccgtcgggcatcaggcccttgccctgggtggcgcgcacggcctggcagaggttggtcttgccggacaggcagaatttgcacttgccgcactcggcggtgtagagcgggatgacatggtcgcccacctgcagggaggtcacgccctcgcccaccgcttcgacgatgccgccaccttcgtggcccaggatgcacgggaacaccccctcggaatcctggccggacagggtgtacgcgtcggtatggcagacgccggtggcgacgatgcgcaccagtacctcgcccttctgcggcggcgccacatccacctcgacgatttccaacggcttgttgggggcgaaggcgacggcggcacgggacttgatcatctgggaactcctgaacgatggaagccggcgggccgctaa

SEQ ID NO: 4225 - DNA, 405 bp, Pseudomonas aeruginosa
tcgagcgcgcgcagatctgcttcaccagtgccgcacgggacctctggaccaccggccggacccgcgccgccttcggcatcctgctcggcatggcggccgcctgcatcggtaccttcgccgcgatccgcctgggcgtcgcgccgaagatcttctggatgggcccgaatgcgatcatcggcggcattctcttcggcatcggcatcgtcctcgccggcggttgcgagaccggctggatgtaccgctcgatggagggccaggtgcacttctgggtggtcggcatcggcaacgtcatcggcggaaccctggtggcgatcttttgggaccagttgggcacccgcctcgccctgccctatcccaagctcaacctgctggaaagcttcgggcccggcaacggcctgctattga

SEQ ID NO: 4226 - DNA, 285 bp, Pseudomonas aeruginosa
acgcctcccgattcacccgaccgcggaaaccgaaccatgagccagaccgacaaaccgaccctgtcgcttgacctgcgcggcgaacattgcccgtacaacgccatcgccaccctggaaaccctggcgaccatgcagccgggcgaacgcctggaagtggtcaccgactgctcgcaatcggtccacgggattcccgaagatacccagcgccagggctacaaatgcctggcggtggagcagcatggcgcgctgttccgcttcctcatagaggtgccgctggaaagctga

SEQ ID NO: 4227 - DNA, 822 bp, Pseudomonas aeruginosa
acgagcgagcctgcaacgacaagaaagccgaccctcggggcggctttcttgtgccagggttcagtgcggaaaactgcgctgcaggcgcagcaggtcttccggggtggtgatcttcaggttgtcggcgcgcccttccaccagcttcggcgcatagccggcccactccatcgccgaagcctcgtcggtgatcgccacgccggccaccaacgcatcggccagcgcccggtgcagggcgccgaggcggaacatctgcggcgtataggccagccagaccaccgagcggtcgatggtttcgctgacccggccgtcgcggtcggagcgcttgagagtgtccctcgccggcaccgccagcagcccgccgaccggatcttcggcgagttcttcgagcaggcggtcgaggtcgccgcgggtcaggttcggccgcgcggcgtcatgcaccagcacccagtcgtcggcctgtgcccccaactccagcaggcgcagcaagccgttcaacaccgagccggcgcgctcggcgcccccggcggcgcgctgcacatgccggctggcggcgcagtccagcccgggccagtagggatcgtcctcggccaggcagaccaccaggcccctgagcatcgggtgttcgaggaaacaatcgagggtacgctcgatcacggtgcgaccggcaagatcgagatattgcttcgggcggtcggcgcgcatgcgcgaacccacgccggcggcggggatcaccgtccagaaggcgggaaggtcggaagtcgtcatcgggagaagggtcgtcagctcacttggcgagctggtagagggtttcgccgtccttga

SEQ ID NO: 4228 - DNA, 1317 bp, Pseudomonas aeruginosa
tctactggaaacggcttactagctcaaacccgggtcgttcgtcggcgggctccaggacagtcgccagcccccctcgcggggactgtccaggccaggaatgttggccaccgcgagcagttcgtcggctcggaagagcagcggcaaacgaccgcgcaggaagctcggtacgcccgcttcgttgagcaatcgcttgaggtcgcggcgaccgcgcccggccagggccagcacctccccaccccgccggtagtcgacgcgcaacggccccgccggaacctcgccgagcaacgccagccgaccattgccgggaagaagcaatggatgagcgggacgctcccagacgaacggtcccgccgccgcccgccagtccgccggcaaccaccagatccgccccgcgccgcgacgcagctcgccgctctccaggcgccagatcgggtcggcatcgtcgccggcatcgcgcaacgactcccagccggcccagtggtcactgtccggcaaccgcgtcagctgccccagccaggcccgcagcaggttgcgctggcgcgcagcgctgaggcggcgcagaggctccagggcgatccggggcagatccagccagtccggccaatccagttccgagggttggcggcaggcccggaggtcgatggcggccagttcagccagcaggtcttcggcctcgcgcagatgcgccgcgcagcgcgccatgccggcgacggcctgcggccagtgggaggcgagacgcggcatgatctcccggcgcaggtagttgcgcgagaagcgcggatcctggttggaaggatcctccacccagtccagccggtgcgcctgcgcataggcttccagttcggcgcgggaaaccccgagcaagggtcggcacaggcggccgccgcccagcggccggctcgccggcatcgccgccaggccgcgcaggcccgctccacgcaacaggcggaacagcagggtctcggcctggtcgtcgaggtgctgcgcggtgagcagcacctgtccctcgcccaggttcgcctggaatgcgcgatagcgggcgtcgcgcgccgcctgctcgatgctgccgccaacggcgacctgcacccgctcgacccgcagcgggatacccagcgaccggcagaccacctggcagtgcgccggccaaccgtccgccgcagcctgcaagccatggtggacatgcagcgccgacagcgccggcaaggcttcgctccgggccagttgggcgagcagatgcagcaacaccgtggaatccagcccgccggaaaacgccacgcaccagccccccgcttcgcgccagggcgccagggcctgtaa

SEQ ID NO: 4229 - DNA, 1203 bp, Pseudomonas aeruginosa
cagacgggattcgagcggcaccgccggcatgcttgcgctcctcatgcgacaagcccggcgaatgccgggcttgtcgatcgtaccagtgcgccggatggcttacggcgcgccgtagctcatcaggcggtcgtaacgacgctccagcaactcacccatttccaggccctggagcatcttcagttgcgtcagcagttcgccacggatcgattcggccatgctcgccggatcgcgatgggcgccgcccagcggttcgtcgatgaccttgtcgacgatgcccaggcctttcaggcgctcggcggtgatgcccatggcctcggcggcttccggcgccttctcggcggtcttccagaggatggaggcgcagccttccggcgagatcaccgaataggtggagtattgcagcatgttcaactggtcgcagacaccgatggccagcgcgccgccggaaccgccctcgccgatcacggtggcgatgatcggcgtcttcagtcgcgccatcacccgcaggttccaggcgatcgcctcgctctggccgcgttcctcggcatcgatgcccgggtaggcgccgggcgtgtcgatgaaggtgaggatcggcatcttgaagcgttcggccatttccatcaggcggcaggccttgcgatagccttccggacgcggcatgccgaagttgcgccggaccttctcacggacttcgcggcctttctggtggccgatgaccatcaccggggaaccgtcgaggcgggcaacgccaccgacgatcgccgggtcgtcggcgaaatgccggtcgccgtgcagttcctcgaaatcgctgaacaggtagccgatgtagtcgagggtatagggacgcttgggatggcgcgcgagctgggcgatctgccaactggacagattgccgaagatgttttcggtgagcgccttgctcttgtcctgcagacgcgagatttcgtcgctgatgttcagcgcattgtcgttgcccaccaggcgcagctcttcgatcttggcttgcaggtcggcgatcggctgttcgaaatcaagaaagttcgggttcataggcttccgtcgtgcgcagattctagtgggccgtttccgtttggcgccctaccttacgggatcgggcgccaggggtcgagccgggagcaagggcgatccgcgttttcccgccgcagagcgcggaacaacggcgttatcgcccatcgcgattaa

SEQ ID NO: 4230 - DNA, 366 bp, Pseudomonas aeruginosa
gtcggcttgtcgtccagcgggatgaagtcgatgttcaccggctccaggcccttcttggcctgctcgcggttgatgatctccatcgcccacttgatgatggtcagggtccgcaggccgaggaagtcgaacttcaccaggccggccgcctccacgtcgtccttgtcgaactgggtcaccaggccgccgccttcctcgtcgcaggcgatcggcgagaagtcggtcagcttggtcggcgcgatcaccacgccaccggcgtgcttgccggtaccgcgggtgatgccttccagcttgagggccatctcccagatctcggcggcttcctcgtcgctcttgaggaagtcgcggagcatttcttcctgctcgtag

SEQ ID NO: 4231 - DNA, 702 bp, Pseudomonas aeruginosa
acccggtccagctcgaccatttcccggtcgcgactgaccttggccaggatcgacgccgcagcgatcgccggcacctggctgtcgcccttgaccaccggcgcgcagggcaccgccagtttcggacaacgattgccgtcgatcagggccagccgcggagtcacgctgaggccttcgaccgcgcgctgcatggcgagcatggtggcatgcagaatgttcagccggtcgatctcctcgacctcggcgcgggcgatgcaccaggccagggccttctcgcggatctcttcgaacagcgcctcgcggcgggcttcgctgagcttcttcgagtcgttcaggccgaggatcgggcggctcgggtcgagaatcaccgcggcggtgaccaccgggccgcacaacggaccgcgaccgacctcgtcgacgcccgcgaccagatcctccaccagattgaaatccagacccagttgcatcagcggcgctccaccagttgcaggacggcttccgccgcctgtgccgaggcatcctggcgcaaggcccgatggatggcatcgaagaattccacctgctgtgagccgtcgtccagcagcggcaagagggttgcggccagcgcttgcggagtcgcggcgtcctggatcagctccggcaccaacaggcgtccggccaacaggttcggcagggagatgtacgggcttttcaccaagcgcttga

SEQ ID NO: 4232 - DNA, 465 bp, Pseudomonas aeruginosa
tttgcgttccgcacagatgatttcagccgagcataccggcttgtcgtcgacggtagcgtggcagtcgaatttccagatgctgcgcttcacgctgatgaacttggcgtgcagttgcagttggtcgcccggcaggaccggctggcggaagcgcagcttgtccgaaccgacgaagtagtaaagggtgccgtcggcgggcttcacgtcgagcatcttgaaaccgaggataccggccgcctgggccatcgcctcgatgatcagcacgcccggcatgatcgggtgctcggggaaatgtccgttgaagaacggctcattgatactgacattcttgtaggcgcgaatgcgcttgccctcgatgtccagctctaccacccgatccaccagcaggaaaggatagcgatgaggcaggtattcgcgaatctcgttgatgtccatcatgttagggggagcctgttcagaaaagggtga

SEQ ID NO: 4233 - DNA, 1209 bp, Pseudomonas aeruginosa
gatggataccggcagccgccttcggtttgcgatcgaacaggtgcgacaggctggcataggccaggtaggggttggccaccaccagcgcggtaccggcgaacccgtcggcgtcggcagccgtcagcaggacggcgccggcacggctttcgggcaggtacttgcgatactgcgggttggccaggaagctcagctgagccggtccggcctcctgcaaggtcgccaggccctggatcggcaggtccgcgtcgccacggacttccgcgccgacatgcgcggccagctggcccagggtgtaggacaaggtactcatcatcaacgcagctggttcatccgctcgatcacctggcgggtgatgtcgtattgcggcttgacgtcgaccacggcgccacgttcgatgaccatgtcgtaaccacctttcttgatggtctcctcgacggcctggtccagcttcggcttgagtttcttcagcatgtcgcggtcggcggcggccttcgactcgttcaattccttggactggaactggaagtcacgggccttctgcttgaagtccagctcggccttctcgcggtcgccctgggacatcttgctgccgttggaaaccagcttgtcctgcagagccttggcgtcgcgctcgaggttcttcagcttgttcagctgggggccgaacttcttctcggcatccacggcgtattgcttggcggcatcggactcgagcagcgccatctggtagttgagcaccgcgatcttcatttcagcgaacgccgaaggagccgccatgatggctgcggtgatcaggacgaactgggtgaacttacgcacgatgcactcctgcacaaagcatggtttcgttactcggtactacgtacaaatcagaaggtctggcccagggagaactggaagacctgggtttccgcgttgtccggcttcttgatcggcgtcgccaggctgaagctcagcgggcccagcgcggtgatccaggtcaggccgacgcccacggaactggcgaggttgtcggtcttgatgccgtcgcagttggtggtggtcttggtcgggcagtcggtatcgaaggtgctacccacgtcccagaacagcacggtacgcaactggcgctggtccttgacgaacggcagcgggaacagcagctcggcgccgccggtgatcaggatgttaccaccgaaggcttcgggatcctggtccgggtcggtgtag

SEQ ID NO: 4234 - DNA, 471 bp, Pseudomonas aeruginosa
gaaattggcgatgggaccagccgcgacgatggcgatccgctgacggaccgtcttgcgattgaaggactgttcgagcagatgggccggtacttccgcctcgcgctcgtcgagcatcttgacgtagccgcccagcggaatggccgccaccacgaactcggtgccgtgccggtcgtgccagcgcaccagcggcgtgccgaagccgacggagaagcgcaggaccttcaccccgcagcgtcgcgcgacccagaagtggccgaattcgtggaacgtcaccagcacacccagggctaccagggtgccgacgatcatgtaaagcgcactcatctcctacctccaggccgtccgaagactagccggcgtgccgggtcaaccattgcccggcgaccgaacgcgcgcggcgatcggcagccaggacctgatcgagcgattcgactgcggtcaccgcctcgcggttcagcacgtcctcgatga

SEQ ID NO: 4235 - DNA, 627 bp, Pseudomonas aeruginosa
agcggatgtgccgctcgagaaatgcggccacggccacctcgttcgcggcattcagcatggccggggcgctgccgccggtttccgcggcctggctcgccaggcgcaggcaggggaagcgctgctcgtcggggcgctggaaatccaggcgaccgacggcgaacatatccagcggcgaaacgccggaatcgattcgctccggccaggccatggcataggaaatcggcgtgcgcatgtccggattgccgagctgggcgatcaccgaaccgtcgacgtagtccaccatcgagtggatcacgctctgcgggtggatcaccacctcgacctggctcggctgggcgtcgaacagccagcacgcctcgatcagttcgagccccttgttcatcatgctggcggaatcgacggaaatcttccgccccatcgaccagttcgggtgcgcacaagcctgctccggcgtcaccgaagcaagctgctccagcggcgtctcacggaacgggccgccggaggcggtcaagaggatccggcgcacgccgacccgctccaggccatcggcataattgcgcggcagcgactggaagatcgcgttgtgctcgctgtcgatcggcaggagcaccgcgccgctgcgcttga

SEQ ID NO: 4236 - DNA, 648 bp, Pseudomonas aeruginosa
ttggcggcgacctggaggaggaaacgggtattgccggcagtggcggcttccgcttcgcgcatggccgcctgcaactccggatggaaacgcgtgcgatcgccgatgatgcgcaggcggatgccgttctcgtcgagcttgcgcacctcgcggcgcagggccacgagaaacagctccatcagcgcgctgacttcgtccgccggacgctgccagttctcgctggagaacgcgaacagggtgaggacctcgacccctgcctcggcgcagacctcgatcaccgccctgacggcatcgacaccggccttgtggccggcgacgccgggcagaagacgcttcttcgcccagcgattgttaccgtccatgataatggccacgtggcgtggcacgcacacatccttccgggtcttttccatgacgtcagcccggcctcagacagccatgaggtccgcttctttggcttccagtgccttctcgatctcaccgatgaacttgtcggtcagcttctgcacgtcgtcgccggcgcggcgctcttcgtcctcgctgatttccttttccttctgcaggtccttcaactgggccagcgcatcgcgacggatgttgcgcacggaaacccgcgcctgctcggcctcggcacgcgcctgcttggtgtag

SEQ ID NO: 4237 - DNA, 2721 bp, Pseudomonas aeruginosa
cagataaaggaaggccgcatgccgcaggtggatcccgaattgttcgatcgcgggcagttccaggcggaactggccttgaagtccagcccgatcgccgccttcaagaaggccatccggcaattccgcgaagtgctcgacaaccgcttcaacagcggccgcgacatccgccgcctgatcgaagatcgcgcctggtgcgtcgaccagatcctgcaacaggcctggcagcgcttcgactggggagacgacgccgacatcgccctggtcgccgtgggcggctacggccgcggcgaactccacccctactccgacgtcgacctgctgatcctcctcgacagcgaggaccaggagagcttccgcgagccgatcgaaggcttcctcaccctgctctgggacatcggcctggaagtcggccagagcgtgcgctcggtgcagcagtgcgcggaggaagcacgcgccgacctgacggtgatcaccaccctcatggaatgccgcaccatctgcggccctgacagcctgcgccagcgcatgctgcgggttaccggcagcgcgcacatgtggccgagcaaggagttcttcctggccaaacgccacgaacagcagcgccgccacgccaagtacaacgacaccgagtacaacctcgagcccaacgtcaagggctcccccggcggcctgcgcgacatccagaccatcctctggatggcccgccgccagttcggcagcctcaacctgcacgccctggtgcgcgaaggcttcctggtggaaagcgagtgcagcatgctggcttccagccaggagttcctctggcgggtccgctatgccctgcacatgctcgccgggcgcgccgaggatcgcctgctgttcgatcaccagcgcagcatcgcccgtctgttcggctacgaagacaacgacgtcaagctggcggtcgaacgcttcatgcagaagtactaccgggtggtgatggcgatctccgagctgaacgacctgatcatccagcacttcgaggaagtcatcctgccctgcgagcagccggtgcagatccaaccgctgaacagtcgcttccagttgcgcgacggctacatcgaggtgacgcacccgaacgtcttcaagcgcaccccgttcgccctcctggaaatcttcgtgctgatggcccagcacccggaaatcaagggcgtgcgcgccgacaccattcgcctgctgcgcgacagccgacacctgatcgacgacgagttccgccacgacatccgcaacaccagcctgttcatcgagctgttcaagagcagccagggtatccaccgcaacctgcggcggatgaaccgctacggcatcctcggccgctacctgccggagttcggccatatcatcgggcagatgcagcacgacctgttccatatctatacggtggacgcccacaccctcaacctgatcaagcacctgcgcaagctgaatcggccggagatggccgagaaatatccgctggcgagcaagatcatcgatcgtctgcccaagccggaactgatctacatcgccggtctctaccatgacatcgccaagggccgtggcggcgaccactcggaactcggcgcggtggacgccgaggccttctgccagagccaccagttgccgctctgggacacccaactggtgtcctggctggtgcagaaccacctggtgatgtcgaccaccgcgcaacgcaaggacctctccgacccgcaggtgatcttcgatttcgcccaactggtcggcgaccagacccacctcgactacctgtacgtgctcaccgtggccgacatcaacgccaccaacccgacgctctggaactcctggcgcgccagcctgctccggcagctctacaccgagaccaagcgcgccctgcgccgcggcctggagaacccggtggaccgcgaggagcagatccgccagacgcagaccgcggccctcgaccaactggtacgcaacggcatcgaccaggacgatgccgagcagttatggagccagctcggcgacgactacttcctgcgccacaccgccggcgacgtggcctggcacaccgaggcgatcctccagcacccggacgacggcacgccgctggtgctgatcaaggaaaccacccagcgcgagttcgagagcggttcgcagatcttcatctacgccgccgaccagcacgatttcttcgcggtcaccgtggccgccatggaccagctcaacctgagcatccaggacgcgcggatcatcacctccaccagccagttcaccctcgatacctatatcgtgctcgacgccgacggcgactccatcggcaacaacccggagcgcatcgccgagatccgcgaggggcttatcgacgcattgaagaaccccgacgactacccgaccatcatccagcgccgggtgccgcgccagctcaagcacttcgccttcgccccgcaggtgaccatctccaccgacgcgctgcgccaggtctcggtgctcgaagtcatcgcccccgaccgccccggcctgctggcgcggatcggcggcatcttcctggatttcgacctgtcggtgcagaacgccaagatcgccaccctcggcgagcgcgtggaggacgtcttctacatcaccgatgcgcgcaaccagccgctcgccgaccccgacctgtgcaaacgcctgcaggccgccctggtcgagcagctgtcacaagacaacggacgggacaccctgcctacccggataaacttctga

SEQ ID NO: 4238 - DNA, 603 bp, Pseudomonas aeruginosa
aggcaccacggtgatgcacgaaggtttcgtcaacttcaacgccggcaccgaaggcccgggcatgatcgaaggccgcgtatccgccggcgtgttcgtcggcaaggggtcggacctgggcggcggctgctcgaccatgggcaccctttccggtggcggcaacatcgtcatcagcgtcggcgaaggctgcctgatcggcgccaacgccggcatcggcatcccgctgggcgatcgcaacatcgtcgaggccggcctgtacatcaccgccggcaccaaggtcgccctgctcgacgagcagaacgccctggtgaaagtggtcaaggcccgcgacctggccggtcagcccgacctgctgttccgccgcaactcgcagaacggtgcggtggagtgcaagaccaacaagaccgccatcgagctgaacgaagcgctgcacgcgcacaactgagcccagctcgcctccccgctcgcccgacggtgctcgccagcgccgccgggtgcgctaccctttcccctgtaaccgtcctcgcacagtgtccgccatgtccctgccgtctccctggcgcgccgactttccggccttttccgccttcgccgcggaaggcctga

SEQ ID NO: 4239 - DNA, 777 bp, Pseudomonas aeruginosa
gcgcgaccatcgactggctggccaccctggacgaagccgaagtcgccgcccacgaaggcgccctccacgcccgcctgctcgccggcctgctggcgcgcgacggcgtcagcctgctcggcgaaccacaggcggcgctggccagcttctgcgtcgacggcgtgcacgtcgccgatctcgcccacctgctcggcgaacagggcatcgcggtgcgcgccggccaccattgagcgatgccgctgctgcaacgcctccaaggtacccggcgcccctgcgtgtctcgctgggcttgtacaacgatgccgacgacctggagcgcttcttcctggccctcgaccgctcactggagttgctgcgatgaacccggttctccccgaacaggcccaggaggcactggacgccttcggtcacaccgccagttgggaacagcgtgcgcgtctgctgctgcaatggggcgagcgcctggcgccgctcgcggaacacgaacgccaggaagagcatcgcgtgcacggttgcgaaagcctggtctggctgctcggcgagcagcgcgacggccactggcgcttccgtgccgacagcgacgcgcgcctgatccgcggcctgctggcggtgctgctggcacgggtcgacggcatcgagacccgcgaactggcgcgcctggacctcaacgactggttcacctgcctgggtctttcccgccaactgtcgccctcgcgcagcaacggcctgaacgccgtgctgcaacgcatgcgcgaactggccggccagaccgccggctga

SEQ ID NO: 4240 - DNA, 1377 bp, Pseudomonas aeruginosa
ccggtcggccggatagtcggccttggccggcaggacccacgcgcccgcacgccgctcgacccggatatccggcgaaccgtcggcaaactgcatgtgcaggccactcagcgtcgcgctgtccagttccggcagccagcgctctgccgccggcaaggcaggtacctcggttgcgcgctcgcgctgcagccaggcgaaggttccggccagcgccgccaccagcgccagcaggacgatcagcgtattgcgccgcatgcgtcaatgccctccccgggccatgcgccggcgccgccagagccagccgagcagcacgccgaccgtgagcaacgagggaaccagggcgatattgaccagcttcagggtgcggcccagtgcgtcgatatcggcgttcaactggtactgcacctcgcgcagctccttgcggatgcgcagcttctcctgcatgtactggcgcaccgtggcctgctgttcgggcgtcagttcgacggccttctccggggcggcgccctgctggagggcggcgagttgctgctcggtatcggcgaggcgctgcttgagctggtcctccttttgccggaagctcgtctcggcctcgcgctgcaggcgctcgaccaccacgaacggccggctgaaccggccgcgggagcgcacgctgatcagcgcgtcggtgcccgacaggttgtccagcgcgttgaccaccagcgcgccgttgtcggcccagggctgcggcacgcgctggccgaagaagtcctgcacctggacccacatgcgatcgctgagcaggtcggtatcggccacgacgatgacattgatgttgcgcgcctccttcaggccttcgcgatgcccctcgatgccctccgcgaaggcactcttcgccggcccctggatacgggcggcgagagtatgccgccggccgctcgggcgcagctcgcgcatcagatcgccggggtcgcgcagcaggccgaagcgcgaggcatcgaacggcatcgcctgggccgagctttgcagcaaaggcgtgaagctggtgctcgctccggggagcctttcgaggatgccgggcgtcgccagggtcaggctttccaggccggcagtggcgatgtcgtcctggtccagcgcctcgcgcggcaagctgagccaggccggatgccgggccggacgctggtcccggccaagactgatggacatcgcataggcgccgtcgccgagcaccttgcccggcagcaggcgcagcccccaggcctcgaacagcggcgcgaggtcggacgacttgtcgccatccagcgtagcggcgaaatcgctgccgctgtcggcctcgctgaaggggtcgacgaacgccagcagcttgcccccgcgcaggacgaactggtcgatggcgtatag

SEQ ID NO: 4241 - DNA, 1179 bp, Pseudomonas aeruginosa
agatcaccggcagttgcttcatgcctccgtcccccgggtcaggttgcggaatacctcgtcgagccggccgcgctccacgtccagttcgcggatccgccagccgcgctcggcgaccagcccgctgacctgggggaagatcaccgcgcccggctgcgccaggacggtcaggctgccttcggcggggttctcctcgatgcccgccacgcccggcagcaccgccagcgccacggcatccaggggctcgtcgctgtagagcgtcaccgcctggtggtagcgcgagcggctggccagctccagcggcgtgctgtccgccagcagccgcccgccgccgatcaccagggcgcggctgcacagcgccgagacttcctcgaggatatgggtggagatgatcacgatgcgctcctgcgcgaggccgcggatcagttcgcggacctggtgcttctggttcggatcgagcccgtcggtgggctcgtcgagcaccagcgcccgcggttcgtggaggatcgcctgggccaggccgacacgccggcggaagcccttggagagggtttcgatggtctgccggcgcacctcgtccagttccagcagccccagtgcccgggcgacccgctcgcgcttgccggcaccacggtagccacggatctcggcgatgaaatcgaggaagccctgcacggtcatttccgcgtagcagggcgaaccttccgggaggtagccgatcagccgctgcgcctgcagcgtgcggttgcggatgtcgaagccgaagatgctcgcggtgccggcgctgggcgccaggaagccggtgagcatcttcatggtggtggacttgccggcgccgttcggaccgaggaagcccagtacctcccccgtcgccacctggaaggacaggtcgtccaccgccacccgcgagccgaagcgtttgccgaggtttcttgtttcgatcatggtcccctacctgttccggcggccgccgccttgtccggccagggccgcgaaaaacgcgcagggactatagccgaagcgccccgccgcctggcaatacggggcatcgggagaaccttggcaaaacgtgacagaacccgaacgcctgccgaaggttctacattcgcaacctgttcgccgccgttcgccgtaggacgcgttgcgttcttttgcggccctccggggattgcggcaaactag

SEQ ID NO: 4242 - DNA, 480 bp, Pseudomonas aeruginosa
gcgcggcgcctcgccgaccctggtgcgcatgctcgccgcggtcggccagaacggtctcgacgacgcgcagatcattccggtcagcgtgttctggggacaatcgccggacagcgaatcgagcccctggaagctgctgttcgccgacaactgggcggtcaccgggcgcctgcgcaagctggcgcgcatcctgatcctcggacgcaagacccgcgtgcagttctccgcgccgatccacctgcgcgagctggtggaacagggcaagggccacgagcgcacgctgcgcatggtcaaccgtatcctccgggtgcacttccgcaacctgaagaccgcggtgatcggtcccgacctgtcgcaccgccgcaacctggtcaagggcctgctgcgcgcgccgctggtacgccaggcgatcagcgaggaatgcgagagcgaacggatatcccaggagaaggccgaaggcatcgcgctgcgctacgccaatga

SEQ ID NO: 4243 - DNA, 1389 bp, Pseudomonas aeruginosa
ctcgcgccggccgatcgtcttcgtgccggtctacatcggctacgagcgcgtgctggaaggccgcacctacctcggcgaactgcgcggcgcgaccaagaagaaggagtcgatcttcgacctgttcaaggtggtcggcgccctgaagcagcgttttggccaggtctgggtgaacttcggcgagccgatccatctcgaccagttcctcgaccgccaccagcccgactggcaggaccaggacctcggcccggaataccgccccgactggctgccgcagaccaccaacctgctggccaaggacgtcgcccgccacctcaacgacgcggcggcgatcaacccggtcaacctggtcgccctggcgctgctctccaccagccgacaggccctcgacgaaagcgccctggcgcgaatcctcgacctctacctggcgctgctgcgcaaggtgccctactcgcccagcgcgaccctgccggacggcgacggccaggccctgatcgaatacgtgaagagcatgaacctgctggccgagcagaaggacgcgctgggccgcatcctctatctcgacgaacagaacgcggtgctggcgacctactaccgcaacaacgtcctccacgtcttcgccctgccggcgctgatcgccagcttcttccagagcaactcgcggatcagccgcgaacagttgctgcgcttcgcccgcgcgctctatccctacctgcaggcggaactgttcatccgctggagcctggacgaactcgacgcggtgatcgaccagtggctggcggccctggtggaacaggacctgctgcgccaggagaacgacaccttcatccgcccggcgccaagctcgcggcaatacgtgctgctgatcctcctcgctcgttcggtaacccagaccctgcagcgcttctacatggccatcgccctgctgctcaacgcggggcagaacgccctgaccgccgaggaactggagaacctctgcaccgtgatggcccagcgcctgtcgatcctgcatggcctgaacgccccggagttcttcgacaagagcctgttccgccacttcatccagacccttctcgacctgcgcgtgctgcgcaaggacgaggccggcaagctgagctaccacgaactgctcggcgaactggccgaaggcgccgccaagcgcgtgctgccggcggagatccgtctgtcgatccgccaggtggcgctggagcgccccgccgaggaagccgccgccgaaagcaacgacgcggccgccaactgaaacccggcgcccgccccgcgagggacgggcgtcgctccgctgaaatatcctgcgacctttccctgttccggcccggcaacctatgctggtttcccgggtcagaggcccgctcgtttttttgttccgtctga

SEQ ID NO: 4244 - DNA, 411 bp, Pseudomonas aeruginosa
aaggaggctcccatgaaaaaactgccattgctgctcgccgccagcattctcgccggctgcggtacccagcaatcgacttcgaacgccagcttcgatggtgaggtcttctaccgcgagcgtatcgccctgccgccctcggcgcgcctgagcgtgagcctggaagacgtgtccctggccgacgccccctcggtgcagttggccagccagacccgcgagatcaccagccaggtgccgctggcgttccacctggagtacgacccgaagcaggtcaagccgggccacagctatgcggtgagcgcgcgcatcgagctgaacggccagttgctgttcatcaacaccacccgccactcggtgaaactcgacggcagcgacccgcagccctatcgcgtgcaggtcgaatcggcgcgctga

SEQ ID NO: 4245 - DNA, 495 bp, Pseudomonas aeruginosa
agcgccggcaggaacagcagggtgagcacggtggcgacgatcagcccgcccatgatcgccaccgccatcggcccgaagaacacgctgcgcgacagcgggatcatcgccagcaccgccgccagcgcggtcagcacgatgggccggaaacgccgcacggtagcctcgatgatggcgtgccagcgatccagtccatggctgatgtcctgttcgatctggtccaccaggatcaccgagttgcgcatgatcatgccggccagggcgatggtcccgagcatcgccacgaagccgaacggctggcggaacagcagcaggaacagggtcacgccgatcaggcccagcggtgcggtgaggaataccatcgccatccgcgagaagctgcgcaactgcaccatcagcaggctcaacaccaccacgatgaacagcggcacgccggcgttcaccgaactctggcccttcgccgcgtcctccaccgtgccgcccacctccagcaggtag

SEQ ID NO: 4246 - DNA, 660 bp, Pseudomonas aeruginosa
tgcatggcggcgaaggtcatcgccagcaccagcgggatcgacagcgccaccaccaggccggtgcgcaggccgagggagaagaagctcaccagcaggacgatcaccagcgcctcggccagcacccggatgaactcgccgaccccggtacgtaccgccgccggctggtcggacaccttgcgcagttccagtccggccggcagcgactgctgcaggcgggcgaactcggtttccagggccttgcccagcaccaggatgtcgccgcccggcttcatcgctaccgccaggccgatggcgtcctcgcccatgaagcgcatgcgcggcgccggcggatcgttgaagccgcggcgaacctcggccacgtcgccgatgcggaaggtgcggtcgccgacgcggatggggaagtcgcggatctccttcaccgaatcgaaacgcccggaaacgcgcaactgcacgcggtcgctggcggtctcgaagaacccggaggaggccaccgcgttctgttcctccagcgccttctgtaccgccgccaggggcaggccgagggtggccagcttggtgttggacaggtcgatccagatcttctcgtcctgcaggccgatcagctcgaccttgccgacgttcctgatccgctgcaattgcagttgcaggcggtcggcatag

SEQ ID NO: 4247 - DNA, 1425 bp, Pseudomonas aeruginosa
ccgctgagggtgacgctgaacgcagccatttccaggtcgaggtcgtattcgcgcccctcctccacccgctcgccccactccgcggccaggcggcgaacctcgctggccggcggcggcgccaggtgcggccgtacttctttgcgccgggcctgggcgggggcgccctcgcgcatcatgaagctgcgcccgttccactgtttcagcatgcacagcgccggctgccagcgttgcaggtcatcgcggcgatcgaccatcaattcctgcaccgcctgcggatggaacaggcaccagaggcgctgcgggcccatgcgggcaaccgcgaggtccggctgcgcgacgtgcatcttctgcaaccaggccagcggatcgcgctgcatctccagccagtggcggacaccggcacgcccgtcgttggcccagggcaggtgcgccaggcgccggcgaatcggacaatcgatggtctgctgcatgctcgccgcctccctgcggtgtcgacactcagcccttgcccagggccttcttcggatagatgtcgtagcggctggacttgccttccaggctatagccgggcttgggcccttcgatgatcggcgccttgcgcgggcgcttcaccaccacccggtggctggccagggccagggccgcctgcaacagcgccggggcgtcgagatcgtcgcccaccagcggccggaacagacgcatttccttcttcaccaatgcgctcttgtcgcgatggggaaacatcgggtcgaggtagatcacctgcggcgcctcgccatcccaggcgcgcatcaggtccgccgagttgccgccgagcagacgcatccgcgcggcgatcggcgccacgtcgggatcgcgccgggcgcgctccaggccatcctcgagcagggcggcgatcagcggctggcgctcgaccagggtaacctcgcagcccaggctggcgaggacgaacccatcccggcccaggccggccgtggcgtccaggacccgcgggcggatgcctggctggacgccgaccgccttggcgatcatctgtccgctgccgccgccgaacttgcgccggtgggcgctggcgccctcgacgaaatcgacccgcaccggaccgggggagtccgcccccagttgcaagacctgcaagccctgctcgccgacctgcacggcgaactccgcctcgtcgtccgccgccagcggcaggccgagccgctccgcccagcgccgcgcagcctcggcgcaatcggcggacagggcttggacatgcaggcgaggagcggcggaatcggtcatggtcgggcaatcgtcggggaaagcgcggattttgccagagttggcccgcgcgcgctcaccggcagaccttccataggcccatgtcgaggtggaagtgatcccggtgggcggcgttgtagtcgggccccagcaccgcattga

SEQ ID NO: 4248 - DNA, 507 bp, Pseudomonas aeruginosa
ttgtcgggggtatgcaggaatacgtatggagtcaggccggcctcgatccagtcggccaccttgtcgacccagggcaaaaggaacacctcgttggccggcaggtcgggaccgccgatgaaacgcacctgtggcgtatcgctgaaggccgccggacggatcggcaggcgcggcttcttcgactgggcgtggagcaccgccggatcgtccgaacggcaactgaacagcgcccgcgaatccaggcagatgcgctccacgccacgctcgcgcaggtggcggttgagcaggcgctcgtcctcgcctttgtcgaagaacgccgggtggcgtacttccacggcaatccgtcgcggactcagctcatcgaggaaatacagcagttcgcccaggcgctgcggggtgaacgccgccgacagttgcagccacagcgggctgaccctttcgccaagcggcgccagcagttcgaggaagtcgccggcggcctcgagccgttcgcgcaggtcgccttcgtga

SEQ ID NO: 4249 - DNA, 1164 bp, Pseudomonas aeruginosa
ctggccagggccatcgccgcatggctgcttaccgggcgctggaacgccagcaggtcgcgggcgctgaccggcaggctgtcgccgcccgccgaactggcctggaccttgcgcgcctgcggcgcctgctcgaagccctggctgccggaaaccggcgccggctgctcgcgccgcgcctcgacctcgcgctgcacgtcgcgatacggcgtgaccgcggagcccggtcgggcgctgcgctccagcggcaacgaagaggaagaaagaccgtcgatacgcatgatcaaaacccggggaagtctccacactctagccagccccgaaaggcttggcaattaccgctgcgcggcattttcagggcgcttttttcggcgtcgccacgttgtcgcgcaggtacaccggcagcgcctgttccgcctccacgccttcgccgcgcgcccaggcgaagccggccaggctgagcaagtcctcggcatgcggcagcaggctcgcgtccagcgcggccgggcgctgcggcatgcgctcgacgtagccccagccggtgccggcgccgaaccagtccgcggcagcggcgtcccacggtacggcgacccgctcgggcggcagtaccgcttcgctgccggccaggcgcatctcgccctgttgcaactggtagcaaccccagtagacctcgtccatccgcgcgtcgatggccgcggcgacccgctccgcaccctgctcgcggtaggcccgctgggccaggatcgccaggtcggagaccgccagtaccgggcgctgcagggcgaaggccaggccctggaccacgccgatggcgatgcgcacgccggtgaaggcgcccggaccgcgcccgaaggcgatggcgtccaccgcggacagggcgacgccggcctcgtcgagcaggtcgcggaccatcggcagcaggcgctgggcgtgcaggcgcgggatcacctcgtagtgactgagcgcccgcccctcgtggagcagggcgacggagcaggcttcggtggaggtatccagggccaacagagtggacatcgacggttccgcgtggtgaaaaagacgccgattgtaccagccttcgccgccccggaaacgccgacggcccgcaagcgggccgtcggtgctacagcgctgcggatcagctcagggccgaaagcactttcgcggtga

SEQ ID NO: 4250 - DNA, 2592 bp, Pseudomonas aeruginosa
agtctgaggcgtggactgcccgggccaacgggacacgagccagatcagcagcagtgcaaccagcgctgcggccactgtccaaggccagctgggccgccagtgccgacggcggaacgcctgcacctgcatcggaatggaaggacgtttctgttccatggcgttctccggtgtacggcagattcagggcaggtccagggtcggcgactcgatgccacgtgcccggtcgatcttctcagccaccttgaaggcggcatccagctcgctgacgccgtgctgctgcatgagttggtagcgttctgccttctcctcgggctcggtttgcgcgagcgcgaggtagagacttggcggcacggcgcggaacagcacttccatgctcttggagaggatgacgccctcggtgaacttgcccgcttccttgcgtgcggagagcatcagcgccttctgcgccggcgagagttcgcggaagcgcgcgatcttctccacctcgtccggcggcatcgacaggcacacccaccactcgatcatgttgagcatcggctccgctgcacgtggcaggtcgtcgatgttctgcgtcgccagccagaaccaggcgcccaacttgcgccacatttttgtaattttcacgacatagggcgcgagcagcgggttcttggtgatgatgtgaccttcgtcggtcacgttgacgatcggccgtcccaggtactggtcgcgctcggcgatgttgttcaccgtgctgatcaggctgatgtaggcgatggagagctgcgcgttgtagccctcgcgggcataggtcgccagatcgaccagcgtgatgtcggcctcgggccacggcgtgccgtcgcggtcgaacatctcgccgtccgtgccttggcagaacatgtccatcgcgtccgccatctccagcagccgcgcacggcgcatctcgggcaacgtcgggtcctggccacggatgcgcagtgcattgcgcacatcgcgcgtgagcacggtgcgcttctccgccacgcaatgttcggcggcgtcgaggatgcactggcggatcagcgagcggtcggcccgcgtcatccgcgcttcttccttgtcttcgccgcccgtgatcatcagccgtgccgtgatctccagttcgccgagcacgtcgcgctgctcatccgcctccatggccgaggcatccggtggctggtcttcgtccagggcatcggcatcgagcgtctgcacgtcgctgggcgtttcgatcagccggcgtgcgtcggcgaacggcgccaggctgatgcccgatccgggggccagcttgacccggttcacggtcaggcccaggcgccgcgcgaagtcgctgaacaggccgaagctgttgccggcttccacgatgaaaagccgcggccggtagatggccgtcacctggttcagcaggttgttgagcgtggcggacttgcccgagcccgtagggccaaacagaaacagatgggcattcatctgccgatccaacctgttcaaggggtcgaacgtaatcgggccgcctccgcgattgaacatcgtgatgccggggtgccccgtgccctgggcgcggccccacaccggcgacaggttcgccgcgtgctgggcgaacatcagctgcgtgtaccagcggcgccgatccttgccggggttgtagcagcacggcagccagcgcaggtagctgttgagcggcgccacctcgtcgtcctcgcgcaccggttgcaagccggcgttgagcatgacgttcgccaggtccaggccgcgccgatccagttccgcctcgtcgcgcccgcgcaggtagaacgccagcgtgccccggtagagcttgtgcgcgctgccgatcagggagcgggcctcgtgcacgtccttgagggtctgctccgacgccagcgtctcgcccacggctttcttcgccaggtggttcagatccgattccaggacatcctgcggcgtggcgaccatcgtgagacacatcaaggtgtcctcgggcatctggtcgaacagcgtgttgatcgcgtcccccttgcgggtctcgccggtcaggtgccccgtgccgggcggcatgcgcagccggtcggtgatcagcacgcggtgcggcatgccgtcgaagtaccaggccccttgcgccacgtccgagcgcggctgcccgaagaacaaccgctggctgaaatcccgcccgctcgccaactcgatctcgccggcctcggtctcgtccgggtagcgcgccagcgagtagaagcgctcccggtcctccgccccaggaccgagcagcgtggggcgcgggttgaaccatcgcagcagccagtcgtgaacgtccgctgcaaccatgcgccgggcctggatgccggcattcgccagcccgccgcacaggcgatcgcaaacgatgcccagcatctgctcgggtgtctggccgcggcggtttgcctgtccctgaccgctcgcgcggcggtacaccaccatgcgcacgcgccgcgtctggccgcgccagcgcagccgcgtgaccaccgtgtcctcgaacaggccgccgggcttggccacagcgcgcaggtggtggccgaagaagcgcaggtagaactcggtgaacgccgaaccgcgcgcacgtga

SEQ ID NO: 4251 - DNA, 477 bp, Pseudomonas aeruginosa
ctgcacgtaatcgcgcaaggtctgcatgtactggtcgaagctcggttcgtcctgggcatagagctggagcacccacgggttctcgtccagttcatcgaaactgtcctgaagcgcgttttccaaggcgtcgcgggcatgcgcgagccagccaggctcccggccctcggtgcccagcggcaccagctcgaagaaggcggccacggattgaccgtcctccaacagcatcgccttagactcgggcaagaactccacccagggcagcagttccacgaaggacggggcgacgtcgtacagcgcctgctcctcggccacggtcgccggcctgcggccctgcaccggggcgccgggttcggggatgccgacctgctgcagggcatcaacgtggcgctgccagccgtccggctgctcatcgccagccgggccgctgatgctggcgcccgtcagcttcgaccagggaagtttccaccgcatcagtag

SEQ ID NO: 4252 - DNA, 474 bp, Pseudomonas aeruginosa
ggcctgcgagccgaggtattgctgggcgttgctgcgccgctcgccgctgacgcaaggaatgccgtggggatcgctgatccagcccaagccgtcgcgctgttggttgttctgctggttgccctcgcggtcttcggggatcgtgcgaatcgtgccgtcgttgaagacgaacgtgatgctgcgcacctgaccgcgcacgcacgagagcgtccagtcgcccgaggcggtgccgctgaaaacggcgccggccacgtcgggaatgtcgatgccattggcggtcaggttgtccggcccgaccagaactttgaacggatagggatcgttgaccgtgccgtcgatcggcacgcggccgatcagggccgtcatcgccaccgatcccatcagcgtcgagttggtcggcacggtatagaccggcttggcactcttgaccccggcggcgcgggcgcccgcgttggccacggtttcagtggtggttaa

SEQ ID NO: 4253 - DNA, 1257 bp, Pseudomonas aeruginosa
atacgatgcgttcctgaccgaccttcagcggcactgccagtggcatgcgttcccaacgcaggatctccaccgcctgggcaacgggtgccgcggccacggccagtagccccagcagcgcgagtacaggatgcttcatggggtgtttcctccttgaggcgcttgcggagacaggccactcggcgccgggcgcgtcggctccggtgcactgatgcgctggggcgcgccgtcgtagcagtccagcgccaggccgaacgggttgcgggcgggatcgacgtccacccgcgtgaccttgatcggatagcgcaccagggcgcgcttgacctgctcggcgccgtagtactcgtccgccgtgatgtccagcgtcaccacccagtcgcgatcggacacggtgcgcacgcgcgccgtggggtcgtcgccatagccgcggccgggaatctcgtagatgccgcgcacgcgctgacgcagctcgcccgtggagcggcggtagtcatagtccgcccgcaggaaggcctggcaggacggggtgaggtacggcgagagcgtgtggaggttgcgcgagtagtcttcttcgccattggttggccagcggttgagggtctggaacacgtagaacgtgaacgcatagaccgattcgggcggcacttcccaccacttgcgggtactgccggagcgcaggtcgggcgggacgtggatggtcaggtcgcgcggcgcgctccaccagccgccgcccatgaccagggcgacgacgaccagcgcgcccgcgcccaggcgcaaggtcttgatgtgcgcctgcagatgggtaatctcgtttttgaagcggctcatcgcatgctcctgcgggtggaccagaagcccgagcgcgagatcagcacatggccaccgacccagcctgccatcagcggatggcgcgtggcgatgcgccattgcagttgccgatacagccaggtgtcgggacgcccacgcttgaggcggcgcaggatgccgccgccgatgaagacgccgagcgccacgcccaggacgacgaacgtcggcgccagcgcgatcgtgcggaacacccaggacagcggcgcgccgaccagcaggccggcggcgccggacaggccgcagcaaatccagagttcgtcagcggtgaggccgcgcaccacaacgggatggcggttgagccggtgcggaaggaaggtgaccgttccgtccgcacggacgtgctgctgctcggacataccggcctcgcttacaggatgccggtggcttcggtga

SEQ ID NO: 4254 - DNA, 1107 bp, Pseudomonas aeruginosa
gtttgtggacaacctactggatctggacgcggccgccgtggtgtcggctgcgcagcgccagcgtgcccaactcaagcatccgccgatcgaggtggaccgctatctcgaaatcctgctgcgccaaggccttgtgcaaacgaccaaggtgctggcgacctatcgcaccattctctgacccgccgagagccacggatgaccaagaatccttcatcagacgccactttgccgaaaggcatccatcgaagctggaagctgccggacacgtcgctgggcgccctgtgggattccatcgtcatggacgaagctctcaagaagcagttgctgtcacaggcgatcgtcaacttcacggtgcgccccaaggtggagcgcacggtactccccctgcacggcgtgatcttgttggtcggcccgccggggactgggaagacctccttggcacggggcttggcgcatcgtgtggccgaatctttttcttctgcgaagtttcgattgctggaagtagagcctcacacgctgacgagctctgcaatgggaaagactcaacgcgccgtggcagacctgttctcgcaatcgatcgcagaatccgcagcggcgggcccgacgatcgtccttctggacgaggtcgaaacgcttgcggctgatcgagccaagctcagcctggaagccaacccggttgatgtgcaccgggccaccgacgcggtgttggtgcagttggacatgttggccgaacgcaacccgcatctgctgttcgtggccaccagcaacttcccacaggccgtcgacagtgccttcctatctcgttgcgacatggtgatggaggtgccactgcccggcaaggatgcctgcaagcagatcctggtggactgcctgaatggcctggcaaagacatttccggggattggcaagctttcctcggctcaccagttcgacgcgtgcgctggcgagtgcgtcggattggatggtcgggccattcgcaaggtcgtagccaacgccctcgcggccgacccgcaagtggctatcgatccgaacaagctttccgtagagcacctgcgcagtgcgatacgacaggcaaagcaaatgcgccttcaaggagggaagcaaaaatga

SEQ ID NO: 4255 - DNA, 1023 bp, Pseudomonas aeruginosa
tgtggaggggtggagcaaaggaagttatcgctcgacggatggaatggtcaagcagagcctaggctcgactgtcgaacacagcggcctggcgggtcaggccggatattggaggcaacgctgatgctgtcgatcgatgaagcttttcgcaagttcaagtcgcgtctggaactcaacgaacgcgaacagaagaatgcctcgcaacgccagaacgaagtgcgggactacctgcagaccaagttcggcatcgcgcgcagcttcctgaccgggtcctatgctcgatacacgaagacgaagccgctcaaggatatcgacatcttcttcgtgctgaaggactcggagaagcattaccacggcaaggccgcatcggtagtgctggatgatttccactctgcattggtggagaaatacggttcggcggccgtgcgcaaacaggcgcgctcgatcaacgtggatttcggtgttcacatcgacgcggaggacaacacggactaccgggtggtcagcgtggatgcggtgcccgcattcgacaccggcgaccagtatgagatccccgatacggcgtccggaaagtggatcaagacggacccggagatccataaggacaaggcgaccgcagcgcaccaagcctatggcaatgagtggaaaggtctcgtgcgcatggtgaagtactggaacaacaatcccaagcacggcgatcagaagccggtgaagccctcgttcctgatcgaggtaatggcccttgagtgtctttacggcggctggggaggatcgttcgatcgcgagatccagtcgttctttgccacgcttgccgatcgtgttcatgacgagtggccggatcccgccggacttggcccggcaatcagcaacgatatggatgccgcgcgcaagcagcgcgcgcagcagctgctgttccaggcgagccaggacgcaagcatcgccatcgaccacgcgcgtcgtggtcgcaatatcgaagcgcttcgcgcctggcgcgcactgtttggccccaagttcccactgtcctga

SEQ ID NO: 4256 - DNA, 642 bp, Pseudomonas aeruginosa
cgcagcggcacgtgcacgacgacgtgcgccggctggcgcacctggtgctcgatcacctgcagccactggccgaggtcggtgctgcacgccgggggcgctccacgcgcttggcgccgctggccatcgcgcatctggcgcagatgcctgtcgcctacgacggggacgcgcgcggccccgaaaacgggccggcgctcgggcgactgcaccagctcgaagtcgggccgtttcgaggattcatgcggcaggagacgttcgacctcagccatgacatcaccttggtctacggtgccaacggcaccggcaagagcagcttctgcgaagccttggaagtggcgatgctcggttcgatcagcgaagcgcaggccaagcgggtcgaccagcggacgtactgcaacaacgctcgcctgcgccgccacatcgcgccagtcctgtcgtctacggcggcgggcgaggcgcaggccgtccagcccgacgaagctgagtatcgcttctgcttcatcgagaagaaccgcctcgacgatttcgcccgaatcgccgcgcggaccccgagcgatcagcgccagctcatcgccaccctgttcggcgtggaccagttcagcgagttcgtgcgcggcttcaacccctcgctcgatcaggacctga

SEQ ID NO: 4257 - DNA, 924 bp, Pseudomonas aeruginosa
ccgctctgccgggggttctgctacaggggctgggagaccaagcccgccatctctacaacgcattcaaccgggccgatgcccggcgatctgctgcacgcgctgtggttgcccgtggccgagaacggcaagatcgaggtggagttcgccggcgagccgggcgcgcgctacgacgcgttgatcgtcttcagcgaagggcacatcaaatgcctgggcctggcgattctgcttgccaagaacctcgcgcagggctgccccgtggtcatattcgatgacgtcgtcaacgcgatcgacgacgaccatcgcgatggcatctggcgtaccttcttcgaggacggtttgctccacggcaagcaggttatcctcacctcgcacgcagaggagttcctgcaccgcatccagcaggagttgggcgtgcgccgcgccgcggccattaagcgctacaagtttctcccgcatcagggagagcacgaactgcgggtcgacagcgacccgccagcgaagaactatgttcttctggcccagcaggcgttggcggctgacgagaaacgcgaggcactgcgtcaggcccggccggcgctggagagtctgacggaccgcctgtggacgtggctgggtcggcgggcggacggccggatcgacatcaagctgagcgggccccgcgcgccttgggagctgaacaataaatgcaccaagttgcggtcggccgtcgagcgtatcgcggcgcaacatgcgggtgcgccggatgccgtaggggcgttggtccggctgctcaatgtcagcggtacgagtattgaatggggttacctcaatagcggtgtgcacgacgctcagcgcgatcatgagtttgatcgggcgacggtaagaacggtcgtcgaggcggttacggcgttggatgctgctcttgataccctgcagaaccgatga

SEQ ID NO: 4258 - DNA, 1425 bp, Pseudomonas aeruginosa
attgttgaaattcccgatcacttggccggccttcgcgcgatttccgatgcgggcctcgatgtccgagagcgtctgcgtgtacgccgtgacttgcaggccggcaccgccgcccttgttgatgagcgggatgaattcatcgcccatcagttcattgaattcgtcggcatgaacgttgatcggcacgcgagcgccagccactgcgccgggcaggccatcgtcgattccgtgcttgtagatgtgtccggccaccgaaaccaggtcagagaacatcgaattgccgaccgctgcggcgacctcggcgtcagacaacgcatccagacccacatagacgatggcccgctttcggatgacctgcatccagtcgaagatcgggcgcgggtcggccaggtcggagtagttcggcgccaggagatgggcgatcttgccgctcgtgagcttttccagcagcggcagcagcgatgcaacgatcttgtcgaagtaggtcttgtcgtagcgcaccgccgagcgcaggccatcgagcacagggtcgtagttgcgcgcctgggagaggtattgctccagcgccaccacacgcttctcgcgcccgatcatgttccttgggatgttcttctcgttgagcttggcctcgatctggacgatcacctcccaggccttgggctccgtcttggcaaagtagtgctgggcgtactcaatgaacagcgcgtcgatgttgatgacgtggcgctggatcagcatgtagtccgggcgctgccccagttccaccagggcgcgggcgatgatgttcacgaagcgccatgcgaactcgcggaacgccgcgctgttgccttcgccggagagctgccccgcgatgcgtgtcgccacttccgagatccgaccgaagcggcccacggcgttgtagcgggcgctgatttccggccagcccaagtggaagatgtagaactcgccttcgcggccagcgcgctgggcttcgacgtacatccgtttcaagagatcggcatcccccttggggtcgatgacgatgacgacctcatgctcgccggcagcattcctgcggcggatgtcctgcgtgacgaacaattcggccaggcgcgtcttgcccacccgcgtggtgcccagcaccagcgagtgcccgacgcgctcgcccagcggcaggctgacgtccacttcgtcgggctcgatgccgtgcagccttggcaggccgccgacaggcggcaacgggcgcacggggttgaaaggcacgtcccagccggtgagcttcggcaggcgagagagcggcaatggcgcgaactccagccgttcctccaggcgcctggccagccggtaggccggcgtcggctcgacgtagcggcggaactcgggccggtacgtctgcatcagccgatgcgtgtgcttctgctcccagagaaagccgcgccccacgaatag

SEQ ID NO: 4259 - DNA, 987 bp, Pseudomonas aeruginosa
gcgcgagttggaccggatggggtttcgtcatggggaggtctcctggcgcgcggcgaagaccgcggcggttgggcgcgtgccctgcacgcgggcaaggtggcgggacacgctgcgccgatagcggacggcgggctcgccgccagcggggcggtggtagcggccgatcgccagcagccagtcctcgccgggggcgtgctgctccttcaggatctcggcggcaacggcgaggttgcggtacgggtccagcagatcgcacgcgccggtgaagcggtgcttgtggtagccaaggttgatctggcccaggcccgcgtcgatgcgcgtgtgcggcgtggcgcgcatcgcctgctgcaggccagcgcaggcgtcggcgcgcgtggcgaagcggcgcgattggccggcgacgttgagggaccacggccatgggacgatgcgcccgttgcgccggatgccgctctcctgcaaggccacggcgtagagcaccgtcgaagggatgcccgcgcgctgggcggcaagctggtaggccggtggcgggacctcctgggcatggggggtgctggcatacacgcctgcagagagcaccagtgcgcgcaagaactgcgatacgggggcagctacggctggcgctgccattggccgttcacctcgcgcacggctgcgggcaaatcaccgggcaggcccagcgacagccagcggccgccatcgtggttgagcgtgatgctgccggcgcgcacgcgcgccgggtcgatctgcgcgcgcttggcccagtcgcggatgcgcgcgtcgtcctggcggcttccgaccatgtacaggtcgaaatcggcgcctgaggattgcagacgctgtacgagctgcccgcaggcagcgcagccatccttgacgaacaccgcggtgcggcctctaccacgcacgggaccggcgccgggcttgtcgtcgggcaggttcacgcgctgcatgccggggttcaggcgctgccaggcttcgtcgtag

SEQ ID NO: 4260 - DNA, 1278 bp, Pseudomonas aeruginosa
gcacatgccgcatcccgtcgccgaccgtggcgcgggcatcctcgggcatggacacgtcgatggtctgcaacagcaggtcgcgctgcgctgccgtgggtgccaactcgaccagcgtgtagcggccgtagcgcacgaccgggatgtactcgggcgcctcgggttcgggcgcggccgagacttcctcgatggcatcgggtgcgagcggcgccgtggtggtcgcgcagccactggccagggctgcggccaggaggccggcgccgaccaagtgccgggatacatggattgcgggcatggcatcggctcttctgttgcgatgccgataccttggccgcgcgcggcggcgcggtcagtcaggaatgcgaactgggagctacccgcttttgcagtccaacacatagcgcaacccgcaaacccaactgtggtttgcacattgattcaataattgttgtattatcgaaccatgcaagaagatcaagccatttccgccttaaacgccctggctcacacccagcgcctgcgcgtgttccgcgccttggtcgttgctggcccgggcggactgacgccaagcacgctagccgaccagctcgacgtggcccgcaacaccttgtccttccacttgaaggagctggcccatgccggcctcgtcaccatcgagcagcagggtcgcaacctgatctatcgggccgagtacggccacatgaacggcctcatcggctacctgaccgagcattgctgccaaggtggcgtatgcgaggtttctccatccaagacctgctgctgaccatgaccgataccacttacaacgccttgttcatctgtacgggcaattcggcccgctccatcctcgccgaaggcatcctcaacgacatgggccaggggcggtttcacgcctggtcggcaggtagccatccgaaaggcgaagttcacccgctggcgctcgccacgctggagcggctgcaccttccgacaacgggctaccgcagcaagagctgggacgagttcgtgaagcccgatgcgccggtgttcgatttcatcttcaccgtctgcgacaacgcagccggcgaggcttgtcctctatggccgggcaagccggtgtcggcgcattggggcgtgcctgacccggctgccgtggaaggctccttggaacgacaaagcaaggcgttcttcgataccgccatgacgctgcgccgacgcatcgagttgttcctgtcgctgccgatcaagagtctagatgccatgtcgttgcagcgcgaactgcgcgacatcggccgccagtga

SEQ ID NO: 4261 - DNA, 621 bp, Pseudomonas aeruginosa
ttggtgccagcaacttcttcgagctggccgtggccgccgccatcagcctattcggcttccattccggtgcggcactcgcaacagtggtcggcgtgctcatcgaggtgccggtcatgctgctggtggtgcgggtggtcaaccgctcacgcggctggtacgaacgccgcgcgaccacttcgtaatctccaagaggcatccatgagcaccatcacgatctaccacaacccagcctgcggcacatcgcgcaacgtgctgggcctgatccgcaacagcggcgaggaaccgaccatcatcgagtacctgaagacgccgcccggccgcgacacgctccaggcgctgatcgcggcgatgggcgtgccggtgcgggacatactgcgcgagaaaggtacgccctatgccgaactcgacctgggcaacccgaagtggagcgacgacgacctgatcggtttcatgctccagcatcccattctcatcaaccggccgatcgtggtcacgccgctgggtgtgcgcctgtgccggccatcggaagccgtgctcgaccttctgccgcaaccgcagcgcggcgcgttcaacaaggaagacggcgagccgctggttgatgagaaaggccgtcgtgtctga

SEQ ID NO: 4262 - DNA, 1863 bp, Pseudomonas aeruginosa
gcggatgcgatgtggacatgcgacctccctcgctcacgtcccgggcgccgtggtgccggcttccaggtccagcagacgccgggccaagcggagcagccgaaagagcttgaccaacgccgtgtcgctcaagcgccttgcgccgctgccatggccttggctctggccgtgcaacagggtcggcaggtcggtggcgagctgcgcgccgtccaggcccgcttcggcgacgggctgacccgtcagggaagtgaggagcgtcagcaccgcgcggccgagcggcgacggggcttggccgcgggcgcggcacgcaaacccgatgccatcggcgcgatcctcgatgtactcgtccaggcctgcctccccggcgatctcgcgcgcgaactgcgcgatgtggatgcgcagccgatcgggcgtgtccaggcccgcgtcgatgtaccagacatcggagatcggatagagtccgccggcttgcaccgggatggactgcaacacgctcgccgagaagtcgggcggcagcgcatcgcccaactggtcggcgaccatgcgctggatcgactgcagccgttcggtcgtcggtgccggcgagacgatgtgctcacgaagcagatcgctcggtgcagccgccgggcttcccgtggccgcttcgctagccgccttgtcgtcgtggcgcaaggtgggctcggacgccggagggctggcgggtggaggaccgtccgccgctgcaggcgtggcgatggacgatgctgcgcccggcggagtcggcgtgccggcggtgggcgaaggcaacgccggctgcgccgcaggtggcgtcgggtcactgaccagcgcccggtggcggctttccgattcggtcagatccagcgccagcacgtcgtagccgatgcccagcagctcggacatctggccgatcagctcgtcttgcacgcgctgcggcgcgaactcgtcgccctgcgtgtcgaactgcgccagcacctcctgaaaaaagctgtcgaagtccagcggcagcgagcggtccttggcgtagtgctcccaggtgcgtttgcaggccgtgcgcatgaccgacagccgctcgacctggtggcgcccaaggccgccataaagcacggtgggaatggcgggcagcaggtagcgcaccgcgtcggccatgcgggtgatgtgcgaccgctggacggggaagccatcggccgccaggcggcgggccagttccgactggctcagggcggcgccgctctcctgctcgtagaactcccgtgctttctcgacgccgagcgcgcgctcgatgaacgtgaggccaccgcgcagttcgttctcggcaagatgtccggtcagcgcgacgatttcaccgcgctccggccatggtcggaacagacacgatatgcggaagaagcgttcttccttggtctccgaccagagttcgcgcaggatcgccagccgcgtgttgccgccgttgcggatgatgtagtggtccccgccgggccggcgcgtgatagccggcgccgcgtccaggccgcgctcgcggatggacgccttgatttcctcgtaagccgggttgcgcttcatgcgcgggtcatggtcgtagggccgcaactggtcaagcgtcacgaccatgggcgtgtccgcgatcgggtcgctcaaggccgtagccgctgggccgctgcgctcgaagccggccgcgagcagcttgcctgccatgtcctgcgaggtcatgtcagccatggccgcacccctcgcagtccccacgaccgccggccggcgccatgcgggcctctcgctcggcgcggcggatctgcgcacgggcgttcaattcggcccggtggtcactcgctgtccaactcgtgtagatcgccgcgcagccggccttggtga

SEQ ID NO: 4263 - DNA, 924 bp, Pseudomonas aeruginosa
cgaggtttgggctggcgggaggcggccccgagcgcacggatggcggtcggggcgggacggccggtggccgtggcgggctcagtgccgcgggctgtcctcgggcagcgcgagcaactgcttttcgcggttccagtcgaacgtttcgccgcgctcttcggcttcgtagcggcgctcgtcgaggcgctggaacaggtcgatctcttcgtccggcatgaagtgcaggcaatcgccgccgaagaaccacagcaggtcgcgaggtaccaggtgggcgatctgcggatagcggtggaagacctgggaaatcaggtcctggccgaggtattgggcgccttccgggtcgcgcggcagttcgtccatcagctcgtcgaaacgctcgaggaacaacccgtggttttcttccggcacctgctcggcctcgcccagggcgccgaggatgttgcgcaggtgctggagcagggcgaggtggtgctcgaggtaggagttggccatgacgggtcctctggaaaaaagctgggcagtataaagggtttcgcggcgccggccagtttcagcggatcgccggggactggctctggcgccggcggttttccagttgccggcgttcgctgtcgaggcgccgctggtcctgctccaggcgccagcgctgctggtccagttgctgctggcggatcaggttgtcctgcatctgtcgctgctgccgttgccgctgcaggttctgctgctggcgttgcagttgatcctgctgcaattgcaggcgttgttcgtcgaagcgctggcgctgttcctggagctggcgttggcgctgttcgccagcgcgctgcaccgcctgctggtgcggctgcacgccatagggcgcaggcggtgcggcctgcgccgggggcaggaggagaaacgaggctgccaggccggtggcaagtagcttga

SEQ ID NO: 4264 - DNA, 909 bp, Pseudomonas aeruginosa
tgccgagcgcgggagcgggtggggtacgccgatgggcgaggtaagcgacaccgagtaccagtacgactaaccagagcaacaacatgcggaatcctccatgaagacgccaggcggcgtctcgagcttagcccgtttgccgccgtttggcggcagggccggtcagcttggccggtttgtcacgttataggcgaaaacttcccgtttagactgggacaaattgcccgccgggagcccgccatgcagtcctacctacaatccggccgcttcgtggatagtgaccaccccgtggtggtggagttcgcggaaaaatcccgggggaattcggcgaaaccgcgtgaccaggcggtcgcgctgtactacgcggtacgcgacggggtgcgctacaacccctacgtgttcagccgcgatccgcagaccctgaaggccagccacgcgctgcagcagggcgagtcctattgcgtgcccaaggccatcctgctcgccgcctgcgcccggcattgccggattccggcgcggatcggcctggccgacgtgcgcaaccacctggccacgccgcgcctgctggaagcgctgcgcagcgaggtgttcgccatgcacggctataccgagctgtacctcgagggccgctgggtgaaggccaccccggcgttcaaccgtgccttgtgccgcgccttcgacgtcgctccgctggagttcgacggcgtcgccgacagcgtcttccatccgttcaaccgccagggcgagcgctacatggaatacctggccgatcacggccagttcgccgacctgccggaggaactgttcttctctcacctgcagcagcactatccgcacctgttctccggccgcccgctggccctgggcggcgatttccaggctgaggccggacaagatgaagggcgtcgatag

SEQ ID NO: 4265 - DNA, 735 bp, Pseudomonas aeruginosa
tcaccatcagccggcgcgtcttccttcttcggtccatcctcggtagggtgcggcatgtcgtccgggcgctccggcgacccatccgccgcatcaaccgaagagggaacgcagagtatgttgaccatctggggccggaagaactcgagcaatgtgcgcaaggcgctgtggtgcgccgaggaggctggcctggagtaccggacggtggatgccggcggggcgttcggcctggtggatgagccggcgttccgcgcgatgaacccgaacggtcgggtgccggtgatcgaggacgacggcttcgtcctctgggagtccaacgccatcgtccgctacctggccgcccgctatgcgccgggcgacctctatccgcaggacccggtgcgccgcgccgacgccgacaagtggatggactggaccacctcgactctcgccgggccgttccgcgacctgttctggggaacgctgcgtacgccgccggagcaacgcgacgaggccctgatcgcaaaggcgctgcagacctgcggcgagttgctgcgggtgccggaccagaccctggccggccaaccctggctgtccggcgaacgcttcggcatgggtgacattcccctgggctgtttcatctacgcctggttcgagatgcccatcgagcgcccgccgctgccccacctcgaggcctggtacctgcgcttgcgcgagcgcccggcgttccgcaccgcggtaatgaccgaactgacctga

SEQ ID NO: 4266 - DNA, 1008 bp, Pseudomonas aeruginosa
gccggctactgttgcattttgttacccgtagccttatctagctcttcctcttcaccttccgacacgggaagcctaatgagttccgccctgtccatccgtcaattgacgaaaacctacggcaacggtttccaggccctcaagggcatcgacctggacgtcgccgaaggtgatttcttcgccttgctcggccccaacggcgcgggcaagtccaccaccatcgggattctctcgaccctggtgaacaagaccagcggttcggtctcggtgttcggccacgacctcgacaaggacccggccggcctcaagcgttgccttggcgtggtgccgcaggagttcaacttcaaccagttcgagaaggtcttcgacatcgtcgtgacccaggccggctactacggcatcccggcgaagatcgccaaggagcgcgccgagcgctacctgacccaactgggcctgtgggacaagcgcaacgaagcctcgcggatgctctccggcggcatgaagcggcgcctgatgatcgcccgcgcactggtccaccagccgcgcctgctgatcctcgacgagcccaccgccggggtcgacatcgagctgcgtcgttcgatgtggagcttcctcacagaactcaaccaggaaggcatcagcatcatcctcaccacccactacctggaagaggcggagcagctctgccgcaacattgccatcatcgaccacggcgagatcgtgcagaacaccagcatgcgcgacctgctgatgaccctgcattcggaaaccttcctgctcgacctgaagaacgtccaggccctgccgccgaccctcgacggctatccgacgcggctggtcgacgaccacactctcgaagtgcaggtggagaagagccagggcatcaacgacctgttcgcccaactgggtgcacaaggcatcgaggtactgagcctgcgcaacaagaccaatcgcctggaggagctgttcgtgtcgctggtggagaagaacctgacgaggatcgcccgatga

SEQ ID NO: 4267 - DNA, 1428 bp, Pseudomonas aeruginosa
gcgggcgcggcatgcgccaatgaaacgctcgaaggcatgaaacagaagcccccgtcatgggggcttcgcgtttcatcggcgcgggcgagcgaaatcgatgacgaaacgggtccagccgtcggcagactcgcagcggatctcgccgccgtgggcctggacgatggagcggcagatcgccaggccgagcccggcgtgttcaccctggccttcgcggcgcgccggatcggcacgatagaaccggtcgaacaggcgcggcaagcgctcaggaggaatcgccggaccctggttctccacgctcaggcgccggtcgccgagacggatgcggatctcgccgccatcggcggtgaagcgcagggcattgtccagcaggttggccagcacccgccgcagcatgccgcggtcgcccggcaggctcaggctgccttggcgcagcaggcggatatcgtggtcttccgccagcggctggtagaactccagcagcgagtcgacttccgcgcccaggtccagggcctggcggctgggcgccagcaggccgtggtcggccttggccagcaacagcatgtcgttgaccatcgcggtgagccgttccagctcctcgaggttgccgtgcagggcctcgcgatagtcctccagcgagcgcgggcgggacagtaccacctgggtctgggtcagcaggctggtgagcggggtgcgcaactcgtgggcgatgtcggcggagaacgccgagaggcgctggaaggcttcttccaggcgcgccagcatggcgttcagctcgccggccagtccgcgcagctcctctggcatccggctggcgtcgaggcgggtggtgagggagttggcggaaacccgcgcggcgacttcgcgcatccgtcgcagcggcgccaggctggcgccggtggcccaggcgccgagcagcgccgtggccagcgccgacaggctcatggtcagccagatcaactggcgcatgcgttgcaggaagtgctggtgatgactgatgtcgaggatcacggtgagtcgcggcgaagcgtcgttgccgggctccagcggggcgccgagttcgcggttggcgggcaggccgggatgcgcaggctgcggcaggcgctcgaaccaggggttgccatccgggccgttcaggcgcaggccgaggtcgggatggcgtgccagttcgcgcagcagttccgcttcgcggcggcgcatctgttgttccgagccgaggccgcgcagctcatcgcgaaacaccgcgagcttggcggacatcgccatatggtcgagctcgacgaaatgctcgtcgatggccctgctgaagatcaatccggcgatcagcgagaccgccgccgtgcaggcggcgaacagcaggctcaggcggacgccgagggacatccgcgagccgaacccggcgctcattcgtcgcgctcttcgagaacgtag

SEQ ID NO: 4268 - DNA, 660 bp, Pseudomonas aeruginosa
tcgcgaggcgcttcgcgcggtattgcagaaagacctctcggccgctgccggggcgcccgtgggcgtgcgcctgcgcagcctcgacgaggttgccgaggagggcatcgggcgtctgccggggcgctgcatcgacgagctggacatcgccgtcgacggctacgagcagccgcgcccggaactgctgcgctgcgacgccgggcggatcgtcgaggagcagctctacagccacctgctcaagtccaactgcccggtcaccggccagcccgactggggcaccctggtggtcgactaccggggcccggcgctggacccggccagcctgctggcctacctggtttccttccgccagcaccaggacttccacgaacagtgcgtcgaacgcatcttcctcgacctgcagcgcctgttgcagccgcaggcgctcagcgtctacgcgcgctacgtacgccgtggcggcctggatatcaatccctaccgcagcctggcggaggtcgcaccggacaaccgacgcctggtgcgccagtaacgcctcgcaacacgcggatacgaaaaagccccggccatgccggggcttttcatttcggcaagtcgttcagatacccatgttggccaggctctgcacgatggagcggagcgtgccggcgagggtcgggtggctga

SEQ ID NO: 4269 - DNA, 726 bp, Pseudomonas aeruginosa
tcatgcaaaggagatacagcaatgcgcgcccgcggcgtgaactggatcgaacgtagtgcccgaatcctggcttgcgccagcctcgcattggcacccacgctgtccctggcggccagtgaagaagacccttgggaaagcatcaaccgtcccatcttcaccttcaacgacaccctggacacctatgcgctgaaaccgctggcccagggttaccagaaggtcaccccgaacttcgttcaggacggcgtgcacaacttcttcaacaacctcggcgacgtgaagaacctggccaacaacctgttgcaggccaagttccacaatgccggcgtggacaccagccgcctgctgttcaacagcaccttcggcctggccggcttgatcgacgtggcgaccccgatgggcctgcagcgcaacgatgaggacttcggccagaccctgggttattggggcgtcggcagcggcccgtacgtgatgctgccgttcctcggcccgagcacgctgcgcgatgccccggcgaagatcccggacatctatgtcagtccctaccactacatggacgacgtacgcgcgcgcaacgtgatgttcggcatcaataccgtcgacacccgtgccaacctgctgaagtcggaaaaactgatcagcggcgataagtacatcttcatccgcaacgcctacctgcagaaccgcgagttcaaggtcaaggacggcgaggtggaggacgacttctaa

SEQ ID NO: 4270 - DNA, 1188 bp, Pseudomonas aeruginosa
cccatgcataaagtcagtgccacgctgctgatcatcgatgacgacgaggtggtgcgcgaaagcctcgccgcctacttggaagacagcaacttcaaggtgttgcaggccctcaacggtctgcagggcctgcagatcttcgaaagcgaacagccggacctggtcatttgcgatttgcgcatgccgcagatcgacggcctcgaactgatccgccgcatccgccagaccgcttcggaaacgccgatcatcgtactttccggagccggcgtgatgagcgatgcggtggaagccttgcgcctgggcgccgccgactacctgatcaagcccctggaagacctcgcggtgctcgagcattcggtgcgccgggccctggatcgcgcctacctgcgggtcgagaaccagcgctaccgcgacaagctggaagccgccaaccgcgaattgcaggccagcctgaacctgcttcaggaagaccagaacgccggccgccaggtgcagatgaacatgcttccggtgacgccgtggagcatcgaggggctggagttttcccaccggatcattccgtcgctgtatctctccggcgacttcgtcgactacttccgggtcgacgagcgacgcgtggcgttctacctggccgacgtttccggccatggcgcttcctcggccttcgtcacggtgctgctgaagttcatgaccacgcgcctgctctatgagtcgaggcgcaacggcacgctcccggagttcaagccgtccgaggtgctggcgcacatcaaccgcggcctgatcaacaccaagttgggcaagcacgtgaccatgctcggcggggtcatcgacctggagaagaacagcctgacctacagcatcggcggccacctgccgcttcctgtgttgttcgtcgaagggcaggcgagctacctggagggccgtggcctgccggtgggcctgttcgacgatgcgacctatgacgaccgggtcatggagttgccgccttccttcagcctgtcgctgttttccgatggcatcctcgatgtgctgccaggagctacgctgaaggagaaagaggcttcgctaccggaacaggtggcagccgccggaggcaccctcgacgggctgcgccaggtcttcgggctggccaacctggcggagatgccggatgatatcgccttgctggtgttgagcaggaaccttgcatga

SEQ ID NO: 4271 - DNA, 450 bp, Pseudomonas aeruginosa
tgggcctcaacgaatccaaccgcgaagccttccacgacctggtcagcgccctggagcgccattaaccggtcgatcccttcccgaattcctgctgaatcctccgctgcgccggaacgggacgccctgcatgcgcgtcccgccggcagcggcgatcagtggcgggtcgccaactggtattcgagcttttcctggtcgcgtgcgaacaggcggatgccttcggccagcttttcggtggccatggcgtcctcgttcatctgccaacggaaagcgctctcgtcgagcacctggcgcggctcgccttcgcctggcagcagcaggcgcggcagctcgccctgggcgtcagccagttgttgcagcaggtcgggactgatggtcaggcggtcgcagccggccagttgctcgatctggccgagattgcggaagctggcgcccatcaccaccgtcttgtag

SEQ ID NO: 4272 - DNA, 1182 bp, Pseudomonas aeruginosa
cgcggcagggcggcggccttgagcagcagcgacgggttggtggtggcgtccaccggcttcaggcgggcaatggcatcgaagtcgccggtgtcggcgaccaccgtggtgtattgcttgagttgttccagcttcgaagtcatggcgaggtcttgtcaggtgggttcttgggaagaagaattccccgaccttacccgagccgcaggcgcggctcaatgggagctatcgccccgccagaagttccagcgcctggtcgaaaacccgcagcggatcggcggccttgtgcacgtccaccgagagcagttggcggaatcgccgggagccggggaagccctgggccaggccgaggatatggcgggtcacgtgatgcatcgcgccgccttcggcctggtgtcgctcgatgtacggacgcagacggagcaaggcctcgctgcgactgagcggcggcgcttcgctgccgaacaactggctgtccaccgcggccagcaggtaggggttgtggtaggccttgcgaccgagcatcacgccgtcgaaggtctgcaggtgctcgcggcaggcctcgagggtcttgatgccgccgttgaggacgatctccaggtccgggaagtccttcttcaattgcgccgcgacctcgtagcgcagcggcggtacctcgcggttctccttgggcgagagcccttcgaggatggcgatccgcgcatgcacggtgaagctccggcagccggcctcgcgtacctggccgacgaaatcgcagagttcggcgtagctgtcgcgcccgttgataccgatgcggtgcttcaccgtcaccgctatctccaccgcatccagcatcgccttcacgcagtcagccaccagcgccggatgccccatcaagcaggcgccgatcatgttgtgctggacccggtcgctggggcagccgacgttgaggttgacctcgtcgtagccggcctcttccgccagccgcgcgcaggccgccagttccgccggcacactgccgcccagttgcagcgccagtgggtgctcgcattcgtcgtagcggaggaagcgctggcgatcgccgtgcagcaacgcgccggtggtgaccatctcggtgtagagcaaggtgtgacgggacaactggcgcaggaagaagcggcagtggcgatcggtccagtccatcattggcgcaacggagaagcggcgtga

SEQ ID NO: 4273 - DNA, 243 bp, Pseudomonas aeruginosa
gagggcggcgggggcgttggtcggttctgggcgcatcgggacttcggcagggagagcggagcagggcgagggattttatcaggtatggaggtggaggaggggcgggatgagcgtgctagtgtgaatgcgtgcaagagccggggctggtgggatgccgagatgattataagtctgccgtcggtccggcacctgtattcattcatgagtttttcatcagaaatttttttcaatatttatttttga

SEQ ID NO: 4274 - DNA, 540 bp, Pseudomonas aeruginosa
cctcggtgcctgccgggtagtgccaggcgcccagttgcaaggcctcggcgaggaccgtaccgccgaggccgtacaggcggcggtcgcggtcgaaggccagggcgccgccgctcagcgcgatgccgcgcaccgacacccgttgcccggtttccggcattacccgccagcgctcggcgtcgcggtagccgtcggtgtagaccatgccatcgctggcgaacaatcgcgcaccggcggggaagtcgatgtcgtcggcgcggttgccgatcgccaggctacagccttcgaaggcggcgggacgcccgtcgcgctcgctggcgaaggcgatttcctggctggcgtcgcaacgccagccttcgatctcggcgactccctcgccacgcaggcgcagcgaagtgggatggacgccggtggttttccatgggtcctgcgggttgtcctgctcgctctgcagccagcgttgcaggtggcgggtggcgacgccgcggatcgtcaccggggtggggaattcggcttctcggaagctttccggctggtgcttga

SEQ ID NO: 4275 - DNA, 1593 bp, Pseudomonas aeruginosa
gcgggacgatcaggggaagaggggcgacggggatcacgcgggcgtccttgcgggttgggttccatgacgtctccggcgcggcgtgccgggtacctgccagagtttacagggcgcgtcccgatgccgcagcggcaaactgtcttcaggccttgtccgccgggggccacgccctggagagggaggcgctcggggatggagtcggcgaagtgccgattcaagcccaggcgcgacgggccgatggggtggttatcggtttctgtagtccagtggggaaaaaccaatgaacgaaagcgtcgccagggtgttcgatcggattctacgggggctcgggttgaagaccctgaacgcccagttcctgctgtcctatgcactgatgttcggcctggccgcctgcgcctcggtggcgttgtacctgagcatgtcgatctcgccggaaaccatcaacgtggccggcgcgcagcgcatgctcagccagaagatggcccgcgaggcgctgcaattgcgactcggcgccggcgacccaaaggccctggccgcgaccatcgcccagtacgaacgctcggccgccgacctggatacgggcaatgccgagcgcaacgtgagccggatgggcgcgccggagatcgccgcccagcggcagaaggtggcgcagatctggggccgctaccgggccatgctcgaccaggtggcacagcctgccagccaggtcgatctgcgcggcttctcgcagtattccaccgagctgttgggcgagctgaacaacctggtctcgctgatgagcgcgcgcgccgacagtgtccagcacacccagatgtggatcgccttcggttgcctgttggcgatcctggtgctggtggtgctcggccggcagttcggcctggcgccgctgatgcggcagttgcgtgggttggaagtggcgctgaccgaggtcggcgcggcgaacttcacccatgccctggcggcgggccatgcggacaacgagatcggccgcatcgtcgctggctacgagcggatgcgccaggacgtcagcggtttgctggcgaacgtcaagcgcagcgcggcagagaccgacaaggacgtggccgaggccctggagcaggcgctcggcgccggcgaccaggtggcgcgccagcaccaggacctggaccaggtggccaccgcgatgaacgagatgagcgccaccgtggccgaggtcgcccgccacgccaaccatgcggcgcactccacgcgcgacgccgcggccctggcccacgagggacggcgtctggtggagcacgccagcagccagaccggtgcgttggcggaggaactggaacagaccgccctggcgctgaacaccctgcaccagcatgccggcagtgtcggccaggtgcttacggtgatcagcagcatcgccgagcagaccaacctgctggcgctcaatgccgccatcgaggcggcgcgggccggggaggccgggcgcggcttcgccgtggtggcggacgaagtgcgttcgctggccaaccgtacccagcagtcgacccaggagatccaggggttgatcgagcagttgcaggacggcgccaacgatgcggtcgccgccatgcgcggtag

SEQ ID NO: 4276 - DNA, 474 bp, Pseudomonas aeruginosa
tgtgggtttccaggctgccgcgcaccacggtcaggctttccgcctcgtcgccgtccaccaggccgccgcgccagaccggcaggccggcgctgttatgggtgctggcgaggcgtgcctgcaaggcccgctcgcgacccggcaggctcatttccagcacctggccgagcgccagcgtgtcgagcagggcgggttcgacctgcgccaggtattcgggaataccctggggcgccttcgcggctgcgcagttcgccttgccagagcgtcacccgctcgcgtggcgcgggcgtcgtgacgggggtcggggcgagcatgcgggtagcgtccgccgccggcgccgcgagcgccgctgtcggggcggcggctgcctgggcggcgggggactggcgggcctgcggcgatgcctcgggcggagccgggtcgagcagccagccgccgatcagcgcaccgccgatggcggcggccgaggctgcgtag

SEQ ID NO: 4277 - DNA, 747 bp, Pseudomonas aeruginosa
gtgaacgtggcgcggagtctaggaagaagcctctcccagcgtggcggcaaccgttcacatttgcgccaggccgcgcgccggcgtgacgaaactgcgaatcaggccggagcgctgcgggcgccaggtcacgtgcgctctgtgcgctgcggcaaggctggcgttcggccgccatgctgttcgcggcggaaggcttcggcgcacctggccgtcctcgcgcttgaagaactggacgaagttgctcggctcgtcgaagccgatgccatcgtctacggcagccccacctatatgggcggaccggcctggcagttcaagaagttcgccgatgccacctcaaagccctggttcgtccagctggcttcgctgacgcctggcgctggctatggggtgtcgacatcccggccgacggtggcatgttcgctcatctccaggcaacccggtacggcctctagccgcgccggggcctcagcctcgcgccagttgcaggagacgggcgcgctcctgcatcagcggccggcaactgcggatgccttcgacgatgctgtagaggctttcgatctgctgctggctgaggctgttgttctgggcccagccgagcaactgcagccaggtccagcgggcgatggtctcgctctgcgtctcggccttcctgcggtcgtccccgtcgctctgtccgaccagggtctccaccagccccgaggcgcacaacggcagcagctcccggtactgctccgggtgcgtgtcgcgtag

SEQ ID NO: 4278 - DNA, 1785 bp, Pseudomonas aeruginosa
aggcggacgccgtttcgtcgcctgggggcggcgggtcgtcgtctcgccagaggggcgggcatcggcgccgaggcggcggaaaacggcgatcgggacgatactcaggaaaggtgggcgttgcggaaccaagcctcgccttccaggactaatagccgggtttcacgcagaggtcattcccatgagaacaacaacaagcatccgccgtgtcgctgccgtcctggcagcgctgcacctgctcaccttcgccgaggttccgctcgcccaggcagcgatgatcggtactgcggaagtcatgcagcaacaacagcacaacctcgatcgccagcaactgctgaagatgctcgacgaccagggcgtccagaagaagctggaggccatgggcgtgccccgcgaccaggtggcgagtcgcatcaacagcctgaccaacgccgagctggcgcagttcaaccagcagctggaccaggcgccggcgggcggcatcatcggcatcatcgtgttgttcctagtgatcttcatcatcaccgacatgctttgcgccacggatatcttcagcttcatcaaatgcatcaatcggtgaggcggctggcaggggcactgctggtctccgcaatgctcggcggctgcgcgcagccgccgagactgccgccggaaagcgcggcgctgcccgcacgggtggagctgcgcgaagtgccgttcttcccccaggaagcctaccagtgcggtcccgccgcgctggccacgatgcttggccagcgcggcctggcgttgacgccggggcaattgaaggacgaggtgttcattcccggtcgcgagggcagcctgcaattggagatggtcgccgcggcgcgccgccacggcatgctggtctatccgctgcaaggcggactggagagcgtgctcgaggatgtcgcggcgggcaacccggtgctggtgttacagaaccaggctttctcctggtggccgcgctggcacttcgcggtggtggtcggtttcgatcgggagcgccgcgaactggtgctgcgctcgggcatcacccggcgctgggttaccgacttcaccagcttcgagtcgacctggaagcgttcggggcgctgggcggtgctgaccctgccgggtgaccgcctgccggccacggcagcggcggtcccgtggctcaaggccgccagtgacagcgaggaaaccggccaccccaaggttgcccggcgcgcctacgaagaaccgtgcgacgctggcctgaggacgccttcgcctggtttgccctgggcaacagtcgctacgccgcaggcgattccgccgctgccgaacaggccatgctcaccagcgtcgagcgtcgcgtggatttcgccgcgggttggttcaacctgtcccagttgctggcggaacgcggttgcgcggcgccggcgcgccaggcgcaggcctgcgcgcgggcattgcagcctggggaagcccgcttcgctgcggccttgccgcaggccgtcgcacccgcggctcggtgcgccgagctgccggcctgtcccgttggcgcaccgccccgctgaggcggcggagccgaaggttgtcggaaccccgttccagcgagacggctctatacctgggaggaccccactcaggtgcagaacatggccaacgacaagcggacttcgccccccaccccccggcaaccggccaagggcggtgcggcgggcaagcgccaggggcatgcggcggagggcacgcgcaagccgcgtgcgcgcggcgaggagcggaaagagaaaccggccgacggacgttcggccacggcgctga

SEQ ID NO: 4279 - DNA, 720 bp, Pseudomonas aeruginosa
tcgacgatgccggcgcgctctggggaaccagcgctttcctctgcggcttcggcgcactcttcggtattgtcgggttcaggggattgctgggcctgcgttcttcccaaccgacctcaaaaggacattgaagtcatgtcgcaacttcccattcccttgcccctcaacgagagtcgctggcgctacgtgacggccagtggcggaggcatgaccgtggccttcctggcgggtagcggcggctccatcacgttgctctcgccggagggtgagaacgtgtccttccgctatggcggggtgggcggcgggatcggactgggcatgcgcctgccgcgcttcggcaaggtcaacctcaatgtcaagggcaagagcgttggcggggccggtgcgctggaggcgttgccgagcaccggaaccgtcttggtcgcggacggcctggtggggcgcgacctgtcccgcggcgacttcaccgggccctgcatgtacgtcgaactcggcgcgggagtcatcgccggcggttcgggcacggcgattctcttcggcctcgatcccaagctgctggcggcggtggcgctggcgagcgcctcgccattgaccgccgcgctgggcgccagcatgtcgcggcaattactgcaatcgtcccgtggcgccctgttgatggccggggtcaacgtcggtgcacagttcggcggcggcgcggcggcttacctgggggcgttgttctga

SEQ ID NO: 4280 - DNA, 720 bp, Pseudomonas aeruginosa
tgcaggagggcgatccgggaggatcgccctttttaccttgcgcaggcgtgcggcggccagggctccgttgagttccatggccagcggggcggtggcggaaatcgttaccggcgcggggaacggtcgtcggagattccgaaccggcatggatcggttctttccaaacaagcccatccactcgttcgaggtgtcgtgcttgtgtccaggttgatcatgcccggagggccgttgtcgcaagaatccgatgtccggatcttctgttcagccaaggagcggctggacttctaccggcgggaaatccactacgagacgggccagctatccagtcggaccaacgcctacctgacggcgcagtcgttcctggtcatcgcctatgcctcgtcgatggccaacctgaacccggcctggggcgagctgttcaccctggtggtgccggcgctcctggcactgctcgggatcgtcaattccctgcatgcctggccgggcatccaggcatcctcggagatcatctgccactggcagttcaagcagtcctgcctgttgcacagcgatccggagatcggcctggcctacgatgattcgccattgttcagcgaacgcgaggtcaaccgcggcagcttcgagaaaaccttgctgttctcgcgacgcgtgccgttcctgttcgccggcttctggtgtgcgctgggcgtgttttcgctctggttgcaactggccggttag

SEQ ID NO: 4281 - DNA, 531 bp, Pseudomonas aeruginosa
cttcgcccggctgaagggcttgccgtgccgcggggtggcggtgaccgcgcgcagccagcgcttcgatttcgtctcgcgctggttcgggcccaacgtcggcgtcaacgaagacccggtgaccggttccgcgcatacctccctggcgccgtactgggcgcagcgcctgggcaagacccggctgagcgccgagcagggcggggcgcgcaaggggcgcctggaatgcgacgtgcgcggcgagcgggtggtcatctccggcaaggcggcgttgtacatgagcggtacgctccatctctgatcccgaagcaggagtacgacgatgccggcaccgcaggtaggcgtgggcgtcctgatcttgcgggacggcaaggtgttgctggggcgccgcaagggcagtcatggcgctggctgctggtcggcgcccggcggccatctcgagttcggcgaggcggtggaggactgcgccctgcgcgaagccctggaagagaccggcctggcgctgagcgaactgcgccacggcccgttcagcaatga

SEQ ID NO: 4282 - DNA, 696 bp, Pseudomonas aeruginosa
agatcattatccaatgtgacgacatcgtctccccaaccaacggatagtcggcatgcgctacaaaccggaacagaaacaggccacccgcgccctgctgttgagcaaggccgctccgctggtgaagcgccagggcttcgccagcaccggcctggacaccttgatgaaggcggctggtcttaccaccggggcgttctactcgcaattctccagcaaggcggagttgctcgaagcgatcctgcagcgcgagctgagcgcccagcacgatgcctttccgctggacagcctggagcaactggccggcgccacccgtctctacctcagtcgcggtcatgcgcagcatgccgacatgggctgcccgattccggcgctggccgccgaggtgggccgggcagggcccgaggtgcgggaaaccttcgaacgcgccctggaacagcggcaacggcggctggccgaactgatgggcgacgagaaccgggcctgggtgctcacctgcttgtcggtcggcgcggtgcttctcgcgcgtgcccaggcgagcgaggtggcgcgcgacaaggtcctggatgcggcgctggagcatgcgctgggcctgctttcggcgagcggagcggtttcgccgcaagcggaccgggactgattgcacaactgcaatgttcggcgtctagcgtcaggctttccctccgacaggtaagcccatga

SEQ ID NO: 4283 - DNA, 1020 bp, Pseudomonas aeruginosa
gatgcgcgggtatttcggagccgcttcgcttggcgtcgcccgccgctgcgctccgaaaccgagcattgctcgaaccagaacgagatcgaaggtgcatcgccacgagcggcgcacggcctgatgatagatggaggcaacatgagcgcggctcagccaggcattctcaccccgattccggtggtgggtcgctacctgtttttcagcatttcccaacccgagcaggtggccgcgaccttggccagcctggccgcggccaccgatggttaccagctggtggtgggtatcggccattcgctgatgctcagcctcggcaagaccgtcgagggcatgaaggactatccggtgctcgccgcgcccggcatcgacctgccgtccacgccctccgcgctgtggtgctggctgcgcggcgaggatcgcggcgaggtgacgctgcgctcgcacgcgctggaacggtcgctggcgccggccttccagcggaccggcgcggtggatgcgttcctctacggcgaggaccgcgacctgtccggctacaaggacggcaccgagaaccccaagggcgatgcggcgctcgaggccgcgctggtctccgggcgcggtgcgggcctggatggcggcagtttcgttgctgtccagcagtggctgcatgacttcgaccggatgcaggcgatccccggcgaggagatggacaacatcatcggccgccgcaagtccgacgacgaagaactggaagacgcgccggcctacgcccacgtcaagcgcaccgagcaggaaagcttcgagcccgccgcgttcctcctgcggcgcggcgcgccctggtccgacgagcaccgcgcggggctgttgttcgccgccttcggccgctcgttcgaggccttcgaggtccaatggctacggatgatcggcgtggaagacggggtgctcgatggcctgttccgtttcacccggccgatcagcggcagctacttctggtgtccgcccatggccgacggccgcctcgacctgtccgccctcggcctctga

SEQ ID NO: 4284 - DNA, 456 bp, Pseudomonas aeruginosa
atcgggcgttgccggatcgcttcgtcatgcgcctgcaatatcaaccttatcgataagtaccatgccgcgaagtcgctgcagttctcgctttgggcggtgataccgtcgaatcgtgaacggatcgacaaagagggacgtgacatgaagattcttatcgctgtattcgccgccctggccctgtccgcctgtgcctcgcctcccgcttcgaacgccccggcgctggccgccagcaccagcaaggctccctacgattacgcgatgtgcgtcttgcccaagtggcaacgccaggcgcccggcgtggcgctggtggaggaaggccgcggctatcgcctggcggacgccggtcagtggctggaggtgcagccggcgaggggtggcagcctggtgcgaatccatgaccagcagccctgggtcacccgcggggccttcatcgatgcggccaggacctgttcctga

SEQ ID NO: 4285 - DNA, 510 bp, Pseudomonas aeruginosa
ctttttctgtcaagaaaattgatccaaccttgcccgcctttccgctatcacgcccgagaggtccacgtgcaaggcatcaagcgcaaactggtctacgtgaccgcctacgaattgatcgggatgagtatctcgaccctggggctggccctgctcgccggttccacgcccactaccaccggccccctggcggtggtgatcaccaccgtcgcggtgacctggaacttcatctacaactgcctgttcgagttctgggagcggcgccaggccgtgcgcggacgcagcattgcgcggcgggtggcgcacgccatcggcttccagctgaccctggtggtctacctgatcccgctgatcgcctggtggatggggatttccctgctggaggcgttctggctggacctggcgctgatcgtcctgatcccgtgctacaccttcctcttcaactgggccttcgatcgcctgttcggcctcccgacttccgcgttgccggccggcgaggcggcctccgtctga

SEQ ID NO: 4286 - DNA, 573 bp, Pseudomonas aeruginosa
ggattttttttcttcagcgccattcgcgctcgccttggccggggcaaatcgcctaccttagacggacgtgcgctgtggtgccggttcagggaggaagtacgaccgcaagccatgaaggtctgccccggcgaggatggggtgcggcatttcgatgaacggattggggtcactatgcggattttggggatgctactgggggccgtcttgctggcgggttgttcgacatcgacgccctcgctcgacgagacggaccaggtaccgaaggagcgtttgtacaactatcagttccgtgacgacggcgacgccttcctggtggtttcccgggaccgcgagttcctcggcagcgtctgcaatacccgcttgatcatcgatagccgcctggccgccgagatccaggccggcgagagcgcgcgtttccgtcttccggcggggctgcgggtggtatccgtgcagggcgatgggatctgccgcggcgaggcgcccaagcaggtggtgcatgtgcagaacgggcagaccacgcattaccggatcaccgtggactccggcctgaacatcggcctggtgccgggctga

SEQ ID NO: 4287 - DNA, 1050 bp, Pseudomonas aeruginosa
cgaggatggttacctaggtatggagtcgcccgcttcgctgaaagttgcacggcatggcctgagtcgggggcttccgtagcatgcgggagagccgtttcaggatgccccggcctcgccgcgcaggtagcggtcgaggtcgatcgcttcgccgctcttgagtttcaggcgtcggcgcaggtcgtcgaacatagcgtcgtactcgcggcgctggcgcacgatcggtccctgccgcaagcgcaggccgtggcgccgggccaggcgactggcacggctggcgaaatgcacggcggcgtcgcgcggcagttcgaagctttcgctgaaaggctggccgtcgatccggccctccatgtcgaagtgtacggccaccgggcgggcctcggcctccaggacccggtagcgcaggtggatatcgaatgcctggcggtcgacttcgctggccgaggcgagatgcagatggccgggaatgaacatggcctgcctccttttcggataaccggggaaatgcccttgcctgccagggtatgcttcgccggcctcgggacggctgtcccaggtcagttttttccggattggagtggggatgcgaatggcgctgggagcgttcgggtgttgactgactgggccgcgtacgccgggctgttcctctcggcgttcggttcggcgaccctgctgccgttgcagtcggaaaccgtgctggccgccttgctgctgcgcggcggccagtcggtcgcgtggctgctggcgctggccatcgtcggcaatgtgctgggttcctgggtcaactggtggctgggtcgctacctcgagcatttccgcggtcgccgctggtttcccgtgggcgaggtgcagttgctcagggcgcagcgacactatcgccgctacggccgctggaccctgctgctcagttgggtgccggtcatcggcgatccgctgacgctggtggccggcatcatgcgtgagccctgctggagtttcctgctgatcgtcggcctggccaagacgctccgctacctcgtcctggctgcgctggtgctgggctgggccggctga

SEQ ID NO: 4288 - DNA, 849 bp, Pseudomonas aeruginosa
ggattgcgtttcgccgtcgcgccacagcgccttctccacgccgatcgagctgatgcagttcatcgcccagctgcgcgaactgtccggcggcaagccggtcggcttcaagttctgcctgggccatccatgggagttcatgggcatcgccaaggccatgctggagaccggcatcctccccgacttcatcgtcgtcgacggcaaggaaggcggcaccggcgcggcgccgctggagttcaccgaccatatcggcgtgccgctgcgcgaaggcctgctgttcgtccacaacaccctggtcggcctcaacctgcgcgacaagatcaaggtcggcgccagcggcaagatcgtcagcgccttcgatatcgccagcgtcctggccaccggcgcggattgggccaactcggcgcgcggcttcatgttcgccatcggctgcatccagtcgcagagctgccataccaacaagtgcccgaccggcgtcgccacccaggacccgctgcgccagcgcgcgctggtggtgccggacaaggccgagcgggtgcgcaacttccatcgcaacaccctcaagggcctggccgagatgctcgccgcggcgggcctggaacatccctcgcagctcgaagccaagcacctggtgcgacgcatcaccgacaccgagatccgcctgttctcgcagctgcactacttcctcaagccgggcgaactgctttccggcaagatcgagggcgagttctacgagcgcatgtggaacatggcgcgggccgacagcttcgacgcggcggcctgagccgccgccctcgcacgctagaaaaagccggaggcatcgctgcctccggctttttcatgtccgcgtag

SEQ ID NO: 4289 - DNA, 1074 bp, Pseudomonas aeruginosa
gggatacctcgtacaccgcgttcgtcttttcaaacaccccggcttgctggcagagtggcggaccctccccgccccgtcgagcgagccatgcgaagccaagccctgcgtgccgatgtcctgatgctgatcaccgccatgatctggggggtgtcgttcgtcgcccagcgcctggggatggacgccatcgggccgttcctctataccggcctgcgcttcgtcctcggtgccctggtgctggtgccactgctgatgctgcgctcgcgacgcgacggcgcgcaacccttcaatcgcggacagttgctcgccggtgtgatcctcggcgtcgccctgaccaccgggatcaacctgcagcaggtcggcctgctgttcaccagcgtgaccaactccggcttcatcaccgggctctacgtgatcgtcgtgccgttgctcggcctgctgttcggccagcgcaccggcgcgggcacctggctgggggcgtcgctggcggtgctcggcatggccctgctgagcatcggcccgggcttccaggtcgcctccggcgactggctgcaactggccggcgcggtggtctggggcgcgcacgtcctgctggtaggcctgttcgccagccgctacgacccgatccgcctggccttcctgcagttcgccacctgcgcggcggtcagcctgctgctggcactggtcttcgaggaaatccactggggacgccatcgtccaggccggtcccgccctgctatacggcggcctgctcggcgtcggcaccggcttcaccctgcaggtggtggcgcagaagcacgccatcgcttcccatgcggcgatcatcctgtccctggaagcggtgttcgccgccatcgccggcgccctgttcctcgccgagaccctgcacctgcgcggctatttcggttgcgcgctgatgctggcgggcatgctggtggcgcagttgtggccgcgcaagctcgccgccgaagcgcgcccggcctgacactcagccacggaacggcgccagggcacggtgcgccgggctggcctcgtccagcggaatgtgccgcttggcgcccaggtagcgctcgctga

SEQ ID NO: 4290 - DNA, 1314 bp, Pseudomonas aeruginosa
ccaggcacatgcctgcgcgcgcctcgacccgcggccgccaggcgcacatgcaatagctcggcagcagccgacagccttcgcagcgcggcatgcgcgaaccgcgcgcgacgaagggtttcaggctgcgcgccaggcgctcctggcgcaagcgggaaacggcatggctcatcgggcaggctcccgatacggaaaggacgggcgaaggaacatcgaagactcgaggaaacgggctggaaagcgaccgcgaaattctatcagagcccgcgtggctcctgctttgtcggacaacttccgaggccgcgaaaaaaaattcttcacaggggcctcagacgtctagttagagcgggatgcgatccctataatccgccccctttttcgacaccgggcagccggctccgcccgctgaccttactgcctctccagacgaatgacgccccccttgctcgagatccgcaacgtgacccgccgcttcggcgacttcaccgccgtcgacaatgtcagcctgacgatcaacaccggcgaattcttcaccctcctcggcccttccgggtgcggcaagaccaccctcctgcgcatgctcgccggcttcgaccagccggacagcggcgagatccgcctcaacggccaggacctcgccggcgtcgagccggagaagcgcccggtgcatacggtgttccagagctacgcgctgttcccgcacatgagcgtggcgcagaacatcgccttcccgctgaagatggccggagtggcgaagagcgagatcgacgcccgcgtcgaacaggccctgaaggacgtgcgcctggcggacaagggcgggcgcatgccgacacagctttccggcggccagcgccagcgcgtggcgatcgcccgcgcgctggtcaaccggccgcgcctgctgctgctcgacgaaccgctgtcggcgctggacgccaagctgcgcgaagaaatgcagatcgaactgatcaacctgcagaaggacgtcggcatcaccttcgtctatgtcacccacgatcagggcgaagccctggcgctgtcgcaccgcatcgcggtgatgaaccagggccgggtggagcagctggacgccccggaaaccatctacagcttcccgcgcagtcgtttcgtcgccgacttcatcggccagtgcaacctgctcgacgccacggtcgaggcggtcgacggcgaacgcgtgcgcatcgatctccggggcctgggcgaggtccaggcgctgaaatccttcgacgcccagcccggcgaggcctgcgtgctgaccctgcggccggagaagatccgcctggcgcagagcgtcaccgctga

SEQ ID NO: 4291 - DNA, 255 bp, Pseudomonas aeruginosa
tcatgctgttcgcctcgttccgctttcccggcgactacggcggcctggcgccctggatgtacagcgaggacgggcagaccgtctacgacctcagcgtggagaactacacccggctcaccgagagctgggtgtacctgcaactgttcgtcaaatccttcggctacgccctggtcaccaccctggcctgcctgctgctcgcctacccggtggcgaccaccctcgcccgggccccggcgaagtggcgcaacctgctga

SEQ ID NO: 4292 - DNA, 1074 bp, Pseudomonas aeruginosa
caaggaaccatgatgaaaaagctgttgctcgtcgcaaccctcatggcaggagccgcccaggccaccgccgccgagaagctgtatctgttcaactggaacgactacatcgccgaggacacgctgaaacgcttcgagcagcaatgtggctgcgagctggtgcaggagttctattccggcaccgaggaaatgatggccaagctggccgccggggccagcggctacgacgtgatcatcccgacccagaacgcgatcgaggcgctgatccgcaagggcgacctgctggagctggacaagagtcgcctggcgaacctgagcaacgaggccgcgggctacctcgacaaggatttcgacaagggcaaccgctattccctgccctacgccttcaccaccaccctggtcggctacaacaagaccgagctggacaagctgggcatcgaccccgccgactggtcggtgatcttcgacccggcggtcctggagaagatcaagggcagggtcacggtgatggacgacccgcaggaactgttcggcgccgccctgaagtacctcggtcactccgccaacgacaccgacccgcagcactggaaggaagcccaggcgctgatcctcgcggccaagccgtactgggccgcgttcaactcgtcgagctatatcaaggagctgaccctgggcaacatctgggtcgcccatggctactccagcgacatgtaccaggccagggccgacgcggaggctgccggccgcgccttcaaggtcgacttcgccctgccccgccaaggtgcggtgctggccatcgacaacatggtgatccacaagggctcgaagaaccctgacctggcctaccgcttcatcgacttcatgctcgacggtcggaacgcttccgagctgaccaaccagatcggtaccggcacgcccaacgccgccgccctgcccttcatcaagccggaaatcaagacgctcgccgccctgttcccggacgccaccacccaggccaggctggagccgctgaaggacctgaactcgcgccagcgacgcgccctgaacaagctctggacagagatcaagctgcgctga

SEQ ID NO: 4293 - DNA, 495 bp, Pseudomonas aeruginosa
gtagcacgcggcgctcatggctatccgggaacagtcgttccaccagcgcctcgtcggccaccgcctcgacctcccagcgatcgcgcggcgcgcggaagcgtcccggctcctgcaggtagaccagccggtaggcctgcccggcctcggccaggcgctgcgcggcgcggcgcatctgttcgagctggtagctgccgttggcgatcagcagcagcggatcggagccgcagcgctcctcgaccaggatcgcgccgtcgcgggccaggcgctcggcctggacggcgtcgaacaccatcggccggtcgcgcttggggatcaccaggcaggccagttggccccggctgcggtagatcgtcggtagcagcgccagggcgctgttgtgatcggccgggaagagcacccggaccatgtcgctcatctcgccaagcagggcatcgcagaaggtggtgtcctggtgcgactgctggttcttgccgttctcccaggtatgcgaagtag

SEQ ID NO: 4294 - DNA, 1878 bp, Pseudomonas aeruginosa
aatcctcggcctgcaacggctggccgtccaggcggatgcgccgggcgtaggtcatgtgcacgacgatgcgcagggcgctggcggtcagccggtcgagggcgcggaacagttggtagacgctggccaggtccggttgcagcccggcttggaccaattgatgagcggtgcggaacacggcggcgcgggtctctgcgctatgctggagcggaccatggccttgcagccacgcggcaaacgccggctcggccgccgcatgggcaagcaactcgtcctgactgggcagaatctgactcatggtgggtagcctccctagtggtgccttgcagtctaggcagcacacggcaaagggcgctgacctgcatcaagctccccgcccccgattcgttcaccctggccctgtacgaaggttccatggcattccacgatccccgaaaggtatcggggtgtcgacagagctctgacggaggaggctcgatggcatcactgacgtttctaggcgccgcccaggaggtcactggctcctgttatctgctggaaaccctcgatggcgtgaaggtcctgctcgaatgcggcatgcgccaggggcgccgcgaagccgacaacggcaaccgcgcgcccttccccttcgatcccgcgagcatcgacgcggtggtcatctcccacgcccacctggaccacagcggcctgctgccgcgcctggcggccgagggcttcaagggcccgatcttcgccaccgaggccacctgcgaactgctggaactcatgctgctggactccgcgcacatccaggaaaaggacgccgactgggagaaccgctggcgcaaccggatcggcaagccgagcatcaagccgctgtatacccaggccgacaccgaacgcgcgctcaagctgcgccggccgatcagcctcggcagcaccgtggcggtcgctcgtggcgtgcgggtgacctttcacaacgccgggcacatcctcggctcgtcgatcgtcgaagtgcaattccacgaccaggtgcaaccgcgccgcctggtgttttccggcgacctcggcaacacctgctcgccgttgatgcgcgcgccctcgccgctgagccgggccgacgtggtgatgctcgaatccacctatggcgatcgcgatcaccgcgacagcaacgacaccctggaggaactggcggcgattctcgaccaggcgcaccgcgacggcggcaacgtgctgatcccgtcgttcgccgtcggccgcacccaggacctgctctactacctcggccgcttctaccaggagggccgcctgccgcaacaggcggtattcctcgacagcccgatggccgcccgtgccaatggcatctacctgcgccacagcaacgagttcgacgaccgcgaccgcgagtacattcgcggcaccggcaccacccgcctggaggaatggctgccggtgctgcgcgtaacccgcagcgccgacgagtcgatggcgatcaaccggatcaagagcggcgcggtcatcatcgccggcagcggcatgtgcaccggcggccgtatcgtccatcacttcaagcacaacctctggcgcccggaatgccatgtggtattccccggcttccaggcgcgcggcaccctgggccgcaacatcgtcgacggcgccagcgcggttcgcgtgttccaccagcgcatcgcggtcaaggcgcagatccataccctcggcggcttctccgcccacgccgggcaatcgcagctgctcgactgggtcggtcacttcgcccaccgtccagcgctatacctgatacatggcgagcgggaaaagatggaagcgctgcagggcgcgatccgcgagcgtctcgactgggatgccgagataccggagcccggcgaacgcatcgagatctga

SEQ ID NO: 4295 - DNA, 1242 bp, Pseudomonas aeruginosa
agctttcgagatagcgggattcgtcgagcagaccttcctcggccaggcggtcgagggcaggatcgatcaactcggcagacgcgccacgctggcgcaacttgcgggaaagctcggcgcgcccgtgctcacggcgcgccagcagatccatggccgcccgccgcacggcgacgggcgtatcgagcacggtcgccattggcctcaatcggcttcggcgtcagccacttcttcggcgtcggccttcaccgggccgctcttggccagcaactggtcgcgaatggtcttctccagtaccgaaccgatttccggattgtcttccaggtacttggcggcgttcgccttgccctggccgatcttgctgccctggtagctgtaccaggcgccggacttctcgaccaggcccaattgcacgcccaggtcgatgatctcgccggtacggtagatgcccttgccgtagaggatctggaactcggcctggcggaacggcggggaaaccttgttcttcaccaccttgacgcgggtttcgctacccaccacctcgtcgccttccttcaccgcgccggtacgacggatgtccaggcggaccgaggcgtagaacttcagtgcgttaccgccggtggtggtttccgggttgccgaacatgacgccgatcttcatgcggatctggttgatgaagatgaccaggcagttggcgttcttgatattgccggtgatcttgcgcagcgcctgggacatcaggcgtgcctgcaggccgacgtgggcgtcgcccatctcgccttcgatctcggccttgggtaccagcgcggccacggagtcgacgatgatcacgtcgaccgcgttggagcgcaccagcatgtcggtgatttccagggcctgctcgccggtgtccggctgggagaccagcaggtcgtcaacgttgacgcccagcttgccggcatagtcgggatcgagcgcgtgctcggcgtcgacgaaggcacaggtggcgccctgtttctgggcctcggcgatcaccgagagggtcagggtggtcttgcccgaggattccggaccgtagatctcgacgatccggcccttgggcaggccgccgatgccgagggcgatgtccagacccagggagccggtggagatggccgggatcgcctggcgctcatggtcgcccatgcgcatgaccgcgcctttgccgaattggcgttcgatctgtcccagggccgcggccagggcgcgcttcttgttctcgtccattga

SEQ ID NO: 4296 - DNA, 3924 bp, Pseudomonas aeruginosa
cctgctcgcccaggtaacgaaggctttcgccgaggcgggcggccagtgcggtcaggtcggactccatcagggtcatcactgttctccagggtagaaacggaaagggactaccctacaccatcggcttttccattcagaagcagctttcggacaagcgcaaccgcgcgaaggcagcgaatgcgcgaacatgcgtgttccatcaccgtccaaggaaaggcacaccatgaacatcgcgccactcaaggtctctctgctctccctcgccctgctcctctcccccgttgccagcctccccgcccatgcggcctgcaccgccaacctggccctgcaacccgccagcagcctgcccgcgctcggcgggcgcctggtctaccacagctatatggagtacggggacggctcctcgaacctctacctgcacgatttcaagagcaagagcacccgccagctcaaccagcccggctggaacatcgaggacccgatgaatgcgcatttctccccggacggccgctacctgaccttcatgggccgccagaatggcgcctggcacgtgttcgcctgggccatcggcggtacccaggcgccgagcaacctgaccgcggccatcggcggtcgcaacgaggatccgaagttctccttcgacggccgccaggtcgtgctcaagcacgagggcgacatccgcctcgccaccctggtcttcaatggcgatggcagcgtcggcgtgagcgcctggaaagccgtgaccggcgacggctggagcaccgaggagtcgatgccgttcctcacaccctcaggcaagtacgtggtctacgcgacaggagccggcgacagcctgcgggtggtgcgcaggaacctggagaacggccaggtcagcgccctcgccaccccggccgcggggggccgcgactattacccggtggtacgcgactacaccgcctacttcctctcgcgtacccagccggccggcaacgaccagttggccatggtcgtacccaacagcccgcccggcaccccggcgatcctgccgctcaaccactgccagggcgacaattccgacgccgcgccggtgaacgaggactacctgatcttctccagcacttcgttcgacccgacctacagcctgctcctcggcgacatcgccgcggcgcgggtctggcgtctcgacccggcgcagatcaacctgcccgacggtcggcagaagctcggcgccagctataccgcggcacgctgaaagcagcccgcacaggcgcggacctgagggtccgcgccggttccgaacggacccgacacaggccggcgaatcgggttaacattaccctcttttgcaccgtccaaagcccgcttccgaaggcccgtatgaccgacctctcccagcacacgccgatgatgcagcagtacttcaaactgaagcatcagcaccccgaccaattgatgttctatcgcatgggcgacttctacgagctgttctacgaggacgcgaagaaggccgccaaactgctcgacatcaccctgaccgcacgcggccagtccggcggcaaggcgatcccgatggcaggcattcccttccattccgcggagggctacctggccaagctggtcaagctcggcgagtcggtggcgatctgcgagcagatcggcgatccggccaccagcaaggggccggtggagcgccaagtggtgcggatcatcactcccggtacggtgagcgacgaagcgctgctcgacgaacgccgcgacaacctgctggcggcgatcctcggcgacgagcgcctgttcggcctcgccgtgctggacatcaccagcggccgcttcagcgtccaggagataaaaggctgggaaaccctgctggccgaactggagcgcctcaacccggccgagctgctgattcccgacgactggccacagggcctgccggcggagaagcgccgcggcgtacgtcgccgcgcgccatgggacttcgatcgcgactcggcgcacaagagcctctgccagcaattcggcacccaggacctgaaaggcttcggctgccagaacctgaccctggccatcggcgccgccggctgcctgctcgcctacgccaaggaaacccagcgtaccgccctgccgcacctgcgcagcctgcgccacgaccgcctcgatgacacggtgatcctcgacggtgccagccgccgcaacctggagctggatatcaacctcagcggtggccgcgagaacaccctgcaatcggtggtcgaccgctgccagaccgccatggccagccgcctgatgagccgctggctgaaccgtccgttgcgtgaccgcgcggtactggaagcccgccaggagtccatcgcctgcctgctggaacgctaccgcttcgagaacctgcaaccgcagctcaaggaaatcggcgacctcgaacgcatcctcgcccgcatcggcctgcgcaacgcccgccctcgcgacctggcgcgcctgcgcgacgcgctggcggcgctgccggacctgcagaacgccatgaccgaactggaagcgccgcacctgcaggcgctggccaccaccatcggcacctatcccgaactcgccgaactgctggccaaggcgatcatcgacaacccgccagcggtgatccgcgacggtggcgtgatcaagaccggctatgacgccgagctggacgagctgcaggcgctgagcgaaaacgccgggcaattcctgatggacctggaagcgcgcgagaaggcccgcaccggcctgcccaacctgaaggtcggctacaaccgcatccatggctacttcatcgagctgccacgggtgcaggccgaacaggcgccggccgactacatccgccggcagaccctgaaaggcgccgagcgcttcatcacgccggaactgaaggccttcgaggacaaggcgctgtcggcccagagccgcgccctggcccgcgagaaggcgctctacgaagagctgctggaacgcctgatcggccacctcgctccgctccaggacagcgcctcggcgctggcggaactggacgtgctggcgaatctcgccgaacgcgcgctgaacctcgacctgaatcgcccgcggttcgtcgaacacacctgcctgcacatcgagcaaggccgccatccggtggtcgagcaggtgctggagacaccgttcgtggccaacgacctggcgctggatgccgacacccggatgctggtgatcaccggtccgaacatgggcggtaaatccacctacatgcggcaaaccgcgctgatcgtgctgcttgcgcacatcggcagcttcgttccggctgcacgctgcgagctgtccctggtggaccgcatcttcacccgcatcggctcgtccgacgaccttgccggcggccgctcgaccttcatggtggagatgagcgaaaccgccaacatcctgcacaacgccaccgacaagagcctggtgctgatggatgaggtcggccgcggcaccagcaccttcgacggcctgtcgctggcctgggcagcggccgaggacctggcccggactcgcgccttcaccctgttcgccacccactatttcgaactgaccgtactgccggaaagccagcccgcggtagccaacgtgcacctgaacgcgaccgagcacaatgaacgcatcgtgttcctgcaccatgtactgccgggaccggcgagccagagctacggcctcgcggtggcccagttggccggcgtgccggccccggtaatccagcgcgcccgcgaacacctcaagcgcctggaaaccaccagcctgccgcacgagatgccgagccagcagagcggcaagcccgcctcgccgatgcagagcgacctgttcgccagcctgccgcacccggtgatcgatgaattgtcgaggatcaatcccgacgatatcagcccgcggcaagctctcgatctgttatatgcatggaagatgcgggtctga

SEQ ID NO: 4297 - DNA, 327 bp, Pseudomonas aeruginosa
aaaatgaccttcgtcgtcaccgacaactgcatcaagtgcaaatacaccgactgcgtggaagtctgcccggtagactgcttctacgaaggacccaacttcctggtcatccatccggacgagtgcatcgactgcgccctgtgcgagcccgaatgtccggcccaggcgattttctccgaagacgaagtgccggagaacatgcaggaattcatcgagctgaacagcgagctggcggaaatctggccgaacatcaccgagaagaaggatgccctgcccgacgccgaggaatgggacggcgtcgccggcaagctccagcatctggagcgctga

SEQ ID NO: 4298 - DNA, 420 bp, Pseudomonas aeruginosa
ggttttccgtcactggaacagcgcgtcactcgacaggccattcttctccaggatctcccgcaggcgcttcagcgcctcgacctggatctgacgaacccgctcgcgggtcaggccgatttcctggccgacctcttccagcgtgctgctttcgtgcccgcgcaagccgaagcggcgaatcaccacctcacgctgcttgtcggtgagttccgtcagccactggtcgatgctttcgctgagatcgtcatcctgcagcagctcgcacgggtcggtggggcgatcgtcggtgagcgtatccagcagggtcttgtccgagtccggaccaagagagacgtctaccgaagtcacccgttcgttcaggccgagcatgcgcttgacctcggcgaccggcttctccagcaggttggcgatttcttcgggtga

SEQ ID NO: 4299 - DNA, 1686 bp, Pseudomonas aeruginosa
atccgttgtccaggcgctgcgggtgcagcgggcggtccagcgtcagggaactgctggcgccgctcttgtcctggtcgggggcgatcactacgcaatcggcatgatccgccagcgcgtcgtaaagcgcggcgataccgggtgcggtcaccccgtcgtcgttggcaatcagtatgcgcatgggttttccgtctgccctgtcggtaccaggtcgaggatttcacgcaccactacggtggcgaaacaaccggccggcaggacgaattccagttgcagaacatcaggttccggataatgccacgccagcccctggatggggagccgcaggatgcgccgttcgtgcgccatgcccgccttcgccagccagcggcagagcgccggctcgcgcccggccagggccagctcgcgttcgaggacgccggcgccgctcggcggatcgccctcgccccagagcggtccggtggggtgcaggtcgagggcggccagacgggcatcgcggcattcttcctcgccagcgaggaaaaagctgcggctgtcggtaaaggccagcaggtcaccgaccgctgcccggttccagctaccctccgcgacccgctcggcgagcaggcgattgaacaggtagctgcgcccggcggaaaggaagcgcgaacgcaggttgcggttcgccggcagcaggtcctgttccgcgcaactgcgcgcgtcgaccaggttgccgccgccgtggccgaagcgttgcaggccgaaataattgggcacgccgtccgcggcgatacgttccaagcgcgcgtcgagaagggcacgctccgcccgcagcccggtcagacgcagggtgaagccgttggcggcatgcgcgcctcgctgcaacttgcgcgaatgacgggtgcagcgaagaatccgcaggtccgcgccctcggctgcacccaggtcgggatcggccttgcccggcaggtgcaggctgaaccattgccgggtcagggcctggcggtccttcaacccggcgtagctgacgttcttctgctgcacgccggcggcgcggccgaggcgacgggccgcctcctcggtgttcaatccgcgcttttccacccacaaccagaggtgctcgccttcaccgctgaggggaatgtccagcacctcgtcgacctggaagtcctcggccacggccttgagcaccgcctcgccgcaggctgccccatgggcgcgcggcccgagcaggtcgagttcgccgagaacgctcatcgggccatcagcaaagcgaccgcatgtacagcaatgccctcttcgcgtccggtgaaacctagccgctcggtagtggtggccttgacgttgacctggtcgaccgcgacgccgaggtcctcggcgatcaacccgcgcatggtctcgatgtgtggcgccatcttcggcgcctgggcgacgatggtggcgtcgacgttgccgaccttccagcccttctcggcgacgatggcgaccacgtgtcgcagcagcgcgcgactgtcggcgcccttgaaccgcgggtcggtgtccgggaagtgcttgccgatgtcgcccagcgccgccgcgccgagcagcgcatcggacaaggcgtgcagcagcacgtcgccgtcggagtgggcgaccagcccatgtttgtggggaatgcgcacgccgccgagggtgatgaagtcgccctcgccgaagcgatgcacgtcgtag

SEQ ID NO: 4300 - DNA, 999 bp, Pseudomonas aeruginosa
ccatggccaattcgcatgaaaaaacgccctggttggaatcagggcgtgattctaccccggatcgggacaggcttcaggtatcgcggatcaaccgttgagaaccccggcatgatggcgcaggtgatcctcgatgaaactggcgatgaagtagtagctgtggtcgtagcctggttgcagacgcagctccagcgggtggccggccttgtccgccgcattgcgtatcgcttccggcttgagctggacggcgaggaagtcgtcgcgctcgccctggtcgaccaggatcggcaagcgttcggacgcaccctcgagcaacgcacaggcatcccactcgcgccaggccgccgggtcctcgcccaggtagcgggagaacgccttctggccccagggacaatcgctcggatggcagatcggcgcgaaggccgacagcgacaggtagcgccccgggttgcgcagcgcgcaaaccagcgcgccatgcccacccatcgagtgcccgctgatgccgcgccgccgggacaccgggaaatgcgcctcgatcagcgccggcaactcgtgtaccacgtagtcgtgcatgcggtagtgcgcggcccagggctcctgcgtggcgttcaggtagaagcctgcgcccaggccgaagtcccaggcgccgtcgggatcgccggggacaccgctgccgcgcgggctggtatccggcgccaccagtaccaatcccagttcagcggcgacccgctgggcgccggccttctgcatgaagttctcgtcggtacaggtcagtccggacagccagtacagggccggcagcgccgcctccggctcggcctggggcggcaggtagatggcgaagaccatctcgcagttcagggtccgggaaaaatgacggtaacgctggtgccagccgccgaaggtcttctggctgccgatcagttcgagggaatccttcacgtgacctccgtgaaacggtcgtggcgagccgcagggcccgccgcgacggcttgtcagtaa

SEQ ID NO: 4301 - DNA, 201 bp, Pseudomonas aeruginosa
ctcggcagctcgctgcgcccgcgcaccccgccgaacgccgaaccgcgccagacgcggccggtgaccagttggaacggccgggtgctgatttcctggccggcaccggcgacaccgatgatcaccgactcgccccagcccttgtggcagcattccagcgcggcgcgcatcaactgcacgttgccgacgcactcgaaggagtag

SEQ ID NO: 4302 - DNA, 318 bp, Pseudomonas aeruginosa
tccttcggattgatgaagtcggtggcgcccagttccctggcgatatcgaacttgcccgggttgatgtcgaccgcgatgatgcgcgcggccttggccatcttcgccccgatgatcgctgccaggccgatgccgcccaggccgaagatggcaacggtagcgccctcttccaccttggcggtgttcagcacggcaccgatcccggtggtgacgccgcagccaagcaggcagaccttctccagcggggcatccttgggaatcttcgccagggagatttccggcagcacggtgtattcggagaaggtcgagcagcccatgtag

SEQ ID NO: 4303 - DNA, 1311 bp, Pseudomonas aeruginosa
agcgggatgacatggtcgcccacctgcagggaggtcacgccctcgcccaccgcttcgacgatgccgccaccttcgtggcccaggatgcacgggaacaccccctcggaatcctggccggacagggtgtacgcgtcggtatggcagacgccggtggcgacgatgcgcaccagtacctcgcccttctgcggcggcgccacatccacctcgacgatttccaacggcttgttgggggcgaaggcgacggcggcacgggacttgatcatctgggaactcctgaacgatggaagccggcgggccgctaagcgacccactgaaacggaaagtgtagaaaaccgcgtttcaaggaataatcaggcaataatcaaaacattattgccatacagggacaatccagatgaatcgctgggaaggactcgacgaattcgtcgctgtcgccgaaaccgggcagttcaccgcggcagccgaacgcatgggcgtttcctcgtcgcacatcagccgccaggtcgcccgcctggaggagcgcctgcagacccgcctgctctaccgcagcacccggcgagtatcgctgagcgaagccggacagaccttcctgcaacattgccagcgcctgcaggacgcccgcgacgaagccctgcgcgcggtcagcgacctctccgcggagcccaagggcctgctgcgcatgacctgcgcggtagcctacggcgaacgtttcatcgtgccgctggtgaatgccttcatggccgactatccgcaactgcgggtcgacatcgagctgtccaaccgccagttggacctgctccacgagggcttcgacctggccatccgcctcggccgcctgagcgattcgcgattggtcgccacacggttggcaccacgcgtcatgtacctctgcgccaccccggaatacctgcgccgccacggcactccgcagtcgccggcggaactcggccagttcaactgcctgatcggcagcagcgacctgtggagcttcctcgaggacggccgggaaacccagcaccgggtccagggcaactggcgctgcaacagcggccaggcggtgctcgacgccgccctgcgcggcttcggcctgtgccagctgcccgactactatgtgatcgagcatctgcgcagcggccgcctggtctccctgctggaaggccaccagccgccgaatacagcggtatgggcgctgtacccgcagcagcggcacctgtcgccgaaagtcaggcaactggtggactatctcaaggaaggcctggcgcaatcccatccgggactcgccggggagaaaaacctgcgctgaagcagtaa

SEQ ID NO: 4304 - DNA, 1242 bp, Pseudomonas aeruginosa
acttggcggtttcccgttccacccgctatcgattcaaggaagtcgcatgtctgccttcaatgcgtttcgccaacgctacctggtgaggttctggtcgccgctgccggcgctggtcgccctcggcgtcgcctccgcctactacttcgcgctcaccggcaccttctgggcggtgaccggcgaattcacccgctggggcggccacgtgctgtcctggttcggctaccagccacaggactggagctacttcaggctgatcggccttcaaggcacgccgctggaccggatcgacggagtgatgatcatcggcatgttcctcggcgccctgtgctgcgccctctgggccggcaacgtcagcctgcgctggccgaccagcaaacgtcgcctgctgcagggtctggtcggcggtatcgtcgccggcttcggcgcgcgcctggcgatgggctgcaacctggcggcgttcttcaccggtatcccgatgttttccctgcacgcctgggccttcatgttcgccaccgtcggcggcgcctggatcggcgtgaagatcagcctgctgccgttcctgcgcacaccgctgaaagtcggcgccacggccagcgccctgcccagcgccgaaagcctggcccgacgcgcacgcctgcaggcccgcctgggcctggcggtgctggcgctcgccgcgctgttcgccgcctggcgcttcgaggtatcgctggtgctgggcatggcctgcctgttcggcctgctgttcggcggcctgatcgagcgcgcgcagatctgcttcaccagtgccgcacgggacctctggaccaccggccggacccgcgccgccttcggcatcctgctcggcatggcggccgcctgcatcggtaccttcgccgcgatccgcctgggcgtcgcgccgaagatcttctggatgggcccgaatgcgatcatcggcggcattctcttcggcatcggcatcgtcctcgccggcggttgcgagaccggctggatgtaccgctcgatggagggccaggtgcacttctgggtggtcggcatcggcaacgtcatcggcggaaccctggtggcgatcttttgggaccagttgggcacccgcctcgccctgccctatcccaagctcaacctgctggaaagcttcgggcccggcaacggcctgctattgaccttcgccggcctggccctgtgcctgctgctggtgcaactgaacgcctcccgattcacccgaccgcggaaaccgaaccatga

SEQ ID NO: 4305 - DNA, 1722 bp, Pseudomonas aeruginosa
cccgtacgtattcttcgcagacctgcatggccaggtcgcgcgactccagcacgttcatgccgccgaacagcacgaacggcaggtcgttgccgatctggatatcgccgacgcgaacgatcttctgtgccatgctcaggccttcccggaatatttcagcgcggcgttgacgaaaccgctgaacagcgggtggccatcacgcggtgtggaggtgaactccgggtggaactggcaggcgacgaaccacggatgctccggggactcgaccacttccaccagggcgccgtcgccggagcggccggaaatcttcaggccggcctgttccagttgcggcagcaggttgttgttcacttcgtagcgatggcgatggcgctcgacgatcacgtccttggcatagcaatcgtgcaccagggtgccggtctgcagctggcactcctgggcgcccaggcgcatggtgccgcccaggtcggaagcttcggtgcggatctcggtggcgccggtcgcgtcctgccattcggtgatcaggccgaccaccgggtggccgctggacttgtcgaactcggtggagttggcgtcgctccagccgagcacgttgcgggcgtattcgatgaccgcgacctgcatgcccaggcagatgcccaggtagggaatcttgttctcgcgggcgtactgcacggtgctgatcttgccttccacgccgcgcaggccgaagccgcccgggaccaggatggcgtcgacgccttccagcaggctggtgccctgctgctcgatgtcttcggagtcgatgtagcgcaggttgaccttggtgcggctctggatgccggcgtgggtcatcgcctcgatcagcgacttgtacgcgtccagcagttccatgtacttgccgaccatggcgatggtgacttcacgctcggggttgagcttggcatcgaccacccggtcccattcggacaggtcggcctgcccgcactccaggccgaagcgctcgacgacgatgtcgtccaggccctgggcatgcagcaccgacgggatgcggtagatggtgtcgacgtcttccagggcgatcaccgcgtgctcctcgacgttggtgaagagcgcgatcttgcgccgcgaggagacgtcgatcgggtggtcggaacggcagaccagcacgtccggttgcaggccgatggagcgcagctccttgaccgagtgctgggtcggcttggtcttggtctcgccggcggtggctatgtacgggaccagggtcaggtgcatcagcatcgcgcgcttggcgccgatctcgacgcgcagttggcggatcgcctcgaggaacggctgcgactcgatgtcgccgacggtgccaccgatctccaccagggcgacgtcggcatcgccggcgcccttgatgatgcgccgcttgatctcgtcggtgatgtgcgggatcacctgcacggtggcgcccaggtagtcgccgcggcgttccttgcgcaacacgtccatgtagacgcggcctgtggtgaagttgttgttctgggtcatggtggtacgaacgaagcgctcgtaatggcccaggtccaggtcggtctcggcgccgtcctgggtcacgaagacctcaccgtgctggaacgggctcatggtgcccgggtccacgttgatgtaagggtccagcttgagcatcgtgatcttcaggccacgcgcttccaagatcgcagccagagaagccgaagcgatgcctttccccaatga

SEQ ID NO: 4306 - DNA, 441 bp, Pseudomonas aeruginosa
gcgggacgctcccagacgaacggtcccgccgccgcccgccagtccgccggcaaccaccagatccgccccgcgccgcgacgcagctcgccgctctccaggcgccagatcgggtcggcatcgtcgccggcatcgcgcaacgactcccagccggcccagtggtcactgtccggcaaccgcgtcagctgccccagccaggcccgcagcaggttgcgctggcgcgcagcgctgaggcggcgcagaggctccagggcgatccggggcagatccagccagtccggccaatccagttccgagggttggcggcaggcccggaggtcgatggcggccagttcagccagcaggtcttcggcctcgcgcagatgcgccgcgcagcgcgccatgccggcgacggcctgcggccagtgggaggcgagacgcggcatgatctcccggcgcaggtag

SEQ ID NO: 4307 - DNA, 1023 bp, Pseudomonas aeruginosa
gccgtcgtccagcagcggcaagagggttgcggccagcgcttgcggagtcgcggcgtcctggatcagctccggcaccaacaggcgtccggccaacaggttcggcagggagatgtacgggcttttcaccaagcgcttgagaatccgatacgtcaacccggcgacccgataagccaccaccatcggccgcttgtagagcagcgcctcgagagtcgcggtgccggaggcgatcagcaccgcatcgcaggcggcaagcgcttcatgggacgcaccgtcgagcagcgtcagcggcagaggctcgcggccctggagcatctgctcgatctgttcgcgccgtgcagcgctggcgcagggcagcacgaaacgcaggcccggccgttcgacgagcaggcgctgggcggtgtcgaggaacaaggcgccgagcttgccgacctcgccgccgcgactgcccggcatcagcgccagcacctgtccgtccgccggcaatccgagccgcgcgcgggccgcagcgcgatccgcctgcaggggaatggtgttggccagggggtggccgacgaaacgcacgggcaccccatgctcttcgtagaaacgtgcttcgaaggggaacaatgccagcatcaggtcgcaggcttcgcgaatcttcagcacccgcttctgccgccaggcccacaccgaagggctgacgtaatgcacggtgcgcaggccagcctggcgcagcttgtgttcgacgccgagggtgaagtcgggagcgtcgatgccgatcatcacatccggccgggcctcgatgagcgtgcggatcaggcgcttgcgccgtcgcaacaactccggcagccggcccagtacttcgaccaggcccattaccgacaggcgctccatgggaaaatagctggacagcccttcggcctccatgcgcggcccaccgacgccgatgaactcgatatccgggtgccgcgcccgcagcgcctgcatcagtccggccccgaggatgtcgccggaggcctcgccggcgaccagggctacgcgtaa

SEQ ID NO: 4308 - DNA, 969 bp, Pseudomonas aeruginosa
tccgtcagccatggctcagcgggtgatgccgcgggttgcgctctggatggaatcacggaacaccgcgacctcggggaactgggcagcgctttcggccagctcggccagggcttcctcgacggtatgtccctggcgatagaccaccttgtaggcacgccgcagggcatggatggcctcgctgctgaagccgcgccgacgcatgccttcgaagttcatgctgcgggcttcggccgggttgccgaagaccgtcacgtaggccgggacgtccttgccgatggcgctgcccatgccggaaaagctgtgcgcgccgatccggcagtactggtgcaccagggtgtagccggacaggatcgcccagtcgtccacgtggacatgcccggccagcgccgtgttgttcaccaggatgcaatggttgccgatcacgctgtcatggccgatgtgcgcataggccatgatcaggttgtggtcgccaatggtggtttccgcgcgatcctggacggttccgcgatggatggtcacgccttcgcggatcacgttgtggtcaccgatcaccaggcgcgtcggctcgcccttgtatttcaggtcgggagtatcctcgccgacgctggaaaactggtagatgcggttgtgcttgccgatcttcgtggggcccttgagcaccacgtgcggaccgatcaccgtcccttcaccgatctccacttccgccccgacgatggaccacgggcccacctggacgtcagccgccagcctggcgctcggatcgatgatggcgcgaggatcgatcaaactcatagtttgcgttccgcacagatgatttcagccgagcataccggcttgtcgtcgacggtagcgtggcagtcgaatttccagatgctgcgcttcacgctgatgaacttggcgtgcagttgcagttggtcgcccggcaggaccggctggcggaagcgcagcttgtccgaaccgacgaagtag

SEQ ID NO: 4309 - DNA, 1128 bp, Pseudomonas aeruginosa
ggtcacggcagccaggcgtttttccagctgctgaagtcgacgcgccatgtcgtccagttgacgaatgcgcgcggcgctttttttccattcggccgccggttgcatggcggtaccggaggaatacgatcccggctcggtgatcgagcgggtcaccatggtcatgccggtcacgaaaacgttgtcgcagatctcgatatggccgaccaggccaacgccgccggcgagcatgcaatgcctgccgatcttggcgctgccggaaatgccgacgcaagcggccatggcggtatgatcgccgatctgcacgttgtgcgcgatcatgatctggttgtccagcttcacaccgttgccgatcagcgtatcggacagtgctccacggtcgatggtggtgttcgcgccgatctcgacgtcgtcaccgatggtcaccccgccgatctgggcgatcttctgccagacgcccttctcgttggcgaaaccgaaaccttcgccgccgatcaccgcgcccgactggatactcacccgcgcgccgatggtgacgtcgtggtagagcgtgacccgcggcgccagccagccgccttcgccgatcacgctacgggctccgatcacgcagtgcgcgccgatgctgacgccagcgccgatgcgggcgccactctcgatcaccgcataggcgccgacgctggcgctcggatcgacctcggcgtccgccgcgacgatggcggtaggatggataccggcagccgccttcggtttgcgatcgaacaggtgcgacaggctggcataggccaggtaggggttggccaccaccagcgcggtaccggcgaacccgtcggcgtcggcagccgtcagcaggacggcgccggcacggctttcgggcaggtacttgcgatactgcgggttggccaggaagctcagctgagccggtccggcctcctgcaaggtcgccaggccctggatcggcaggtccgcgtcgccacggacttccgcgccgacatgcgcggccagctggcccagggtgtaggacaaggtactcatcatcaacgcagctggttcatccgctcgatcacctggcgggtgatgtcgtattgcggcttgacgtcgaccacggcgccacgttcgatgaccatgtcgtaa

SEQ ID NO: 4310 - DNA, 618 bp, Pseudomonas aeruginosa
ccgctccgggccttgccctcgccgcgcaccgccagttccagggcaacatccagcacttcgccgtcgcgcagcaccttgagctggacgcgctgcccgggacgggcacggacgctgtccaccacctgctgccagtcgtcgacggcgatgccatcgatgctctgcaagcggtcgccgagcttcagcccggcggcctgcgccggccccttggggtcgagttcggccagcaccggcggcaaggccggccgccagggccggatgcccagcgaggcgatgggatcgggattgtcctcgcccttcagccagccatccagacgcacctggtgggtggaatcgacattcgagcctttttcctgcacccgcacttccagcgtaccgctctcgccgagacggcgaaccagctgcaggttgaccccgttccagccggtgacgggctcgccatccaccgccagcagctcctgcccggcctccaggccggcctgggcggccaggctctccggcgccacggaaccgatgaccgggcgtacctgctggctaccgagcagggcgacgacccagaagaacagaatcgccagtaggaaattggcgatgggaccagccgcgacgatggcgatccgctga

SEQ ID NO: 4311 - DNA, 1461 bp, Pseudomonas aeruginosa
agcgcactcatctcctacctccaggccgtccgaagactagccggcgtgccgggtcaaccattgcccggcgaccgaacgcgcgcggcgatcggcagccaggacctgatcgagcgattcgactgcggtcaccgcctcgcggttcagcacgtcctcgatgataaccgcgatgtcgctgaagcggatgtgccgctcgagaaatgcggccacggccacctcgttcgcggcattcagcatggccggggcgctgccgccggtttccgcggcctggctcgccaggcgcaggcaggggaagcgctgctcgtcggggcgctggaaatccaggcgaccgacggcgaacatatccagcggcgaaacgccggaatcgattcgctccggccaggccatggcataggaaatcggcgtgcgcatgtccggattgccgagctgggcgatcaccgaaccgtcgacgtagtccaccatcgagtggatcacgctctgcgggtggatcaccacctcgacctggctcggctgggcgtcgaacagccagcacgcctcgatcagttcgagccccttgttcatcatgctggcggaatcgacggaaatcttccgccccatcgaccagttcgggtgcgcacaagcctgctccggcgtcaccgaagcaagctgctccagcggcgtctcacggaacgggccgccggaggcggtcaagaggatccggcgcacgccgacccgctccaggccatcggcataattgcgcggcagcgactggaagatcgcgttgtgctcgctgtcgatcggcaggagcaccgcgccgctgcgcttgaccgcctgcatgaacagcgcgccggacatcaccagcgcctccttgttggccagcagtacgcgcttgccggcctcgacggccgccagggtcgacggcagcccggcggcgccgacgatggccgccattaccatgtccacttcgggcgcgctggccacttcgcacaacgcctgctcgccgaacagcacccgggtgcggacacccgccgcggcgagcaagccctgcaaggcaatcgccgcggcctgctccggcaccaccgcatagacggggcggtgcctgaggcacagcgcctcaagttcggccaggcggctgaagccagtcagggcgaaggcttcgtaacgatcgggatgacgctggacgacgtccagggtgctcaggccaatcgagccggtcgcgccgagcacgctgatccgctgcggtcgactcatggcgcaccccagccagcggcccagagcagggccgcgaacaccgggatggctgccgtcaggctgtcgatgcgatccagcacgccaccgtggccgggcagcaggttgctgctgtccttgattccggattggcgcttgaacatgctttcggtaaggtcgccgacgatcgagacgaacaccaccagcgccgcgccgagcagggccaggagcagcgcgccgagggaccagccgcggtag

SEQ ID NO: 4312 - DNA, 696 bp, Pseudomonas aeruginosa
tcattctcaaccctcctcgatcagggtgccttcggcaccaccaacaacaatattcagcaatgcgcccggcttgttcatgttgaacacccgcagcggcatgttctggtcacggcacaggcagatggcggtcaggtccatcacgccgagcttgcggtcgagcacttcatcataggtcaggcgctcgaacttctcggcattcgggtccttgaacgggtcggcagtgtacacgccatcgaccttggtagccttaaggaccacgtcggcgtcgatctcgatggcgcgcaggcaagccgccgagtcggtggtgaagaacgggttgccggtaccggcggagaagatcaccacctcgccaccgccgaggtggcgcatggccttgcggcggtcgtagtggtcggtcacaccgaccatggagatcgccgacatcaccagcgcggggatgttcgagcgctccagcgcatcgcgcatcgccaggccgttcatcacggtggccagcatccccatgtggtcgccggtcacccggtccatgccggccgcggacagggccgcgccgcggaacaggttgccgccgccgatgaccaggccgacctgcacgccgatcccgaccaactggccgatttccagcgccatgcggtccagcaccttgggatcgatgccgaactcctccgagcccatcagggcttcgccgctcaactttag

SEQ ID NO: 4313 - DNA, 1359 bp, Pseudomonas aeruginosa
cggccgggccgtcgtgggcggagacgactttgcgcctgcgttgcgtgcgagcccgccgagcgggccggcaacgcggaagctgccccgaacgcttccccatttgacgaagaggccgcacgcatcagcgggcagcctcttccggggcgacagtcgaaaccgtctttgttactgcttggtggcggctacttgagcggcaacttcggcagcgaagtccacttcggccttctcgatgccttcgcccacttcgtaacgaacgaaggaaacgatttcggcgccggcctgcttggccaggtcgccgaccttcacttccgggttcttcacgaaaggctgctcgaccaggctcgcttcggcgaggaacttgctgatgcggcccttgaccatgttctcgacgatgttctccggcttgccggcgatcttgtcggcgttcagcgccaggaagatttccttctctttcgcgatcgcttcttcggaaacttccgaagcgctcaggaactgcgggttgctggcggcgacatgcatggcgatgtccttggccagttccgggttgccgcctttcaggttgaccacgacaccgatgcggtggccgtgcaggtaggcgccgaccacgtcgccctcgacgcgggtcaggcggcggatgttgacgttctcgccggtcttggcgaccagggccagacgagcttcctcacgtgcttcgaccagcggagcggcgtcggtcagcttctcgttgaaggccttttccaggctctcggcgacgaagcccttgaagtcgtcctggagggccaggaagtcggtctgggagttgacttcgatgatcacggcggccttgttgtcggcagcgatcttgacggcgatcgagccttcggcggcaatgttgccggccttcttggcagccttgatcgcaccggcagcgcgcatgtcgtcgatggccttctcgatgtcgccgccagcggcggtcagcgccttcttgcactccatcatgcccaagccggtacgctcgcgcagttctttaaccatggctgcagtaatttctgccatttcgaaatcctcttgagtggtagctctcaaaaaacctttgtgcccggcctgccgggcagaaactcaaaggtggcaaaaagggggcctagcccccttcctgcgcaccgtcggacgtctgaacgtcccggaatcagccttcggcggattcggccggcgcttcctcgacgaactcgtcggcgctggtggcagcgccctgcttgccgcggattaccgcttcgcccatcgagttcaggtagagttgcacggcgcggatggcatcatcgttaccgggaattacatagtcgacgccttccgggctgctgttggtatcgacaacgccgatga

SEQ ID NO: 4314 - DNA, 1176 bp, Pseudomonas aeruginosa
gcctccacgcatcccaatgaccaacccttgcgggcacccaggccatcgtgtcgatgcatgtgtgggtttgtgctccggaaaaggccgcagcctcggagcggggcgctttataccataaccgtggacgcagtgaaacccgccgcggatggccgggcgggagtagatcggtcggtcaggtctgctagaatcgcgtattccttattcatgcgtgcttgcacgcccgaagagaattcgcatgaccgtcaccatcaagacgcccgacgatatcgagaagatgcgcatcgccggccgcctggccgccgaagtgctggaaatgatcggcgaacacatcaagcccggcgtgaccaccgaggagctggatcgcatctgccacgactatatcgtcaacgagcagaaggcgattcccgcccccctgaactacaagggctttcccaagtcgatctgcacctcgatcaaccatgtggtctgccatggcatccccaacgagaagccgctgaaggaaggcgacatcctcaacgtcgacatcaccgtcatcaaggacggctaccacggcgacaccagcaagatgttcctggtcggcaagaccccggaatgggccgaccgcctctgccagatcacccaggaatgcatgtacaagggcatttccgtggtgcgtccgggcgcgcacctgggcgatatcggcgaaatcatccagaagcacgcggaaaagaacggcttctcggtggtccgcgaatactgcggccatggcatcggcaaggtgttccacgaggagccgcaggtcctccactacggtcgtgcgggtaccggcatcgagctgaaggaaggcatgatcttcaccatcgagccgatgatcaaccagggccgcccggagacccgcctgctcggcgacggctggaccgcgatcaccaaggaccgcaagctgtccgcgcaatgggagcacaccgtgctggtcaccgccgatggctacgagatcctcaccctgcgcaacgacgaaaccttcccgcgcacctcggcagcctgatccggcccggcttttgctgccagccgtgcgcctcgacgccccgccccattccggcggggccgacgccccgattcggcgcagcgcgcgcaccaatacagcgcaaaaacgcaccaagacggggcgctcgcgtatcgaacccaaccgctagcagataa

SEQ ID NO: 4315 - DNA, 489 bp, Pseudomonas aeruginosa
tcaccaccctcatggaatgccgcaccatctgcggccctgacagcctgcgccagcgcatgctgcgggttaccggcagcgcgcacatgtggccgagcaaggagttcttcctggccaaacgccacgaacagcagcgccgccacgccaagtacaacgacaccgagtacaacctcgagcccaacgtcaagggctcccccggcggcctgcgcgacatccagaccatcctctggatggcccgccgccagttcggcagcctcaacctgcacgccctggtgcgcgaaggcttcctggtggaaagcgagtgcagcatgctggcttccagccaggagttcctctggcgggtccgctatgccctgcacatgctcgccgggcgcgccgaggatcgcctgctgttcgatcaccagcgcagcatcgcccgtctgttcggctacgaagacaacgacgtcaagctggcggtcgaacgcttcatgcagaagtactaccgggtggtga

SEQ ID NO: 4316 - DNA, 282 bp, Pseudomonas aeruginosa
ccatctccaccgacgcgctgcgccaggtctcggtgctcgaagtcatcgcccccgaccgccccggcctgctggcgcggatcggcggcatcttcctggatttcgacctgtcggtgcagaacgccaagatcgccaccctcggcgagcgcgtggaggacgtcttctacatcaccgatgcgcgcaaccagccgctcgccgaccccgacctgtgcaaacgcctgcaggccgccctggtcgagcagctgtcacaagacaacggacgggacaccctgcctacccggataa

SEQ ID NO: 4317 - DNA, 2865 bp, Pseudomonas aeruginosa
acttctgagaagccttgccaacgccatgaataccgcactcgacaacctgcaaccctaccccttcgagaagctccgcgccctgctcggcggcgcccggccgcccgcgacgctgaagccgatcgcactgtccatcggcgagcccaagcaccgctcgccgagcttcgtcgccgaaaccctggcggagaacctggaccagctcgcggtctacccgaccaccctcggcctgccggccctgcgcgaagccatcgcgcgctggtgcgagcggcgcttctcggtgccggccggctggctggatgcggcgcgccacgtactgccggtgaacggtacccgcgaggcgctgttcgccttcacccagaccgtggtccgccgcagcgagcccggcgaggcgcccggcctggtggtcagcccgaacccgttctaccagatctacgaaggcgcggcgctgctcgccggagccgtgccgcattacctgccctgccgcgaggaaaacggcttcaaccccgacttcgatgcggtcgacgaggcgacctggcagcgctgccagattctcttcctctgctcgccaggcaaccccaccggggccctggtaccgctggagaccctgaagaagctgatcgccctggccgaccgctacgacttcgtgatcgccgccgacgagtgctacagcgaactttacttcgacgaaaacgccccgccgcccggcctgctcaacgcttgcgccgagctgggccgcacggacttcagccgctgcgtggtgttccacagcctgtccaagcgctccaacctgcccggcctgcgctcgggcttcgtcgccggcgacgcggagatcctgaagaaattcctcctctaccgcacctaccacggctgcgccatgccggtgcagacccagttggcgagcatcgccgcctggagcgacgaggtccatgtgcgcgccaaccgcagcctctaccgcgagaaattcgacgccgtgctggcgatcctcgacggcgtgctcgacgtacagcgcccggacggcagtttctacctgtgggcacgtaccccggtggacgacaccgtattcacccgcgaactgttcgagcagcagcacgtgacggtggtgccgggttcctacctgtcgcgcgaggtggacggcgagaaccccggcgccaaccgcgtgcgcatggccctggtggcaccactggccgagtgcgtcgaagccgccgagcgcatccgcgactacctgcgggcgcgctgaagcctgcgcggagaaacgaaaagggatcgccgcggcgatccctttttcgttcacacccagcgggcgaagcgattggtcagccagctttcctgctggtccagctcgcgcaggatgtcgcccagggtctcgtcgtcgatctcgttgttgcgccgctgccggtacagttccaggcgctgcgcgcgcaacgccttcaggcgcaaggccttgtcggcgatctccagggcttgggcctggtcgcgggcctcatcggtggtcggtgcggtatccagcgactggcggtattcggccatgatctgcgcacgcgcctcggcgacccgcgaagtattcgccgcatcgttgccttccacctgcggcaattcctcgctctccagggcccggatcgccgcctccgcggtcttgcgccaggcctcgcgccgctcgcgctcgtgggcgccattgttgctcgccggcagcccgcgcagcagcagcggcaggccgatggtcgcgccgatcagggaaatcaggatcacgctggtggcgatgaagatgatcaggtcgcgctgcgggaaggcgctaccatccatcaggctcatcggtaccgacagcaccgccgccagggtcaccgcaccacgcacgccgctcaatgcactgagggcggagagacggcgcagggagatgccgctcagcccgggcgggctcttgccgcgccagcggtcgatgcgcagcgacagcttccagtagccatagacccagccgtagcggatcagcatcagcacggcggtgatcgccgccacgtaggccagcagcagcgaggaacgccagagcaggtcgccgtggtggttggccaccgacttcatgatgtccggcaactgcaggccgagcagcaggaacaccacgccgttgaaggcgaactccagcatcgaccagacgctgcggttgagcaggcgcgtggaagtctgccgcggcagcaggtcgacccagctctgcatcatgccggccgctaccgccgagagaatcccggagacgcccaggtgttccgccaccatgtaggaggcgaacggcagcaacagcatcagtaccacgtgggtcgccgggtcgtcccagccacgggagatcatccaggcgcggatgcggcccagcgaccagctgaggaacaccccgatggccaggccgccgaccgcgaccaggaggaagttgaggctggcgtccaccagcgagaacacgccggtcatcgccgcggcgatggcgaacttgaatgccaccaggccagaggcatcgttcatcagcgcctcgccctccagcaggtgcatcaggcgattgggcagccgcccttgggtgatcgccgagaccgccagggcgtccgtgggcgacagcacggcggcgagggcgaaggaagccgccaggggaatttccgggatcagcaggtggatgaaatagccggcaccgaccacggtgaagaacaccaggccgaacgccatcatcaggatcggccagcgcatccgccagacttcccgcttgggaatacgccagccgtcgacgaacagcagcggcggaatgaacaggaagaggaacagctccgggtcgagggcaatgtgcagtccgagggacggcaaggccagcagggccccggcggcgatctggatcagtggtag

SEQ ID NO: 4318 - DNA, 474 bp, Pseudomonas aeruginosa
cggtgcgagacgctcctacactccccttcagtccaggcccgccgtagcgtcggccaggacgacgccccgaaggagtacggggtgcagcgcccactcagacaaaggaatgccgccatgacaagcaagggacttacttccgcactgctgctcgcctcgatgttcgccgccacctccggctgcctccagcagaacgcactgacccagggctaccgcaccacccagcccgggcaacccggccaggcccaggtcgcctccgccaacaccccttgcacccccagcgccaccaatgacctgatcgctaccggtcgcagcctgctggacatcaccaccaacctgatcaagacccgcaaccagatgagcgacggcggcagcatcatgcgcgacgtcgacgacgtgcagaaggtcggcaagggccatgccgtactggacagcgtcgagagcatgaccggcggtccgcagcagccctgcggctaa

SEQ ID NO: 4319 - DNA, 393 bp, Pseudomonas aeruginosa
tggcaatgtagaattacacctttggatgtagtcgtttcgggtaggtcgcgagatggaacgagctttttcccctaccgcggaatcgcggagcagcggcccatgaggcgcgccgagatgctgttgctgaagagcctggcggaaacactgatggccgaccgggacaaccgccacgacgacttgcaggcgaccatgcggctggcgcacctgagttcgccggagatgatcctgtacatggtcaaccgggtgctcgagctcgaagagagcatcgagcggatcgccgcggttctccagaaactctctgcggacgagccgatgcccctagaggaaacgccgcccgaaccagccttcgaaccggccctgcagtcccgcgccaccgagaccgcggaaacctag

SEQ ID NO: 4320 - DNA, 2553 bp, Pseudomonas aeruginosa
gcctcgcagccgttcggtccgagatggacgcagttccactcggccagggcggcgtcgtgttcggcctcgctcttcagcggcaggcgggccatctcttccgacgaggcggtaaccggcccgcagcaatcgtggcagccgggcttgcaggcgaagcccggtatctgcaggcgtaattggtctatctggcgaccgatgcaactcatgggaaatctcctcggcgggggaaggattgtacagcgcggaccggagcattccgaaagtaccggtaaggatgctctccagcgagccgaatcgacctgttcaacctgcgctctctccgttcccggccagggaaacagcccggctccctgtccgcccgcccgtccacggctatctgccgtcacgccgctcccgagcgcggtagccccgagaccgcacaggggcggaacgacgtggcataatccggcgatcacctttcggcgacctatcggcagggcccgggaagacccgggcctcgggagaagcaatgacctacgttctctacggcatcaaagcctgcgacaccatgaagaaggctcggacctggctcgacgagcacaaggtcgcctacgacttccacgactacaaggccgtcggcatcgaccgcgaacacctgcggcgctggtgcgcggagcacggctggcaaaccgtcctcaaccgcgccggcaccaccttccgcaagctcgacgaagcgcagaaggccgatctcgacgaagccaaggcgatcgagctgatgctggcccagccgtcgatgatcaagcgcccggtgctggagctgggcggcaggacgctggtcggcttcaagcccgacgcctacgccgccgccctggcctgagcgggaggccgcatgagtgtcgcctgggccctgttcgtacccgcctgcttcgccctcaacctggcgccggggccgaacaacctgctgtcgctgaacaacgccgcccggcacggtttcgccaccgcctcgctggccggcggcgggcgcctgctggcattcgccggcatgctcgccctggccgcctccgggctggcgctggtgctgcacacctcggcctggctgttcctggcgatcaaggtgctcggcgctgcctacctgttgtggcttgcggtgcaattgtggcggaccgatgcgcagccactggtgaacgaagccagcccggcgcgtcccagcctctggcgcctggggcgccaggagttcctggtggcggcgggcaacccgaaggcgatcctgattttcaccgccttcctgccgcagttcgtcgatcccggccaaccgctgggcgcccagttcgcccagctcggagcggcattcctgctgctcgaatggctggccatcgctctttattcctatgccgggctccacctcggccggctgctcgccggccagcgggcccggcgtctgttcaaccgcggttgcgccgcgctgctcggcagcgcgggactgggcctgctgctcagccgccgtccggcctgaccgttccactccgtttcgaggaaacccacatgtcgcaatccctgttcagcctggccttcggcgtcggcacccagaaccgccaggaagcctggctggaagtgttctacgcgctgccgctgctcaagccttcgagcgaaatcgtcgccgccgtcgcaccgatccttggctacgcagccggcaaccaggcgctgaccttcacttcgcagcaggcctaccagttggccgacgccctgaagggtatcgacgccgctcagtcggccctgctctcgcgcctggcggaaagccagaagccgctggtcgccaccctgttggcggaagacgccgcgccgtcctccaccccggaggcctacctcaagctgcacctgctctcccaccgcctggtcaagccgcacgctgtgaacctgagcggcatcttcccgctcctgccgaacgtggcctggaccaacatcggcgcggtggacctggccgaactggccgaactgcaactggaagcgcgactgaagggcaagctgctggaagtcttctccgtcgacaagttcccgaagatgaccgactacgtggtcccggccggcgtacgcatcgccgacaccgcccgcgtgcgcctgggcgcctacatcggtgaaggcaccacggtgatgcacgaaggtttcgtcaacttcaacgccggcaccgaaggcccgggcatgatcgaaggccgcgtatccgccggcgtgttcgtcggcaaggggtcggacctgggcggcggctgctcgaccatgggcaccctttccggtggcggcaacatcgtcatcagcgtcggcgaaggctgcctgatcggcgccaacgccggcatcggcatcccgctgggcgatcgcaacatcgtcgaggccggcctgtacatcaccgccggcaccaaggtcgccctgctcgacgagcagaacgccctggtgaaagtggtcaaggcccgcgacctggccggtcagcccgacctgctgttccgccgcaactcgcagaacggtgcggtggagtgcaagaccaacaagaccgccatcgagctgaacgaagcgctgcacgcgcacaactga

SEQ ID NO: 4321 - DNA, 1230 bp, Pseudomonas aeruginosa
ccgtcctcgcacagtgtccgccatgtccctgccgtctccctggcgcgccgactttccggccttttccgccttcgccgcggaaggcctgacctacctcgacagcgccgccaccgcccagaagccacaggccgtactcgacgccctgaacggctactacctcggcggcgccgccaacgtccaccgcgcccaacatgtccccggcgagcgtgccacccgggccttcgaggccgcgcgcagccgcgtcgcccactggctgcacgccggcaacccggccgaggtactgttcacccgcggcaccacagaggcgatcaacctggtggcctatggcctggagcggcatttccggcctggcgacgaactgctggtcagtgccctggaacaccatgccaacctgcttccctggcagcagttggccctgcgccgcggcctggtcctgcgcgtgttgccgctggacgagcgcggggtgatcgacctggagcaggcccgccatatcatcggcgagcgtacccgcctgctggcgatcagccagttgtccaacgttctcggcacctggcaaccggtggtggagttgatccagctggcccgcgagcgcggtgcctggaccctggtcgacggcgcccagggcagcgtccacggacgccacgacctgccgggcctgggctgcgacttctacgcattctccggccacaagctctacggccccgacggcatcggcgtgctctggggtcgcccacaggccctggagcaactggcgcactggcagttcggcggcgagatggtacgccacaccggcttccacgaagccagcttccatgccgctccgctcggcttcgaggcgggcaccccggcggtttccgcggcgatcggcctaggcgcgaccatcgactggctggccaccctggacgaagccgaagtcgccgcccacgaaggcgccctccacgcccgcctgctcgccggcctgctggcgcgcgacggcgtcagcctgctcggcgaaccacaggcggcgctggccagcttctgcgtcgacggcgtgcacgtcgccgatctcgcccacctgctcggcgaacagggcatcgcggtgcgcgccggccaccattgagcgatgccgctgctgcaacgcctccaaggtacccggcgcccctgcgtgtctcgctgggcttgtacaacgatgccgacgacctggagcgcttcttcctggccctcgaccgctcactggagttgctgcgatga

SEQ ID NO: 4322 - DNA, 1098 bp, Pseudomonas aeruginosa
agcttctgctcggtcaggtcgagccgcgcgccgctgaacagcaggccggagaccatgttgaaggccaggaacgccagcgcgatcagcaacagcccggcgccagaggacaacacgcgtttcatcgactccccctcattcggctttcttcaggtcgaccgccaccgccgtggcggccagccaggcgacgatcaggctgacgaaatacagcaggtcgcgcaggtcgatgacgcccttgctgacggcatcgaagcgggtcagcaggctcagcgaggccaccgcatcgagcaaccactgcggcgcccactggctgaacgcatcgagcaccagcggaaagccgctgagcatgaacaggaagcaggcggccacggcgaggatgaaagcgatcacctggttcttcgccagggccgacatgcacgaaccgatggccaggtagccgccggccagcagccaactgcccagatagccggcgagaatcgcaccgttgtccggctcgcccaggtagttcaccgtgagcaccatggggaaggtcagcagcagcgcgattccggcgaacgcccaggcggccaggaacttgccggccacggcttcgaagcgggtcagcggcagggtcatcagcagctcgatcgagccggacttgcgctcctccgcccacaggcgcatggccagcgcgggaaccaggaacaggtagagccagggatggaaggcgaagaaggaggccaggtcggcctggttgcgttcgtagaagttgcccaggtagaaggtgaacacgcccgccaggaccaggaagataatgatgaacacataggccagcggcgtggcgaaataactcgccagctcgcgcttgaagatcaccggcagttgcttcatgcctccgtcccccgggtcaggttgcggaatacctcgtcgagccggccgcgctccacgtccagttcgcggatccgccagccgcgctcggcgaccagcccgctgacctgggggaagatcaccgcgcccggctgcgccaggacggtcaggctgccttcggcggggttctcctcgatgcccgccacgcccggcagcaccgccagcgccacggcatccaggggctcgtcgctgtag

SEQ ID NO: 4323 - DNA, 2598 bp, Pseudomonas aeruginosa
gacgcgttgcgttcttttgcggccctccggggattgcggcaaactagccgcgcccgtcacgccgggtcccgatcaactgccagtagacaccgtatgccccgctaccctttccgccgctttggttttggcgccctgcgccgcctgctgtacctctgggtacgctcggaaaccatcaaccaatcggccttcaccctgaagatcgaccgcagcaagccggtgctctacgtgctgcaacagccttcggtcagcgatctcgcggtagtggataccgaatgccgcaaggccgggctgccgcgtccggtgatgccggtagcggtaggcgacgccatcgagccggcggcgttcttctacctgacgcccgaacccgactggctcggccgccaggataagcgcggcgcctcgccgaccctggtgcgcatgctcgccgcggtcggccagaacggtctcgacgacgcgcagatcattccggtcagcgtgttctggggacaatcgccggacagcgaatcgagcccctggaagctgctgttcgccgacaactgggcggtcaccgggcgcctgcgcaagctggcgcgcatcctgatcctcggacgcaagacccgcgtgcagttctccgcgccgatccacctgcgcgagctggtggaacagggcaagggccacgagcgcacgctgcgcatggtcaaccgtatcctccgggtgcacttccgcaacctgaagaccgcggtgatcggtcccgacctgtcgcaccgccgcaacctggtcaagggcctgctgcgcgcgccgctggtacgccaggcgatcagcgaggaatgcgagagcgaacggatatcccaggagaaggccgaaggcatcgcgctgcgctacgccaatgaaatcgcctcggacttctcctatccggtgatccgcttcctcgaagtcatcctcagctggttctggaacaagctgtacgaaggtgtcaaggtcaaccacatcgagcgggtgcaggacgtggcccagggcaacgagatcgtctacgtgccctgccaccgcagccacatcgactacctgctgctctcctacctgctgttccgcaacggcctgaccccgccgcacatcgccgccgggatcaacctgaacatgccggtgatcggctcgatcctgcgccgcggcggggccttcttcatgcgccgcagcttcaagggcaaccagctctacaccgcggtgttcaacgagtacctgcacaccctgttctcccgcggcttctccaccgagtacttcgtcgagggcggccgttcgcgcaccgggcgcatgctccacccacgcaccggcatgctcgccatcaccctgcgcagcttcctccgtgactcgcgccggccgatcgtcttcgtgccggtctacatcggctacgagcgcgtgctggaaggccgcacctacctcggcgaactgcgcggcgcgaccaagaagaaggagtcgatcttcgacctgttcaaggtggtcggcgccctgaagcagcgttttggccaggtctgggtgaacttcggcgagccgatccatctcgaccagttcctcgaccgccaccagcccgactggcaggaccaggacctcggcccggaataccgccccgactggctgccgcagaccaccaacctgctggccaaggacgtcgcccgccacctcaacgacgcggcggcgatcaacccggtcaacctggtcgccctggcgctgctctccaccagccgacaggccctcgacgaaagcgccctggcgcgaatcctcgacctctacctggcgctgctgcgcaaggtgccctactcgcccagcgcgaccctgccggacggcgacggccaggccctgatcgaatacgtgaagagcatgaacctgctggccgagcagaaggacgcgctgggccgcatcctctatctcgacgaacagaacgcggtgctggcgacctactaccgcaacaacgtcctccacgtcttcgccctgccggcgctgatcgccagcttcttccagagcaactcgcggatcagccgcgaacagttgctgcgcttcgcccgcgcgctctatccctacctgcaggcggaactgttcatccgctggagcctggacgaactcgacgcggtgatcgaccagtggctggcggccctggtggaacaggacctgctgcgccaggagaacgacaccttcatccgcccggcgccaagctcgcggcaatacgtgctgctgatcctcctcgctcgttcggtaacccagaccctgcagcgcttctacatggccatcgccctgctgctcaacgcggggcagaacgccctgaccgccgaggaactggagaacctctgcaccgtgatggcccagcgcctgtcgatcctgcatggcctgaacgccccggagttcttcgacaagagcctgttccgccacttcatccagacccttctcgacctgcgcgtgctgcgcaaggacgaggccggcaagctgagctaccacgaactgctcggcgaactggccgaaggcgccgccaagcgcgtgctgccggcggagatccgtctgtcgatccgccaggtggcgctggagcgccccgccgaggaagccgccgccgaaagcaacgacgcggccgccaactga

SEQ ID NO: 4324 - DNA, 873 bp, Pseudomonas aeruginosa
aactcgacggcagcgacccgcagccctatcgcgtgcaggtcgaatcggcgcgctgaagcacaccgcggcatgccgccggtgcgaaccggcggttccctccagtacactccacctcctattcgctaccggttgccgatccacctcacgacgagcggccggataccccgtacgttccacatcaaggacgctgtcatgttccgactcactgccctctgcgccggcctgctactctcggccaacgccctcgccctgtccctcgccgacctgtcgcagaacgacgcctccagcggcctgaaggacgccctgacccagggcgcgcagatcgccgtccgccagcttggccagccgggcggcttcaacaacaacccggacgtgcgcatcgaactgcccggcaagctgggcaaggcggcgaagctgatgaagcagttcggcatgggcgcccaggtcgaccagctcgaggcgagcatgaaccgcgccgccgaggctgccgtgccgcaggcccagggcctgctggtggaggcggtgaagaagatgaccgtggccgacgccaagggcatcctcaagggcggtgacgacgccgccaccgaatacctggacaagtccagccgcgaacagctgcgcgcgaagttcctgccgatcgtcaagcaggccaccgacgaggtcggcctggtcaagcagtacaacgccttcgccagccaggcggcgacccttggggtggtcgatgcgaagagcgccaacgtcgagggctatgtcaccgagcaggccctcgacgggctcttcgagatgatcgccaggcaggagaagagcatccgccagaacccggcggctgccgccaccggcctggccaagaaggtcttcggcgcggccaggtga

SEQ ID NO: 4325 - DNA, 327 bp, Pseudomonas aeruginosa
acccgcgcgctctggcccagttcggccggagtcgcgcggtcgtcgaaggccacccgggcggcgaaggtacgcgattgcggatcggccgcgggcgagagctcgcggatatgcccggcgaagcgtctgtcgcgttgcgaccagagttcgaccgacaccggctggccgatgcggaaacgttcgaagctgtgttccggcaggccgatcagcacctcgcgttcgccgtcggcggccaggctgaagaccgtctgtccggccgccaccacctggcccacctcgacgcgccggctggcgatcacgccatcctggggcgagcgcagcacggcgtag

SEQ ID NO: 4326 - DNA, 603 bp, Pseudomonas aeruginosa
atcacctgcggcgcctcgccatcccaggcgcgcatcaggtccgccgagttgccgccgagcagacgcatccgcgcggcgatcggcgccacgtcgggatcgcgccgggcgcgctccaggccatcctcgagcagggcggcgatcagcggctggcgctcgaccagggtaacctcgcagcccaggctggcgaggacgaacccatcccggcccaggccggccgtggcgtccaggacccgcgggcggatgcctggctggacgccgaccgccttggcgatcatctgtccgctgccgccgccgaacttgcgccggtgggcgctggcgccctcgacgaaatcgacccgcaccggaccgggggagtccgcccccagttgcaagacctgcaagccctgctcgccgacctgcacggcgaactccgcctcgtcgtccgccgccagcggcaggccgagccgctccgcccagcgccgcgcagcctcggcgcaatcggcggacagggcttggacatgcaggcgaggagcggcggaatcggtcatggtcgggcaatcgtcggggaaagcgcggattttgccagagttggcccgcgcgcgctcaccggcagaccttccatag

SEQ ID NO: 4327 - DNA, 525 bp, Pseudomonas aeruginosa
gcccatgtcgaggtggaagtgatcccggtgggcggcgttgtagtcgggccccagcaccgcattgaaactggcgcaggcgccgtcccgcacgcggggcaggaagcgcccgtcggcgctctcgccggcccagtccgtggccaggcggatccgcctcccgtcggccaggcggaagccgctgatgtccagggcattggccgaggcatgctggctgcgccgaccgtcctcgcggttgtagacgttgcggcaggcgaagctgccgacatgctcgacccgcgccagcggctggccatagatgtccagggctgccggttgcagcacgtgccgctcgaacaacgcatagctcaccgccagcgggcaactggcgagaaagctgctgctcaactccagcgccgccccacgcacgcgcaggctgttgctcaacgggcaggtagccgatggcgggtcgtcggctacccgctggtagcgcagttgcgaggtggccagggcggcgtcgcagaggctccggtcgtcggccagccgccatag

SEQ ID NO: 4328 - DNA, 747 bp, Pseudomonas aeruginosa
aaaagacgccgattgtaccagccttcgccgccccggaaacgccgacggcccgcaagcgggccgtcggtgctacagcgctgcggatcagctcagggccgaaagcactttcgcggtgatctgctcgaccgagccgacgccggcgatgctgtggtatttcggggtgccttcggcggccgacagcttctggtagaagtcgaccagcggcttggtctgcgaatgatagaccgacaggcggtgacgcacggtctcttccttgtcgtcctcgcgctggatcagctcttcgccggtaacgtcgtccttgccggcgaccttcggcgggttgtgctcggtgtggtacacgcggccggaggccggatgcacgcgacgaccggcgatacgcgacacgatctcctcgtcgtcgacggcgatctcgaccacgtggtcgatggtcacaccggcgtccttcagcgcttcggcctgcgggatggtccgcgggaagccgtcgaacaggaagcccttggcgcaatcggcctcggtgatgcgttccttgatcagggcgatgatgatgtcgtcggataccaggccgccgctgtccatcacgcctttcacctgctggccgagcgggctgccggccttgactgcggcgcgcagcatgtcgccggtggagatctgcggaatgccgaacttctcggtgatgaaccgtgcctgggtgcctttgccggcaccgggtgccccgagcagaatcacacgcatcgatatgctccttag

SEQ ID NO: 4329 - DNA, 786 bp, Pseudomonas aeruginosa
cctgaactcacgcgagcggaacgccgcgccgttgtccgtcagcagtcgctgcacggtgatgcccaggcgggcgtaataggccacggcattgcgcaggaacaggaccgcctgcgccgtcttctcatcgggatgcatggcggtgaacgccaaccttgcgtgatcatcgatggccacgaacagcgtctcccagcctgcaccatcgaccgagtcgcgacggttgcctgtgacgcggtggctgggccgcacgatgcgcccgagcttcttggtgtcgatgtgcagcaggtccccgggcgcctcgtgctcgtagcgcacaacggcttcgacgggctccaggtcgctcaacctggacatgcccgctcgcgccagaacgcggctgaccgtggactccgagacgcccacactgcgtgcgatgcgagcctgcagcattcgacgtttgcgcagctcgacgatgagcaaagccttgcccgcatcgatggccctgggcgatcgcagcggcctggaagaggcatcggccaaggcggcttggccaccggccaggtaacgaccgagccacttcctggccgttggcgcagtgacgccgtgcgcggctgcggctcgcacggcatccaagccttccagcgtcatctgcttgaccatctcgagtcggcgggcaaaggtaagtcgggcatgcttatgggtgttcatccggttgggcgtcctgagtggattgggtgtttggcgacttccagtctctcaaacccaatccggatgaacaccggatacaacctattggagcttcacaactag

SEQ ID NO: 4330 - DNA, 489 bp, Pseudomonas aeruginosa
gctgtcgtactggatggtgttgaggtccacgtcgatgaacgggatgcccgcgaacatcaccaccacgatggcgacgaagacccggttctcgatgcgggcggcgctcagcacgcctttattgccctcgtcggcgccttctgcacgggccttcaaccactcctgcacgatgatcgccacgaaaggcagcgcgaagacgccgctggacaccagcacggcccagatgccgttgttgacgatccaggacaccagcgtcaggtagtactccaggtagtcggtcgtgaacagcgtcatggcgccatctcccctcaacccgcctgcatcagcaggctggcttccagcgccacgatggcgacgacgcccgcgatctcggtgcgcaccaggcggcgccgcgcctgggcgtcgtcctcacgtaccagcagccggcggcgcatccagatccacccgtacaccgtcgccccgtatagacacagccgccacacgaagaagtaa

SEQ ID NO: 4331 - DNA, 591 bp, Pseudomonas aeruginosa
gtcgccagatcgaccagcgtgatgtcggcctcgggccacggcgtgccgtcgcggtcgaacatctcgccgtccgtgccttggcagaacatgtccatcgcgtccgccatctccagcagccgcgcacggcgcatctcgggcaacgtcgggtcctggccacggatgcgcagtgcattgcgcacatcgcgcgtgagcacggtgcgcttctccgccacgcaatgttcggcggcgtcgaggatgcactggcggatcagcgagcggtcggcccgcgtcatccgcgcttcttccttgtcttcgccgcccgtgatcatcagccgtgccgtgatctccagttcgccgagcacgtcgcgctgctcatccgcctccatggccgaggcatccggtggctggtcttcgtccagggcatcggcatcgagcgtctgcacgtcgctgggcgtttcgatcagccggcgtgcgtcggcgaacggcgccaggctgatgcccgatccgggggccagcttgacccggttcacggtcaggcccaggcgccgcgcgaagtcgctgaacaggccgaagctgttgccggcttccacgatgaaaagccgcggccggtag

SEQ ID NO: 4332 - DNA, 468 bp, Pseudomonas aeruginosa
accggcttggcactcttgaccccggcggcgcgggcgcccgcgttggccacggtttcagtggtggttaagagcgtgctctgggccgggccgaagatcgtggggaagctcatgccgccgctcgcgccacgccccccgttgcgcccctcggggggctttgcgtcgtccggctcgacccaccgcacgccgccctccatgcgggcctcgtcgccgccctgcagccccaggcccacgggcaggtccgcatggccgccgccgcgcccgccgatgctgtccaggcgccgctgcaggtcggcgagcagccattcggtctggctggcgcgcgctgggccgcctggctcttggtcgcggcgcaggttggaccgctcggattcgagcgccgagttgatgcgctggtcgatggagttctcgcgctggcgcagccgctggttctcttcacgctgcgacttgttgtccgagagcgcggtctga

SEQ ID NO: 4333 - DNA, 1098 bp, Pseudomonas aeruginosa
  unsure (618): Identity of nucleotide at the above locations are unknown.
agctcggtgcgcaactgcttcacttgggcaacgagcgtcgccacggtgtcgcgcggggtgtcgccttcgatgcccagcgccttcatttcctcgggcgtgagctgggcgccgttgtccgccgcgggtggcgccgtgccgcctccacccgagaacagccggataccggcgaacagcaccaggatggcgacagggatcatcagccacttgagcaggccgttactgcgcatggcgggcctccttggcgttctcgtcgccgtccggctgcggcagatgcacggcagggtcgaagcggtgaatcgccggcagcagcgactgcgcgaggccgcggccgcgcgtgaccaggtacaggacggtcgtgtcctcgggcgtgccgcgcgggcccagcgcctcgtgctggaaggtggcggtgaggaaatcgccttgcagcacgcgcgggtcgagcgcgacccagtcggcgccggtgttggtgaggcgcacggcagtcacccattggtcttccaggcgccacgacgcgagcacggccgcgcgcaccggcagcgttggcatcagtgtgtccaggtcgaggtcgcggggcaggttgacccgcatgacgcccggaagcggctcgacggtgcgcancggtgcgtaaaagttctgcgcggcgaagcgcgtcagcacgacagggaccggagtttcgcgccgcgcggtccgcgcacctgcctggccctgggcgcgtgccggggcctccgcactgtcgggctgctcgccatagcgtcccggtgcgctgtcaccctcgacgatgcgcaccggctccagctcggcttccccgtccttgggcggttcggctacgatgtccagcaggatcagcgcgcccgtgtcggcgtcctgcagttgcaaccgcgtgggctcgatcggctcgctggcacgcaggtacaccgcgccgctcgcactctgcacgcgcaggcgctcgcccacgcctgcgggcacgcccacgcgcacgttccggtcgatgaatacgatgcgttcctgaccgaccttcagcggcactgccagtggcatgcgttcccaacgcaggatctccaccgcctgggcaacgggtgccgcggccacggccagtag

SEQ ID NO: 4334 - DNA, 630 bp, Pseudomonas aeruginosa
gcaggcgatggccgaactcgctcagcagtcgcaagagttgggaatgggatacgaatgaggcattccccattcaccgccgtctacgacgcgtgcgttctatatcccgcgccactgcgggatttcctgatgtggctcggcctgtctggccgcttccgggcgcggtggagccaagccattcatgaggagtggaaacgcaacctgttgatcaaccgccccgatctcacccgggttcaggtcgacaggacgtcggatctcatggaccgggcaattccggacggcttggtggagggctacgaagcgctcgtggcaggcctgacattgcccgatccggacgaccggcacgtcctggctgcggcgattcgctgcggtgcgagcgtgattgtgacgttcaacgaacgggatttcccgaacgatctgctggctccgtacggcatcgaatcgcagcaccccgatgagtttgtggacaacctactggatctggacgcggccgccgtggtgtcggctgcgcagcgccagcgtgcccaactcaagcatccgccgatcgaggtggaccgctatctcgaaatcctgctgcgccaaggccttgtgcaaacgaccaaggtgctggcgacctatcgcaccattctctga

SEQ ID NO: 4335 - DNA, 714 bp, Pseudomonas aeruginosa
tgccaacgaagaagtcttggggttcgagccgttgaagggagactggggagtctcgctgccgtgtccgaaggagcagctcggctgggtgcaaaccgcgctcaaaaagcacagttctcgcatcattgcacgggacttgagccaaggaattgccacgcaggcgcaggccgatgctggacaagcgctgtcgctcgacctcggaggtttcctcaagtcatgagcaccgtcgccacctactcgtacacgcactcggttacctatgtgaccgacaacatcctcaagagcttgaaagacatcatcctgctcagtgggctggaccccgagcacttcgcggatcgctgggagagcaatacccgagccatcaagacgtggctcgggaccggtgatctgcgcaaggtgattctggagatctacaacccggcaaccgacaaactcgtgacccgatgggatatcgacatcgtgtatgggtggtccgatggcgacggcagcttctggacagataccgagcagttgaagtacgcgatcaagaaagctgggctgctgccatcgcaggccaagtacaagttaatgctcgatacaaagccagggcggcctgatgtggaggggtggagcaaaggaagttatcgctcgacggatggaatggtcaagcagagcctaggctcgactgtcgaacacagcggcctggcgggtcaggccggatattggaggcaacgctga

SEQ ID NO: 4336 - DNA, 627 bp, Pseudomonas aeruginosa
cgaaatgcgccgcgtggtggcggcggctggggtcgcttgtcctgccgaatcgcaggccgcgggcctgccactgctgcctcccacgtcggcgggcaattggctcggcggcggggtgaatggggaccagcgcgcctggcaagccctcttacggatcgcacagatcatcgaaggcttcgacgcgcgggcgcgcgacgtgaatgcccagcgcggcgcgatggcccaggagcgggaccgcctgcaacagcatcagctggagatcgaacggctgcggaccatgcgcacgactgcggatcaggagctggcggccgcccgccaaaccgtggcccaattcgacgacgcgaaccgcggcctaatccaggcggccacggacgaaatgccggtggtggtgcaccatcagcgggtcaaggccgcctacgacggcttcctgcccgagattcaggcatacctaaccgctctgccgggggttctgctacaggggctgggagaccaagcccgccatctctacaacgcattcaaccgggccgatgcccggcgatctgctgcacgcgctgtggttgcccgtggccgagaacggcaagatcgaggtggagttcgccggcgagccgggcgcgcgctacgacgcgttga

SEQ ID NO: 4337 - DNA, 411 bp, Pseudomonas aeruginosa
tcgtcttcagcgaagggcacatcaaatgcctgggcctggcgattctgcttgccaagaacctcgcgcagggctgccccgtggtcatattcgatgacgtcgtcaacgcgatcgacgacgaccatcgcgatggcatctggcgtaccttcttcgaggacggtttgctccacggcaagcaggttatcctcacctcgcacgcagaggagttcctgcaccgcatccagcaggagttgggcgtgcgccgcgccgcggccattaagcgctacaagtttctcccgcatcagggagagcacgaactgcgggtcgacagcgacccgccagcgaagaactatgttcttctggcccagcaggcgttggcggctgacgagaaacgcgaggcactgcgtcaggcccggccggcgctggagagtctga

SEQ ID NO: 4338 - DNA, 672 bp, Pseudomonas aeruginosa
gtacttcttgaagctgcctgcggtcaggctgactgccatccccagcaacgccgcgctgggcagcaggatgaccagaggatgcaccgatatgggcagagcgagataggtgacccaaggcagcacggccaacggcatcaggctggccttcgcgcggtggtagatgaagccggattcgcggcccgcgccgaaccggcgcacatcccgtcgcaccaggccgtcaatcaggccgacgaatgccgccgtgaggatcagcggcagcgtgagcaccaggaccagcaggcgcaccaggaaggtgagcgtcgtgaaggccgcagcgatcaggtagctttcggcccagacatagacttggctgatgtagtagcggaagttgcggctctgcccgtggctgggcgcgcggacgcgctcggcggtctggctcatgcgctccagcaaccccgagcgcacgaacacccactcgtacccggtatccaccaactcgtgcgccgtgcgcccgggctcctgtaccaccacgctgcgcgtgaagtggttggacaggtgcccgagttcgtaccgcagcatctgctgggagtggcgccagccctggtccttccagaacaggtgcatgccggcgcactccaccacgatcgaaaacagcagcgagccaatgagcaccccgagcagccggaacggtaa

SEQ ID NO: 4339 - DNA, 657 bp, Pseudomonas aeruginosa
gcgccgaacgccaaggcgctgccgatgcccatggccgggctcagcgcgagcgaccatggggccaccaggcacagaaacgcggcgcctgcacacgccgcgacggtgtatagctccaccgctgggcgtagcagaacctcgaccggctgtttgcctgacatggcttcattgctcgatgccggtggccgtgatcagcgccgggtagtgccgcaggcccaggcgatcggccaggtcgtcgccggccacgggcgcgagcggtacgccaggcaccagagcgcgcagccgtgccaggctctgcgcggtctcgacgttgaccaccaggccgaccgcgccgcgttcacgcaaagcggcggcgcggcgctgcaaccagacccgggaagcctcgtcgtcgccgatgaccgcgaacggccgcaggccgggcgcttcgatcacgcgccgcgcgacggtaccgggcgtgagcttgctgctgcgcaccggcagcatcgcggcttcgtccgctggcgtggcgggaacccggggcgtcgggatgggggggcgggccggcgcgttggcgcgcggctggaggttcagggcttcgtagtacggcaatgccgacgtgccgccacggtcctcgaccacgatcagcggctcgccagcacgcgaggccagcggcaggcctga

SEQ ID NO: 4340 - DNA, 339 bp, Pseudomonas aeruginosa
ttgttgtattatcgaaccatgcaagaagatcaagccatttccgccttaaacgccctggctcacacccagcgcctgcgcgtgttccgcgccttggtcgttgctggcccgggcggactgacgccaagcacgctagccgaccagctcgacgtggcccgcaacaccttgtccttccacttgaaggagctggcccatgccggcctcgtcaccatcgagcagcagggtcgcaacctgatctatcgggccgagtacggccacatgaacggcctcatcggctacctgaccgagcattgctgccaaggtggcgtatgcgaggtttctccatccaagacctgctgctga

SEQ ID NO: 4341 - DNA, 894 bp, Pseudomonas aeruginosa
tcggtttcatgctccagcatcccattctcatcaaccggccgatcgtggtcacgccgctgggtgtgcgcctgtgccggccatcggaagccgtgctcgaccttctgccgcaaccgcagcgcggcgcgttcaacaaggaagacggcgagccgctggttgatgagaaaggccgtcgtgtctgaagcccgcctcgacctgccaaacatcgacgcggcgctgttccagcaaccagacgccgaacacctgttcgcgccggcacggaccacccacgcgccgcgcttcctgctgctctacggctcgctgcgcgaacgctcgttcagccgcctcgcagccgaagaagccgcccgcatcctgcgggcgctgggcggtgaaacccgattgttcaatccgtccggcctgccgctggtggacgatgcacccgctgatcaccccaaggtcaaggaactgcacgaactggtgcaatgggccgaaggcatggtgtggagttcgccggagcgccacggcgcgatgaccggcctgatgaagacgcagatcgactggattccgctgtcggtcggcgcggtgcgcccgacccagggcaagacgctggcggtgatgcaggtgtcgggcggctcgcagtccttcaacgcggtcaaccagatgcgcgtgctcggccgctggatgcggatgctgaccatcccgaaccagtcctcggtcgccaaggcataccaggagttcgacgaggtcgggcgcatgaagccctcggcctattacgaccgcatcgtggacgtgatggaagaactgatgaagttcacgctgctcacgcgcgacgcggtcccgtatctggtggatcggtacagcgagcgcaaagagggcgctgaatcactgtccaagcgtgtacggcaaggtgcaatttga

SEQ ID NO: 4342 - DNA, 1257 bp, Pseudomonas aeruginosa
agttcaggcggcgaccaattgccgggccagtgcgacctcgacggaatcaccgtcctggttcaggacatcgagcccggattcgggcacgtcgcccgaggtggactgcgagaccatgatcttcttggccatcagctccaggcaggtcatctgcgaggaaccggcgtagccgaggtagatcacacgcacgggctgcttctgcccgatgcgccaggagcggcgtgccgcctgctggagcgagtacacgttgtagcccgactgcatgaacacgatcgtcgggaactccaacaggtccagccccgtcttgaccaactcggggttggtgatgagcacgtcgatgccacggtccagttgctcggcgatccagtcttcgcggcggctggcatccacgctcgcgcgcagcaccgccaccttgaagccttcctgctccagcaacaccttcaggcgcgacgtggtgtcgcgcgtgccggtatagaccgtgtaggccaggaccttgcggccctgcgccttctcctctttgcagatgtcgatcagctcacgctccttggggctgatctcgaactcgttgaactgagccgggacaaacgccaaggtgttgcgcgtgcgcggatgcaccacggtctccgaccggaagcagcaatccggccaggccagcagcacgttgaggaccacacccagcaaggtcgtatcgcgtcgcgccagagcctgtttcagctcggcggtcagccgacccgccagatcgcggtaggccgcggcttgcgccgtgtccatcgcgacttcacggaactcctcgtcatacggcggcaggacgttgccgccgatgtccttgagcttgaggaagatcgtgaatggcaggatgcagcgcaagacgcccttggggccgaagcccggggccttgaccgtgcgcaccgataccttggtgcccttggccgtcttgtgcgccgtgccggtgctctcggagtagatgtccttcaacaccccgtgatcgcgcatgaacgccatcgcagccgaggtcatgctgccgctcgtggtcgggcggtagccgtcttcgatcatccgccccggaagggctcggaacagcaggtgaaaaagatcatcaccgtagccgcccatcagcgtgccagtcagcagcaaggtcttgcgagccttcgccgccagcacgcccatggcctggccctgggcactgcccccgttcttgtactcatgcgcttcatcagcgatgagcaggtcgaacgtaccttgcggcaagtagtcgggtag

SEQ ID NO: 4343 - DNA, 1209 bp, Pseudomonas aeruginosa
cagcagttcactttcgttggtcataccacccagcctagcgccgtacccgcattgatgctcgcagataacgccttgcctcacggcgttggcgcggcccgaaggcccagctacattgtcccggcagcttcacacaagaccgttatcagtcctgcatgtgccggtaggctactgatgacggaacaccaggttcctcgccgggattgcccccgttggaacaattactcagacgacttcacgtcgcaccctcttgatgaactccgagggttgataaccgccctcgccaaagccgaactccatgttggccatcgcacgttccatgcgcgtggcttgacggtcggaaaacaccagctcgccgttgccatccatgaggttgatgaactcgtggatgttgtcgcccagcatcgaggccaggaagccgtcaccgaacttctgcatcagcttctgcgcagtgacttccccgatggtcgggatgcgcttcagggctttgaggacggccgaggactggtcgctgccggacaggctgcgcgggcggatcagcgtccacaggggcgcagcgcaatggctgcacttcctgcggtactcctcggcttcgagcgcgaccgggttgaccggctcgccgtcgaggtcggtgatgaccgtgccgcagtccgggcaggccgccacgtcgccgtggcgggtgcgccgctgggtgaagacgggcttccagtggaaacccatccgcatcctgacgcgccccaggacgaagaactcctggcccgtgggctgcacgcccaactgctcacgcagcttgaggagcttgacgagcgtatccggcccattgagcacccataccttggcgccggccaccgtctcctggatctcccgccgccacttgtaaaccaagtgcggtggcgacaggaccagagtgcggcggtagccttcggcgttgagcacggcggccgcggcgatgccaacggtcgtcttaccacagcccatctcgccattgacgatcgcggcgcgttcgccacggtcgatcagcagctcggcggcggcgtggacgacttcggcctgggccgggaacagcttgcgtttgaggctggcgacgatgagctgccggtgcgcctgcggttggccggtatagacaggcgggttggcgctgttgagggcgtcgagcagttcgtcgccgaactcgccgacgaaatcctgaaggctcagggtcagaggggatga

SEQ ID NO: 4344 - DNA, 414 bp, Pseudomonas aeruginosa
cccagctcgcccaggcgggcgatctgtgcacgcaaagcgcggcggtcgatggtcgaatccagtttcacggactcgcccagcggccacagcaggccgaagagcgcggggtcaccgtcttgggtgctgccgggggcagcagcctcagcaggtggcggcgcatccacgccaaagggcgtggtatcgaccatcgggtccgcggacgcctgcacgggtgcgggcttggcgggcctggacgccttggtgggcttggccggcgttgccgcaggctgcgccccttgctcttcatcgagcggatcgacgtcctgggtggcgaagctgcgggcttcgtcgcggctgagtttgtcgatgccgttgagcgtcatgccgtcgaggctggcacggatctcgaaccgcatgccgccgccgaccggatag

SEQ ID NO: 4345 - DNA, 1965 bp, Pseudomonas aeruginosa
caccctggctgctggctgttgccgatgcgtcggcaatgcaggaggaaggatcgcgcgacctgccggccgcgtcgtacatcaatccgtagcgctcgatcccgtcttgtgcaggcattgcaccagccgctggcccagccacgcgacgcacggcacggccatggagttgccgatcgccttgtagcgcggcgcgtcggcggcgggcttaccgcggtacgggaccagcgtgtagtcgtcgggcatgccttgcagccgctcgcactccacaggcatcagccgacgtacccgccactgcgaccagtcgcccgggccggggtcgttccagtcgtagcggaaatgtgcctcgaagtccggtgccagcacatggggcttgtcggcaccgccgctgctggtgcgcagcgcggtcgagacgccatcgcccagttcagcggccaggccttcggtgcgaccgcgcagcgccacgccgatcaccatcggccggccctggcctggcttggcgccacccgtggagagcgtcccggcaagctggccgtggccggattccagccgcagctcgccgcgcgagttctgcgcgaacgcgattgccggcacgacgccggcattcgcgtggctgaggcgatgcccgccggcacgcagcgtcggcgcatggttcgtcgtcgcatccgccccgcagccctgtgcggtgaaggcaatgatcggcacgcccttgccggtgccgtcctcgctgcagcccttgccgccgttggcggtgctgagcgtgtggctgatgctgcccgcgacggactgcgccacgaaggtctcgacctcgaagtcgttcttagggccgggcgccgcggtcaggcaggccgcgacgtcgatgggtcctgcggtgttgcccccgccgaatccgaacgtcaccgtggccttgccgtagggctgcttcagtcctggatatcccgagtaccagcctgctgccgcagcgcccgatccagcagcgccggcagcgtcttgccacggcgcgaagcccggcgaagaatccccgcgcaggcctgggcgctcaaaaagtacctcggcgggatcgacgccacctccaccacttgccacaagaaacacgcgacggcgccgttgggcgacgccgaaatattgagcatcgagcaagcgccaggcgatgcggcgccggggtccagacacacaacctgcgtgcgcccatttttgccctggcggttcgagcgcacggctttcgccggccagtgcgcccaggaagtgtccgaaggcgttgctgcggtcgctgaggacgccggggacgttttcccagacgagcgttgccggcgggcggcggtcttggcggcgggtttggtcgatggcatttgcaagctccacataggcaagggtcagggcgccgcgcgggtcagccaggccacggcgggcgccggccacgctgaacgactggcacggcgtgccgccgaccaggaggtctggcgcgggcacggtgccggcgcggacctggcgggcgatcgtggtcatgtcgcccaggttgggcacgcgggggtaacggtgggcgagcacggcgctcgggaacggctcgatctcggcgaaccacgcggcttcgaggccgagcggttgccaagcgaggctcacggcctcgatgccgctgcagacgctgccgtagagcagcggcgtgttgcgcggcggtgcgcaaagtttcgggtgcatgtcggtctcctgttcgtatggcgcagggccatcgccctggccggggcgttgaaaggcaggagaaaggcgccgaaggccccaggggccttcggctcgggaggaaagaagaaccacccgtgggctgattggcaggcccggtcgtcgctagaaccgtctgctcatccagcaatcacacccggcccatgtcgtggctggggccggcatcgtctggcgcacatccgcgcacaaagggagcccgtttttgcgccggcgggcaccggcaccgaataccgctga

SEQ ID NO: 4346 - DNA, 2493 bp, Pseudomonas aeruginosa
ccacgaagggtctccgggtggctcgcacaggcaagccatcgggggacccttcgcagcgtgcggaagagatgcggacggggagaacgcgcggggtgcggttcgcggagaagctaccttcaggtcccgcggccgggggcggctgaacgggacgcgcacacggacaagaaggcgttgcgcgctgggcgtcccgcagggcatgcggaacacgggccacgccgccgatggcgggcacggctcacggggaacgggggtcggtcaggagcctttgcggccgctcttgcgtgggcgcgaggcaccacgcttggacgtgccggtttcgaccggcagcgtgcctttgcagtcgggatagcgactgcacgaccagaacggcccgctcttgccggtgcgttggcgcgtgggcgcgccacactgcggacaagccggtccttgaggaaccttgatggacagcgaggtgctgctgtgctgcgcgatcaactgcgaaatccaggcggcctgcttgccgatgaacacatccagggtgagttgtccgccctcgatcatgtccagcgcctgttcccagacggcggtggtgccggggtcggcaatcgccgcgggcacggcgtcgatcagcgtgaacgctgcatccgatgcgcggatggagcgacccttcttcacgatatagccgcgggcgatcagcccgctgatgatgttggcccgcgtcgcctcggtgccgatgcccgtcgtgtccttgagcttctgcttcaggcgcgggtcggtcacgaaacgcgcaacgcccttcatcgccttgatcagttcgccctgggtatagggcttaggcggcatcgtcttgagggccttgatgtcggccccggcgatctggcatgccatcccgtcacgcagcgcaggcagcacttggctgcgcgcggcaccatcgccgtcctcgtccgcttgcggttcggccggcaccaggcgccatcccttggcgacgacctgcttgcccgtggccaccagcttctgctggccgcaggagagatcggccacggtgcggtcgaactcgtggtgcgggaggaactgggccaggtaatgtgcccggatcagccggtacaccgcccgttccttctcgctcatggcggagagattcgcgggttcgagcgtcgggatgatgccgtggtgcgccgtcaccttgccgtcgttccaggcgcgcgaacgcacggagcggtcgagctgctccgtgatcgggcgcagcgagggatcggtcttgagcaggctgtcgaggaccgtaggcacctcggcgaacatgctttcgggcaggtagccggaatccgagcgcgggtacgtcgtggccttatgcgtctcgtacagggcctgagcgatctccagcgtctcctgcacgtccagcccaagctgcttggagcacacctcctgcagggtgcccaggtcgaacagcagcggcgggccttcgcgcacgcgctcggtctcgaccgacaccacctgggcactgcccgcggcgcggatctgctgcgcggcttgctgtgcgacgggctgctgcaggcagcggccggcgtcgtcggtgctggcatcgggtgccacccactgcgcggtgaacgtctgaccgcctgcggacagggacacgtcgatggcccagtagggcacggactcgaaggccgcgatctctcggtcgcggtctaccacgagtttgagcgtcggggtctgtacacgcccgaccgacagcacgccgtcgtagccggcctgccgcccgagcacggtgaacagccggctgaggttcatgcccacaagccagtcggcgcgcgagcgcgccagcgccgagtaatacatcggcagcgtctcggccgagggccgcagcttggcgagcgcggtgcggatggacgcatcgttgagcgccgacagccacaggcgtgctatggggccgcggtatccgcacaggtcgatgatctcgcgggcgatcagttcaccctcgcggtcggcatcggtggcaatgacgagatgggtcgccttcgccagaagcgttttgacgaccttgaattgcgtggcggtctgcggtttgacctcgacccgccactgctgagggatgatgggcaactgctccaacgaccagcgcttgagcgccgcgtcatagacctcgggtgctgccgcttcgacgagatggccgatgcaccaggtgaccgtgacgccggagccgttgaggcagccttcaccgcgctgcgtggcgccgagaatccggccgatgtctttgccctgggagggcttctcgcacagaaacagccgcatgtccgtccatccgcttcccgttgttcatggagttgctgggatcgaggatgccgagcgcctgttggggcagcagcaaacaagctgcatgcggcagcgaccgctttcacgagatgggatggctgcggcggggatggcgtgcggccggcgatgtgcgagtcgggagccgcgatgttcgggagcgcgtggaagccggtggacgctggtggcgctatcccctggggatag

SEQ ID NO: 4347 - DNA, 1311 bp, Pseudomonas aeruginosa
cgagccctgtgctcaggtcttgcgcagcaggtcgcgcaggcgctcgatgtgctgccgggccacctcgggcggcacgacgttgcgcggcggctcggatggtggcgctcgcgccgccgatggtgttggcggtgctgggccggtctgcttggcccacgcattgaactcgccgcgcatggcgcgctggatgatgccgaacagatatccggcggggttgcggatgccatgcttgccgcaccgtgcggcccattcgtccagcacggcctgccccagggcagcgtccacctgctgcaacgccatcctggctccggcctgctgttccgccttcagttccgcgaagcgcttgggccattgcaggtcgcccagcgcacgcgcctgcgcggtagtacgtacttcattaatactactactacgtactgtacggtcctgcttcggattccgaagagcgccgtctggcgcgggtttcggccctgcttcggattccgaagaggggcgttcgccattccgaagaaggctcgcgggcccttcttcggaatcgtggatcgcatcctcctgtggataactttcggtggcggtgatgccctggtcggccaggcgctcggcgagcacttgcagccgcgacggcaaggtgcgtccggacaacatcgggtcgtccgcgatctcctggagggtgttgagtcccaccacctgaacggccttggccgaatgccccagcgactggctgaccagggccaggtagtcggcgtcgagctgcatggcctcgaacggtgtcaggggttcgtcatgcaggacgtagaggtttccgaggatgcggccggtcttggggtcgcgccgtcgtcgcacgaggctcagccagcgcgtcaggcgcagcagcgtcagcgcccgcgcgacggtctcgtgggaggcttgtcccgcgcagggcatggacgccagccaggggcgcaactgctcataggtcgagaacgccgtgacgccgtcgtcgttgagcatcagccggaacacctgccaggcgttgcgctccagcggtgtcaggcggcggtcgaggaacagccgccgcggcacgctctcgtgccgattgccactgaacaggaaggcgtcgccggacgcggcaggcgtgggcactgccatgggcgctggcgcgctgggatgtggcttgggcgtgaggtccttcagcgcagcgtcgaacaggtcggcgagtgcgatggggccttgacgcggggctcgtggggcggtgtcgtccacggccatggcctagcccaatccctgatcgacccagttcctgatcgcggcccagaccaccgagagcggcagtga

SEQ ID NO: 4348 - DNA, 420 bp, Pseudomonas aeruginosa
agtccgccggcttgcaccgggatggactgcaacacgctcgccgagaagtcgggcggcagcgcatcgcccaactggtcggcgaccatgcgctggatcgactgcagccgttcggtcgtcggtgccggcgagacgatgtgctcacgaagcagatcgctcggtgcagccgccgggcttcccgtggccgcttcgctagccgccttgtcgtcgtggcgcaaggtgggctcggacgccggagggctggcgggtggaggaccgtccgccgctgcaggcgtggcgatggacgatgctgcgcccggcggagtcggcgtgccggcggtgggcgaaggcaacgccggctgcgccgcaggtggcgtcgggtcactgaccagcgcccggtggcggctttccgattcggtcagatccagcgccagcacgtcgtag

SEQ ID NO: 4349 - DNA, 192 bp, Pseudomonas aeruginosa
cgtgtcgtgctgctcctgcagttctcgcatctcacgtcgggcttgttcaagcgcggcctgaagggccagccgctccacgaggatcgcctgtcctgtttccatggtgatgaaaggatgcgccatgcgttcgccacggctgaacagaaatcctggccggtgctcgggatagtgggtgcgcatccagcgttttag

SEQ ID NO: 4350 - DNA, 510 bp, Pseudomonas aeruginosa
gagacggagatggctgaacattcccatgaacatcaacatcacacatccggtcagatgggtaagcacggccgaccatacgccaagttctgggtgaacatggtgttgggcctcgtcgtcatgtacttcgtaatgttcagcatgatcgacggcgccagggacttcagaaacaatctcaacatgctctacatggcggtcactatgtgggcgccaatgggcatcttcatgctagcgacaatgcccggcatgtttccaaaccggcggctcaatctcgtgctgtacggcttgtttgccgttctcacactcggttcttttgccgctacccgtgctcaaaccggaatcggcgatcgacagttcatcgcgtctatggtcccgcaccattcgggagcgatcctcatgtgccgcgaggcgcagctctcagatccggaactcgtcaacctatgccaagcgatttccgatggccagcgcgcggagatcgagcagatgaaccggattgctgcacgccttcgttga

SEQ ID NO: 4351 - DNA, 2571 bp, Pseudomonas aeruginosa
cttgagcatgatggcctcccgtacgtcagggatgtgcccgtcgattctagccaatcgcccgggtttgggtgggtgaagacgacaaaggcgccggaaggcgcctttgtcggttgcgaccgtcgctttgccgcggagtgtcagcggatcctgccgtcggccagttgcagttcctccttggcgaagtcgtcgacgtcgatcaccttgcgccgtgccgcttcggcctggtgcagggcctgcgcctgctcggcgctcagcacgccggcggcggcgccggcatcgatcgggttctgccccgcttgcggctggaccctgccttccttgatcgccttgtgcagggttttctccagcgcggcgctttcgcgtaccgcgtcgaaggcgtgggcgagggcaccgaccgggtcctgcgggtccttcggcaggaacgcgccggcgatgatcgccctgcaacgccgggtcgtcgtccggacggtcgatgatttccgcgatctcggcgtccagttcgtcgcccggccctttgtgccggcggccgaactgcagtaccaggaccttcagcgcgcagccgaagaatcggctggggaagttgttcagcaggtcctccagcgccgcctcgggcttgccgaggttttcctccatggcccagcgcagcagcggatgcaggtagtccgggttgcccaggtcgtggtagcgcttgagcgccgccgagcccaggtagagatagctgaggacatcgccgagacgcgcggagaggcgttccttgcgcttcagttcgccgcccagcagcatcatgctgaagtcggcgagcagggcgaaggacgccgccaggcggttcagcgcgcggaagtagggacggctgatgcggtcgccgggcgcgttgccgaggtggccgcagctgagactgaggaggaagctgctggcggcgttgccgacggcgaagccgatgtgcttcaccagcagcgcgtcgaactcgcgggcggcctggtccttgtcctcgcgctgggccagttccatttccttgagtacgtacggatggcaacggatcgcgccctggccgaagatcatcaggttgcgcgagaggatgttcgcgccttccaccgtgatgaagatcggcgcgccctgccaggaacgacccaggtagttgttcgggcccatgatgatgcccttgccgccatggatgtccatggcatgggcgatgcactcgcggccgcgctcggtgaggtggtacttgaggatcgccgaaagcaccgagggcttctcgccgaggtccaccgcgttggcggtgaggattcgcgcgctgtccatcagccaggcgttgccgccgatgcgggcaagcgcctcctggatgccttcgaaggcggcgatcggcacgttgaactgctcgcggacctgagcgtagcgaccgctgacgtagctgctggccttgccggcgctggtgcccaccgccggcagcgagatggagcgtccgaccgacaggcagttcatcagcatcatccagcctttgccgatcatttcctgcccgccgatgatgtactccagcggcacgaacacgtccttgccggagttcggaccgttcatgaaggcggcgcccagcggcacgtggcggcggccgatctcgaccccgggggtgtcggtggggatcagcgccagggtgatgcccaggtcctcctcgtcgcccaacagatggtccgggtcgtggcacttgaaggccaggccgaggagggtggccaccgggccgagggtgatgtagcgcttttcccaggtcaggcgcaggccgagcacctcgcgaccttcccattcgcccttgcagacgatgccgacgtcggtcatgccgccggcatcggagcccgcgtaggggccggtgagggcgaagcaggggatgtcgtcgcccttggccaggctcggcaggtagcgctggcgctgctcgtcggtgccgtagtggagcagcagctcggccgggccgagggagttcggcaccatcaccgtcgaggccaggtcgccgctacgggtggcgagcttcatcactacctgcgagtgggcgaaggcggagaagcccttgccgccgtactccttgggaatgatcaggccgaagaagccgtgctgcttgatgaaggcccaggcttcttccggcaggtccatgcgctggccgatgtcccagtcgctgaccatggcgcagagttcttcggtcgggccgtcgacgaaggcctgctcttcttcggtgagttgcgccttggggtagtcgagcagtttctgccagtccgggcggccgctgaacaattcgccatcccaccacacggtgcccgcctcgatggcctcgcgctcggtgtcggacatcggcggcaggactttctggaaccaggcgaacagcggaccgctgagcacgcgccggcgcaggtcgggcagggcgaggggaagcgccaccgccagccagagcagccagaagaccagcagcagccagccgggcgcgtggctgaacacgcccatcaggatcaggtaggcggcgctgatgccgagcgcgggagcgggtggggtacgccgatgggcgaggtaagcgacaccgagtaccagtacgactaa

SEQ ID NO: 4352 - DNA, 261 bp, Pseudomonas aeruginosa
tcagtgggtaacgggggcgacagtggcccccgcgcagactacaggggaactcattcgaggagacttcccatgcgtaccttcactgcctccaccctcgctttcctgctggtcctcgccccgaccgttccggccatggccgacagcggcggcgacatcgtcttcgagcgcatgcaggcccaggccgccaaggctcgtgccgcgcaccaggagaaactggcgaagcaggccgaagcgacgaagaaggacaaggaaaactgctga

SEQ ID NO: 4353 - DNA, 789 bp, Pseudomonas aeruginosa
tcgccagttcttccacccccggctccacacgggatgacggagggctccgatcccgtcttcacccgccaccggttccctggtttccggtcggcgggttttttatgcccgtcggtggcgctgggcgatcttagccttcgcggtccgcaacggcggcaagctgacaaagatgtaatgctcccgacagccagccggcaggcgcagcgacacaggataggcgacatcaacccgatggagattccccgtatgtttccgcgccgcctgcttcccgcttccctgatcgtcctcggcgtgcttttcggtgccagcgcccaggcttcgccggcccacggccaggccttcggcaagccggcccaggccgcgcaggccagccgcagcatcgaggtggtgctcggcgacatgtacttcaagccgcgggcgatcgaggtcaaggccggcgagacggtccgcttcgtgctgaagaacgaaggcaagctgttgcacgagttcaacctgggagacgcggcgatgcatgccgagcaccagaaggagatgctggagatgcagcagtccgggatgctcaccccgaccggcatggcgtcgatggaccatagtcagatgggccacggcatggccggcatggaccatggccggatgatgaagcacgacgaccccaacagcgtgctggtcgagccgggcaagagcgccgagctgacctggaccttcgccaaagccacccggctggagttcgcctgcaacatccccggccactaccaggccgggatggtcggtcaactgaccgtgcagccctga

SEQ ID NO: 4354 - DNA, 927 bp, Pseudomonas aeruginosa
agatgccggccgatccgtatacacttgccgccgcccgccagtgcggcgcggcgcgcggggaagggccctgcgcgattcatccagcaggtttccctcatgcagcatcccgccgaacattcgccgctgggcaagaccagcgaatacgtctccagctacacgccgtcgctgctgtttcccatttcacgcacggcgaaatgggccgagcttggcctgagcgccgagaccctgccttatcgcggcgtggatatctggaactgctacgagctgtcctggctgaccccggccggcaagccggtggtggcgatcggcgagttctcgatcccggcggactcgccgaacatcatcgagtcgaagtcgttcaagctttacctcaattccctcaaccagtccgccttcgatagtcgcgaggcgcttcgcgcggtattgcagaaagacctctcggccgctgccggggcgcccgtgggcgtgcgcctgcgcagcctcgacgaggttgccgaggagggcatcgggcgtctgccggggcgctgcatcgacgagctggacatcgccgtcgacggctacgagcagccgcgcccggaactgctgcgctgcgacgccgggcggatcgtcgaggagcagctctacagccacctgctcaagtccaactgcccggtcaccggccagcccgactggggcaccctggtggtcgactaccggggcccggcgctggacccggccagcctgctggcctacctggtttccttccgccagcaccaggacttccacgaacagtgcgtcgaacgcatcttcctcgacctgcagcgcctgttgcagccgcaggcgctcagcgtctacgcgcgctacgtacgccgtggcggcctggatatcaatccctaccgcagcctggcggaggtcgcaccggacaaccgacgcctggtgcgccagtaa

SEQ ID NO: 4355 - DNA, 1320 bp, Pseudomonas aeruginosa
aggatgaatacttattttgatattccgcatcggctagtgggaaaggctctgtatgaatcatattatgatcattttggccaaatggatatattgtcagatggaagtttgtacctaatatataggcgggcaacagagcatgtaggtggtagtgatgggcgtgttgttttcagtaaactggagggtggtatttggagtgcgcctaccatagttgcccaggcgggaggacaggattttcgagatgtagctggtgggacgatgcctagcggaaggatcgtcgcggcctcgacggtttatgaaacaggagaggtgaaggtctatgtatctgatgattcaggtgtgacatgggtacataaattcacattggctagaggtggggcggattataattttgctcatggaaaaagttttcaagtaggggcacgctatgtgattcctctttacgcggcgacgggagtcaattatgaactgaaatggctagagtcttctgatggcggagaaacttggggcgaaggaagcacgatctacagcgggaacacaccatacaatgagacttcttaccttcctgtgggagatggcgtaattctggctgtagccagagtaggatctggtgccggaggagcgttacgtcagtttataagtctggacgacggcggcacatggactgatcagggtaatgtgactgcacaaaatggtgactctaccgatattctcgtagccccttctctctcctatatttactctgagggaggtacaccacatgtagttcttttgtacacgaacagaacgactcatttttgttattacagaacaatcctgctggcgaaagccgtagcaggctcctccggctggacggagcgtgttcctgtgtatagtgcgccagccgcctccggttatactagtcaagtcgttttgggaggtcgaagaatactgggtaatctattcagggagacgtcttctacgacgtcgggagcttatcagtttgaagtgtatctgggaggagtcccggattttgagtcagactggttttctgtttcttcaaatagtttgtataccctgagtcatggactccagaggtcgccgcgtcgggtggtcgttgagtttgcaaggtcatcgagtccatcaacatggaacattgtcatgcccagttatttcaatgatggagggcataaaggcagtggggctcaggttgaagtgggtagcttgaatattcggcttggaactggagcggcagtatggggcacgggatatttcggaggaatcgacaatagtgccacgactcgattcgctaccgggtattatcgggtcagagcatggatttag

SEQ ID NO: 4356 - DNA, 1788 bp, Pseudomonas aeruginosa
aatattgcgatcctggcatgggccagtaagatgggccgttcgacgacccgcaccagcctctatcaaggatcgatgcatgagactgccccgcccgcgttttgccctttccgccgccttgctgctttgcctttccggttgcgtgtcggaactcgattcgggcgcctatggcagcatggacgatccgcgcaacgcgcagatgctggacctggtggaccaggcgctgaaggggaacatggccgtggtactggtggccgacgtgatgccgcacaagtccctgagcgatgccctgaccatgacccagtggacgccaacggcgatctgggagtacgagaaggacccgaaggtgaccttcggccgcaagttccagaccaacgcgctgcagcggaagcccgacgagacctatctgttcaaggccttcgaggtgcatatcctgccgcccggcaagtacctgctgaccggcggcgacgactaccagatccatggcttgctcgaccaggtcggcgcccgcagcggtccgcccggttcgggccatggcgccaacggcaccgcgtacctgtcccccgagctgtatcgcgagtactaccgggaagaagtctggaaagatgccacctatggcagcgagatcaagaccgagaaggtctgcaccgccgtgcatgtggcctcgggcgcctgcgtgagctggggcgagcagcaatacacgcagacgacccagggctcccaggccggctattaccagcagaccgactcccgcgacgtgccctcgatcaaggtccaggcgcgcctgccggtcgacaaggcgctggccagcttcaccgtgcagggcgggcaattgctgctggccccgcgcatgcacctgaagacccccggctacaagtaccagcagtcgaagtgccgggcgatcgatccgaagaagatcgaatgcccattggaaaacctgaccgtctacacctggccggcgccgatggacttcagccagtccctgatcgcccagcgggccctgagcgacaagcaccggcaactgctgtccagactccagcccctgcagatcacgccgctgcgcaagcagggcatggaagacccggtctggggcgtgccgctgtcattgaaatagcgggtgttcgctcaggggggcgccgggtgccgcccctatccacgatcggcagggaagcatttccccacaaggaaggtgacatgaacgtatatcgcaaggtttcccgcagtgccgcgacttggctgtgcgccgcgctgctggccgcatccggccatgcctgggccgaagactggtgggtggtacacaagggcgacgaccctgccgagcttgacgtgttcctggccgatgccgattcgctggcacccgtgccgggtatcgaaaacgcctggcaggtgcagatcgccatgctgttcgactccttccatctgctcagcgcgcaccagtaccgctgcgatacgcgagaggtgaaggtggtcaacgccaagaccttctccaacaacgggcaacccacgaacctccagttcaccttcgccaagggctggaccccgctgcccaacgaaagccatgaggctgtcctccagttcatctgcgcgccgcaggagcgcgaacgcaatggcatgcgctccaccggcaggggcgtgccattgcaggcggtgatcaccgccgtcggcatggtcgagatggagcgcgcccaggccaatctcgccgaggcccggcgcaagctcgaagaggccaagagcgatcgcgtcatgggcgaactcgatcgtctgctcggcaacgaaccccggaagccctga

SEQ ID NO: 4357 - DNA, 360 bp, Pseudomonas aeruginosa
ggcgaggcggatcgggccgttttccggagcgatcggcgtaggtccggaaggcgcgtcgggagggtctcgatgaagtggtatagccgcatcagcctgggactcagcctcgcggtcgcgagcgctttcctggtggcgtactggcgatcgctcgtcagccatagctatcccaatatgaatgcgcctgggctgatcgcctacctgctggtctttcctgcctgcgccctgttgctgcattcccctgcgttggcattcgtgctccagcagcgaaagctgggaagcgctcgcgaaagagcgctgcaatggacgatcaacctggcgctgtggatggcgccgctttgtttcatatttgccagtctttaa

SEQ ID NO: 4358 - DNA, 1614 bp, Pseudomonas aeruginosa
tccagtggggaaaaaccaatgaacgaaagcgtcgccagggtgttcgatcggattctacgggggctcgggttgaagaccctgaacgcccagttcctgctgtcctatgcactgatgttcggcctggccgcctgcgcctcggtggcgttgtacctgagcatgtcgatctcgccggaaaccatcaacgtggccggcgcgcagcgcatgctcagccagaagatggcccgcgaggcgctgcaattgcgactcggcgccggcgacccaaaggccctggccgcgaccatcgcccagtacgaacgctcggccgccgacctggatacgggcaatgccgagcgcaacgtgagccggatgggcgcgccggagatcgccgcccagcggcagaaggtggcgcagatctggggccgctaccgggccatgctcgaccaggtggcacagcctgccagccaggtcgatctgcgcggcttctcgcagtattccaccgagctgttgggcgagctgaacaacctggtctcgctgatgagcgcgcgcgccgacagtgtccagcacacccagatgtggatcgccttcggttgcctgttggcgatcctggtgctggtggtgctcggccggcagttcggcctggcgccgctgatgcggcagttgcgtgggttggaagtggcgctgaccgaggtcggcgcggcgaacttcacccatgccctggcggcgggccatgcggacaacgagatcggccgcatcgtcgctggctacgagcggatgcgccaggacgtcagcggtttgctggcgaacgtcaagcgcagcgcggcagagaccgacaaggacgtggccgaggccctggagcaggcgctcggcgccggcgaccaggtggcgcgccagcaccaggacctggaccaggtggccaccgcgatgaacgagatgagcgccaccgtggccgaggtcgcccgccacgccaaccatgcggcgcactccacgcgcgacgccgcggccctggcccacgagggacggcgtctggtggagcacgccagcagccagaccggtgcgttggcggaggaactggaacagaccgccctggcgctgaacaccctgcaccagcatgccggcagtgtcggccaggtgcttacggtgatcagcagcatcgccgagcagaccaacctgctggcgctcaatgccgccatcgaggcggcgcgggccggggaggccgggcgcggcttcgccgtggtggcggacgaagtgcgttcgctggccaaccgtacccagcagtcgacccaggagatccaggggttgatcgagcagttgcaggacggcgccaacgatgcggtcgccgccatgcgcggtagcgccagccatgcccagagcaacctcgtcgaggccgacagcgcggcccaggcgctggggcgcatcgtcgccacggtggaagaactggacggcctcaaccagcagatcgcgaccgccgctgaggaacagagccaggtggcccaggacatcgaccgcaacatcaccaacgtctccggactctccgagcaggcccacgaagggaccgccgcagtgctttcggccaaccagagggtcaaggagcacatggctggcttgcgcgtggtgctcggtcgcttccgtacctga

SEQ ID NO: 4359 - DNA, 1245 bp, Pseudomonas aeruginosa
ttcgaggtattccgcctcgctgtgcaggccggcgccgaccacgccgagggtttccagcaccgccggtttgtcgctgccgggcacgtaggcgtagccggcgtccgtgccgaagcgcatggcgatcggctcgatgcgcttgccgactcgaccgtagagcgtctgcgcggtttccgccaggcgctgcgaggcggggttcttcaccagaggcggacgacccttgtcgagacgcagactgacttcggtatcggcgaccaggcgttcgccggtcagcttccgggcgtcggccagtacccgctcgctctcggccgggtccgagtagcgcatgtcggcttccgccgaagcctcggcgggaatgatgttgcgcttctcgccgcccctggcgagggtccagttcagcgtggtgcctttcgccggatcgccgaggtccttgagacgcagcaactggtgcgacagttcgagaatggcgttgcggccttgctcgggtgccgagccggcatgggacgagcgacccttcacctcgagcagcaggccgtcgatgccattggtggctaccgtcactgcgtcccggtccggcggctcgtaggagaagacgtagtcctgctgccgggccagctcggcgatcagttgcttcgagccggcggagccggtctcttcgtcgggattgaacagcacggtgatccgtccgtagtccctgaagccttgctgcctgagcagcgccagggcatgcagcaccatcgccacgccgcccttggcgtcggccacgccgggtccgtaggcgcgctccgcgtcctcgcggaacggacgcttcgccgcgctgccggcggcgaacacggtgtcgtagtggatcatcagcaggaagcgcttgctgccggtgccatcgagggtggccaccaggttgtcgccggccgagggcgtcgccggtgcgctgcggacttgcgcgccgagcgcctgcaggcgttcggcgagcagcgcggacaactggccgaggccttcggcctggccggtaccgctgtccaccgcgaccagttgccggagcgtgtcgaggtaggccgggcgttcggcttcggcctggcgcagcagctcggcggctggcgtgtcggcagcgaaggcggcgggcgaaagcaggaaggcgagggcgagcggcaagaggcggggcaggcggcgggcgtgcacggaaggtcctcgtctggcgggcggaggcggcgcggttgtgcgccgcggtatccgattgaccttaggtcatga

SEQ ID NO: 4360 - DNA, 837 bp, Pseudomonas aeruginosa
ttcttgcggcttttagccgggtacctagcatccatacaactcccgtcccgttggcccgctcgctcaaggttgggcaaatctggacaagatggaagctcaggaatccttagttttcgccgtgccggaggctctgtcgtccggggcggcgcgcggtttcgacgccgtgtacgaggctgcggcggggatatgcgtcgatgtcgccgagatcgcgcatgctccggttttctcgcggcgagccggagtatatgcgaattgcataaaggcggacgccgtttcgtcgcctgggggcggcgggtcgtcgtctcgccagaggggcgggcatcggcgccgaggcggcggaaaacggcgatcgggacgatactcaggaaaggtgggcgttgcggaaccaagcctcgccttccaggactaatagccgggtttcacgcagaggtcattcccatgagaacaacaacaagcatccgccgtgtcgctgccgtcctggcagcgctgcacctgctcaccttcgccgaggttccgctcgcccaggcagcgatgatcggtactgcggaagtcatgcagcaacaacagcacaacctcgatcgccagcaactgctgaagatgctcgacgaccagggcgtccagaagaagctggaggccatgggcgtgccccgcgaccaggtggcgagtcgcatcaacagcctgaccaacgccgagctggcgcagttcaaccagcagctggaccaggcgccggcgggcggcatcatcggcatcatcgtgttgttcctagtgatcttcatcatcaccgacatgctttgcgccacggatatcttcagcttcatcaaatgcatcaatcggtga

SEQ ID NO: 4361 - DNA, 1449 bp, Pseudomonas aeruginosa
cgaaggttgaggagcggatggaaaaaacggcaccccggggtgccgttctgtcgacgcggactagaccccgagcttgtcgcgcaggctgtagtaccaggcgccgatggcggtgaacggtacgcggaacagcttgccgccggggaaggggtagtgcggcaggccggcgaaagcgtcgaagcgctcggcctggccgcgcagggcttcggccaggaccttgccggcgacgtgggtgtaggtcacgccgtggccgctgcaaccctgggaatagtagatgttgtcgccgatgcggccgacctggggcaggcgcgagagggtcagcaggaagttgccggtccaggcgaagtcgatcttcacgtccttcagttgcgggaaggtcttgagcatcttcggccggatgatcgcctcgatgtccgccggatcacgagcgccatagatcacgccgccaccatagatcaggcgcttgtcgccggagaggcgatagtagtcgagcaggtaattgcagtcttccacgcagtagtcctgcggcagcaggctgtgggccagttcctcgttcagcggctcggtggtgatcacctgggtgccgcagggcatcgacttggccgccagttccgggaccaggccgttgaggtaggcgttaccggcgaccacgatgaacttcgccttcaccttgccttgcggggtatgcaccaccgggctggcgccgcgctcgatgcgggtcgccgggctctgctcgtaaattctgccgccgagcgactccaccgccgccgcttcgccgagggcgaggttcagcggatggatgtggccgccgctcatgtcaagcatgccacctatatagttgtcggtcgccaccacctcgcggatgcgcttggcgtccatgatctccaactggttgtggccgtagcgttcccacaactgtttctgcgcgcgcaggtgatccatctgcttctcggtgaaggcggcgaacaccccgccgtccttcaggtcgcattggataccgtagcgggccacgcgctcgcggatgatgcgcccgccttcgaaggccatctcgccgagcaactgcgcttcgcgcttgccgacggtgcgctcgatcacgtcgatgtcgcggctgtagctgttgacgatctggccgccgttgcgcccggaagcgccgaagccgaccttggcggtttccagtacggtgaccttgaaaccattctccaacaggaacagggcggtggagaggccggtatagccggcaccgatcacgcagacgtcggtttcgacctcgccctggagttccgggcggggcggcgcgggattggccgacgcggcgtaataggaggaggggtagggggtgtgcggcatcttgcacctctgttttttattttttacggatgcccggatgctacccgagtcgaaatcggccggctagcctccgtgcaaaattttcaacggacccccagaaaataa

SEQ ID NO: 4362 - DNA, 492 bp, Pseudomonas aeruginosa
ccctggtcagacgctgaccacccggttgcgtccggcacgcttggcgtcgtacagcgcggcatccgcccgggcgagtgcccgttccggttcttcgccgctgccggccagggtacagccggcactgatggtcaccggcacggacgtgccggcacagtcgatcggggtcgcttccatcagttcgcggatgcgattggcgatcatggtcagttccgtggtctcgcggacccggaccatcgccacgaactcctcgccgccgaaacgcgccaggagatcttccggccgcagcgccgcgcgcagtcgcgaagccgcctcgcggaggacgctgtcgccggcccggtgccccagggtgtcgttgatacgtttgaaatggtcgatatcgctgtagatgatgccgatgcgctggtcgctggcccgcgccaactccagttcatgctggtgcagcgcgtggaagccggcccggttccacaattgggtgagggggtcgagcagtga

SEQ ID NO: 4363 - DNA, 813 bp, Pseudomonas aeruginosa
ggtgcgcagcccatcgatacaggagtccggaacatggaactgacgatcttccaggtagacgcattcgccgacagtcccttccagggcaatccggcggcggtctgccccctcgatgcctggctggacgacgagcgcctgcaggccatcgcggaagagaacaatctttcggaaaccgcctttgtcgtcggccgcgacggcgactatcgattgcgctggttcacgccgcaggtcgaggtggacctgtgcggtcatgcgaccctggcgacggcctgggtactgatccacaagctcgacgacgcttccccggtactgcgtttcgctacccgtagcggtgagctgagcgtgcggcgcgagggcgactcgctggcgatggacttcccggccaagcgtccggagccttgcgcgacaccggacggactgctggaggcgctgggtattgccgaggcggaagtgctgaagaccgacgattacctcgtggtggtcgacgacgaaaagacgatcgccgccctggcgcctgacttcgcccggctgaagggcttgccgtgccgcggggtggcggtgaccgcgcgcagccagcgcttcgatttcgtctcgcgctggttcgggcccaacgtcggcgtcaacgaagacccggtgaccggttccgcgcatacctccctggcgccgtactgggcgcagcgcctgggcaagacccggctgagcgccgagcagggcggggcgcgcaaggggcgcctggaatgcgacgtgcgcggcgagcgggtggtcatctccggcaaggcggcgttgtacatgagcggtacgctccatctctga

SEQ ID NO: 4364 - DNA, 432 bp, Pseudomonas aeruginosa
tcccgaagcaggagtacgacgatgccggcaccgcaggtaggcgtgggcgtcctgatcttgcgggacggcaaggtgttgctggggcgccgcaagggcagtcatggcgctggctgctggtcggcgcccggcggccatctcgagttcggcgaggcggtggaggactgcgccctgcgcgaagccctggaagagaccggcctggcgctgagcgaactgcgccacggcccgttcagcaatgacgtcttcgaggggcgccactacctcaccgcgttcatcctggccggttgcgcggaggatgccgaggcgcgcctcatggagccggacaagtgcgacggctgggcctggttcgattgggccgatctgccggaaccgctgttcgcgcccctggcgagcctgcgccggcggggctattcgcccttcgacccgaagcgctga

SEQ ID NO: 4365 - DNA, 537 bp, Pseudomonas aeruginosa
acagccggtggcggaagggctggctggcggcgcgccagaggaatgcgccccagaccaggtagatcgtcgagatcatcagctcatagtgctgtccgccgccttgctggtcgccccagcgaaccaggcggagcagcaggcgcccggcgtcggagtcgagcagcgactggtcgagccgcaggagcagcgtggccagggccaggccgaagaacagcaggaagccgccggccatcaggcgaatgctcagggtcagccaaggcgtggcggaaaccggggaaggggaggcagtcatgcagatcacctgtaggccatgtcgatggcgttgccttcggtcaggtcgtcaaaatccgcacggcggaaagggcgctcttcccgggtgatggtgcgcacccgttcgatgtattcgcgcatggcgcggcgggtattgccctgggaggcggcggagaggaagccggccttttcgctggccatgccctccgtccagtcgcgggaagccgcctggtagatcgaacgcttgatcaggcgcaccgcttgcggtga

SEQ ID NO: 4366 - DNA, 615 bp, Pseudomonas aeruginosa
cgacatcgtctccccaaccaacggatagtcggcatgcgctacaaaccggaacagaaacaggccacccgcgccctgctgttgagcaaggccgctccgctggtgaagcgccagggcttcgccagcaccggcctggacaccttgatgaaggcggctggtcttaccaccggggcgttctactcgcaattctccagcaaggcggagttgctcgaagcgatcctgcagcgcgagctgagcgcccagcacgatgcctttccgctggacagcctggagcaactggccggcgccacccgtctctacctcagtcgcggtcatgcgcagcatgccgacatgggctgcccgattccggcgctggccgccgaggtgggccgggcagggcccgaggtgcgggaaaccttcgaacgcgccctggaacagcggcaacggcggctggccgaactgatgggcgacgagaaccgggcctgggtgctcacctgcttgtcggtcggcgcggtgcttctcgcgcgtgcccaggcgagcgaggtggcgcgcgacaaggtcctggatgcggcgctggagcatgcgctgggcctgctttcggcgagcggagcggtttcgccgcaagcggaccgggactga

SEQ ID NO: 4367 - DNA, 471 bp, Pseudomonas aeruginosa
cgctgcgctcgcacgcgctggaacggtcgctggcgccggccttccagcggaccggcgcggtggatgcgttcctctacggcgaggaccgcgacctgtccggctacaaggacggcaccgagaaccccaagggcgatgcggcgctcgaggccgcgctggtctccgggcgcggtgcgggcctggatggcggcagtttcgttgctgtccagcagtggctgcatgacttcgaccggatgcaggcgatccccggcgaggagatggacaacatcatcggccgccgcaagtccgacgacgaagaactggaagacgcgccggcctacgcccacgtcaagcgcaccgagcaggaaagcttcgagcccgccgcgttcctcctgcggcgcggcgcgccctggtccgacgagcaccgcgcggggctgttgttcgccgccttcggccgctcgttcgaggccttcgaggtccaatggctacggatga

SEQ ID NO: 4368 - DNA, 537 bp, Pseudomonas aeruginosa
acatcggcctggtgccgggctgaagcaggcgcaacgaaaaaagccgcccgtgggcggctttttcatgcgcggcgtttattcgctgaccgctttctcgaccttttcggacgccgaccagatccgatagcggacctccacgtccttcggcgcatagaccacgatcggcagcttgctgttgtagcgcagcaggaagccttcgccgaccaccgggatgaagcgctgctccttcttctggccggggcaggccatcatcgtgctcatcggcccgctgaccttgtccaggcggtagtaggagtagccccagccttccagggtgtgttcttccagctcgccgcccaggcgctgctggttgcagtcggcctcgagggtcttgccggcgatgatctcgaccttgaatgcgtcttccgcgtcctgtttcggcaggtggatgacctggcgggtgaagccggcatctgccttcgggtagggaaccttttcatccagtttggcggccatggcggtgctggaaagagcggcaacgccggcggcgatcagtag

SEQ ID NO: 4369 - DNA, 357 bp, Pseudomonas aeruginosa
actggccttgcaactgacccgctgaaaaaaacgcaaactgatgcgctgacggctctatcgtgcggaacttgctatgagttggcggggaatttcaagtcaccggcatcgatagccactatcagcccaaagcatttttccccagcggagcggcgtgagatcgtagcggcgtcgggagaaccccaagtccccgacgctcctttgaagaccatcgccctccccccgcagatggtcttttttttgcccgcgattcggccgtgccccgaccggctggcccaggacatggaacattccgttacgtcccccactgaacttttcacccgtgcctcggtgtcttaccctgctcgcgttaccacgtaa

SEQ ID NO: 4370 - DNA, 1350 bp, Pseudomonas aeruginosa
ctcccgtgcacttcgaaccttgcgcttccttcaatttcagcgcacatcaagccaacaaccaggaacaataagatgttgaagaaaaggatttgcctgctggcactgggcatcgcgactgcaagccaggcgatggccaatgaccaagaagcagcaaaggggtttgtcgaggacagccacctcgatctgttcttccgcaatggctatatcagccgtgactacaaacatggccggcaggacaaggccgaatggggccaggccgccactgccaccttcacctccggcttcacccaggggacggtgggcgtcggtgtcgacgcgttcggtctgtacgcggtacgcctggacggcggcaagggtcgtagcggcgccgccggtatcgacttcttcaagcagggcgacagcggctccgcggcggacgatctgtccaagggcggcgcggcggtgaagttccgcatctccaacaccgtgctcaagtacggcgaccagatgcccagcctgccggtgctcagctacgacaactcgcgcctgctcccggaaagctacagcggcaccctgatcacctccaaggagatcgagggcctggagctgaacgccggtcgcttcaccgcggaatcccgcaagagcgccgaagggcgcgacagcggcggcctgaagagcatcaacgtgttcggcggcaagtacgccttcaccgatcacttcaacgcctcgctgtacgcttccgacgtcgaggacgtactgaagaagcagtacatcaacctgaactacaccatcccgctgcaggccgaccagtcgctgaacttcgacttcaacggctatcgcaccaagctggacagcgacttcgccgaccagaacttcaacggtaaccgcgacaacaagatctggagcctggcggcgtcctacaccatcgacgcccacaccttcatgatcgcccaccagcgcaacaccggcgacaccggctacaactacggctggtaccagaatgccggcggcatcggcgacggcggcaccaccatctggctggccaactcctactggtcggacttcaacgccgaggacgagcgttcctggcaggtcagctacgccctggacttcgccaagtacggcgtgcccggcctgacctaccgcgtagcctacgtgcgcggcgacaacatcaagaccgccgagaccagcaacggcaaggagcgcgagatcttcaaccaggtccagtacgtggtgcagagcggtccggccaaggacctcaccctgcgtctgcgcagctcgttcctgcgtgtctccaacgacgcccgctcgtacaacgacgacggcaacgaaatccgtgccttcgtcgagtacccgttcagcgtgttctga

SEQ ID NO: 4371 - DNA, 528 bp, Pseudomonas aeruginosa
tcgaacctgcgagcgcgacgagaaccccgggccagtcccggggttttcttttttgcgtttcgtgcgccagttcaaccttatcgggtagagccgtacagcttcggaaagccagtgatagcattcgctctcgcttgccattgcttatcgatatcgacaatgccgttccggaaacaccttctgctccccctcctcggtcttgccctgctgctcggcggttgcggccctagcgtcagctactcctacattccgccgaccagcgatgccggcctgcactgcgtgagccagtgcaatgccgagaagcgccagtgcaagaccctcaccaagctgcagcagcgccaggacgaggcgctctaccaggcgcagagcacggcctacaactactgcatgcagaacagcgacaagaagaagcgcaagtcctgcccctacccgcagcgcaacttcgatttcggcgacgactgccaggacgagtaccgcagttgctaccagtcctgcggcggcaccatccgccgcatcgtccaccaggactga

SEQ ID NO: 4372 - DNA, 834 bp, Pseudomonas aeruginosa
cacgtcgcctaccggaacaaggagttgttcttttcgacgaacgtcctcgactcccgctatcgcccgcccatcgcgacctcgtatgctcgccgggcgatgcctcatgccagcaacccccacccacaagggagcaacacgatgagcaacctgcctgcaatcatcctggtccacggcttctggggcggcgccgcccactggagcaaggtcattctcgaactgaaacgcctcggccacgacaacctgcatgccgtcgaactaccgttgacctcgctggcggacgatgccgagcggacgcgcaagatgatcgcgcagcaacaggggccggtcctgctggtcggacactcctatggcggcgcggtgatcaccgaggccggcaaccagccgaatgtggtcgggctggtctatatcgccgccttcgcccccgacagcggcgaaagtcccggtggcatcacccaggagcacttgcccctggccgcagcgaacctggcgccggacagcgatggctatctctgggtgaaggcggacaggttccacgaaagcttctgccaggatctcgctgcggacgaagggctggtcatgagcatcacccagaaggctccgctggccagcactttcggcgatgccatcggcagcccggcctggaagagcaagccctcctggtaccagatttccagcgccgatcgcatgattgcgccggagaaccaggagcggatggccgcgcggatcgcaccgaggaagatcgtcaccctcgatgccagccacgcgtcactggcctcgcgagcgaaggaagtagcggcgctgatcgacgaggccgccgtggccaccgcccactag

SEQ ID NO: 4373 - DNA, 555 bp, Pseudomonas aeruginosa
ggtcaccgcgcacatgcgccgcatggacaaggtgttcatcgccgcgatcaacggcctggccctgggtggcggctgcgagctggcgctggcctgcgacctgcgcctgatggccgaggacgaccaagtggaacgcttcctcggccagccggaagtactcatcggcctgataccgggaggcggcggcacccagatgctggcgcgcagcctgggcgtagccagggccctggagctgtgcctggaagggcaactgctggagccgcgccaggcccttgcgctgggcctggtcaacgggctggcgccagcggaggagctactggaagccgccgacgcgctggcgcaacgcctgtcccggcgctcaccgcaagcggtgcgcctgatcaagcgttcgatctaccaggcggcttcccgcgactggacggagggcatggccagcgaaaaggccggcttcctctccgccgcctcccagggcaatacccgccgcgccatgcgcgaatacatcgaacgggtgcgcaccatcacccgggaagagcgccctttccgccgtgcggattttga

SEQ ID NO: 4374 - DNA, 531 bp, Pseudomonas aeruginosa
cgacctgaccgaaggcaacgccatcgacatggcctacaggtgatctgcatgactgcctccccttccccggtttccgccacgccttggctgaccctgagcattcgcctgatggccggcggcttcctgctgttcttcggcctggccctggccacgctgctcctgcggctcgaccagtcgctgctcgactccgacgccgggcgcctgctgctccgcctggttcgctggggcgaccagcaaggcggcggacagcactatgagctgatgatctcgacgatctacctggtctggggcgcattcctctggcgcgccgccagccagcccttccgccaccggctgtttatcgacttcaccgtggcggccaatgccgcgcacttcggcctgatgttcctgcagggactgttgatgcccggcgaacacatccacctggccggcgatgtcctgctgggctgggcctcgctgctgccgctgatgctgttctggataccgcaacgcaagcgggcagccccttcgctcgccgtcgagcggaagtga

SEQ ID NO: 4375 - DNA, 300 bp, Pseudomonas aeruginosa
cgccgacgttgggcccgaaccagcgcgagacgaaatcgaagcgctggctgcgcgcggtcaccgccaccccgcggcacggcaagcccttcagccgggcgaagtcaggcgccagggcggcgatcgtcttttcgtcgtcgaccaccacgaggtaatcgtcggtcttcagcacttccgcctcggcaatacccagcgcctccagcagtccgtccggtgtcgcgcaaggctccggacgcttggccgggaagtccatcgccagcgagtcgccctcgcgccgcacgctcagctcaccgctacgggtag

SEQ ID NO: 4376 - DNA, 888 bp, Pseudomonas aeruginosa
aacccgcaaatcctattggttcgcgaccccacttgccaggatagtcggcgaagcgggtcacacatcgacgcgaaaatcgcgcctaccagatccggcagcttcatcgaaaccgccgccgacataagctgtgggcgctgtacatccctggatcctttcccggcctgctccacgcggccgggattttttttgccctcttcacccttgcgccgactgcggacgccaggctggccttcagcctgtccggcagctataccgaaagtctccaccgtgatcaggatccagtatgctcgcctgccccctccctcccgacgaagccctgcgccagcaggccctggacgacatggcgctggtcgacacccccgccgaacactacctggacgccctggtggaactggcgcgggaaaccttcggggtgaagaccgtgctgatcagtctgatcgaccacgaccgccaatggttcaaggcccgtatcggcctggatgccgaacagacgccgcgcgacctgtccttctgcggccacgccatcctggccagcgaaccgctgatggtgacggacgcctccagggatccgcgttttcacgacaatccgctggtcaccgggccgcccttcatccgcttctacgccggcgagcccctgcacgccagcaatggccaggccatcggcacactctgcctgatcgacccgagcccgcggcttctggatctccgggaaggacgccagctcaatcgactgtcgatcctggccgaaggatatctccagctacgcagcctcaccgagcacacccgcttcctgcgccaggagatcgaccgggagcagcgcaagtcactgctcgaccccctcacccaattgtggaaccgggccggcttccacgcgctgcaccagcatga

SEQ ID NO: 4377 - DNA, 222 bp, Pseudomonas aeruginosa
aatcgcccggcgcagcgcctgcgccctcaagcctctttcgtagaaaacaccatgagcaaactgcaacatatcggcctgttcctgttcgttcttctctccgccggcctggcgctcggctaccgagtcgactgcccggacggcagccatgtcgagacctacatgcttcgcggcatgggcgcgcgcatcctcggcaacgatctatgcgagcaggcagcgccctga

SEQ ID NO: 4378 - DNA, 417 bp, Pseudomonas aeruginosa
gccgccgcgccgccgccgaactgtgcaccgacgttgaccccggccatcaacagggcgccacgggacgattgcagtaattgccgcgacatgctggcgcccagcgcggcggtcaatggcgaggcgctcgccagcgccaccgccgccagcagcttgggatcgaggccgaagagaatcgccgtgcccgaaccgccggcgatgactcccgcgccgagttcgacgtacatgcagggcccggtgaagtcgccgcgggacaggtcgcgccccaccaggccgtccgcgaccaagacggttccggtgctcggcaacgcctccagcgcaccggccccgccaacgctcttgcccttgacattgaggttgaccttgccgaagcgcggcaggcgcatgcccagtccgatcccgccgcccaccccgccatag

SEQ ID NO: 4379 - DNA, 546 bp, Pseudomonas aeruginosa
aaaacagaggtgcaagatgccgcacaccccctacccctcctcctattacgccgcgtcggccaatcccgcgccgccccgcccggaactccagggcgaggtcgaaaccgacgtctgcgtgatcggtgccggctataccggcctctccaccgccctgttcctgttggagaatggtttcaaggtcaccgtactggaaaccgccaaggtcggcttcggcgcttccgggcgcaacggcggccagatcgtcaacagctacagccgcgacatcgacgtgatcgagcgcaccgtcggcaagcgcgaagcgcagttgctcggcgagatggccttcgaaggcgggcgcatcatccgcgagcgcgtggcccgctacggtatccaatgcgacctgaaggacggcggggtgttcgccgccttcaccgagaagcagatggatcacctgcgcgcgcagaaacagttgtgggaacgctacggccacaaccagttggagatcatggacgccaagcgcatccgcgaggtggtggcgaccgacaactatataggtggcatgcttga

SEQ ID NO: 4380 - DNA, 1776 bp, Pseudomonas aeruginosa
tccggcggacatcgaggcgatcatccggccgaagatgctcaagaccttcccgcaactgaaggacgtgaagatcgacttcgcctggaccggcaacttcctgctgaccctctcgcgcctgccccaggtcggccgcatcggcgacaacatctactattcccagggttgcagcggccacggcgtgacctacacccacgtcgccggcaaggtcctggccgaagccctgcgcggccaggccgagcgcttcgacgctttcgccggcctgccgcactaccccttccccggcggcaagctgttccgcgtaccgttcaccgccatcggcgcctggtactacagcctgcgcgacaagctcggggtctagtccgcgtcgacagaacggcaccccggggtgccgttttttccatccgctcctcaaccttcgctacggatctgcgcatgactgatcagggcgaagatcaggctaccgccgacgatgttgccgcccagggtaggcagggcgaacttcagcaggaactcggtccagccgatttccccggcgaacgccaggtagcctacctccgccgagcccaccacgatgtgggtgaagctgcccagcgccatcaggtaggtgaccatcgcgatgatccagatcttcgcgccctccgccgccgggatcagccagaccatggtggcgatcatccagccggaaacgatgcccttggcgaacatttgcgccaggtcgttgtgcatcacctcgcggccgatctcaaggaacgccgcgtcggccgcttcattgaatatcggcagatgcagcaccgcccaggcgaacagcagcgtaccgacgatattgccgaacagcaccacgctccagagacgcaacagttgccaggccttttccagggtcggctcggtcatcaccggcaacacggcggtcagggtgttttcggtgaacagttgctggcgggcgaggatcactgccaggaagcccatgggatagccgaagctgctgacgatgatcgcccactcctgctcgggcaaggcagcgcggaacaggcccatgcccatcaacgagaggccgatggtcagccccgcggccaccgccgaccaccagagtgccgccagcgtgcgctgcaactcgtgttcgccctggacgcgaatcacctcgtgcaggacagcggcgcgcggtggctgcttgtcgtcgatctcccgccgctcgttggcggtcagcgccgtggccgaacgtccgtcggccggtttctctttccgctcctcgccgcgcgcacgcggcttgcgcgtgccctccgccgcatgcccctggcgcttgcccgccgcaccgcccttggccggttgccggggggtggggggcgaagtccgcttgtcgttggccatgttctgcacctgagtggggtcctcccaggtatagagccgtctcgctggaacggggttccgacaaccttcggctccgccgcctcagcggggcggtgcgccaacgggacaggccggcagctcggcgcaccgagccgcgggtgcgacggcctgcggcaaggccgcagcgaagcgggcttccccaggctgcaatgcccgcgcgcaggcctgcgcctggcgcgccggcgccgcgcaaccgcgttccgccagcaactgggacaggttgaaccaacccgcggcgaaatccacgcgacgctcgacgctggtgagcatggcctgttcggcagcggcggaatcgcctgcggcgtagcgactgttgcccagggcaaaccaggcgaaggcgtcctcaggccagcgtcgcacggttcttcgtag

SEQ ID NO: 4381 - DNA, 420 bp, Pseudomonas aeruginosa
ggattcctgagcttccatcttgtccagatttgcccaaccttgagcgagcgggccaacgggacgggagttgtatggatgctaggtacccggctaaaagccgcaagaatcagagcgggatactcgcagaaacagttgggcatgctggtgggaatggacgagttttccgccagcgcacggatgaaccaatacgaacgcgaacggcactcccccaacatgcggacttccgaacagctggccatggtcctccaggtccccatggcctacctctattgccccgaggacgagctggccgagctcatcctcaaggtgtccagcctgacacccgagttcaagaaagagctgacgcgtttcatcgaacagttgctcgcggcccagggatcaaccagccgccagcctgtacgcacaaggagtgaactgtga

SEQ ID NO: 4382 - DNA, 513 bp, Pseudomonas aeruginosa
ttcgcagtttcgtcacgccggcgcgcggcctggcgcaaatgtgaacggttgccgccacgctgggagaggcttcttcctagactccgcgccacgttcactcagaggagaaacaacgtggccaagacatggatctacgcagcctcggccgccgccatcggcggtgcgctgatcggcggctggctgctcgacccggctccgcccgaggcatcgccgcaggcccgccagtcccccgccgcccaggcagccgccgccccgacagcggcgctcgcggcgccggcggcggacgctacccgcatgctcgccccgacccccgtcacgacgcccgcgccacgcgagcgggtgacgctctggcaaggcgaactgcgcagccgcgaaggcgccccagggtattcccgaatacctggcgcaggtcgaacccgccctgctcgacacgctggcgctcggccaggtgctggaaatgagcctgccgggtcgcgagcgggccttgcaggcacgcctcgccagcacccataa

SEQ ID NO: 4383 - DNA, 1950 bp, Pseudomonas aeruginosa
cgacccgcacggcgatcatgtcgacgcgccgctcgccgagctgccaccgatgccgccgcccgcccagggctgagcccaccttcccagcatgtttccccagcggtgccctcggggcgccatggcttcctattgtccgaacacaggcaacccatgaagaaatccctgctatgctccaccctagccctggcggtagcctgtgccgcccaggccgcgccgaagaccgtcgacatcatggtcgtctacaccaccgcggcgacccagaccgcaaatggccgcgacatcgatgcgcggatcgccagctacatcgagttcgccaacaccgcctacgagaagagcggcgtcaacctgcgcctgcgtctggtgcacaagcagcgcctggactgggccgactacccgacggtgaccggcgccaacctcgatcgcttcatgcgcgacccgcaggtgcagcgcctgcgcgagcagtacggcgccgacctggtcagcctggtcaaccgctcgcagaacagcggcaacggctacatcacctgcggcatcggctacatgggctcgggcgataagaacagcgggcgcttccacagcaacgccaaggacattgcctacaacctcaccggggtcaactgcgggctcaacaccttcgcccatgaagccggccacaacatgggcctgcgccactcctacgagcaggacctggagtccagctactacgatccgcgctacgcccacagcggcacctacgaatggatccgaggctacggcgtgcaagggcgcttcgccaccgtgatggcctacccgcatgccttcggcaccaacaagcaggcaccgtttttcgccaacccgcgcatggtcaacgccggatgcgccaaccagccctgcggccgggaagaacacgcggaccccgtacgcgcgctgaacagcatggccacgcagatcgccgacttttgcccgaccaaggtacccggcacgatcaacccgggctccggcggagacacgcagaccccgccggacctgccatggtgcacgaaagccaagctcggcggcctgctcggcgatggcgagttcgccagcatggaaggctggcgcgcatggtccggcaacgcccagttgagcttggtgaacgtcgccaagggctgccgcgacaatgccttgctggtcgacgtgcgtggcttcgatctgctggtccgccccattgcccccctgcgcgccggcagcggctaccggctgagcggcaaggtcatgttcaaggccgccaatacccgtgaaaccgtgcgcatggcgctgctcagcgaacgcgccgatggcgccctggcctacaacccggcgcagagcgtcgaactgtcggtcagcggcaacgagttcagtcgcctggagaagaccttcgactaccgtcccgccgccgaccagcgcaacctctacgtggcggtctggagcgacagcggcgccagcctgctggtcgacgagatgaacctgcaggaagcccaggccgcgccgccgagcgtaccgccggcgccgaaacgcatcgcctacgacttcgagagcggcatcggcggctggagcggcgtgcatgccagcgcccgcgccacgcgcgtcgccagcgccgggcggctggccctggaagcctaccagcggcgctacgccggcaccggcgcgagcaccagcctgctgggcaacctggaagcaggccggacctacgcgttcagcgcggacgtacgggtcggcgacggtcgcggctcgcaggccatgacctatgcctacctctacctggaaagccagggtcggcccggcgaatacctgcccctgggctacaaggtggtcgagaatggccgctgggccatcctgcgcggccaggtgcaattgccgaaggggccgatcaagcgtgctgaactgatgatcctcagcggtaaccagcaggagtcgatgttcatcgacaacgtccagttggtgcagaagtag

SEQ ID NO: 4384 - DNA, 1374 bp, Pseudomonas aeruginosa
ggtcaatcggataccgcggcgcacaaccgcgccgcctccgcccgccagacgaggaccttccgtgcacgcccgccgcctgccccgcctcttgccgctcgccctcgccttcctgctttcgcccgccgccttcgctgccgacacgccagccgccgagctgctgcgccaggccgaagccgaacgcccggcctacctcgacacgctccggcaactggtcgcggtggacagcggtaccggccaggccgaaggcctcggccagttgtccgcgctgctcgccgaacgcctgcaggcgctcggcgcgcaagtccgcagcgcaccggcgacgccctcggccggcgacaacctggtggccaccctcgatggcaccggcagcaagcgcttcctgctgatgatccactacgacaccgtgttcgccgccggcagcgcggcgaagcgtccgttccgcgaggacgcggagcgcgcctacggacccggcgtggccgacgccaagggcggcgtggcgatggtgctgcatgccctggcgctgctcaggcagcaaggcttcagggactacggacggatcaccgtgctgttcaatcccgacgaagagaccggctccgccggctcgaagcaactgatcgccgagctggcccggcagcaggactacgtcttctcctacgagccgccggaccgggacgcagtgacggtagccaccaatggcatcgacggcctgctgctcgaggtgaagggtcgctcgtcccatgccggctcggcacccgagcaaggccgcaacgccattctcgaactgtcgcaccagttgctgcgtctcaaggacctcggcgatccggcgaaaggcaccacgctgaactggaccctcgccaggggcggcgagaagcgcaacatcattcccgccgaggcttcggcggaagccgacatgcgctactcggacccggccgagagcgagcgggtactggccgacgcccggaagctgaccggcgaacgcctggtcgccgataccgaagtcagtctgcgtctcgacaagggtcgtccgcctctggtgaagaaccccgcctcgcagcgcctggcggaaaccgcgcagacgctctacggtcgagtcggcaagcgcatcgagccgatcgccatgcgcttcggcacggacgccggctacgcctacgtgcccggcagcgacaaaccggcggtgctggaaaccctcggcgtggtcggcgccggcctgcacagcgaggcggaatacctcgaactatccagcatcgccccccgcctgtacctgacggtggcgctgatccgcgagctgtccgccgactagcgccgacgcccgcagccagcctcaggtacggaagcgaccgagcaccacgcgcaagccagccatgtgctccttga

SEQ ID NO: 4385 - DNA, 477 bp, Pseudomonas aeruginosa
agttcgccgcgccgacctcggtcagcgccacttccaacccacgcaactgccgcatcagcggcgccaggccgaactgccggccgagcaccaccagcaccaggatcgccaacaggcaaccgaaggcgatccacatctgggtgtgctggacactgtcggcgcgcgcgctcatcagcgagaccaggttgttcagctcgcccaacagctcggtggaatactgcgagaagccgcgcagatcgacctggctggcaggctgtgccacctggtcgagcatggcccggtagcggccccagatctgcgccaccttctgccgctgggcggcgatctccggcgcgcccatccggctcacgttgcgctcggcattgcccgtatccaggtcggcggccgagcgttcgtactgggcgatggtcgcggccagggcctttgggtcgccggcgccgagtcgcaattgcagcgcctcgcgggccatcttctggctga

SEQ ID NO: 4386 - DNA, 537 bp, Pseudomonas aeruginosa
aatcgctcagcgccatctgatatcgctcgtgcacgaagctgtggatcgcccatgggcagatccagcagtccgcgcgtaggatgggcaggcccgcttcctgcccattttccgccaggaaaagagaggaattcctttccgagatttccacagaggtcatggatgaaaaaaagccccctgctgatactgagcgtactcctcgccgcgtgcggccccgacaagctgatttccgacctgccgtcgccgaacgggcaataccacgtcgaggttcggaaatgcccggagaaaggttcgatcacctggggcgaagaaatacaggtctccctcctcgaaaccgggaaatcggaaaagtgccatgcagtcgtgcggtcgctggcgcaattcgacctgcgcgcatccgcggaccaattgcaactggagtggctgtccgatacggaactcagggcctggcaccctagcttcgagcccgggaaccaaccgaacggctcgcgcctgaagcacgatgcgccggtgaagatggtctttgcgccgaagcgctga

SEQ ID NO: 4387 - DNA, 1320 bp, Pseudomonas aeruginosa
cagcggcacgccccagaccgggtcttccatgccctgcttgcgcagcggcgtgatctgcaggggctggagtctggacagcagttgccggtgcttgtcgctcagggcccgctgggcgatcagggactggctgaagtccatcggcgccggccaggtgtagacggtcaggttttccaatgggcattcgatcttcttcggatcgatcgcccggcacttcgactgctggtacttgtagccgggggtcttcaggtgcatgcgcggggccagcagcaattgcccgccctgcacggtgaagctggccagcgccttgtcgaccggcaggcgcgcctggaccttgatcgagggcacgtcgcgggagtcggtctgctggtaatagccggcctgggagccctgggtcgtctgcgtgtattgctgctcgccccagctcacgcaggcgcccgaggccacatgcacggcggtgcagaccttctcggtcttgatctcgctgccataggtggcatctttccagacttcttcccggtagtactcgcgatacagctcgggggacaggtacgcggtgccgttggcgccatggcccgaaccgggcggaccgctgcgggcgccgacctggtcgagcaagccatggatctggtagtcgtcgccgccggtcagcaggtacttgccgggcggcaggatatgcacctcgaaggccttgaacagataggtctcgtcgggcttccgctgcagcgcgttggtctggaacttgcggccgaaggtcaccttcgggtccttctcgtactcccagatcgccgttggcgtccactgggtcatggtcagggcatcgctcagggacttgtgcggcatcacgtcggccaccagtaccacggccatgttccccttcagcgcctggtccaccaggtccagcatctgcgcgttgcgcggatcgtccatgctgccataggcgcccgaatcgagttccgacacgcaaccggaaaggcaaagcagcaaggcggcggaaagggcaaaacgcgggcggggcagtctcatgcatcgatccttgatagaggctggtgcgggtcgtcgaacggcccatcttactggcccatgccaggatcgcaatatttcaaatggactaggtcggcaggggcacaccggcagggccaggagctgccacggcccgccggccctcgttggttctacgcctacgcagacctccaggcgttgggatcggcgttgtctggcaggccaggctcgggaaacgtgcacatccggaagagtggtaatcccgcgcgcattgaggccacgccagtctcttcggagagtatccagatgtaccaggtgtaa

SEQ ID NO: 4388 - DNA, 267 bp, Pseudomonas aeruginosa
aaacaacacgcccatcactaccacctacatgctctgttgcccgcctatatattaggtacaaacttccatctgacaatatatccatttggccaaaatgatcataatatgattcatacagagcctttcccactagccgatgcggaatatcaaaataagtattcatccttcactccttcggtcaaattaggccaacacactcgccccactcaacagctctaccctacaaaccttgactacccggccaactataaaattcttcaaaaataa

SEQ ID NO: 4389 - DNA, 273 bp, Pseudomonas aeruginosa
tggactggaccgatcgccactgccgcttcttcctgcgccagttgtcccgtcacaccttgctctacaccgagatggtcaccaccggcgcgttgctgcacggcgatcgccagcgcttcctccgctacgacgaatgcgagcacccactggcgctgcaactgggcggcagtgtgccggcggaactggcggcctgcgcgcggctggcggaagaggccggctacgacgaggtcaacctcaacgtcggctgccccagcgaccgggtccagcacaacatga

SEQ ID NO: 4390 - DNA, 936 bp, Pseudomonas aeruginosa
caagacctcgccatgacttcgaagctggaacaactcaagcaatacaccacggtggtcgccgacaccggcgacttcgatgccattgcccgcctgaagccggtggacgccaccaccaacccgtcgctgctgctcaaggccgccgccctgccgcgctacgccgagcaccttcgacaggctaccgcgggtagcggcggcgacgccggactggcttgcgaccgcttcgccgtggcagtcggcaaggacatcctcggagtcattcccggacgtatttccaccgaagtcgacgcgcgcctgtcgttcgacagcgaggccaccctcgcccgcgcccaccgcctgatcgagctgtacgacgaacagggcatcgaccgcgagcgggttctgatcaagatcgcctccacctgggaaggaatccgcgccgccgagattctggaacgcgagggcatccagaccaacctgaccctgctgttctccttcgcccaggcggtggcctgcgccgacgccggggtgttcctcatctcgccgttcgtcgggcgcatctacgactggtacaagaagagcgagaaccgcgactacgccggcgccgaggatcccggcgtgcagtcggtctcgcgcatctatcgctactacaaggccaacggctacaagacggtggtgatgggcgccagcttccgcaatctcggccagatcgagcaactggccggctgcgaccgcctgaccatcagtcccgacctgctgcaacaactggctgacgcccagggcgagctgccgcgcctgctgctgccaggcgaaggcgagccgcgccaggtgctcgacgagagcgctttccgttggcagatgaacgaggacgccatggccaccgaaaagctggccgaaggcatccgcctgttcgcacgcgaccaggaaaagctcgaataccagttggcgacccgccactga

SEQ ID NO: 4391 - DNA, 1203 bp, Pseudomonas aeruginosa
ccctgccgaacacctccgcgacgccagtctgctgcccttcgccgaggcacaaagcttcctgttgcagcgcaagccgaacaagaacgagcgccagcgcctggagcaggccctcgacgaagccgccgaggaacaggccgaagccatcgccggtgccgtggccctgctggagagcctggacgaacaacggattccctacgcctggcaggacgagctaccggaatcggtctgccagcgccttgccgcgccgctcggccgagcggacgccctgatccccctcgccggcgcgcgcccctggccggcccccgatggctgctggcaggccctcgcccggctgggcatcgagcgcctcgacggctgcgtgctggtcagcgcccaaccgcgtcaactccaggccggactcaatgccgggctatggaccatcggcctggccgccagcgggccgtcgtgcggcctctcgccagccgactgggacgctctcggacataccgagcgcgaccgcttgcgcgccgacgccaccctggaactgtaccgcctgggcgtgcattccgtgatcgatcacctgggcgagctgcaaccctgcctgcacgacctcgccgtccgccgcctgaaaggagaaaaaccatgagccgcgcccgtcaccgctttctagacgaactggccgaacgcttcgccagccatggcgccgagccctatggcgaggcagtcagccaggccgagcacgcgctgcagtgtgcgaccctggccgagcgcgccggttgctcggacagccttgtagtcgccgccctgctgcacgatatcggccacctctacgaagacccggcgcagatcgacgaggaggacctgcgccacgaggaattcggcgcacgcctgctgcgcgagctgttcccagagtcggtctggcagccggtgcgcctgcacgtatcggccaagcgcttcctctgcgcggtggacccgagctaccacgccagcctgtcgccggcctcccggcacagcctggtgctgcaaggcgggccgttcgacgagcgtgccgccgcggcctacatcaaggcgccctatgcccaggacggcctgaccctgcgccgcctcgacgacctggccaaggacccggccatgcgcaccccagaactgacgcacttcttcccgctgctggaacgcctgctgcggattgatccggatcgcgcacatctgcgcccgacaggttaa

SEQ ID NO: 4392 - DNA, 693 bp, Pseudomonas aeruginosa
cgagggatgaacatgaaactgctgatcgtcgaagacgaaccgcgcatcggccagtacctgcgccaggggctcgccgaggcaggcttcgccgtcgacctgagcgacgatggcaacgagggcgagcaactggccctgggcggcgactacgacctgctgatcctcgacgtcatgctgcccggccgtgacggctggcagatcctgcgcagcgtgcgcgacgccgggatgaccgtaccggtgctgttcctgaccgcccgcgatgccgtagaggaccgcgtgcgcggcctcgaacaaggcgccgacgattacctggtgaagccgttcgccttcgtcgaactgctcgcccgggtgcgcaccctgctgcgccggggcagccagcagttgcaggagaccaccctgcaactggccgacctcgaactcgatttgctgcgccgccgggtgcaacgccagggcaagcggatcgacctcaccgccaaggagttcgccctgctcgaactgctgctgcggcgcagcggcgaggtgctgcccaagtcgctgatcgcctcgcaggtctgggacatgaacttcgacagcgataccaacgtcatcgaggtggccatccgccgcctgcgcgccaaggtcgacgacgactacccgcagcgcctgatccataccgtgcgcggcatgggctacgttctcgaagagcgcgacgaatga

SEQ ID NO: 4393 - DNA, 1239 bp, Pseudomonas aeruginosa
gcgtggagaaccagggtccggcgattcctcctgagcgcttgccgcgcctgttcgaccggttctatcgtgccgatccggcgcgccgcgaaggccagggtgaacacgccgggctcggcctggcgatctgccgctccatcgtccaggcccacggcggcgagatccgctgcgagtctgccgacggctggacccgtttcgtcatcgatttcgctcgcccgcgccgatgaaacgcgaagcccccatgacgggggcttctgtttcatgccttcgagcgtttcattggcgcatgccgcgcccgctcaccagcagccttacgcagccgagatagagcaccgcggtggccagcagcatgaagccgatggccacgccgatgcgaatgtcggagacgccgaggatgccgtagcggaaggcgttgaccatgtgcaggatcgggttggccagcgacactgtctgccagaacggcggcagcaggttgatcgagtagaacaccccgcccaggtaggtcagcggcgtcagcacgaaggtcgggatgatcgagatgtcgtcgaagttgcgcgcgaacaccgcgttgatgaaaccgcccagggagaaaatggtcgcggtaagcaccaccaccagtaccgtgatgcccaggtggtgcacctgcagcttggtaaagaacagcgacagcagggtcacgatcacccccaccgccaggccgcgcagcacgccgccgatggtgtagccgaggaggatggtgtgcggcgacaccggcgacaccagcagttcctccaccgagcgctggaacttgctgccgaagaagctcgacaccacgttgccgtaggcgttggtgatcaccgacatcatgatcaggccgggcacgatgtattccatgtaggtgaagccgcccatgtcgccgatctgccggccgatcaaattgccgaagatcacgaagtacaggaccatggtgatcgccggcggcagcagggtctgcggccagatccgggtgaagcggcgcacctcgcggtagacgatggtgttcagggcgaccaggttggcgctcagttcgctgctcatcgggcgatcctcgtcaggttcttctccaccagcgacacgaacagctcctccaggcgattggtcttgttgcgcaggctcagtacctcgatgccttgtgcacccagttgggcgaacaggtcgttgatgccctggctcttctccacctgcacttcgagagtgtggtcgtcgaccagccgcgtcggatag

SEQ ID NO: 4394 - DNA, 273 bp, Pseudomonas aeruginosa
ccggcctgggtcacgacgatgtcgaagaccttctcgaactggttgaagttgaactcctgcggcaccacgccaaggcaacgcttgaggccggccgggtccttgtcgaggtcgtggccgaacaccgagaccgaaccgctggtcttgttcaccagggtcgagagaatcccgatggtggtggacttgcccgcgccgttggggccgagcaaggcgaagaaatcaccttcggcgacgtccaggtcgatgcccttgagggcctggaaaccgttgccgtag

SEQ ID NO: 4395 - DNA, 1746 bp, Pseudomonas aeruginosa
cggcgacctggcctcgacggtgatggtgccgaactccctcggcccggccgagctgctgctccactacggcaccgacgagcagcgccagcgctacctgccgagcctggccaagggcgacgacatcccctgcttcgccctcaccggcccctacgcgggctccgatgccggcggcatgaccgacgtcggcatcgtctgcaagggcgaatgggaaggtcgcgaggtgctcggcctgcgcctgacctgggaaaagcgctacatcaccctcggcccggtggccaccctcctcggcctggccttcaagtgccacgacccggaccatctgttgggcgacgaggaggacctgggcatcaccctggcgctgatccccaccgacacccccggggtcgagatcggccgccgccacgtgccgctgggcgccgccttcatgaacggtccgaactccggcaaggacgtgttcgtgccgctggagtacatcatcggcgggcaggaaatgatcggcaaaggctggatgatgctgatgaactgcctgtcggtcggacgctccatctcgctgccggcggtgggcaccagcgccggcaaggccagcagctacgtcagcggtcgctacgctcaggtccgcgagcagttcaacgtgccgatcgccgccttcgaaggcatccaggaggcgcttgcccgcatcggcggcaacgcctggctgatggacagcgcgcgaatcctcaccgccaacgcggtggacctcggcgagaagccctcggtgctttcggcgatcctcaagtaccacctcaccgagcgcggccgcgagtgcatcgcccatgccatggacatccatggcggcaagggcatcatcatgggcccgaacaactacctgggtcgttcctggcagggcgcgccgatcttcatcacggtggaaggcgcgaacatcctctcgcgcaacctgatgatcttcggccagggcgcgatccgttgccatccgtacgtactcaaggaaatggaactggcccagcgcgaggacaaggaccaggccgcccgcgagttcgacgcgctgctggtgaagcacatcggcttcgccgtcggcaacgccgccagcagcttcctcctcagtctcagctgcggccacctcggcaacgcgcccggcgaccgcatcagccgtccctacttccgcgcgctgaaccgcctggcggcgtccttcgccctgctcgccgacttcagcatgatgctgctgggcggcgaactgaagcgcaaggaacgcctctccgcgcgtctcggcgatgtcctcagctatctctacctgggctcggcggcgctcaagcgctaccacgacctgggcaacccggactacctgcatccgctgctgcgctgggccatggaggaaaacctcggcaagcccgaggcggcgctggaggacctgctgaacaacttccccagccgattcttcggctgcgcgctgaaggtcctggtactgcagttcggccgccggcacaaagggccgggcgacgaactggacgccgagatcgcggaaatcatcgaccgtccggacgacgacccggcgttgcagggcgatcatcgccggcgcgttcctgccgaaggacccgcaggacccggtcggtgccctcgcccacgccttcgacgcggtacgcgaaagcgccgcgctggagaaaaccctgcacaaggcgatcaaggaaggcagggtccagccgcaagcggggcagaacccgatcgatgccggcgccgccgccggcgtgctga

SEQ ID NO: 4396 - DNA, 588 bp, Pseudomonas aeruginosa
cgtacgggaggccatcatgctcaagctacttgccaccggcctggcagcctcgtttctcctcctgcccccggcgcaggccgcaccgcctgcgccctatggcgtgcagccgcaccagcaggcggtgcagcgcgctggcgaacagcgccaacgccagctccaggaacagcgccagcgcttcgacgaacaacgcctgcaattgcagcaggatcaactgcaacgccagcagcagaacctgcagcggcaacggcagcagcgacagatgcaggacaacctgatccgccagcagcaactggaccagcagcgctggcgcctggagcaggaccagcggcgcctcgacagcgaacgccggcaactggaaaaccgccggcgccagagccagtccccggcgatccgctgaaactggccggcgccgcgaaaccctttatactgcccagcttttttccagaggacccgtcatggccaactcctacctcgagcaccacctcgccctgctccagcacctgcgcaacatcctcggcgccctgggcgaggccgagcaggtgccggaagaaaaccacgggttgttcctcgagcgtttcgacgagctga

SEQ ID NO: 4397 - DNA, 801 bp, Pseudomonas aeruginosa
tcaacgacctcggtcgcctacgacgcaaggccgaactgccggccgcgcccctgtcacccaggtaacagcctcgcccaccgcccgcctcacagactgctcgccgacacgagcaaccagggaggtagcggttatggatcgtccgaatcagccaggcggcaacgaaaccggttccgatcgcctgttcgaggaaagctggcgtgccgcgcaggctggcctgcgcaaacgcgcgcaacgccttgcgcgcggcaacagccatcgggccgaagaatggctgtcgagcaccgcggtcaaggcgatgctgttcctgcgccagtcaccggagcgggtacgcgacccccagggcttcctgttcctggtcctggaacacgtctacctggacagcgcgcgccaccagatccgcgaggaccgcctcatcgaccgcggcatcgacctgcacgatggccagttggagcgcttcgccgccgtcggctcgccgctggaacgcctggagcagctggaacgtctcgaccaggtggacaaggccctggcctcgctgtcgcgccaacagcagcagctcttcgagctgcgcttcatcgaagaactgccctatgccgacatcgccagccaactcggcatcgccccgccgctggtgcgcaagcgcgtgcagttgctgcgctcgcggctgagcgccgactttttcgccggcgacgtttcacaagacagacgcagccgcgttcattcctgacaagcgagtcgaggcccgtgcgaccggcccccctgcccgacgagcacctgcccattcaaggagagtcccatggctga

SEQ ID NO: 4398 - DNA, 3105 bp, Pseudomonas aeruginosa
ccccacggctgtgaatgcccagatcaccgatgccgtcacccagaccaacgtcaaggtggtcgccgaagccccggcccaggccatcgccgcgctctaccagatcgccagccattccgccggcctgtccctgcagaacgcagtctacagccagcaggccctgaaccagatctccaccgcggtggtttccaaggcggtgtcgatgatcatggcgatagaagacaagaaaggtatctgacccgccccttgatcccaggagtgcccagacatgttcggcttcggcaagaaatccgcgcccgcgcccgcgccatccggcgacagcgagcaagccgccgcccctggcgaggccggccggcagacgccagccagcggcggcagggcgtccgccaacggcgacgtgaagctgccgtcgcgcccttcgccgctggccggcatgagcgagcgcctgctcaagcagaccgaggcgccgccaccggacaccagcgccctgaacagtcaagtcgtgcaggcggtgcagatgagcaacagcgaaaccgccggctatgcgccgtcgcagatcgccatcgcgccgaacatgatgatcagccaggcctccgggctggtggcgcaatccgccgccagctacttcgacggagtcagcaagatcgccctggccagccaggcgatcctgctccggcagatgacccagaacatcgccgaaaacaagctggcccaggctgccgaggacgcgctcggcgcccttgccaccgacctgctgatgggcgctgccgccgcggtagccgcggcggccggggcgatcgaggcggaatcggccagcttcgccatcgacaagatcgaccagagcattgccaagtacagcgagaccctcgccagtcgcggcggcaaggacacccaatcgtagccaccaccgacggggccggcggcgcccggccctggcacaggagagccgtcatggcctatttcaagctggaagaaccggtcaggttccatcgctatcccttcgacttccatagtcacttcgccggcatcctgccggtggaaagcaacagccgctggacgcgcgaccgccgggtcttccgcgtcggcgagcggcaggtgagcctggagaaaggccaggagctttccctgatcgggctgctgatgagtgcccgcggcgtcgccccggacgtcgacggcaaggcgctggaggaggctcgccaggccgcgcactatgagctgttcgaactggctctgcagcggatggtcaggcgcaatccgttcgccgcgaccgaccgtcagggctacctgcgcggcgaatgcgcggcggagaacatctatctcgcctgcctcatcctggcacaacgttttggccggacctcgccgccagcggccatcgaccagccggcgatctacctcggcaccctggaactgctcggtgcgagcgcggttcgcgacagcgagacggaccagttcgtccgctacttcaaccgcaagatctggagcggcaacaagtacacgccgttcgacgacgcctactgggcccgcggcgccatccgcgatcgccatccgggcgaattcgcctgcctgacgctggggttcctcctccacgaaggaatcagccatacccagacggcgacgggggaagacgaggtggccgtcctcgattccctgttcgaacaattcaacgcctccgagaagaccgcctaccgcctgctcgcccacaccgcgcatggctatgccagcgaagccgccttcgatgccgagctgcacaggatcctccgtcatttcgaaatacagcaggggcagccaccgcaggcccggctggtcggcatcgacctgctcggcatggagaccgctaccggcctgtaccgacagttcttcgacttcctcctcggacaggccgcggtgtttcgccgctacctggacggcaagccggaaacccgcaaggtggtcctgcacatccattgtggagaggggaccggggtgtccgacgacaaccggtcgctgtccggttacttcctgcgcaacgccaacgcgctggacgatttctacgcagcgctctccgcctatgcctggaagtgctatggcaacaccatccgccagggcaaggcgcggctacgcgaacgggagaacctgcaggaccgtgacaaggcgcccagcgccctcgccggccttttcgacgaactgtttttcggcaacagcctgacctcctccggcctgcggctacgccgcttcgacatcaccagcgggactacccaggccctggtcgcctactacgcccgcaccaacgtcgtgaacctctgccaggcgctggccagccgcgacgccgacggcaacagctactaccgccgcctgctggagagcgatctgttcagcctgcgcatcggccatgcctactactaccgcaactatctggccagcaagttccccgagctgtgcttcgacaccaacctgggaagcaatttcattaccggcgcctccggcctcttcgactcgctgcaggaataccgcctgaaccgtggcctgcgccatctcgacggatacgtcggcaccgaccagctcaaggaactcagcctggccatcgcctaccagggcgaacagcgcctggacccacaacagatgcagtacgtccatgccctggcggaaagccagagcggcttcgacgaactgggcgaacacctcccgggtacacccggctgggcgaaacccgcgctggaacagttcttcgtaagtcagtgcgcgctctaccgctccgaggaggatcgctactttccagttcgaagcctaccggcgcctcttcgcccaggtcctcaactggcgctcctatctgctgggcgccgacggccagggtgtcgagcactccaacgtacaggacgaagcgatccgcatggcgctcctgctcaactatgccgccgcggaccgccacggccgggtaccggtcgcttcgctggagaatgcccaacgcctgctggtgcaactgggcagcgcctactgggaggaaaccatcggcgccgtcgacctggccggcgcgccccatcgggaccgagagctgcagcgcttcgaagggttcgccgcccccgcctcggtcgtgcgcatctccacccgcagcagttgaggagcgaccgatga

SEQ ID NO: 4399 - DNA, 876 bp, Pseudomonas aeruginosa
aactgctcggatgagcacccaccccaggagaagcgtcatgaaggaagaactcgaaaccctcgtcacccaggtcaaggcactcctcaccgaatgcctgcaaggctggctccaggccctgtcccagggagacagcgtggacgacccggccagccttggacagttggcggtgcagttgagcaccgcctacagcaccctgcaggccgctgccgccgcctaccccggcgataccggcggcagcgcgcaggccccctcggcggacggcacgcagcagtactgaagcctcgccacgacaccccgcgcaccgcgcgtctatcgcagaggagtccgcgcatgtcgatctcggaagaattgggaaggaatctggtccagctggcgcaacgctggctgaaacgccccctcaccagcgaagaacacgagcagttgagacagttccagctcggcctcggcaacgacgccagcagcgatccggccgtgcacgcgcgacagcaggccgaacaggtgatcgagaacggccggcagcgttccgaaggctccatccgccagatcctgcagaacgtccagcaggcctcgacccaggccctccgcgcccaggacagcggcgagcaggcgattcttgaggcggtcaatgccgccggcagcctggccgaactgcgtcccagccacctgcagagcggccaggcaagcgccaaccagttggtgatgtcgcagattgccgaccgcctggccaacctagtgaagagcgaggtacgcctgtgcttcgagcagaacttcggctcgctcaagcagcaactggagaacgctatcgccatcttcaaccagagcaaccacaacacgtccgcaccgccgccggacaagcccgacccgcccgccgcatga

SEQ ID NO: 4400 - DNA, 471 bp, Pseudomonas aeruginosa
gaccgcaccgacaagcgccccgcctcgcggggcgcttgcattttcgccgcccgccaggcctggcgccgacggattcacaactccctggctggagcgttcatcaagacagcacgacatgagccgtgccgttcactcacagggagtcacatcatgagttttccgaccgcagtcaacgaccagatcaccgatgccgtcacccagtccaacgtcaaggtcgtcggtgaggcgccagccatggcgctgggcaccatctaccagaccatggcccactccaccgggattctcttcgagaacgcggtgagcgcccagcaacagcagaacgccctggccctggccgcctccaacatgggcgtgatgcagatctacagcctcgacaccgccgccgatgccggagccaccgagaaagtcggccagttgggcgtggccgacaacctcaccagcctgctgaccgtactgaaatccttcacctga

SEQ ID NO: 4401 - DNA, 597 bp, Pseudomonas aeruginosa
acacgttgttgctgcatgcgccggatggccgcctgcggttgcggcatctgctgccagcacttgctcccctcctacgacctggtgctgatcgacacccagggcgcgcgttccgtgctgctggagatggcggtgctcgcctccgatctcgcgctgtcgcccgtcacgccggagatcctcgcggcacgcgagctgcggcgcggcaccatgcagttgctcgaagacattgcgccgtaccggcacctgggtatcgaaccgccgccgctgcacttgctcatcaaccgcgtccacccggtgtccgccaacgcacggctgatccagcaggccctgcgcgacctgttccaggacagcgccggcatccgcgtgctcgccaccgacgtgccggccatagaagcgtatccacgcgccgcaacgcgcggcctgccagtgcatcgggtcgagcaccgccagccgcccggcagagtcgcccctgccgcgctcgacacgatgcgcgcgctcgccagcgagttgttcccgcaatggcaggaccgactggctcaagtatccggccgcccgcagcgacctcttgatcctgggaggccccatggcgaacgcacatga

SEQ ID NO: 4402 - DNA, 810 bp, Pseudomonas aeruginosa
ccttcgcaacggccaactgcgccgctgcaaggccatgggcttcggcgaggccgagctggatgcgctcaagcaccccgcgctcatcagcgtgctggccaacgccagcgtctcgtggtgctcggtcacggtcaaccgcgaagtgctgcagcgcctgctcaaccaggcacaggacgtggagaaggaaatcgccacggtcgatcgcatgctgcggctgggggccagcacggagatggtcagccgcttctatggcctgacccatcaggaagtcgccctgcggcgggagatcctcggcctgcccaagcgcaaggggcgccaccccgtcctggacgagacccaggacaccgaactgtggcggcaatggaaagccgtgaccagcagcaggaacgtcgatctggaggacgagacctcgattctcgatgcggccatggacctggccgagggcatgtcactgccgctctcggtggtctgggccgcgatcaggaactgggtcgatcagggattgggctaggccatggccgtggacgacaccgccccacgagccccgcgtcaaggccccatcgcactcgccgacctgttcgacgctgcgctgaaggacctcacgcccaagccacatcccagcgcgccagcgcccatggcagtgcccacgcctgccgcgtccggcgacgccttcctgttcagtggcaatcggcacgagagcgtgccgcggcggctgttcctcgaccgccgcctgacaccgctggagcgcaacgcctggcaggtgttccggctgatgctcaacgacgacggcgtcacggcgttctcgacctatga

SEQ ID NO: 4403 - DNA, 492 bp, Pseudomonas aeruginosa
aggggacttggaggcctgggccagccagtgcttcgccatgcgcgacgagttgatcggcttggcgcagcgacaagtgctgcaacaggccagtgggcatcccttccacctgctgcccgtggaactggcccagcagaccactggctcgggaacgacgttcctgcgctggcgcaggcacgaccgctcggccatgggcgtggccctgtggcaggagctgatggcgagcaccagcacgccggtcaacctgctggccgacctgcacgcgatcgagctgcagcgcatcacgctgaacatgcagatcagcctgttgcacaccctgggcaggcaggcacaggattgcgccagcaaggccgccgaggcggaagacgcctacctgcgccggctcacgtcctttcccgccgcaatgcgcgatcggtgattgcgccgggcatcccagcacgcgcccggcgccgaccaggtgcgggtatttcaaccaccaaggagattgcaacatga

SEQ ID NO: 4404 - DNA, 624 bp, Pseudomonas aeruginosa
actgatcgcccgcgagatcatcgacctgtgcggataccgcggccccatagcacgcctgtggctgtcggcgctcaacgatgcgtccatccgcaccgcgctcgccaagctgcggccctcggccgagacgctgccgatgtattactcggcgctggcgcgctcgcgcgccgactggcttgtgggcatgaacctcagccggctgttcaccgtgctcgggcggcaggccggctacgacggcgtgctgtcggtcgggcgtgtacagaccccgacgctcaaactcgtggtagaccgcgaccgagagatcgcggccttcgagtccgtgccctactgggccatcgacgtgtccctgtccgcaggcggtcagacgttcaccgcgcagtgggtggcacccgatgccagcaccgacgacgccggccgctgcctgcagcagcccgtcgcacagcaagccgcgcagcagatccgcgccgcgggcagtgcccaggtggtgtcggtcgagaccgagcgcgtgcgcgaaggcccgccgctgctgttcgacctgggcaccctgcaggaggtgtgctccaagcagcttgggctggacgtgcaggagacgctggagatcgctcaggccctgtacgagacgcataa

SEQ ID NO: 4405 - DNA, 573 bp, Pseudomonas aeruginosa
agatcgatccgtacatccgcaccaagggtgagcacgccggggagccggccgcaagcctggaatcgacgctggtccacatcggtctcatcaagatcgacggcacccaggtctatccgacgagccaggcgcaacccgaggcgccgccggccgaagacgcatccgcgtccgaagccgacgacgccatcgacacggccaccgagcccgccgagcgcgagcccgaggcgcaagtcgaagagcaggagccggcattggctgcttcgttctgatacggcatggcccctcacggggccttgtcgcttctcttcccgcatccgccgcgtccccatgacgcgcgcttgcgcatttcatcccccgagttccgcgtggtctcaccgccgcgcggttgtcgcatttctcaaaggagatcagccatgtctctggcatcccgttttgctccgcaatccccgatcctgcgctccgatcgtccactctcggacgaccgcattcgtgccgtcgttccgtcgatcttcgccgacgctccgcatgggagtcggtccgatcgatatgcctacataccgacctcgaccgtgctga

SEQ ID NO: 4406 - DNA, 558 bp, Pseudomonas aeruginosa
aactggattcgaccatcgaccgccgcgctttgcgtgcacagatcgcccgcctgggcgagctgggctacgcgctggacttcaagacgcaggagtggagccgccaggccgaactgcaacctgcgtgatcgcagacgccgcatgcgcagtgttcttcatccacccgccggggttccttccccatgcgggggaggccctggccatcttctggaggtcttcatcatgtccaccatcgcttgcgatatcccccgctccgcgctggatgaacccgcgtggcgggctctctgcgagacggcagccgcacaagccaccaagggttgcggactgtctcacgactactacgtcgaacgcttcagttcggcgatcgacgcgcaactcggtcgattgcccgaagaacagcgcgcacaggcgctgaagatcgcacaggaatgggactacgcaacaccggccgaacggcaggaaacccaggactggaatgcggagcatggctattgctcgcatgggatcgagttcggctgctgcccggccggttgtgatcgcgacgatgacgactgggactaa

SEQ ID NO: 4407 - DNA, 219 bp, Pseudomonas aeruginosa
agctcgttgaagcatttgtccaacgacgaagtttcctccgacgaggaaatgctggggtacttcatcgacaacggcctcaccgaggagcaggcacggcaggcgctgacctaccgcgaccagtacctcaacaacatctacctggacggcttcacgccgatcaccgcggtggacgaggcgcttcacttcaatccgcacacccgacagttcgagccggactga

SEQ ID NO: 4408 - DNA, 324 bp, Pseudomonas aeruginosa
accatcaaggaggagcccatggcatcgcatcgtatcgaaacctactgccacaggctgacgttccccattggggcgctcatcttcagcagaggtatcaaccgcctgttcaacgcgggtcgcctggacccgattccgtacttcaggcgccacacccgtggcgactggggtgacgtcaacgtctgccaatggcacgccaacggcgttgcacttcaatcgggcgcgtcgctggaatcgcactatgtgatccacccgggactcgccattcgcatcatcaccgatgcggggcgcagcgtcactgccatcgtgctgccgtccgaagactga

SEQ ID NO: 4409 - DNA, 1818 bp, Pseudomonas aeruginosa
gccgcaaggcaacatcatcccacgcgaaagcgggcagacttccacttggtctttctctacgagagagtttgtctaaccttcttcaagagggaattgcagatgactacgcaagaaattgcttgcgcgggtgcgccctcacacgaatcggtcaactggcacagcatcgactgggccaggtgtcaccgtgaagtgcgaaggctccaagcgcgtatcgtaaaggcgactcgggaagggaaacacggcaaggtgaaagccttgcaatggattctgacccactcgttcagcggcaaagcattggccgtcagacgagtcaccgagaaccaaggcaagaagacgccgggcgtggatggcatcacgtggtccaccccggaagccaagtctcaagccatgttgtcaatcaagcggcgcgggtatcgtccccaaccgctgaagcgtgtctatattcccaaaaccaatgggaagatgcggccgctgggtatcccgaccatgaaagacagggcgatgcaggcgctatacctgctggctctcgaacccgtggccgagaccacagcggacggacgctcgtttgggttccgacccgaaaggtctacggcggacgccatcgaacagtgcttcacgacgctgtccaagaaggtggctccgcaatggattctcgaaggcgacatcaaaggctgcttcgacaacatcagccatgactggcttatgggtcatgtaccgacggatcgcgagattctgaggaagtggctcaaggctggatacatggaagatcggcaactttttccaaccgaagccggtaccccgcaagggggcatcatctcgccaaccctggcgaatctcgtcctcgacggactggaagccaaactggatgccgcgttcggaagaaagcggtacgccaacggtgtacagacccgtttgatggtcaactatgtgcggtatgcggacgacttcattgtgacgggacgctcgaaagagctactggagcaggaggtcatgccgatcatcaaggacttcatgcaggaacgggggctcacgctctcacccgagaagaccaagatcacgcacatcgacgacggcttcgacttcctcggacaaaacgtgcgcaagtacaacggcaagctgttgatcaagccgtcgaaagcgaacgtggcgaccttcttggagaaagtgcgctcggcggtcaaaggcaacaaggcgctggatcagcctcggctgattcggatgctcaacccaatgatccgcggctgggcgaattatcaccagcacgtcgtatccaaagcgacgttcgcgcgtgtcgatcacgagatttggcgtgtgttgtggcagtgggccgttcgtcggcatccgcagaagagcagcgtctggatcaaacagcgctacttccattccgtcggcacccgtaactgggtgtttgcggcggcgacaggcgaaaggttccctgacgggaatccgatcctgacgtcactgcggaaagcaacggatacgcccattcggcgacaccggccaatcaagttggaggccaaccccttcgacccgatgtgggaaacgtactttgaggagcgtatgagcctcaagatgcagaactcgctgaggggcaggaagaagctcatcaacctctggttggatcaggatcgtcgttgtccaatctgcggcgaattgatcacgcaggagtcggggtggcatgtccatcacatcatccggcgggtcgatggcggaaaggacgggagtaccaacctcgtgatggtgcatccgaactgtcataaccagatccacgtcaatggtctcaaggtggtgaagccggctcgcgaaagcgggctttga

SEQ ID NO: 4410 - DNA, 771 bp, Pseudomonas aeruginosa
ccgcgcacggcaaatctgcttcgatcggcccggcgaccgtgcagtcgccgagtccccatccgggccactcgccaccgagacggtgcagacgttcccgctggcgcctgcggtttcgggaggccagccatgaatgcctcgcatcccgcccaacgctcaaccgcggcggttgtcatacagagcctgttctggctttggctgatcggcctcagtgtcatcgtggcgctgggctacctggcgatgcgcgatcaaaccgaccaggatcggctggattcccgcctgcagcgcctggaagcgcaggcgactggcctggccgagaccatcgaggccatccagcagcgcccagccgtcgcaacggccgctgacctcaaggacacccgccaagtcctggaagcacgcgctgcccaggtcgagaagtcgctgagcggctatgccgccgctgatgaccttcaggcgctacgcgccgaaatcgagcagatcaagacgcgccagaccgccgcgcgtgccgcagcccccgcccagccgcgcgcatcacgcccggccgccgcctccaaggccgaaccgccgccgctgccgttccgcgtcgtcggcgccgaactgcgcgctggccagcgcagcgtgtccgtcgcgccgagcaccggggacttcatgcccgcccaacttcaggtgctgctgcccggggatgcggtcggcccgtggcgcctgcaggcgatcgagggcaacaccgcagtgttccaggccggcaaccagacccgccgtgtggcgattccctga

SEQ ID NO: 4411 - DNA, 738 bp, Pseudomonas aeruginosa
ccggagcaccccatgaagccgtcgatcctcctttccgcgctcgtgttggcgtcggtgcagtggcccatctgggcgcagcagcccgcaacggccccggcgcgcaatgcgcaaagccaggagcgcccgctggccgcccgcgtgctggacgatcgggcggccagtgaatggggcctgcaaccgcaggagtggactcgctatcgcgagctgatggacgggccgctgggcatctactcgcccaacctggacccgctgtccgccctgggcatcgaggcacgcactgacgaagagcggcggcgctacgcagagctgcaggtgcaggtcgaagcgcgccgcgtcgagaagctgctcgcctaccagcgcgcctacgacgaagcctggcagcgcctgaaccccggcatgcagcgcgtgaacctgcccgacgacaagcccggcgccggtcccgtgcgtggtagaggccgcaccgcggtgttcgtcaaggatggctgcgctgcctgcgggcagctcgtacagcgtctgcaatcctcaggcgccgatttcgacctgtacatggtcggaagccgccaggacgacgcgcgcatccgcgactgggccaagcgcgcgcagatcgacccggcgcgcgtgcgcgccggcagcatcacgctcaaccacgatggcggccgctggctgtcgctgggcctgcccggtgatttgcccgcagccgtgcgcgaggtgaacggccaatggcagcgccagccgtag

SEQ ID NO: 4412 - DNA, 408 bp, Pseudomonas aeruginosa
ctgcccccgtatcgcagttcttgcgcgcactggtgctctctgcaggcgtgtatgccagcaccccccatgcccaggaggtcccgccaccggcctaccagcttgccgcccagcgcgcgggcatcccttcgacggtgctctacgccgtggccttgcaggagagcggcatccggcgcaacgggcgcatcgtcccatggccgtggtccctcaacgtcgccggccaatcgcgccgcttcgccacgcgcgccgacgcctgcgctggcctgcagcaggcgatgcgcgccacgccgcacacgcgcatcgacgcgggcctgggccagatcaaccttggctaccacaagcaccgcttcaccggcgcgtgcgatctgctggacccgtaccgcaacctcgccgttgccgccgagatcctga

SEQ ID NO: 4413 - DNA, 390 bp, Pseudomonas aeruginosa
tgcagacgtaccggcccgagttccgccgctacgtcgagccgacgccggcctaccggctggccaggcgcctggaggaacggctggagttcgcgccattgccgctctctcgcctgccgaagctcaccggctgggacgtgcctttcaaccccgtgcgcccgttgccgcctgtcggcggcctgccaaggctgcacggcatcgagcccgacgaagtggacgtcagcctgccgctgggcgagcgcgtcgggcactcgctggtgctgggcaccacgcgggtgggcaagacgcgcctggccgaattgttcgtcacgcaggacatccgccgcaggaatgctgccggcgagcatgaggtcgtcatcgtcatcgaccccaagggggatgccgatctcttga

SEQ ID NO: 4414 - DNA, 1800 bp, Pseudomonas aeruginosa
catgcgctgcgccaaagcttgttccaggccctcgaccgctgcgatcttctgcgggtaggcggcgatggtctgttcggagttcgccaactgcaggcgacgctgcgccagctgcgccgcctgcacgccggcaagcatcaggtcctgatcgagcgaggggttgaagccgcgcacgaactcgctgaactggtccacgccgaacagggtggcgatgagctggcgctgatcgctcggggtccgcgcggcgattcgggcgaaatcgtcgaggcggttcttctcgatgaagcagaagcgatactcagcttcgtcgggctggacggcctgcgcctcgcccgccgccgtagacgacaggactggcgcgatgtggcggcgcaggcgagcgttgttgcagtacgtccgctggtcgacccgcttggcctgcgcttcgctgatcgaaccgagcatcgccacttccaaggcttcgcagaagctgctcttgccggtgccgttggcaccgtagaccaaggtgatgtcatggctgaggtcgaacgtctcctgccgcatgaatcctcgaaacggcccgacttcgagctggtgcagtcgcccgagcgccggcccgttttcggggccgcgcgcgtccccgtcgtaggcgacaggcatctgcgccagatgcgcgatggccagcggcgccaagcgcgtggagcgcccccggcgtgcagcaccgacctcggccagtggctgcaggtgatcgagcaccaggtgcgccagccggcgcacgtcgtcgtgcacgtgccgctgcgtcaagtgcgccaggaaccggtggtactccgaacgtatgcttgccacagcgacccctcacttggtcaaccactgaccgtaagcctccacatcgatcatggggaccgttccactgaactgaagctgcgcgatcagcttgaaaagaaacgcggtcgccggcttgttttcgttggtgtagctgtacgcgccgctggcttggtcatagaaaaagtgcccgtgggcggcaacgcatccgatgtccagacgcccctcggtgaggtttgcgttcagcgccttgtccatggatgggcccaatgcaggactccattcgctctcgaaggtgagcaagccacccagaatcggaatcaacggcttcgctgggtaggtcccgccagcgtgcgggatcggcaggctcgtgcggtgcagcctgcgcacactggcgaccttctcctgggcataggccacaagccccgcgtcagccgtctgcttggcctcgaacacggcgtacacgctttcggctggaatgatcgtctcgttctcgtaggtgaagataaaaggcgaatattgccgatcaaacaccaccacatcgatctgctggctgaagttccccaggctgtccaccacatgcgccttcgccgcctggtaccgtttgggcagataggtatccagcatgtcgatccagacgttctcgctcgcatcccccttcgcacccgggtgaccgaaggtcttgcgtactacggacaagcgctgctggatgtcttcatgcagggacgacaggagctgggaaagcgaccactgggacatgctgtacctcgatgggacgtgtatggaagccgatggaatcaggacagtgggaacttggggccaaacagtgcgcgccaggcgcgaagcgcttcgatattgcgaccacgacgcgcgtggtcgatggcgatgcttgcgtcctggctcgcctggaacagcagctgctgcgcgcgctgcttgcgcgcggcatccatatcgttgctgattgccgggccaagtccggcgggatccggccactcgtcatga

SEQ ID NO: 4415 - DNA, 183 bp, Pseudomonas aeruginosa
agccgaggtaggcagttccacctgatgagcctgtttgtggtcatcaaagatctggatgtgctgcgtctcgaactgggttgcgaggtaagccgccaaggcacgttgaccctggacggctgccttcacctctcccgcggcgggaagggtcatcttggattgggcagtggcggtggtcatgggtag

SEQ ID NO: 4416 - DNA, 783 bp, Pseudomonas aeruginosa
  unsure (232): Identity of nucleotide at the above locations are unknown.
aaggcccgaccatgcacaaccgcaacctcacttcccgttttgcccagcgcgccgccgtggccatgggcgccgccgcgctgcccgcgctgtcgttcgcgcaaggtctgccgcaattggagaaccccaacgcgcggcaccggccaccggcatcatggagaccatccgcaactacgggtacgacatcatcatgctcgtggccctgctggtggtggcgtcgatgttcatcggcgtntggtaccacgcctacggcacctacgcggagatccacaccggccgcaagacgtggggccagttcggcctcacggtcgccatcggcgccgtgctgctcgtgatcggcatctggctgctcaccgaagccaccggcatcctgtaagcgaggccggtatgtccgagcagcagcacgtccgtgcggacggaacggtcaccttccttccgcaccggctcaaccgccatcccgttgtggtgcgcggcctcaccgctgacgaactctggatttgctgcggcctgtccggcgccgccggcctgctggtcggcgcgccgctgtcctgggtgttccgcacgatcgcgctggcgccgacgttcgtcgtcctgggcgtggcgctcggcgtcttcatcggcggcggcatcctgcgccgcctcaagcgtgggcgtcccgacacctggctgtatcggcaactgcaatggcgcatcgccacgcgccatccgctgatggcaggctgggtcggtggccatgtgctgatctcgcgctcgggcttctggtccacccgcaggagcatgcgatga

SEQ ID NO: 4417 - DNA, 747 bp, Pseudomonas aeruginosa
tcaccgcggccggtgccggtgtggcctcgctcatcgagagtgacagcggccgcatgtcctatgtcggctcggacggctccatcggcaccgtgggcatcaccggccaagaagcggtcggccagattctcgcgggcggtgtccgggacatgtcggcctgggtcaacaagctctacggccaagccttcgccgccgtctatgtccaacccggcgccaaggttgccgtccacctcgaaaagccgctcgccatcgacttcgatcccgaaggccgcaaggtcgatcaccgcgcaggagaaagccatgcccttgaacttgactaacctggcccgtggcctagcactggccctcgccgtcgcggtgctcgccggctgcgccaccagcaaggaaaagctgttgacccacggtgaccgcacgatgatggacatctggcagcaggaggccggcgacggcggtggcgcagccggacggaatgccggtcgccaactgctcgatgcgcgccagagcctgcgtcggccgctgaccgacgccgacatgcaggccgcgcctgccgagcagatgcgctatacgcgcaccgcccgcaacgaggttcatcgccagttccagcgcctgcccaatcccgatctcgtgatgtacgtgtacccgcacctggccggcaccgatcccgtgccggtgccgggctacacgaccgtcttcccgctgtaccagcgcattcagtacgcgatgccgggcgagcgcgtggaggactactga

SEQ ID NO: 4418 - DNA, 576 bp, Pseudomonas aeruginosa
tggatgcaccttgttcgttccccaggagggcttgccctcccagggcgcgcgccctccgatctcaccgtctggaggttcgccatgtctttcgtcgtcaatgactcctgcctggagtcgctttccgccatcgctgcccaacacgaggactggatcatccagcaagccatcgtgctgctggagagacggattttcaaagctgggccgtgcctcagccgaccggccgctgtgcgggactacctgcgtctgaaactggtcgccgagcccaatgagatattcgccgctgtgttcctggacagcatgcaccaggtgctggcctacgagccgttgttcaggggcacgatcaactcgacttcggtctatccgcgtgtcgtcgtacagcgtgtgctggagttgaatgccgccgcggtggtcttcgcccaccagcacccctcgggtatcaccgagccgtcaagcgcggatcgcatgctgacccagcaactgcaagccgcactcgcgctcatcgatgtgcgggtactggatcacatcatcatcggccagggtgccccgttctcctttgcggagtccggcctgctgtaa

SEQ ID NO: 4419 - DNA, 1161 bp, Pseudomonas aeruginosa
gcgggcagcagccatcgtccggcaaggcctgaaccagggaggcgccgaccttcagcgccgcatcgcgatggcctaccaaggcgtgaccgacgcatggagtttgggtgtcacgaccatcccggccgtggtggtggaccagcgctatgtggtctatggcgagccggacgtcgcccgcgccatcgcgcgcatcgagcagcaccggagggcgcagccatgacgcgcccattcgatctgctgcgccgcctgcgcgtgcccgtggcctcgctgctgctggccaccgccacaggcagctacgccttgaacaccgccacgatcgtctcgtccgtcatgtcgccggactgcctggagtaccgggtggtgggcatctgctactggctgtactgcacctatggcggctgctcggtgcgcacgtcggtcaaggtcaggcactacgtgcccgatgcggtcgtctccagctacagcaacaccggcgagaacccctgggtcgaggtgcaggcgatgagcacgcccaatccctccgcacaggccggcggcgatgggaccactaacgaagaccacgaaaacaacctcgccaaattcaagaacagcgatgtcatcggccatcctggcggggaggtgttcaaccagttcgcgtcgtcgtcgggctatttctgccagggcgcgggcacggccttcatgccgtatctgctcagcaccctggacacgctggcctggcgctacaacgtgcctgaaatggcctacccggaggcgttgattccgggcatgcgcgaggtcggtgcgcgcaccacgatgaatctctggggaaacgtctatccgcgcggcggcttcctgcaccagaccgacgaccacaaatccggggcagtggtggcccagcgcgcgggcgatgtcgtcacgcgccgcgggcagatccacgtgtaccagccgctgcttgccaacgcccgcgacggctactggccggccggcgcgctgatggagggtgatgcctctacgggcaagtggcaggagctgacgccgcgcctgtccaacacctgcgtggtgttcccgcacagcggcacgctgacccaggcccagcaaggcgactacgcctgggcgctgtggcgtccctatgcgtgctgcgaacgccgcgggcaggtgttcctgggcagcgtcgatttcctctga

SEQ ID NO: 4420 - DNA, 1404 bp, Pseudomonas aeruginosa
ggtgccacgatgaagcgtcctgaaccgatcaacctttccgccaaggcgtgccgcctgctgcgcccgacggcgctggccggcacgctcgctctggtctgcggcctggcgtgggcgcaggtcggataccagaacagcggccccgtcctcggcgatgacgtcatgtactcgatcggcggtggcagtgcggtgtccatgggccgcgcggccggcatgcgctccatcggggtcggcgtggggtggaacagcaacctgatctgcggcgatatgagcatccagaccacgctgcgcaatcagctcaacggcatcacgaacggctttcagcagatcatgagcaacgtgatccagagcgcgaccagcgcggttgcatcgctgccggcgctgatcattcagcgcgccgatccgggcctgtacaacctgctgaccaacggcgtgctgcaggcgcggctggacttcgaccgctccaagctgacgtgccgcgccatggcggagaagatggccgagacggcgggtggccagcttggctggagccaaatggccgaaggcatggccttgcgtgacgcggttggcagcaacgatgccgtgtcggctgtcgagcaggccgagacgcgccgcggcaacgacggcgttccctgggtgggcggcagcaatgccggtggtgcgggccagtccgccatccgggtggtcggcgacgtcacccgcgcgggctacaacctggtcaacggtcgcggcgtgacggacacctcctccatcgcgtccaccagttgcgcgagcctgtcctgccagacctggacgtcgccgcagcaggcgaccgaatgggccacgcgggtcctcggagagcaggtgcagcgcacgtgcgactcctgcaccaagaccgagacggtgcccggcgtcgggctgacgccgctgatccaggaagagtacgaggcgaagctggaggtccttcaggagctggtttccggcacgcgcaataccacctttgagaacctgcgcgaggctggcagcacgtcgctgccgatcacgcgcggcgtgatcgaggcgctgcgcgatgagcccgaccaggacctgctggcgcggcgcctcgcgtccgaggtggcgctgtcgtcggtgctggagaaggcgctgctgctccagcgcacgctgctcaccggcaagaaagagcccaacgtggcagccaacgagttggcggtcgaggccgtgaaccacgagagcgacacgctcgaccgggagatccgcaacctcaagaccgaacttgaactgcggcgcgagctggcgaacaactcgccgatggcgatcatccagcgccatggcacgcgcgcggcaggctcgcgcggcatctatgagggcgatccggtgcccgaccgcctcgaccagttgcagaagggcaatccaggagccaggccatga

SEQ ID NO: 4421 - DNA, 510 bp, Pseudomonas aeruginosa
gcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtcgaatgctgcaggctcgcatcgcacgcagtgtgggcgtctcggagtccacggtcagccgcgttctggcgcgagcgggcatgtccaggttgagcgacctggagcccgtcgaagccgttgtgcgctacgagcacgaggcgcccggggacctgctgcacatcgacaccaagaagctcgggcgcatcgtgcggcccagccaccgcgtcacaggcaaccgtcgcgactcggtcgatggtgcaggctgggagacgctgttcgtggccatcgatga

SEQ ID NO: 4422 - DNA, 306 bp, Pseudomonas aeruginosa
cctcttgacgcttcacatctagtgccgctcgatctgcgtccgctggggcgtcgtttacgcgacctattgtcgcaggcggtgcgcgtggtgctgggactgaccgggcagtcgctgctgctcgcccacgctagcgagacccgcgagtcgatcagcgtgcgcaacagctatctagacccgctgcacctgctccaggctgagcttctggcccgttcgcggcgctgccagggcgacgcctgcggcggcctggagcaggcgctgctggtgacggtcgcgggggtcgccgccggactgcgcaacaccggatga

SEQ ID NO: 4423 - DNA, 1002 bp, Pseudomonas aeruginosa
gggaaggcggggggcaactttcggtgtcttgtgcggtgggggggcgctgtgtatcttggacagccttttcggcgccatacagtgccgtttcctgcaaatacgagattggccccacgaggcggatccagactttcgcttaccaattctaaggagcatatcgatgcgtgtgattctgctcggggcacccggtgccggcaaaggcacccaggcacggttcatcaccgagaagttcggcattccgcagatctccaccggcgacatgctgcgcgccgcagtcaaggccggcagcccgctcggccagcaggtgaaaggcgtgatggacagcggcggcctggtatccgacgacatcatcatcgccctgatcaaggaacgcatcaccgaggccgattgcgccaagggcttcctgttcgacggcttcccgcggaccatcccgcaggccgaagcgctgaaggacgccggtgtgaccatcgaccacgtggtcgagatcgccgtcgacgacgaggagatcgtgtcgcgtatcgccggtcgtcgcgtgcatccggcctccggccgcgtgtaccacaccgagcacaacccgccgaaggtcgccggcaaggacgacgttaccggcgaagagctgatccagcgcgaggacgacaaggaagagaccgtgcgtcaccgcctgtcggtctatcattcgcagaccaagccgctggtcgacttctaccagaagctgtcggccgccgaaggcaccccgaaataccacagcatcgccggcgtcggctcggtcgagcagatcaccgcgaaagtgctttcggccctgagctgatccgcagcgctgtagcaccgacggcccgcttgcgggccgtcggcgtttccggggcggcgaaggctggtacaatcggcgtctttttcaccacgcggaaccgtcgatgtccactctgttggccctggatacctccaccgaagcctgctccgtcgccctgctccacgaggggcgggcgctcagtcactacgaggtga

SEQ ID NO: 4424 - DNA, 609 bp, Pseudomonas aeruginosa
tcccgcgcctgcacgcccagcgcctgctgccgatggtccgcgacctgctcgacgaggccggcgtcgccctgtccgcggtggacgccatcgccttcgggcgcggtccgggcgccttcaccggcgtgcgcatcgccatcggcgtggtccagggcctggccttcgccctgcagcgcccggtactggcggtctccgacctggcgatcctggcccagcgggcctaccgcgagcagggtgcggagcgggtcgccgcggccatcgacgcgcggatggacgaggtctactggggttgctaccagttgcaacagggcgagatgcgcctggccggcagcgaagcggtactgccgcccgagcgggtcgccgtaccgtgggacgccgctgccgcggactggttcggcgccggcaccggctggggctacgtcgagcgcatgccgcagcgcccggccgcgctggacgcgagcctgctgccgcatgccgaggacttgctcagcctggccggcttcgcctgggcgcgcggcgaaggcgtggaggcggaacaggcgctgccggtgtacctgcgcgacaacgtggcgacgccgaaaaaagcgccctgaaaatgccgcgcagcggtaa

SEQ ID NO: 4425 - DNA, 402 bp, Pseudomonas aeruginosa
ttgccaagcctttcggggctggctagagtgtggagacttccccgggttttgatcatgcgtatcgacggtctttcttcctcttcgttgccgctggagcgcagcgcccgaccgggctccgcggtcacgccgtatcgcgacgtgcagcgcgaggtcgaggcgcggcgcgagcagccggcgccggtttccggcagccagggcttcgagcaggcgccgcaggcgcgcaaggtccaggccagttcggcgggcggcgacagcctgccggtcagcgcccgcgacctgctggcgttccagcgcccggtaagcagccatgcggcgatggccctggccagctacaactccaccgccagcctcaacatcgacgccggcgccgaggatgtcctcggcctcgacctctacgcctga

SEQ ID NO: 4426 - DNA, 885 bp, Pseudomonas aeruginosa
gcggttccctgcgctcccgtggtttcccttccttatttcctcggttgtccatcctggaacgaggcggcctggcgcggcagcttctatccgcgcgaattgcgttccgccgactacctcggacactacggcggcatcttcaacgcggtcgagggcaataccaccttctatgcccggccttcggcggaaaccgtgcggcgctgggccgagacgatgccggcggggttccgcttctgtgccaagtttccccgcgatatcagtcacgaaggcgacctgcgcgaacggctcgaggccgccggcgacttcctcgaactgctggcgccgcttggcgaaagggtcagcccgctgtggctgcaactgtcggcggcgttcaccccgcagcgcctgggcgaactgctgtatttcctcgatgagctgagtccgcgacggattgccgtggaagtacgccacccggcgttcttcgacaaaggcgaggacgagcgcctgctcaaccgccacctgcgcgagcgtggcgtggagcgcatctgcctggattcgcgggcgctgttcagttgccgttcggacgatccggcggtgctccacgcccagtcgaagaagccgcgcctgccgatccgtccggcggccttcagcgatacgccacaggtgcgtttcatcggcggtcccgacctgccggccaacgaggtgttccttttgccctgggtcgacaaggtggccgactggatcgaggccggcctgactccatacgtattcctgcatacccccgacaatcacctggcggcccagcaggcccagcgtttccatgcgctgctgggccagcgcctgccaggcttgccggcgctacccgagccgatcccggccccggaagtggagcaactgggcctgctctga

SEQ ID NO: 4427 - DNA, 897 bp, Pseudomonas aeruginosa
gcgcggcgctcgacgctccaccggcctgcgcctaggctagggagtcctttccccgccacggagcccgccgccatgaccagccaacgccaacgcgccgaacgtttccgcgacctgcaccaggggcccggcatgctggtcctgcccaatccctgggatgcaggttcggcgaagatgctcgccagcctcggcttcgacgcccttgccaccaccagcgcaggcctggcgttctccctgggccggcgcgatgcggaaggcgcggtgagccggaccgaggcgctggaaaacgcccgggcgatcgtcgccgccaccgatctgccggtcgccgccgacctggaaaacggctacggcgatgctccgcaagactgcgccacgaccatccgcctggccgccgaggccggtctggtcggtggttccatcgaggatgccagcgggcgcgccggacagcccatctatgagttctccgccgcgctggagcgggtcgctgccgcggtcgaggcggcccgtgcgttgccatttccgttcaccctctgcgcccgcgcggagaacttcctgcatggtcgcgaggatctcgacgacaccctgcggcgtctgcgcgcctacgccgatgccggcgccgatgtgctctacgcgcccggtttgaaccgccgcgaacagatcgtcgcggtgctcgaagcggtggcgccgaagccggtcaacgtgctggtcggttcgccgcgcctggagctgtcgctggacgagctggaagccctcggcgtcaagcgcgtgagcctgggctcgaatcttgcccgggtcgccttcggcgctttccatcaggcggcgcaggcgctggcgcggcgcgacctggaagcgacccgtgcggcgatgcctttcgaccgtatcaacgacctgttccgctga

SEQ ID NO: 4428 - DNA, 1416 bp, Pseudomonas aeruginosa
agcgcccgcgcaaggcgccgatcatcgaagggcccaagcccggctatagcctggaaggcaagtccagccgctacgacatctatccgaagaaggccctgggcaagggctgagtgtcgacaccgcagggaggcggcgagcatgcagcagaccatcgattgtccgattcgccggcgcctggcgcacctgccctgggccaacgacgggcgtgccggtgtccgccactggctggagatgcagcgcgatccgctggcctggttgcagaagatgcacgtcgcgcagccggacctcgcggttgcccgcatgggcccgcagcgcctctggtgcctgttccatccgcaggcggtgcaggaattgatggtcgatcgccgcgatgacctgcaacgctggcagccggcgctgtgcatgctgaaacagtggaacgggcgcagcttcatgatgcgcgagggcgcccccgcccaggcccggcgcaaagaagtacggccgcacctggcgccgccgccggccagcgaggttcgccgcctggccgcggagtggggcgagcgggtggaggaggggcgcgaatacgacctcgacctggaaatggctgcgttcagcgtcaccctcagcggtcacgcgctgttcgacgtcgacctgcaaccgtcggcctatcggatcgccaaggcggtgcgcctgctgtcgcgggtggcattgctggaaatgagcaccggcctgccgctgggccactggtttccgagcaaactgtgtccgcgcaagcgctgggcgctgggccagttgcgcgaggcggtgggcgaggtggcggagcgctcgccgcggccgctggcggacctgcgcgatgaactctgcaccctgctcatggcgtcccaccagtccaccggcgtgaccctgacctggagcctgttgctgctggcccagcgtcccgagttgctcgcgcggctacgcgccgagctggcgcgagtgaattggacggcgatccgctcggtcgccgacctgcgtgattgcgcgctgctcagggcggtcctgcaggagtgcctgcgcctgtacccgccggcctacggcctggcgccgcggcaggtgacggcggacatcgaggtgttcggccagcggctgaagcgcggcgacgtgaccatggtctcgagctggatcacccagcgcgatccccgttggttcgaggcgccgctggagttccgtcccgagcgcttcctcgaaccggcgcgctggccgcgcggcgcctacttccccttcggcctcggcgaccgcgcctgccccggcaccgcgatggcgatgatcgatctggcggcggcgctggcctactgggtcgagcactgggacatcatgcacgacggcgacctggcgccgcgcggctggttttccctgcgtccgcagcgagcgcgggtgcgtttccgccgtcgcgcctga

SEQ ID NO: 4429 - DNA, 3102 bp, Pseudomonas aeruginosa
aactggcggccaaggagtagtcgcatgtccttcaacctttccgcctgggcgttgcagaatcgccagatcgtcctgtacctgatgatcctgcttggcgcggtcggcgcgctgtcctacagcaagctggggcagagcgaagacccgccgttcaccttcaaggccatggtggtgcagaccaactggccgggcgccagcgccgaagaggtggcccggcaggtcaccgagcgtatcgagaagaagctgatggaaaccggcgactacgatcgcatcgtgtccttctcccgccccggcgtctcgcaggtgaccttcatggcccgcgaggacatccattccagcgagatccccgaactctggtaccagatccgcaagaagatcagcgacattcgcgccaccttgccgcaaagcatccagggcccgttcttcaacgacgagttcggcaccacctacggcaacatctatgcgctcaccggcaagggcttcgactacgcggtgatgaaggactatgccgaccgcctgcaactgcaattgcagcggatcaggaacgtcggcaaggtcgagctgatcggcctgcaggacgagaagatctggatcgacctgtccaacaccaagctggccaccctcggcctgcccctggcggcggtacagaaggcgctggaggaacagaacgcggtggcctcctccgggttcttcgagaccgccagcgaccgcgtgcagttgcgcgtttccgggcgtttcgattcggtgaaggagatccgcgacttccccatccgcgtcggcgaccgcaccttccgcatcggcgacgtggccgaggttcgccgcggcttcaacgatccgccggcgccgcgcatgcgcttcatgggcgaggacgccatcggcctggcggtagcgatgaagccgggcggcgacatcctggtgctgggcaaggccctggaaaccgagttcgcccgcctgcagcagtcgctgccggccggactggaactgcgcaaggtgtccgaccagccggcggcggtacgtaccggggtcggcgagttcatccgggtgctggccgaggcgctggtgatcgtcctgctggtgagcttcttctccctcggcctgcgcaccggcctggtggtggcgctgtcgatcccgctggtgctggcgatgaccttcgccgccatgcattacttcggcatcggcctgcacaagatctccctcggcgccctggtgctggcgctgggattgctggtggacgacgcgatcatcgcggtggagatgatggcggtgaagatggagcagggctacgaccgtctcaaggcggccgccttcgcctggaccagtaccgccttcccgatgctcaccggcaccctgatcaccgccgccggcttcctgccgatcgccaccgcgcagtccggcaccggcgaatacacccgctcgctgttccaggtggtgaccatcgccctggtggtctcctggttcgccgcggtggtcttcgttccctacctgggggccaagctgctgccggacctggccaggttgcacgcgcagaagcacggcggcagcgccgatggctacgatccctatgctacggccttctaccagcgcttccggcgtctggtggagtggtgcgtgcgctaccgcaagacggtgatcgtcctgaccctcgccgccttcgtcggcgcgctgctgctgttccgcctggtgccgcagcagttcttcccgccctcggcgcgtctggagctgctgctggacatcaagctggcggagggcgcctcactgcgctctaccggcgaggaagtccagcgcctggaaaaaatgctgcagggccatgacggcatcgacaactacgtggcctacgtcggcactggctcgccccgcttctacctgccgctggaccagcaattgccggcggccagcttcgcccaggtggtggtgctggccaaggacctggagagccgcgaggcgctgcgcaagtggctgatcgagcggatgaacgaggacttcccgcacctgcgcagccgcatcagtcgcctggagaacgggccgccggtgggctatccggtgcagttccgggtttccggcgaggacatcccgcaggttcgcgaactggcgcgcaaggtcgccgacaagatgcgcgagaacccgcacgtggtgaatgtgcacctggattgggaagagccgagcaaggtggtgtacctgagcatcgaccaggagcgcgcccgtgccctgggggtgagcaccgccagcctgtcgcagttcctgcagagcgcgctgaccggctcgcacgtgagcttcttccgcgaagacaacgagctgatcgagatcctcctgcgcggcaccgagcaggagcgtcgtgacctgtcgttgctgccgagcctggcggtgccgaccgagaatggccggagcgtggcgctgtcgcagatcgctacgctcgaatacggcttcgaagagggcatcatctggcaccgcaaccgcctgccgacggtcaccgtgcgcgccgatatctacgacgattcgctgccggcgaccctggtcgcgcagatcgccccgaccctggaaccgatccgcgccgagttgccggacggctacctgctggaggtgggcggcacggtggaggacgcggcgaagggccagagttcggtgaacgccggcgtgccgctgttcatcgtggtggtgttgagcctgctgatggtgcagttgcgcagcttctcgcggatggcgatggtattcctcaccgcaccgctgggcctgatcggcgtgaccctgttcctgctgctgttccgccagccgttcggcttcgtggcgatgctcgggaccatcgccctggccggcatgatcatgcgcaactcggtgatcctggtggaccagatcgaacaggacatcagccatggactggatcgctggcacgccatcatcgaggctaccgtgcggcgtttccggcccatcgtgctgaccgcgctggcggcggtgctggcgatgatcccgctgtcgcgcagcgtgttcttcgggccgatggcggtggcgatcatgggcgggctgatcgtcgccaccgtgctcaccctgctgttcctgccggcgctctatgccgcctggttccgcgtgaagaaggacgaggcgcgggcctga

SEQ ID NO: 4430 - DNA, 495 bp, Pseudomonas aeruginosa
tgtcgtcgctgccgctcaatggcggcttcgacatggccagccggcagccgacctcgccgtggatggtcatggaggaaatccgccagcaattcgacctgcgcagcctcaagagcgatgccacggaaatcccgccggaggtctcggtgctgctgctggtgcatcccaagcagttacccgagcagacgctatacgccatcgaccagttcgtcctgcgcgggggcaagctgctggcgttcgtcgaccccttcagcgaggccgacagcggcagcgatttcgccgctacgctggatggcgacaagtcgtccgacctcgcgccgctgttcgaggcctgggggctgcgcctgctgccgggcaaggtgctcggcgacggcgcctatgcgatgtccatcagtcttggccgggaccagcgtccggcccggcatccggcctggctcagcttgccgcgcgaggcgctggaccaggacgacatcgccactgccggcctggaaagcctga

SEQ ID NO: 4431 - DNA, 1068 bp, Pseudomonas aeruginosa
gccgatcgccgcggaaaccgccggggtgcccgcctcgaagccgagcggagcggcatggaagctggcttcgtggaagccggtgtggcgtaccatctcgccgccgaactgccagtgcgccagttgctccagggcctgtgggcgaccccagagcacgccgatgccgtcggggccgtagagcttgtggccggagaatgcgtagaagtcgcagcccaggcccggcaggtcgtggcgtccgtggacgctgccctgggcgccgtcgaccagggtccaggcaccgcgctcgcgggccagctggatcaactccaccaccggttgccaggtgccgagaacgttggacaactggctgatcgccagcaggcgggtacgctcgccgatgatatggcgggcctgctccaggtcgatcaccccgcgctcgtccagcggcaacacgcgcaggaccaggccgcggcgcagggccaactgctgccagggaagcaggttggcatggtgttccagggcactgaccagcagttcgtcgccaggccggaaatgccgctccaggccataggccaccaggttgatcgcctctgtggtgccgcgggtgaacagtacctcggccgggttgccggcgtgcagccagtgggcgacgcggctgcgcgcggcctcgaaggcccgggtggcacgctcgccggggacatgttgggcgcggtggacgttggcggcgccgccgaggtagtagccgttcagggcgtcgagtacggcctgtggcttctgggcggtggcggcgctgtcgaggtaggtcaggccttccgcggcgaaggcggaaaaggccggaaagtcggcgcgccagggagacggcagggacatggcggacactgtgcgaggacggttacaggggaaagggtagcgcacccggcggcgctggcgagcaccgtcgggcgagcggggaggcgagctgggctcagttgtgcgcgtgcagcgcttcgttcagctcgatggcggtcttgttggtcttgcactccaccgcaccgttctgcgagttgcggcggaacagcaggtcgggctgaccggccaggtcgcgggccttga

SEQ ID NO: 4432 - DNA, 1071 bp, Pseudomonas aeruginosa
acagggattgcgacatgtgggtttcctcgaaacggagtggaacggtcaggccggacggcggctgagcagcaggcccagtcccgcgctgccgagcagcgcggcgcaaccgcggttgaacagacgccgggcccgctggccggcgagcagccggccgaggtggagcccggcataggaataaagagcgatggccagccattcgagcagcaggaatgccgctccgagctgggcgaactgggcgcccagcggttggccgggatcgacgaactgcggcaggaaggcggtgaaaatcaggatcgccttcgggttgcccgccgccaccaggaactcctggcgccccaggcgccagaggctgggacgcgccgggctggcttcgttcaccagtggctgcgcatcggtccgccacaattgcaccgcaagccacaacaggtaggcagcgccgagcaccttgatcgccaggaacagccaggccgaggtgtgcagcaccagcgccagcccggaggcggccagggcgagcatgccggcgaatgccagcaggcgcccgccgccggccagcgaggcggtggcgaaaccgtgccgggcggcgttgttcagcgacagcaggttgttcggccccggcgccaggttgagggcgaagcaggcgggtacgaacagggcccaggcgacactcatgcggcctcccgctcaggccagggcggcggcgtaggcgtcgggcttgaagccgaccagcgtcctgccgcccagctccagcaccgggcgcttgatcatcgacggctgggccagcatcagctcgatcgccttggcttcgtcgagatcggccttctgcgcttcgtcgagcttgcggaaggtggtgccggcgcggttgaggacggtttgccagccgtgctccgcgcaccagcgccgcaggtgttcgcggtcgatgccgacggccttgtagtcgtggaagtcgtaggcgaccttgtgctcgtcgagccaggtccgagccttcttcatggtgtcgcaggctttgatgccgtagagaacgtaggtcattgcttctcccgaggcccgggtcttcccgggccctgccgatag

SEQ ID NO: 4433 - DNA, 1233 bp, Pseudomonas aeruginosa
ctgcctaccgatcgcgatggtgcaatcgacgcagtcgcatcgtccagggacgaagccggagatccccgccctcatgcaaaccgtgtacaccgttctgaccctgctgctggtcgtcggcgccacccgcctggctgcccagttgctgcccttgccgctaccactgatccagatcgccgccggggccctgctggccttgccgtccctcggactgcacattgccctcgacccggagctgttcctcttcctgttcattccgccgctgctgttcgtcgacggctggcgtattcccaagcgggaagtctggcggatgcgctggccgatcctgatgatggcgttcggcctggtgttcttcaccgtggtcggtgccggctatttcatccacctgctgatcccggaaattcccctggcggcttccttcgccctcgccgccgtgctgtcgcccacggacgccctggcggtctcggcgatcacccaagggcggctgcccaatcgcctgatgcacctgctggagggcgaggcgctgatgaacgatgcctctggcctggtggcattcaagttcgccatcgccgcggcgatgaccggcgtgttctcgctggtggacgccagcctcaacttcctcctggtcgcggtcggcggcctggccatcggggtgttcctcagctggtcgctgggccgcatccgcgcctggatgatctcccgtggctgggacgacccggcgacccacgtggtactgatgctgttgctgccgttcgcctcctacatggtggcggaacacctgggcgtctccgggattctctcggcggtagcggccggcatgatgcagagctgggtcgacctgctgccgcggcagacttccacgcgcctgctcaaccgcagcgtctggtcgatgctggagttcgccttcaacggcgtggtgttcctgctgctcggcctgcagttgccggacatcatgaagtcggtggccaaccaccacggcgacctgctctggcgttcctcgctgctgctggcctacgtggcggcgatcaccgccgtgctgatgctgatccgctacggctgggtctatggctactggaagctgtcgctgcgcatcgaccgctggcgcggcaagagcccgcccgggctgagcggcatctccctgcgccgtctctccgccctcagtgcattgagcggcgtgcgtggtgcggtgaccctggcggcggtgctgtcggtaccgatgagcctgatggatggtag

SEQ ID NO: 4434 - DNA, 1599 bp, Pseudomonas aeruginosa
ggcccgcgaccaggcccaagccctggagatcgccgacaaggccttgcgcctgaaggcgttgcgcgcgcagcgcctggaactgtaccggcagcggcgcaacaacgagatcgacgacgagaccctgggcgacatcctgcgcgagctggaccagcaggaaagctggctgaccaatcgcttcgcccgctgggtgtgaacgaaaaagggatcgccgcggcgatcccttttcgtttctccgcgcaggcttcagcgcgcccgcaggtagtcgcggatgcgctcggcggcttcgacgcactcggccagtggtgccaccagggccatgcgcacgcggttggcgccggggttctcgccgtccacctcgcgcgacaggtaggaacccggcaccaccgtcacgtgctgctgctcgaacagttcgcgggtgaatacggtgtcgtccaccggggtacgtgcccacaggtagaaactgccgtccgggcgctgtacgtcgagcacgccgtcgaggatcgccagcacggcgtcgaatttctcgcggtagaggctgcggttggcgcgcacatggacctcgtcgctccaggcggcgatgctcgccaactgggtctgcaccggcatggcgcagccgtggtaggtgcggtagaggaggaatttcttcaggatctccgcgtcgccggcgacgaagcccgagcgcaggccgggcaggttggagcgcttggacaggctgtggaacaccacgcagcggctgaagtccgtgcggcccagctcggcgcaagcgttgagcaggccgggcggcggggcgttttcgtcgaagtaaagttcgctgtagcactcgtcggcggcgatcacgaagtcgtagcggtcggccagggcgatcagcttcttcagggtctccagcggtaccagggccccggtggggttgcctggcgagcagaggaagagaatctggcagcgctgccaggtcgcctcgtcgaccgcatcgaagtcggggttgaagccgttttcctcgcggcagggcaggtaatgcggcacggctccggcgagcagcgccgcgccttcgtagatctggtagaacgggttcgggctgaccaccaggccgggcgcctcgccgggctcgctgcggcggaccacggtctgggtgaaggcgaacagcgcctcgcgggtaccgttcaccggcagtacgtggcgcgccgcatccagccagccggccggcaccgagaagcgccgctcgcaccagcgcgcgatggcttcgcgcagggccggcaggccgagggtggtcgggtagaccgcgagctggtccaggttctccgccagggtttcggcgacgaagctcggcgagcggtgcttgggctcgccgatggacagtgcgatcggcttcagcgtcgcgggcggccgggcgccgccgagcagggcgcggagcttctcgaaggggtagggttgcaggttgtcgagtgcggtattcatggcgttggcaaggcttctcagaagtttatccgggtaggcagggtgtcccgtccgttgtcttgtgacagctgctcgaccagggcggcctgcaggcgtttgcacaggtcggggtcggcgagcggctggttgcgcgcatcggtgatgtag

SEQ ID NO: 4435 - DNA, 963 bp, Pseudomonas aeruginosa
cggttgggttcgatacgcgagcgccccgtcttggtgcgtttttgcgctgtattggtgcgcgcgctgcgccgaatcggggcgtcggccccgccggaatggggcggggcgtcgaggcgcacggctggcagcaaaagccgggccggatcaggctgccgaggtgcgcgggaaggtttcgtcgttgcgcagggtgaggatctcgtagccatcggcggtgaccagcacggtgtgctcccattgcgcggacagcttgcggtccttggtgatcgcggtccagccgtcgccgagcaggcgggtctccgggcggccctggttgatcatcggctcgatggtgaagatcatgccttccttcagctcgatgccggtacccgcacgaccgtagtggaggacctgcggctcctcgtggaacaccttgccgatgccatggccgcagtattcgcggaccaccgagaagccgttcttttccgcgtgcttctggatgatttcgccgatatcgcccaggtgcgcgcccggacgcaccacggaaatgcccttgtacatgcattcctgggtgatctggcagaggcggtcggcccattccggggtcttgccgaccaggaacatcttgctggtgtcgccgtggtagccgtccttgatgacggtgatgtcgacgttgaggatgtcgccttccttcagcggcttctcgttggggatgccatggcagaccacatggttgatcgaggtgcagatcgacttgggaaagcccttgtagttcaggggggcgggaatcgccttctgctcgttgacgatatagtcgtggcagatgcgatccagctcctcggtggtcacgccgggcttgatgtgttcgccgatcatttccagcacttcggcggccaggcggccggcgatgcgcatcttctcgatatcgtcgggcgtcttgatggtgacggtcatgcgaattctcttcgggcgtgcaagcacgcatga

SEQ ID NO: 4436 - DNA, 939 bp, Pseudomonas aeruginosa
ccgaccgatctactcccgcccggccatccgcggcgggtttcactgcgtccacggttatggtataaagcgccccgctccgaggctgcggccttttccggagcacaaacccacacatgcatcgacacgatggcctgggtgcccgcaagggttggtcattgggatgcgtggaggcctaacccgacttatcgaggaactatcatgtcccaagtcaacatgcgcgatatgctgaaggccggtgtgcacttcggccaccagacccgttactggaacccgaaaatgggcaagttcattttcggcgcgcgcaacaagatccatatcatcaacctcgaaaagaccctgccgatgttcaacgaggccctgaccttcgttgagcgcctggccgctggcaagaacaagatcctgttcgtcggcaccaagcgttccgccggcaagatcgttcgcgaggaagccgctcgttgcggcatgccgtacgtcgaccatcgctggctgggcggcatgctcaccaactacaagaccatccgtcagtcgatcaagcgcctgcgcgacctggaaacccagtcccaggacggcaccttcgacaagctgaccaagaaagaagccctgatgcgcagccgtgacctcgagaagctcgagcgcagcctgggcggcatcaaggacatgggcggcctgccggacgctctgttcgtgatcgacgtcgaccacgagcgcatcgccatcaccgaagccaacaagctgggcatcccggtcatcggcgttgtcgataccaacagcagcccggaaggcgtcgactatgtaattcccggtaacgatgatgccatccgcgccgtgcaactctacctgaactcgatgggcgaagcggtaatccgcggcaagcagggcgctgccaccagcgccgacgagttcgtcgaggaagcgccggccgaatccgccgaaggctga

SEQ ID NO: 4437 - DNA, 561 bp, Pseudomonas aeruginosa
ggaagctcgtctggccctggtcgccaagaccggcgagaacgtcaacatccgccgcctgacccgcgtcgagggcgacgtggtcggcgcctacctgcacggccaccgcatcggtgtcgtggtcaacctgaaaggcggcaacccggaactggccaaggacatcgccatgcatgtcgccgccagcaacccgcagttcctgagcgcttcggaagtttccgaagaagcgatcgcgaaagagaaggaaatcttcctggcgctgaacgccgacaagatcgccggcaagccggagaacatcgtcgagaacatggtcaagggccgcatcagcaagttcctcgccgaagcgagcctggtcgagcagcctttcgtgaagaacccggaagtgaaggtcggcgacctggccaagcaggccggcgccgaaatcgtttccttcgttcgttacgaagtgggcgaaggcatcgagaaggccgaagtggacttcgctgccgaagttgccgctcaagtagccgccaccaagcagtaacaaagacggtttcgactgtcgccccggaagaggctgcccgctga

SEQ ID NO: 4438 - DNA, 459 bp, Pseudomonas aeruginosa
acgcattcttctaaagttgagcggcgaagccctgatgggctcggaggagttcggcatcgatcccaaggtgctggaccgcatggcgctggaaatcggccagttggtcgggatcggcgtgcaggtcggcctggtcatcggcggcggcaacctgttccgcggcgcggccctgtccgcggccggcatggaccgggtgaccggcgaccacatggggatgctggccaccgtgatgaacggcctggcgatgcgcgatgcgctggagcgctcgaacatccccgcgctggtgatgtcggcgatctccatggtcggtgtgaccgaccactacgaccgccgcaaggccatgcgccacctcggcggtggcgaggtggtgatcttctccgccggtaccggcaacccgttcttcaccaccgactcggcggcttgcctgcgcgccatcgagatcgacgccgacgtggtccttaa

SEQ ID NO: 4439 - DNA, 660 bp, Pseudomonas aeruginosa
ccagaacatgccgctgcgggtgttcaacatgaacaagccgggcgcattgctgaatattgttgttggtggtgccgaaggcaccctgatcgaggagggttgagaatgatcaacgagatcaagaaggaagcgcaggagcgcatgggcaagaccctggaagcgctgggccatgccttcgcgaagattcgtaccggtcgcgcgcatccgagcatcctggatagcgtgatggtttcctattacggggccgatacgccgctgcgccaggtcgccaacgtcaccgtggaagactcccgtaccctggccctggccgtgttcgacaagagcatgatccaggcggtcgagaaggccatcatgacctccgacctggggctcaacccggccaccgccggcaccaccatccgcgtaccgatgccggccctgaccgaggagacccgcaagggctacaccaagcaggcgcgtgccgaggccgagcaggcgcgggtttccgtgcgcaacatccgtcgcgatgcgctggcccagttgaaggacctgcagaaggaaaaggaaatcagcgaggacgaagagcgccgcgccggcgacgacgtgcagaagctgaccgacaagttcatcggtgagatcgagaaggcactggaagccaaagaagcggacctcatggctgtctga

SEQ ID NO: 4440 - DNA, 771 bp, Pseudomonas aeruginosa
ggccgggctgacgtcatggaaaagacccggaaggatgtgtgcgtgccacgccacgtggccattatcatggacggtaacaatcgctgggcgaagaagcgtcttctgcccggcgtcgccggccacaaggccggtgtcgatgccgtcagggcggtgatcgaggtctgcgccgaggcaggggtcgaggtcctcaccctgttcgcgttctccagcgagaactggcagcgtccggcggacgaagtcagcgcgctgatggagctgtttctcgtggccctgcgccgcgaggtgcgcaagctcgacgagaacggcatccgcctgcgcatcatcggcgatcgcacgcgtttccatccggagttgcaggcggccatgcgcgaagcggaagccgccactgccggcaatacccgtttcctcctccaggtcgccgccaactacggcggccagtgggacatcgtccaggccgcacagcgcctggcgcgcgaggtccagggcgggcacctggcggcggacgatatctccgccgagctgctccagggctgcctggtgaccggcgaccagccgctgcccgacctgtgcatccgcaccggcggcgagcatcgcatcagcaatttccttctctggcagctggcctacgccgagctgtatttctccgacctgttctggcccgacttcaagcacgcggcgatgcgggctgccctggcggatttctccaagcgccagcgccgcttcggcaagaccagcgagcaagtcgaggccgaggcccgtccgtcatgctga

SEQ ID NO: 4441 - DNA, 432 bp, Pseudomonas aeruginosa
ggcgctgtgcctcaggcaccgccccgtctatgcggtggtgccggagcaggccgcggcgattgccttgcagggcttgctcgccgcggcgggtgtccgcacccgggtgctgttcggcgagcaggcgttgtgcgaagtggccagcgcgcccgaagtggacatggtaatggcggccatcgtcggcgccgccgggctgccgtcgaccctggcggccgtcgaggccggcaagcgcgtactgctggccaacaaggaggcgctggtgatgtccggcgcgctgttcatgcaggcggtcaagcgcagcggcgcggtgctcctgccgatcgacagcgagcacaacgcgatcttccagtcgctgccgcgcaattatgccgatggcctggagcgggtcggcgtgcgccggatcctcttgaccgcctccggcggcccgttccgtga

SEQ ID NO: 4442 - DNA, 2466 bp, Pseudomonas aeruginosa
gtcgtctgtagtcatgttgaattcgaatctgccgccctttgcggcagattctctatttgtcagttggaaaaaaaggactccatgaaacgctttctgctacccgcgctgctgtcagcgctgatgatcgccgaggttcacgccgagtccttcactgtttccgatatccgggtcaatggcctgcagcgcgtgtccgccggtagcgtgttcgccgccctgccgctgaacgtcggcgagaccatcgacgaccaggccctggtccaggccacccgctccctgttcaagaccggcttcttccaggacatccagctcggccgtgatggcaacgtgctggtagtcactgtagtcgagcgcccgtcgatctccagcatcgagatcgagggcaacaaggcgatttccaaggaagacctgctcaagggcctgaaacagtccggcctggccgagggcgagatcttccagcgcgccaccctcgaaggcgtgcgcaacgagctgcaacgccagtacgtggcccagggccgctactcggccgagatcaacgcggaagtgatcccgcagccgcgcaaccgcgtcgcgctgaagatcaacatcaacgaaggcacggtcgccgcgatttcccacatcaacgtggtgggcaacaccgtcttctccgaagaagacctgaccgacctgttcgaactgaagaccaccaactggctgtcgttcttcaagaacgacgacaagtacgcccgcgaaaagctctccggcgacctcgagcgcctgcgctcctattacctggaccgcggctacatcaacatggatatcgcctccacccaggtatccatcaccccggacaagaagcacgtctacatcaccgtcaacatcaacgagggtgagaagtacaccatccgcgacgtgaagctgaccggcgacctgaaggtgccggaagaggaagtgaagcgcctgctgctggtacagaagggccaggtgttctcgcgcaaggtgatgaccaccacctccgacctaatcacccgtcgcctgggcaacgagggctacaccttcgccaacgtcaacggcgtgccggaagcccatgacgacgacaagaccgtctcggtgaccttcgtcgtcgacccgggcaagcgcgcctacgtcaaccgcatcaatttccgcggcaacaccaagaccgaagacgaagtgctgcgccgcgaaatgcgccagatggaaggcggctgggcctccacctacctgatcgaccagtccaaggcccgcctggagcgcctcggctacttcaaggaagtcaacgtcgagaccccggcggttcccggcaccgacgaccaggtcgacgtcaactacagcgtcgaagagcaaccgtccggctcgatcaccgccagcgtcggcttcgcccagagcgccggcctgatcctcggcggctcgatcagccagaacaacttcctgggtaccggcaacaaggtcagcatcggcctgacccgcagcgaataccagacccgctacaacttcggcttcgtcgacccctactggaccgtcgacggcgtcagcctcggctacaacgccttctaccggaagaccgactacgacgaactcgacgtcgacgtcgccagctactcggtgaacagcctgggcgccggcatgagcatcggctacccgatcagcgagacctcgcgcctgacctatggcctgagcgtgcagcgcgaccagatcgacaccggccgctacaccgtggacgagatctacgacttcctcgacaaggaaggcgacaacttcaccaacttcaaggcttccatcggctggtccgaatcgaccctgaacaagggcgtgctggccacccgtggtcactcgcagagcctgaccctggaaaccaccctgccgggcagcgacctgtcgttctacaagatcgactaccgcggccaggtcttcgccccgctgaccgacaactacaccatgcgcttccacaccgagctgggctatggcgacggctacggatccaccgagcgcctgccgttctacgagaactactacgccggcggcttcaactcggtgcggggcttcaaggacagcacgctggggcctcgtagtaccccctctagggcttacaaggatggcaagatcattcctgggcctgatgagcgtggtcgctacaccgacccggaccaggatcccgaagccttcggtggtaacatcctgatcaccggcggcgccgagctgctgttcccgctgccgttcgtcaaggaccagcgccagttgcgtaccgtgctgttctgggacgtgggtagcaccttcgataccgactgcccgaccaagaccaccaccaactgcgacggcatcaagaccgacaacctcgccagttccgtgggcgtcggcctgacctggatcaccgcgctgggcccgctgagcttcagcctggcgacgccgatcaagaagccggacaacgcggaaacccaggtcttccagttctccctgggccagaccttctga

SEQ ID NO: 4443 - DNA, 963 bp, Pseudomonas aeruginosa
agcgcttgccgcctgcgatgcggtgctgatcgcctccggcaccgcgactctcgaggcgctgctctacaagcggccgatggtggtggcttatcgggtcgccgggttgacgtatcggattctcaagcgcttggtgaaaagcccgtacatctccctgccgaacctgttggccggacgcctgttggtgccggagctgatccaggacgccgcgactccgcaagcgctggccgcaaccctcttgccgctgctggacgacggctcacagcaggtggaattcttcgatgccatccatcgggccttgcgccaggatgcctcggcacaggcggcggaagccgtcctgcaactggtggagcgccgctgatgcaactgggtctggatttcaatctggtggaggatctggtcgcgggcgtcgacgaggtcggtcgcggtccgttgtgcggcccggtggtcaccgccgcggtgattctcgacccgagccgcccgatcctcggcctgaacgactcgaagaagctcagcgaagcccgccgcgaggcgctgttcgaagagatccgcgagaaggccctggcctggtgcatcgcccgcgccgaggtcgaggagatcgaccggctgaacattctgcatgccaccatgctcgccatgcagcgcgcggtcgaaggcctcagcgtgactccgcggctggccctgatcgacggcaatcgttgtccgaaactggcggtgccctgcgcgccggtggtcaagggcgacagccaggtgccggcgatcgctgcggcgtcgatcctggccaaggtcagtcgcgaccgggaaatggtcgagctggaccgggtctatccgggctatggcatggccgggcacaagggatatccgaccgcggtccatctcgaggcgctttcccgcctcggcccgacgccgatccatcgacgctcgtttgcgccggttcgcgaattgctggacgtctctgttcaataa

SEQ ID NO: 4444 - DNA, 1452 bp, Pseudomonas aeruginosa
caacaatccgccacaagcggaacaggggagttatccatgcaagaattcgccactcaggtcgtcgacctgctcaacggccttatctggggcaagatcctcatctggctgctggtcggttgcggcctgtacttcaccgtgcgcctggggctgatccagttccgccacttcggtcataccttcagcgtgctcaagggcagccgccagtcggacgactcgggaatctcctcgttccaggcgctctgcacctctctggcggcgcgggtcggtaccggcaacgtcgccggcgtggcggtagcgatcacgctcggcggtcccggcgcagtgttctggatgtgggcgatcgccctggtggggatggcgaccggcttcgtcgaggcgaccctggcccagttgttcaagattcgcgacgacaagggccagttccgtggcggcccggcctactacatggagaagggcctgggcgcgcgctggatgggcatcctgttctcgatcttcctgatcatcgccttcggtttcgtcttcaactcggtgcaggccaataccatcaccggtgccatgcagggcgccttcggcgtgccgacctggatcagcggcatcgccgtggtgatcctcaccgcgttgatcatcttcggcggcctgcgttccatcgcgcgcttctccgaactggcggtacccttcatggcggtggcctacctgctgctggcggtgggcatcatcctgttcaacctcagcgaactgccgggcgtcctggcgatggtggtgaagagtgccttcggctggcacgaggccgccgccggcggcatcggcgcggcgatcctcaacggcttcaagcgcggcctgttctccaacgaagcaggcatgggctcggcgcccaacgccgccgcctcggccacgccctatccgccgcacccggcgtcccagggctacgtgcagatggccggcgtgttcatcgataccctgctgatctgtaccgcttccgccgccatcatcctgctggccggaccgcaggaaggcgagggcatcatgctggtgcagaatgccctgaccagccaggtcggcgactggggccgctatttcctggcggtgatcatcctgttcttcgccttcacctcgatcgtcgccaactacttctatgccgagaactgcctggtattcctcgagcacaaccacctggcgggcctgttgatcttccgtctgatcgtgctggcgatggtgatgttcggcgcgctggcttcgctgccgttcgtctggaaccttgccgacgtgtcgatgggcctgatggcgatcaccaacctgatcgccatcctgctgctgtccaacctcgcgatcaagctggccaaggactacaacgcccagcgcaaggccggcaagctgccgaccttcgacgccagccagttcccggaagtccagcagaagctcgagccgggcatctgggacgaccgccgcgcctga

SEQ ID NO: 4445 - DNA, 3597 bp, Pseudomonas aeruginosa
acctgtagctttgccaccgggcccggtacaatccgggccttgtcgtttttgcgttatttctgctccggggccttcatgaccgtatccttcgttcacctgcgtctgcataccgaattctccctggtcgacggcctggtccgggtcaagcccctggccaaggcagtggcagggctgggcatgccggcggtggcggtcaccgaccagagcaacatgtgctcgctggtgaagttctacaagaccgccatgggcgccggcatcaagccgatctgcggggccgacatctggctcgccagccgcgaggaagatggcccgctcagtcgcctgagcctgctggcgatgaacgcgaagggctatcgcaacctcaccgagctgatttcccgcggttggagcgaaggccagcgcaacggcgagatcatcatcgaacgcgactgggtcaaggaggcggcggaaggcctgatcgcgctgtccgcggccaaggagggcgagatcggccacgctctgctcgacggcgaggaagccaaggccgaggcgctgttgcgcgagtggatggaggtgttccccgagcgcttctacgtcgaagtgcaacgtaccagccgggtcaacgacgaggagcacctccacgcggcggtggctttggcgtcacgctgcaacgcgccgctggtggcgaccaacgacgtgcgcttcatcaagcaggaagacttcgaggcccacgagacccgcgtctgcatcggcgaggggcggaccctcgacgatccgcggcggccgcgtacctattcggaccagcaatacctgaagtcgccggcggaaatggccgagctgttcagcgacctgccggaagcgttggaaaacaccgtcgagatcgccaagcgctgcaacatcgaggtgcagctgggcaagtacttcctgccggacttccccacgcccaatggcatgggcatcgacgactacctgcggcacgcctccttcgaaggtctcgaggagcgcctggaggtgctgttgccgaaggacaccccggactacgaggccaagcgccaggtctatgtcgatcgcctgaacttcgaactcgatatcatcatccagatgggtttccccggttacttcctcatcgtgatggacttcatcaagtgggcgaagaacaacggcgtaccggtaggccccgggcggggctcgggcgccggctcgctggtggcctacgtgctgaagatcaccgacctcgatccgctggcctatgacctgctgttcgaacgtttcctcaacccggaacggatctccatgcccgacttcgacgtcgacttctgcatggagggccgcgaccgggtgatcgactacgtggccgacgcctacgggcgcaacgcggtgagccagatcatcaccttcggcaccatggcggcgaaggcggtggtacgcgacgtggcgcgggtccagggcaagtcctacggtctcgccgaccggctgtcgaagatgatcccgttcgaagtcggcatgaccctggataaggcctacgagcaggaagaaatgctccgcgacttcctcaagagcgacgaggaagccgccgagatctgggagatggccctcaagctggaaggcatcacccgcggtaccggcaagcacgccggtggcgtggtgatcgcgccgaccaagctgaccgacttctcgccgatcgcctgcgacgaggaaggcggcggcctggtgacccagttcgacaaggacgacgtggaggcggccggcctggtgaagttcgacttcctcggcctgcggaccctgaccatcatcaagtgggcgatggagatcatcaaccgcgagcaggccaagaagggcctggagccggtgaacatcgacttcatcccgctggacgacaagccgacctattcgctgctgcagaaggccgagaccactgcggtgttccagctcgaatcgcgcggcatgaaggagctgatcaagaagctcaagccggactgcctggaagacctcatcgcactggtggcgctgttccgcccgggtcctctgcagtcgggcatggtggacgacttcatcaaccgcaagcacggtcgcgccgagctgtcctatccgcaccccgattaccagtacgccggcctggagccggtgctcaagcccacctacggcatcatcctgtaccaggaacaggtgatgcagatcgcccaggtcatggccggctataccctcggtggcgcggacatgctgcgccgggcgatgggcaagaagaagcccgaggaaatggccaagcagcgcggcggtttcatcgagggttgcaagaacaacggcatcgatgccgacctcgcgggcaacatcttcgacctggtggaaaaattcgccggctacggcttcaacaagtcgcactcggcagcctacggcctggtctcctaccagaccgcctggctgaagacccacttcccggcgccgttcatggccgcggtactcaccgcggatatgcagaacaccgacaaggtggtgacgctgatcgaagaatgccggcacatgaagctgcgcatcgtggcgccggacgtgaacaactccgagttccgcttcaccgtcgacgacgatggccggatcgtctatggcctgggcgcgatcaagggcgtcggcgaggggccggtggaggcgatcaccgaatgccgcgccgaaggcgggccgttcaacaccctgttcgacttctgcgaccgcgtcgacctgaaacgcatcaacaagcgcaccctggaagcgctgatccgcgccggtgcgctggatcgcctggggccgcactaccacgacgagctaaaggcctaccaggctaccgtcgacctcaaccgcgccgtgctgctggcggcgatggaggaagcgatccaggccgccgagcagaccgcgcgcagccacgacagcgggcacatggacctgttcggcggagtcttcgccgagccggaggcggatgtctacgccaaccaccgcaaggtcaaggagctgaccctcaaggaacgcctgaagggcgagaaggacaccctcggcctgtacctgaccggccatccgatcgacgagtacgaaggcgaggtgcggcgcttcgcccgccagcgcatcgtcgagctgaagccggcgcgcgatacccagacggtggccgggctgatcgtcaacctgcgggtgatgaagaacaagaagggcgacaagatgggcttcgtcaccctcgacgaccgctccggacggatcgaggcctcgctgttctccgaagccttcgccgcggcccagtcgctgctgcagaccgacgcgctggtggtggtcgagggcgaggtcagccaggacgacttctccggcggactgcgcctgcgcgccaagcgcgtgatgagcctggaggaggcgcgtaccggcctggcggagagcctgcggatgaagctgcacgccgacctgttgaagggcgatcgcctgcgctggctgggcgagctgttcaaccgccatcgcggttcctgcccgatcaccctggactacaccagcgccgacgccaaggccctgctgcagttcggcgagagctggcgggtggatccggcggacgatctgatccaggcattgcgtgaccagttcgggcgcgacaacgtcttcctcaattatcgttaa

SEQ ID NO: 4446 - DNA, 858 bp, Pseudomonas aeruginosa
ggagcgcaagcatgccggcggtgccgctcgaatcccgtctgttacaggccctggcgccctggcgcgaagcggggggctggtgcgtggcgttttccggcgggctggattccacggtgttgctgcatctgctcgcccaactggcccggagcgaagccttgccggcgctgtcggcgctgcatgtccaccatggcttgcaggctgcggcggacggttggccggcgcactgccaggtggtctgccggtcgctgggtatcccgctgcgggtcgagcgggtgcaggtcgccgttggcggcagcatcgagcaggcggcgcgcgacgcccgctatcgcgcattccaggcgaacctgggcgagggacaggtgctgctcaccgcgcagcacctcgacgaccaggccgagaccctgctgttccgcctgttgcgtggagcgggcctgcgcggcctggcggcgatgccggcgagccggccgctgggcggcggccgcctgtgccgacccttgctcggggtttcccgcgccgaactggaagcctatgcgcaggcgcaccggctggactgggtggaggatccttccaaccaggatccgcgcttctcgcgcaactacctgcgccgggagatcatgccgcgtctcgcctcccactggccgcaggccgtcgccggcatggcgcgctgcgcggcgcatctgcgcgaggccgaagacctgctggctgaactggccgccatcgacctccgggcctgccgccaaccctcggaactggattggccggactggctggatctgccccggatcgccctggagcctctgcgccgcctcagcgctgcgcgccagcgcaacctgctgcgggcctggctggggcagctga

SEQ ID NO: 4447 - DNA, 705 bp, Pseudomonas aeruginosa
agtcaccatcgccatggtcggcaagtacatggaactgctggacgcgtacaagtcgctgatcgaggcgatgacccacgccggcatccagagccgcaccaaggtcaacctgcgctacatcgactccgaagacatcgagcagcagggcaccagcctgctggaaggcgtcgacgccatcctggtcccgggcggcttcggcctgcgcggcgtggaaggcaagatcagcaccgtgcagtacgcccgcgagaacaagattccctacctgggcatctgcctgggcatgcaggtcgcggtcatcgaatacgcccgcaacgtgctcggctggagcgacgccaactccaccgagttcgacaagtccagcggccacccggtggtcggcctgatcaccgaatggcaggacgcgaccggcgccaccgagatccgcaccgaagcttccgacctgggcggcaccatgcgcctgggcgcccaggagtgccagctgcagaccggcaccctggtgcacgattgctatgccaaggacgtgatcgtcgagcgccatcgccatcgctacgaagtgaacaacaacctgctgccgcaactggaacaggccggcctgaagatttccggccgctccggcgacggcgccctggtggaagtggtcgagtccccggagcatccgtggttcgtcgcctgccagttccacccggagttcacctccacaccgcgtga

SEQ ID NO: 4448 - DNA, 909 bp, Pseudomonas aeruginosa
tggccacccgctgttcagcggtttcgtcaacgccgcgctgaaatattccgggaaggcctgagcatggcacagaagatcgttcgcgtcggcgatatccagatcggcaacgacctgccgttcgtgctgttcggcggcatgaacgtgctggagtcgcgcgacctggccatgcaggtctgcgaagaatacgtacgggttaccgagaaactcggtatcccctatgtgttcaaggccagcttcgacaaggccaaccgttcctcgatccactcgttccgtggtccgggcctggaagagggaatgaagatcttcgaagagatcaagaagaccttcaaggtaccggtcatcaccgatgtccacgagccgttccaggcccagccggtggccgaggtctgcgacatcatccagctgccggccttcctctcgcgacagaccgacctggtggtggcgatggccaggaccaacgcggtgatcaatatcaagaaggcccagttcctcgcgccccaggagatgaagcacatcctgaccaagtgcgaggaagccggtaacgaccgcctgatcctctgcgagcgcggctcctccttcggttacaacaacctggtggtcgacatgctcggcttcggcatcatgaagcagttcgagtacccggtattcttcgacgtcacccacgccctgcagatgcctggcggtcgcgcggactccgccggcggccggcgcgcccaggtcaccgacctggccaaggccgggctcagccagaagctcgccgggctgttcctcgaggcccatccggaccccgagcacgccaagtgcgacggtccgtgcgcgctgcgcctgaacaaactcgaagccttcctgtcccagctcaagcaactggacgagctgatcaagagctttcctgcaatcgagactgcctag

SEQ ID NO: 4449 - DNA, 1335 bp, Pseudomonas aeruginosa
tctcctcagaccgccccgttcattcacttcggagtgttaacaagaatggcaaagatcgtcgacatcaagggccgtgaggtcctggactcccgcggcaaccctaccgttgaagcggacgtgatcctggacaacggcatcgtcggcagcgcctgcgcgccttccggtgcttccaccggttcccgcgaggccctcgagctgcgcgatggcgacaagagccgttacctgggcaagggcgtgctgaaagccgtggccaacatcaacggcccgatccgcgacctgctgctgggcaaggacgcggccgaccagaaagccctcgaccacgcgatgatcgagctggacggcaccgagaacaaggccaagctgggcgccaacgcgatcctcgcggtgtccctggctgccgccaaggccgccgcacaggccaagggcgtaccgctgtacgcgcacatcgccgacctcaacggcactcccggccagtactccatgccggtgccgatgatgaacatcatcaacggcggcgagcatgcggacaacaacgtcgatatccaggaattcatggtccagccggtcggcgcgaagaacttcgccgaggcgctgcgcatgggcgccgagatcttccatcacctcaaggccgtgctgaaggcccgtggcctgaacaccgccgtcggtgacgaaggcggcttcgcgccgaacctgtcgtccaacgaagacgccctggccgccatcgccgaggccgtcgagaaggccggctacaagctgggcgacgacgtgaccctggccctggactgcgcctccagcgagttcttcaaggacggcaagtacgacctggaaggcgaaggcaaggtattcgacgccgccggtttcgccgactacctggccggcctgacccagcgctacccgatcatctccatcgaggacggcatggacgagtccgactgggccggctggaaaggcctgaccgacaagatcggcgccaaggtccaactggtcggcgacgacctgttcgtgaccaacaccaagatcctcaaggaaggcatcgagaagggcatcggcaattcgatcctgatcaagttcaaccagatcggttcgctcaccgagaccctggaggccatccagatggccaaggccgccggctataccgcggtgatctcgcaccgctccggcgaaaccgaggactcgaccatcgccgacctggccgtgggtaccgccgccggtcagatcaagaccggttcgctgtgccgctccgaccgcgtgtccaagtacaaccagttgctgcgcatcgaagagcaactgggcgccaaggcgccgtaccgtggtcgcgcggaattccgcggctga

SEQ ID NO: 4450 - DNA, 1128 bp, Pseudomonas aeruginosa
caggccgttgccgggcccgaagctttccagcaggttgagcttgggatagggcagggcgaggcgggtgcccaactggtcccaaaagatcgccaccagggttccgccgatgacgttgccgatgccgaccacccagaagtgcacctggccctccatcgagcggtacatccagccggtctcgcaaccgccggcgaggacgatgccgatgccgaagagaatgccgccgatgatcgcattcgggcccatccagaagatcttcggcgcgacgcccaggcggatcgcggcgaaggtaccgatgcaggcggccgccatgccgagcaggatgccgaaggcggcgcgggtccggccggtggtccagaggtcccgtgcggcactggtgaagcagatctgcgcgcgctcgatcaggccgccgaacagcaggccgaacaggcaggccatgcccagcaccagcgatacctcgaagcgccaggcggcgaacagcgcggcgagcgccagcaccgccaggcccaggcgggcctgcaggcgtgcgcgtcgggccaggctttcggcgctgggcagggcgctggccgtggcgccgactttcagcggtgtgcgcaggaacggcagcaggctgatcttcacgccgatccaggcgccgccgacggtggcgaacatgaaggcccaggcgtgcagggaaaacatcgggataccggtgaagaacgccgccaggttgcagcccatcgccaggcgcgcgccgaagccggcgacgataccgccgaccagaccctgcagcaggcgacgtttgctggtcggccagcgcaggctgacgttgccggcccagagggcgcagcacagggcgccgaggaacatgccgatgatcatcactccgtcgatccggtccagcggcgtgccttgaaggccgatcagcctgaagtagctccagtcctgtggctggtagccgaaccaggacagcacgtggccgccccagcgggtgaattcgccggtcaccgcccagaaggtgccggtgagcgcgaagtagtaggcggaggcgacgccgagggcgaccagcgccggcagcggcgaccagaacctcaccaggtagcgttggcgaaacgcattgaaggcagacatgcgacttccttgaatcgatag

SEQ ID NO: 4451 - DNA, 996 bp, Pseudomonas aeruginosa
cgggtggaacgggaaaccgccaagtctatcgcagcggtgaatcgccttactgcttcagcgcaggtttttctccccggcgagtcccggatgggattgcgccaggccttccttgagatagtccaccagttgcctgactttcggcgacaggtgccgctgctgcgggtacagcgcccataccgctgtattcggcggctggtggccttccagcagggagaccaggcggccgctgcgcagatgctcgatcacatagtagtcgggcagctggcacaggccgaagccgcgcagggcggcgtcgagcaccgcctggccgctgttgcagcgccagttgccctggacccggtgctgggtttcccggccgtcctcgaggaagctccacaggtcgctgctgccgatcaggcagttgaactggccgagttccgccggcgactgcggagtgccgtggcggcgcaggtattccggggtggcgcagaggtacatgacgcgtggtgccaaccgtgtggcgaccaatcgcgaatcgctcaggcggccgaggcggatggccaggtcgaagccctcgtggagcaggtccaactggcggttggacagctcgatgtcgacccgcagttgcggatagtcggccatgaaggcattcaccagcggcacgatgaaacgttcgccgtaggctaccgcgcaggtcatgcgcagcaggcccttgggctccgcggagaggtcgctgaccgcgcgcagggcttcgtcgcgggcgtcctgcaggcgctggcaatgttgcaggaaggtctgtccggcttcgctcagcgatactcgccgggtgctgcggtagagcaggcgggtctgcaggcgctcctccaggcgggcgacctggcggctgatgtgcgacgaggaaacgcccatgcgttcggctgccgcggtgaactgcccggtttcggcgacagcgacgaattcgtcgagtccttcccagcgattcatctggattgtccctgtatggcaataatgttttga

SEQ ID NO: 4452 - DNA, 789 bp, Pseudomonas aeruginosa
aatcctcgacctggtaccgacagggcagacggaaaacccatgcgcatactgattgccaacgacgacggggtgaccgcacccggtatcgccgcgctttacgacgcgctggcggatcatgccgattgcgtagtgatcgcccccgaccaggacaagagcggcgccagcagttccctgacgctggaccgcccgctgcacccgcagcgcctggacaacggattcatcagcctcaacggcacgccgaccgactgcgtgcacctgggcctgaacggcttgctggaggaattgccggacatggtggtctcgggtatcaacctgggcgccaacctcggcgatgacgtcctctattccggtaccgtggcggcggccatcgaagggcgcttcctgaaggggccggccttcgccttctcgctggtctcgcggttgacggacaacctgcccaccgccatgcacttcgcccgcctgctggtctccgcccacgagcgcctggccgtgccgccgcgtaccgtgctcaacgtcaatatcccgaacctgccgctggatcgcgtacgtggtatccaactgacccgcctcgggcaccgtgcccgtgccgccgcaccggtgaaggtggtcaatccgcgcggcaaggaaggctactggatcgccgcggccggcgatgccgaggacggcgggccggggacggatttccacgcggtcatgcaaggctacgtgtcgatcaccccgttgcagctggaccgcaccttccacgaagccttcggcggcctcgacgagtggctgggaggactgacgtga

SEQ ID NO: 4453 - DNA, 543 bp, Pseudomonas aeruginosa
ggtagtccctttccgtttctaccctggagaacagtgatgaccctgatggagtccgacctgaccgcactggccgcccgcctcggcgaaagccttcgttacctgggcgagcaggtcagcacggcggaatcctgcaccggtggcggcatcgccgaggcgatcacccgcatcccggggagttcgggctggttcgaggctggctacgtgacctactcgaaccgccagaagaccctccagctggaggtgcccgagtcgctgttcccggcagtcggcgcggtcagccgggaagtggtcgaggccatggtgcgcggcgcccagcggcacagcggggcgcgtttcgcggtggcggtgagcggtgtcgccgggcccgacggtggctcgccggaaaagccggtaggcacggtctggctggcttgggccgacggcgagcggctggtcagtgagcgctgccagttcaacggcgaccgcgacgccgtgcgccggcagacggtggcgaccgcgctgaccggcctgctgcgcatgagcaacggcgagaacccgggctag

SEQ ID NO: 4454 - DNA, 309 bp, Pseudomonas aeruginosa
cgaaacccgcgtcaaggtggtgaagaacaaggtttccccgccgttccgccaggccgagttccagatcctctacggcaagggcatctaccgtaccggcgagatcatcgacctgggcgtgcaattgggcctggtcgagaagtccggcgcctggtacagctaccagggcagcaagatcggccagggcaaggcgaacgccgccaagtacctggaagacaatccggaaatcggttcggtactggagaagaccattcgcgaccagttgctggccaagagcggcccggtgaaggccgacgccgaagaagtggctga

SEQ ID NO: 4455 - DNA, 483 bp, Pseudomonas aeruginosa
cgccgaagccgattgaggccaatggcgaccgtgctcgatacgcccgtcgccgtgcggcgggcggccatggatctgctggcgcgccgtgagcacgggcgcgccgagctttcccgcaagttgcgccagcgtggcgcgtctgccgagttgatcgatcctgccctcgaccgcctggccgaggaaggtctgctcgacgaatcccgctatctcgaaagcttcatcgccagtcgcgcccgtagcggccatgggccgttgcgcatccgtgaggaactggcgcaacgcggtctgccgcgcgccgatatcgaaagggcgctgggtgcctgcgaggtcgactggagtgcgcaattgcgtgaggtctggcgccgcaagttcgcccgcctgccgcaggacgccagggaaaaggcccagcagggccgcttcctggcgtaccggggttactccatggagtcgatcagccgcctgttgaacggccgcagcgacgattga

SEQ ID NO: 4456 - DNA, 2472 bp, Pseudomonas aeruginosa
tgcaggtcagcgccctttgccgtgtgctgcctagactgcaaggcaccactagggaggctacccaccatgagtcagattctgcccagtcaggacgagttgcttgcccatgcggcggccgagccggcgtttgccgcgtggctgcaaggccatggtccgctccagcatagcgcagagacccgcgccgccgtgttccgcaccgctcatcaattggtccaagccgggctgcaaccggacctggccagcgtctaccaactgttccgcgccctcgaccggctgaccgccagcgccctgcgcatcgtcgtgcacatgacctacgcccggcgcatccgcctggacggccagccgttgcaggccgaggatttcaagacacagcccgagggccacaccggcggagccctgaacatggtcccggcctacgccggctatctggcactcaacgtcctgaccggcaagactcgcgcctggctgatgggccagggccattgcgtggccgccatcgacgcgctgaacgtcctcaccggcaacctgcacccggagcaggagcgcgcctatgccgacggcgaggaagggctgaaccgcttgctgcaggacttctacgggtacgcccaggcccccaacggcgcaccggcggcgccactgggcagccacgtgaatccgcataccgccggcggtatcgccgagggcggctacctcggcttcgccgaattgcagtacgcgcacatgccgctgcccggcgagaccctggtggcgttcctctccgatggtgccgccgaggaacagcgcggcagcgactggattccgcgctggtggcgagccgaggattgcggggcggcgctgccggtgatgatcgccaatggccggcgcatcgagcagcgcaccgaactgggcacccatgaggggctggagggcttcaagctgcacctgcgccgctgcggcttcgatccgatcagcttcgatgggcgcgacccggccgccttcgtctgtacgctctgggagatggagcagcgcctggagcggcgcgtgcaggagaagaacagcggcatcctccgctacccgctgccgattccctacggcatcgccgagacggtcaagggcttcggcttctatggcgccggcaacaacgccgcgcacaacctgccgctgccgggcaatccgcataacgacgaacaggcccggcaactgttcaaccagcatgcaaacgaactctgggtcgagcctgaggctctcgaattggcccgccggctgttcgccgagcagcgcggcgagcgtcccctcgaacgggacaacccgctggccctgcgccatcccatcgaaccgatcatcccgccgctgcgctatcgcgacgacgcctgctcgccgatggccgcgctggaccgcttctataccgaactggtggaggccaaccccgacctgcgcgcccgggtcggcaatcccgacgaattggccagcaaccgcctcggcggcgtgctcaaggcgctcaagcatcgggtcagcgagccggagagcgaactggaatcggtgagcggtcgggtcatcaccgcgctcaacgaggaggcggtggtgtccgcctgcctggccaaccagggcggactcaacctggttgccagctacgaagcgttctgcgtgaagatgctcggcgcggtgcgccagaccctgatcttcgcccgccagcagaaggaattccggcgtccggccggctggctgggctggccgctggtcgctacttcgcatacctgggagaacggcaagaaccagcagtcgcaccaggacaccaccttctgcgatgccctgcttggcgagatgagcgacatggtccgggtgctcttcccggccgatcacaacagcgccctggcgctgctaccgacgatctaccgcagccggggccaactggcctgcctggtgatccccaagcgcgaccggccgatggtgttcgacgccgtccaggccgagcgcctggcccgcgacggcgcgatcctggtcgaggagcgctgcggctccgatccgctgctgctgatcgccaacggcagctaccagctcgaacagatgcgccgcgccgcgcagcgcctggccgaggccgggcaggcctaccggctggtctacctgcaggagccgggacgcttccgcgcgccgcgcgatcgctgggaggtcgaggcggtggccgacgaggcgctggtggaacgactgttcccggatagccatgagcgccgcgtgctactcacccatatgcgcgcggaagtggcgcgcggtcatctttggccgatcctgccggatgcccggcgcacctcggtactcggctatcgcaaccgcggcggcaccctcgacgaggcgggcatgcagttcgccaaccgcgcctgctggggcaacgtgctggcggcttgcgcccgcttgatggaggtgccgcgcaccgcgctgctgactccggaggaagcggcggcggtggccggcaagggcgatccggcgttgttgcgctga

SEQ ID NO: 4457 - DNA, 591 bp, Pseudomonas aeruginosa
atctgcgtcggcagggtggcgaagccgccgccggcggtgaagaaggtgatcacgaagtcgtcgatggacagggtgaaggccatcagcgcgccggcgacgatgcccggcatgatcagcggcagggtcaccaggcggaagctctgccagggcgtggcaccgaggtcgcgggccgcctcggtgaggctttcgtccatgcccgacatgcgcgcctgcaccaccagggcgacgaagccgaccgagaaggtgatgtgcgcgagggtcaccgagagcatgcccaggctcatgttcaggccgatgaagaagatcaccagcgagacccccatcaggagttccggaatggcgatcggggtcagcaccagcaggggcagcacgcgcagcttgaagcgatgcagggcgaccccggcgagggtgccgagcagggtcgccacgctggccgaaaccagcgcgatgaccagcgagttggcggcggcctggagcatgtcgcggttgccgaacagcttgcggtaccagtccagggtgaagcccacccactcggcgttcagccgcgagtcgttgaaggagtacagcaccacgatcaccagcggtacgtag

SEQ ID NO: 4458 - DNA, 1302 bp, Pseudomonas aeruginosa
tcgccgggaaagcggaacgaggcgaacagcatgatcagcgccggaaccaggaagaagaacagcagatacgcttgcggcggccagaccagcagccacttgccgaggttctttctcatcgtctcaggccctgaccaggtggccggcatcgaagcgccaggcggcttccaccgcgtcgcccacctcgaagaacttggcccggccgggcgtggcgttgggcagcagggtttccaggcgctcgccgttctccagctcgacgatgtacagggtcacgtcgcccaggtagagcagttcggcgacgcggccgcggaagtgcacctcgtcgctgtcagcggtgacgctctgcgccaggcggatcttctccggccgcagggtcagcacgcaggcctcgccgggctgggcgtcgaaggatttcagcgcctggacctcgcccaggccccggagatcgatgcgcacgcgttcgccgtcgaccgcctcgaccgtggcgtcgagcaggttgcactggccgatgaagtcggcgacgaaacgactgcgcgggaagctgtagatggtttccggggcgtccagctgctccacccggccctggttcatcaccgcgatgcggtgcgacagcgccagggcttcgccctgatcgtgggtgacatagacgaaggtgatgccgacgtccttctgcaggttgatcagttcgatctgcatttcttcgcgcagcttggcgtccagcgccgacagcggttcgtcgagcagcagcaggcgcggccggttgaccagcgcgcgggcgatcgccacgcgctggcgctggccgccggaaagctgtgtcggcatgcgcccgcccttgtccgccaggcgcacgtccttcagggcctgttcgacgcgggcgtcgatctcgctcttcgccactccggccatcttcagcgggaaggcgatgttctgcgccacgctcatgtgcgggaacagcgcgtagctctggaacaccgtatgcaccgggcgcttctccggctcgacgccggcgaggtcctggccgttgaggcggatctcgccgctgtccggctggtcgaagccggcgagcatgcgcaggagggtggtcttgccgcacccggaagggccgaggagggtgaagaattcgccggtgttgatcgtcaggctgacattgtcgacggcggtgaagtcgccgaagcggcgggtcacgttgcggatctcgagcaaggggggcgtcattcgtctggagaggcagtaaggtcagcgggcggagccggctgcccggtgtcgaaaaagggggcggattatagggatcgcatcccgctctaa

SEQ ID NO: 4459 - DNA, 873 bp, Pseudomonas aeruginosa
ggcccctgtgaagaattttttttcgcggcctcggaagttgtccgacaaagcaggagccacgcgggctctgatagaatttcgcggtcgctttccagcccgtttcctcgagtcttcgatgttccttcgcccgtcctttccgtatcgggagcctgcccgatgagccatgccgtttcccgcttgcgccaggagcgcctggcgcgcagcctgaaacccttcgtcgcgcgcggttcgcgcatgccgcgctgcgaaggctgtcggctgctgccgagctattgcatgtgcgcctggcggccgcgggtcgaggcgcgcgcaggcatgtgcctggtcatgcacgacatcgaggcgctgaaaccgaccaacaccggctggctgatcgccgataccgtggccgacaccttcgccttcggctggtcgcgcaccgaggtcgacccgcgcttgctggagttgctggccgacccgcagtggcagccatacctggtgttccccggcgaatacgtggcggcggagcgggtggtgaacgaggtcgccccgctggcggaaggcaagcgaccgctgttcatcctgctcgacgcgacctggaccgaggcgcgcaagatgttccgcaagagtccttacctggagccgttcccggtgctcagcctgctgcccgagcagctctcgcgctatcgcctgcgtcgctcgacccgtggcgagcacctgtgcaccgccgaagtggcggcgctgtgcctggagctggctggcgacgaggccgcgggcgaggcgctcggcgcctacctggaggtgttcagcgagcgctacctgggcgccaagcggcacattccgctggacgaggccagcccggcgcaccgtgccctggcgccgttccgtggctga

SEQ ID NO: 4460 - DNA, 381 bp, Pseudomonas aeruginosa
gaacccgacgtgtcgccttcccccttcaaaggccagaccggcctcaagcgtatcctcaacgccaccggctattccctcgcaggtttcctcgccgccttccgcggtgaagccgccttccgccaactggtgctgctcaacgtggtgctgatcccggtggccttcctcctcgacgtcagtcgcggcgaacgcgcgctgatgatcgcggtgtgcctgctggcgctgatcgtcgagctgctcaactcggcgatcgaggccaccgtcgaccgcgtctcgctggaacgccaccccctgtcgaagaatgccaaggacatgggcagcgccgcgcagttcgtggccctcaccgtgatcaccgtgacctgggcgaccatcctgctgggctga

SEQ ID NO: 4461 - DNA, 1653 bp, Pseudomonas aeruginosa
aaaagccggaggcagcgatgcctccggctttttctagcgtgcgagggcggcggctcaggccgccgcgtcgaagctgtcggcccgcgccatgttccacatgcgctcgtagaactcgccctcgatcttgccggaaagcagttcgcccggcttgaggaagtagtgcagctgcgagaacaggcggatctcggtgtcggtgatgcgtcgcaccaggtgcttggcttcgagctgcgagggatgttccaggcccgccgcggcgagcatctcggccaggcccttgagggtgttgcgatggaagttgcgcacccgctcggccttgtccggcaccaccagcgcgcgctggcgcagcgggtcctgggtggcgacgccggtcgggcacttgttggtatggcagctctgcgactggatgcagccgatggcgaacatgaagccgcgcgccgagttggcccaatccgcgccggtggccaggacgctggcgatatcgaaggcgctgacgatcttgccgctggcgccgaccttgatcttgtcgcgcaggttgaggccgaccagggtgttgtggacgaacagcaggccttcgcgcagcggcacgccgatatggtcggtgaactccagcggcgccgcgccggtgccgccttccttgccgtcgacgacgatgaagtcggggaggatgccggtctccagcatggccttggcgatgcccatgaactcccatggatggcccaggcagaacttgaagccgaccggcttgccgccggacagttcgcgcagctgggcgatgaactgcatcagctcgatcggcgtggagaaggcgctgtggcgcgacggcgaaacgcaatcctcacccatcggcacgccacgggtggcggcgatctcgggggtgaccttgtgcttgggcaggataccgccgtgtcccggcttggcgccctggctgagcttgatctcgatcatcttcacctgcgggtcgagggcctgggcggcgaagcgctcagggtcgaacttgccatcgcgggtgcggcacccgaagtagccgctgcccagttcccagaccaggtcgccgccgttctcgcggtgatagggactgatgctgccctcgccggtgtcgtggtagaagttgcccatatgcgcgccacggttcagcgagcgaatggcgttggcgctgagggcgccgaaactcatcgccgagacgttgaacagcgaagcggagtacggcttgctgcattgtggcccgccgatgtcgacgcggaactcgcagggatcgctgagcggcgccggacgcatcgagtggctgatgaattcgtagccggcggtgtacacgtcgatcagggtgccgaagggcttctccgagctttcgttcttcgcccgcgagtagaccagcgagcgctgggcgcgggagaagggcagggcgtcgccgtcggcttccagcaggtactggcggatctccgggcggatgccttccaccagatagcggatgttgcccaggatcggatagttgcggcgcaccgcgtggggcgtctggatcaggtcgaacaggccgagcaggctcagggccacgcccaggagggtgaacggccagagccattcggtgctgccgaggaacggcaggctgaccaaggtgaacagggcgatacaggcgaaaaacgcatagcgactgagtag

SEQ ID NO: 4462 - DNA, 765 bp, Pseudomonas aeruginosa
cccaggaacccagcacattgccgacgatggccagcgccagcagccacgcgaccgactggccgccgcgcagcagcaaggcggccagcacggtttccgactgcaacggcagcagggtcgccgaaccgaacgccgagaggaacagcccggcgtacgcggcccagtcagtcaacacccgaacgctcccagcgccattcgcatccccactccaatccggaaaaaactgacctgggacagccgtcccgaggccggcgaagcataccctggcaggcaagggcatttccccggttatccgaaaaggaggcaggccatgttcattcccggccatctgcatctcgcctcggccagcgaagtcgaccgccaggcattcgatatccacctgcgctaccgggtcctggaggccgaggcccgcccggtggccgtacacttcgacatggagggccggatcgacggccagcctttcagcgaaagcttcgaactgccgcgcgacgccgccgtgcatttcgccagccgtgccagtcgcctggcccggcgccacggcctgcgcttgcggcagggaccgatcgtgcgccagcgccgcgagtacgacgctatgttcgacgacctgcgccgacgcctgaaactcaagagcggcgaagcgatcgacctcgaccgctacctgcgcggcgaggccggggcatcctgaaacggctctcccgcatgctacggaagcccccgactcaggccatgccgtgcaactttcagcgaagcgggcgactccatacctag

SEQ ID NO: 4463 - DNA, 357 bp, Pseudomonas aeruginosa
gtaaccatcctcgtcaaggagaccgacatgactctgaaaacccgctccgctcgcgccaagcaggctatccaggaccaggccatggccgaactgcaggacctgatcgccgaggtggaccagttgatgagcggcaccggcagcctggccggcaaggagggcgcgaacctgcgtgaacagatcaattccgtgctgcatcgtggtcgcgacgccatcgagcgcacccgccgcggcgtggtgcaacgcagccaggcggccgccgaagcgaccgaggaatacgtcgaggaccatccctggcagaccatcgccgtctcggccggcgccggcttcctcctcggcttgctgatgggccgccgctag

SEQ ID NO: 4464 - DNA, 351 bp, Pseudomonas aeruginosa
agcgcgccgcgcacaacagtctttttcatctgcgacaaaattacccacccccggctcccacggcagccctgccgtcccgccggctatagtggaaaaacagcgagtccaggaggaaccgtcatggacaccagcccgcacaccttttccaacctgttccgccagttggggctccccgctgggcgggacgacatcgtcgcctttctcgcccggcaccacctcgaggagggcacggcgctgcccgatgcgccattctggaaccctgcccaggccagcttcctgcgcgaggccctggccgaggactccgactgggccgaacaggtcgatgaactggccttgcaactgacccgctga

SEQ ID NO: 4465 - DNA, 642 bp, Pseudomonas aeruginosa
agaccatcgccctccccccgcagatggtcttttttttgcccgcgattcggccgtgccccgaccggctggcccaggacatggaacattccgttacgtcccccactgaacttttcacccgtgcctcggtgtcttaccctgctcgcgttaccacgtaaggagaacctcaaggacatgaaagcactactgatcgccgccggcgttgccgctctttccagcaccgccatggccgccaaactggatgaaaaggttccctacccgaaggcagatgccggcttcacccgccaggtcatccacctgccgaaacaggacgcggaagacgcattcaaggtcgagatcatcgccggcaagaccctcgaggccgactgcaaccagcagcgcctgggcggcgagctggaagaacacaccctggaaggctggggctactcctactaccgcctggacaaggtcagcgggccgatgagcacgatgatggcctgccccggccagaagaaggagcagcgcttcatcccggtggtcggcgaaggcttcctgctgcgctacaacagcaagctgccgatcgtggtctatgcgccgaaggacgtggaggtccgctatcggatctggtcggcgtccgaaaaggtcgagaaagcggtcagcgaataa

SEQ ID NO: 4466 - DNA, 984 bp, Pseudomonas aeruginosa
gagaattgctatgaacttttccagcgataccatcgagctgttcctcgccgtcctcgaccgcggctccttttccggcgccgcccgtgccttgggtcgagtgccttcggcggtgagcatgggcatcgccaacctggaggcggagctgggtttcgcccttttcgagcgaacccaccgcgaagcccgtcctacggcgctggccagggccctggcaccgcaagcgcggatgatcgccgagcagctcgcccagttgcaggtgcatgcgctggaactctcccagggattggaaagccgcctgtcgctcggcgtggttgcggacatcgacagcgggcggctgttcggcgccctccgcaccctttccgagcgctacccgctgctcgatgtcgaggtgctcagcgcggcgcaggacgatgccctcgccctgctccatggcggccgcatcagcctgtgcttcggattcgccggcatcagcgtgaacccgcaggagcgcttccagtatgtcggcgcggaatcgctggtcgcgaccatctcgccgcgccatcccgccctgcagaagccggggcaggcgctgtacctggaagagctggtgaacgtgcggcagatcctggtcgccagttgcgacctaccgttggccgacacccgtccgctgattgccggcgcctgctggcgcaccgacagcctgggcacggcgctggaaatggtcgaggcggggatcggctggggcaatttcccgttgtcccgggtcgcgccgctgctggcaacgggaaggctggtacgcctggacttcaggaataccaagaacgagctgaaactgcctgtccacgctatctggctgaaaaaccagccattgcgcaaggccgcccaggaactggttggcatgctggccacccgtcccgattgaagcgttatgcaatgcacttcacagaaaaaacgagacccgtcacgcgaatcgccgcacacgccggctccccggcctccagtacttga

SEQ ID NO: 4467 - DNA, 423 bp, Pseudomonas aeruginosa
gccagtgcaatgccgagaagcgccagtgcaagaccctcaccaagctgcagcagcgccaggacgaggcgctctaccaggcgcagagcacggcctacaactactgcatgcagaacagcgacaagaagaagcgcaagtcctgcccctacccgcagcgcaacttcgatttcggcgacgactgccaggacgagtaccgcagttgctaccagtcctgcggcggcaccatccgccgcatcgtccaccaggactgaggcgcgacgtccggcaggcatcccggacgtgcggcaataccgtcaggcgaagacgaagtacttgcgcaccgtctccactacctcccaggtaccacgcaggcccggctcgatgacgaacacgtcgcccgccctcaggtgcaccggttgctcgccttccggggtgatgatgcagtag

SEQ ID NO: 4468 - DNA, 228 bp, Pseudomonas aeruginosa
tggccttttttcccttctgccgtagtccatggagatcgcatgccacgcattgccctggtcctgggcgtgctgctggtcagcgcctgcgcacagcctgtcacgccggactcgatagtcgaggaatcgttttcccgcagcgccagcgaacgccagctggaagagctgaaccgccagggccttccctacgagcagtaccggctgcgccgccagcgcattctcggccgctga

SEQ ID NO: 4469 - DNA, 996 bp, Pseudomonas aeruginosa
cgctcgttatccaatgaggaagccgcaatgactctagcaccgcgacacctgcgcatagaacaacgaggacgcgtcctgcaagtcctgctcgacaatcccccggcgaacttcctcaccacggcggtgatgcaggagctggccgacctgctggaagaccttgagcaacgccaggacatcggcgccgtcatcctttccggagcggcggacggggtcttcctgacccacttcgacgtcgacgagatcgagcgcgccgtcgcccccatcaccttttccatgccggcctggctgacacgcctgctgctggaaagcgaaagcctcctgcgccacttgcctggggcgaggaagctgctgcggcgcaccctgctggcaggcgtcgccgacatgaacctgttccatgaggtcaccgcgcacatgcgccgcatggacaaggtgttcatcgccgcgatcaacggcctggccctgggtggcggctgcgagctggcgctggcctgcgacctgcgcctgatggccgaggacgaccaagtggaacgcttcctcggccagccggaagtactcatcggcctgataccgggaggcggcggcacccagatgctggcgcgcagcctgggcgtagccagggccctggagctgtgcctggaagggcaactgctggagccgcgccaggcccttgcgctgggcctggtcaacgggctggcgccagcggaggagctactggaagccgccgacgcgctggcgcaacgcctgtcccggcgctcaccgcaagcggtgcgcctgatcaagcgttcgatctaccaggcggcttcccgcgactggacggagggcatggccagcgaaaaggccggcttcctctccgccgcctcccagggcaatacccgccgcgccatgcgcgaatacatcgaacgggtgcgcaccatcacccgggaagagcgccctttccgccgtgcggattttgacgacctgaccgaaggcaacgccatcgacatggcctacaggtga

SEQ ID NO: 4470 - DNA, 1428 bp, Pseudomonas aeruginosa
cagttcgaacaggctcctcttgatgccgttgcggactggcctatgctcacggtgtgtgcgaaccccaagggtatttcccgaccagctcccccgcggtcgggatttttttttgcctgtcgctcagcgcttcgggtcgaagggcgaatagccccgccggcgcaggctcgccaggggcgcgaacagcggttccggcagatcggcccaatcgaaccaggcccagccgtcgcacttgtccggctccatgaggcgcgcctcggcatcctccgcgcaaccggccaggatgaacgcggtgaggtagtggcgcccctcgaagacgtcattgctgaacgggccgtggcgcagttcgctcagcgccaggccggtctcttccagggcttcgcgcagggcgcagtcctccaccgcctcgccgaactcgagatggccgccgggcgccgaccagcagccagcgccatgactgcccttgcggcgccccagcaacaccttgccgtcccgcaagatcaggacgcccacgcctacctgcggtgccggcatcgtcgtactcctgcttcgggatcagagatggagcgtaccgctcatgtacaacgccgccttgccggagatgaccacccgctcgccgcgcacgtcgcattccaggcgccccttgcgcgccccgccctgctcggcgctcagccgggtcttgcccaggcgctgcgcccagtacggcgccagggaggtatgcgcggaaccggtcaccgggtcttcgttgacgccgacgttgggcccgaaccagcgcgagacgaaatcgaagcgctggctgcgcgcggtcaccgccaccccgcggcacggcaagcccttcagccgggcgaagtcaggcgccagggcggcgatcgtcttttcgtcgtcgaccaccacgaggtaatcgtcggtcttcagcacttccgcctcggcaatacccagcgcctccagcagtccgtccggtgtcgcgcaaggctccggacgcttggccgggaagtccatcgccagcgagtcgccctcgcgccgcacgctcagctcaccgctacgggtagcgaaacgcagtaccggggaagcgtcgtcgagcttgtggatcagtacccaggccgtcgccagggtcgcatgaccgcacaggtccacctcgacctgcggcgtgaaccagcgcaatcgatagtcgccgtcgcggccgacgacaaaggcggtttccgaaagattgttctcttccgcgatggcctgcaggcgctcgtcgtccagccaggcatcgagggggcagaccgccgccggattgccctggaagggactgtcggcgaatgcgtctacctggaagatcgtcagttccatgttccggactcctgtatcgatgggctgcgcaccttagcagccggaccgagaccaggacaatgccgcgccccgcgcaggcgcctcgctcagatctga

SEQ ID NO: 4471 - DNA, 1038 bp, Pseudomonas aeruginosa
tcaggatccagtatgctcgcctgccccctccctcccgacgaagccctgcgccagcaggccctggacgacatggcgctggtcgacacccccgccgaacactacctggacgccctggtggaactggcgcgggaaaccttcggggtgaagaccgtgctgatcagtctgatcgaccacgaccgccaatggttcaaggcccgtatcggcctggatgccgaacagacgccgcgcgacctgtccttctgcggccacgccatcctggccagcgaaccgctgatggtgacggacgcctccagggatccgcgttttcacgacaatccgctggtcaccgggccgcccttcatccgcttctacgccggcgagcccctgcacgccagcaatggccaggccatcggcacactctgcctgatcgacccgagcccgcggcttctggatctccgggaaggacgccagctcaatcgactgtcgatcctggccgaaggatatctccagctacgcagcctcaccgagcacacccgcttcctgcgccaggagatcgaccgggagcagcgcaagtcactgctcgaccccctcacccaattgtggaaccgggccggcttccacgcgctgcaccagcatgaactggagttggcgcgggccagcgaccagcgcatcggcatcatctacagcgatatcgaccatttcaaacgtatcaacgacaccctggggcaccgggccggcgacagcgtcctccgcgaggcggcttcgcgactgcgcgcggcgctgcggccggaagatctcctggcgcgtttcggcggcgaggagttcgtggcgatggtccgggtccgcgagaccacggaactgaccatgatcgccaatcgcatccgcgaactgatggaagcgaccccgatcgactgtgccggcacgtccgtgccggtgaccatcagtgccggctgtaccctggccggcagcggcgaagaaccggaacgggcactcgcccgggcggatgccgcgctgtacgacgccaagcgtgccggacgcaaccgggtggtcagcgtctga

SEQ ID NO: 4472 - DNA, 1347 bp, Pseudomonas aeruginosa
ccggccgatttcgactcgggtagcatccgggcatccgtaaaaaataaaaaacagaggtgcaagatgccgcacaccccctacccctcctcctattacgccgcgtcggccaatcccgcgccgccccgcccggaactccagggcgaggtcgaaaccgacgtctgcgtgatcggtgccggctataccggcctctccaccgccctgttcctgttggagaatggtttcaaggtcaccgtactggaaaccgccaaggtcggcttcggcgcttccgggcgcaacggcggccagatcgtcaacagctacagccgcgacatcgacgtgatcgagcgcaccgtcggcaagcgcgaagcgcagttgctcggcgagatggccttcgaaggcgggcgcatcatccgcgagcgcgtggcccgctacggtatccaatgcgacctgaaggacggcggggtgttcgccgccttcaccgagaagcagatggatcacctgcgcgcgcagaaacagttgtgggaacgctacggccacaaccagttggagatcatggacgccaagcgcatccgcgaggtggtggcgaccgacaactatataggtggcatgcttgacatgagcggcggccacatccatccgctgaacctcgccctcggcgaagcggcggcggtggagtcgctcggcggcagaatttacgagcagagcccggcgacccgcatcgagcgcggcgccagcccggtggtgcataccccgcaaggcaaggtgaaggcgaagttcatcgtggtcgccggtaacgcctacctcaacggcctggtcccggaactggcggccaagtcgatgccctgcggcacccaggtgatcaccaccgagccgctgaacgaggaactggcccacagcctgctgccgcaggactactgcgtggaagactgcaattacctgctcgactactatcgcctctccggcgacaagcgcctgatctatggtggcggcgtgatctatggcgctcgtgatccggcggacatcgaggcgatcatccggccgaagatgctcaagaccttcccgcaactgaaggacgtgaagatcgacttcgcctggaccggcaacttcctgctgaccctctcgcgcctgccccaggtcggccgcatcggcgacaacatctactattcccagggttgcagcggccacggcgtgacctacacccacgtcgccggcaaggtcctggccgaagccctgcgcggccaggccgagcgcttcgacgctttcgccggcctgccgcactaccccttccccggcggcaagctgttccgcgtaccgttcaccgccatcggcgcctggtactacagcctgcgcgacaagctcggggtctag

SEQ ID NO: 4473 - DNA, 432 bp, Pseudomonas aeruginosa
cgctctggcaaggcgaactgcgcagccgcgaaggcgccccagggtattcccgaatacctggcgcaggtcgaacccgccctgctcgacacgctggcgctcggccaggtgctggaaatgagcctgccgggtcgcgagcgggccttgcaggcacgcctcgccagcacccataacagcgccggcctgccggtctggcgcggcggcctggtggacggcgacgaggcggaaagcctgaccgtggtgcgcggcagcctggaaacccacatcaatgtcgccaccctcgacggcagctactcgatcatcgtcgacaaccgcagcggcaagacccgggtgatcgacgagaacgacatcgccgcgcgtagcgacccgcacggcgatcatgtcgacgcgccgctcgccgagctgccaccgatgccgccgcccgcccagggctga

SEQ ID NO: 4474 - DNA, 279 bp, Pseudomonas aeruginosa
acctgcaggaagcccaggccgcgccgccgagcgtaccgccggcgccgaaacgcatcgcctacgacttcgagagcggcatcggcggctggagcggcgtgcatgccagcgcccgcgccacgcgcgtcgccagcgccgggcggctggccctggaagcctaccagcggcgctacgccggcaccggcgcgagcaccagcctgctgggcaacctggaagcaggccggacctacgcgttcagcgcggacgtacgggtcggcgacggtcgcggctcgcaggccatga

SEQ ID NO: 4475 - DNA, 849 bp, Pseudomonas aeruginosa
actatgatcacttcggtttccctcgtttccgaggggcctgcccaccttcccaggagtacccccgatgacaagcgaccgcctggccggctacagccgcctgatggctaccctgaccctgctgttgatcgccggcatgctgctgctcaacgccgcgtgctggatcttccccgaccttgccagcgagcacggcctcggtttcgctctcaccgccaccggtgtcgccggcgacctcggcgttgtggcgcgggacatgccgctctggcaggccctcggcggcatcctcctgtcgagcctgccgctgctggtcctggccagtggactgcaggcgctgcgaaggctgttccagcactacgggcgcggcgagtatttctgcgaagacgccgcggcgctgctcggcaaggtcggcctgtgcctggcttgctgggtgctggcgaacttcctgctggaaccgctgctgacagtctgggtcaccttcctccaaccccaggggcaacgcatcgtcagtctcagcttcggttcggcggaactggtcagcctgttcgccgccgcctcggtgatggtgatcgcgcgcatccagcgcaaggccgccctgctcgccgaggaaaaccgccagttcgtctgaggtccgccatgcccatcgaaatcaggctggacgtcatgctcgccctgcgcaaggccaggtccaaggacctggcccaggccatcggcatcaccgaacagaacctgtcgctgctcaagcagggcaaggtaaagggcattcgcctcgctaccctggaggccatctgcgcctacctggcgtgccagccgggagacctgctggagtacctgcccggcccgaccgaggagtga

SEQ ID NO: 4476 - DNA, 582 bp, Pseudomonas aeruginosa
cagccgggcgcttatgcgctcgagcgagggggagcgcaccaaagggtatttaggccaagccccctttcgccgctacagtcgcggttcatccaccagacatgggcgaggccgggcatggcgaaatcctccgaacgattcgaatccctgcgccgggatatcgacgcactggcccgccggctcgacgtgccgtcggtgctgatcatgcgttccctgccccggcacatgcgcgtcgaggcctccgccggacgcctggaggacacctacccgatcggcgccgaaggccgcaagagcgtccatgaagacggcgccaaacccctctactgcgaacgcgtggtcgaccgcgacgccccgttgcacgtgcgcgactcgcgccaggagacggaatgggccggcaacgaggatgaagtcgagttcggcctgagcaactaccttggctatccggttcatgcgcccgacggcaccccgtacggcaccgtctgcgtactcgacagccgaccgcgcgactattcggccgaggaacgagccctgctggaagaattgcggcgcaaggtcgaggcgctgctggcggaaaccgtctcatga

SEQ ID NO: 4477 - DNA, 1305 bp, Pseudomonas aeruginosa
cctaaggtcaatcggataccgcggcgcacaaccgcgccgcctccgcccgccagacgaggaccttccgtgcacgcccgccgcctgccccgcctcttgccgctcgccctcgccttcctgctttcgcccgccgccttcgctgccgacacgccagccgccgagctgctgcgccaggccgaagccgaacgcccggcctacctcgacacgctccggcaactggtcgcggtggacagcggtaccggccaggccgaaggcctcggccagttgtccgcgctgctcgccgaacgcctgcaggcgctcggcgcgcaagtccgcagcgcaccggcgacgccctcggccggcgacaacctggtggccaccctcgatggcaccggcagcaagcgcttcctgctgatgatccactacgacaccgtgttcgccgccggcagcgcggcgaagcgtccgttccgcgaggacgcggagcgcgcctacggacccggcgtggccgacgccaagggcggcgtggcgatggtgctgcatgccctggcgctgctcaggcagcaaggcttcagggactacggacggatcaccgtgctgttcaatcccgacgaagagaccggctccgccggctcgaagcaactgatcgccgagctggcccggcagcaggactacgtcttctcctacgagccgccggaccgggacgcagtgacggtagccaccaatggcatcgacggcctgctgctcgaggtgaagggtcgctcgtcccatgccggctcggcacccgagcaaggccgcaacgccattctcgaactgtcgcaccagttgctgcgtctcaaggacctcggcgatccggcgaaaggcaccacgctgaactggaccctcgccaggggcggcgagaagcgcaacatcattcccgccgaggcttcggcggaagccgacatgcgctactcggacccggccgagagcgagcgggtactggccgacgcccggaagctgaccggcgaacgcctggtcgccgataccgaagtcagtctgcgtctcgacaagggtcgtccgcctctggtgaagaaccccgcctcgcagcgcctggcggaaaccgcgcagacgctctacggtcgagtcggcaagcgcatcgagccgatcgccatgcgcttcggcacggacgccggctacgcctacgtgcccggcagcgacaaaccggcggtgctggaaaccctcggcgtggtcggcgccggcctgcacagcgaggcggaatacctcgaactatccagcatcgccccccgcctgtacctgacggtggcgctgatccgcgagctgtccgccgactag

SEQ ID NO: 4478 - DNA, 1581 bp, Pseudomonas aeruginosa
cgccgacgcccgcagccagcctcaggtacggaagcgaccgagcaccacgcgcaagccagccatgtgctccttgaccctctggttggccgaaagcactgcggcggtcccttcgtgggcctgctcggagagtccggagacgttggtgatgttgcggtcgatgtcctgggccacctggctctgttcctcagcggcggtcgcgatctgctggttgaggccgtccagttcttccaccgtggcgacgatgcgccccagcgcctgggccgcgctgtcggcctcgacgaggttgctctgggcatggctggcgctaccgcgcatggcggcgaccgcatcgttggcgccgtcctgcaactgctcgatcaacccctggatctcctgggtcgactgctgggtacggttggccagcgaacgcacttcgtccgccaccacggcgaagccgcgcccggcctccccggcccgcgccgcctcgatggcggcattgagcgccagcaggttggtctgctcggcgatgctgctgatcaccgtaagcacctggccgacactgccggcatgctggtgcagggtgttcagcgccagggcggtctgttccagttcctccgccaacgcaccggtctggctgctggcgtgctccaccagacgccgtccctcgtgggccagggccgcggcgtcgcgcgtggagtgcgccgcatggttggcgtggcgggcgacctcggccacggtggcgctcatctcgttcatcgcggtggccacctggtccaggtcctggtgctggcgcgccacctggtcgccggcgccgagcgcctgctccagggcctcggccacgtccttgtcggtctctgccgcgctgcgcttgacgttcgccagcaaaccgctgacgtcctggcgcatccgctcgtagccagcgacgatgcggccgatctcgttgtccgcatggcccgccgccagggcatgggtgaagttcgccgcgccgacctcggtcagcgccacttccaacccacgcaactgccgcatcagcggcgccaggccgaactgccggccgagcaccaccagcaccaggatcgccaacaggcaaccgaaggcgatccacatctgggtgtgctggacactgtcggcgcgcgcgctcatcagcgagaccaggttgttcagctcgcccaacagctcggtggaatactgcgagaagccgcgcagatcgacctggctggcaggctgtgccacctggtcgagcatggcccggtagcggccccagatctgcgccaccttctgccgctgggcggcgatctccggcgcgcccatccggctcacgttgcgctcggcattgcccgtatccaggtcggcggccgagcgttcgtactgggcgatggtcgcggccagggcctttgggtcgccggcgccgagtcgcaattgcagcgcctcgcgggccatcttctggctgagcatgcgctgcgcgccggccacgttgatggtttccggcgagatcgacatgctcaggtacaacgccaccgaggcgcaggcggccaggccgaacatcagtgcataggacagcaggaactgggcgttcagggtcttcaacccgagcccccgtag

SEQ ID NO: 4479 - DNA, 1137 bp, Pseudomonas aeruginosa
actctggcaggtacccggcacgccgcgccggagacgtcatggaacccaacccgcaaggacgcccgcgtgatccccgtcgcccctcttcccctgatcgtcccgctcatctacctgtcgtcgttcgtcgccggcatctggctgctgatctggctatcgctcctggccttcagcccgcgcgcgcgccagcgcttgcgccgccgctggccgagccgcggcctgctgatgctgatcccgttgggactgcgcgcctggctggagatcggtctctggcagtacgagcgcgaacgtgcacgcgaggaagccgcgcacagcgccgtgctcgagcgccctacccgcctcggaggcatcgagatgcctgccggcacccggctgaagctggaactcaagcaccagccggaaagcttccgagaagccgaattccccaccccggtgacgatccgcggcgtcgccacccgccacctgcaacgctggctgcagagcgagcaggacaacccgcaggacccatggaaaaccaccggcgtccatcccacttcgctgcgcctgcgtggcgagggagtcgccgagatcgaaggctggcgttgcgacgccagccaggaaatcgccttcgccagcgagcgcgacgggcgtcccgccgccttcgaaggctgtagcctggcgatcggcaaccgcgccgacgacatcgacttccccgccggtgcgcgattgttcgccagcgatggcatggtctacaccgacggctaccgcgacgccgagcgctggcgggtaatgccggaaaccgggcaacgggtgtcggtgcgcggcatcgcgctgagcggcggcgccctggccttcgaccgcgaccgccgcctgtacggcctcggcggtacggtcctcgccgaggccttgcaactgggcgcctggcactacccggcaggcaccgaggtcagcctttcaccccgcgccgcctggcgcgcgcaacatccgcacgcctggctgttcagtcctacccgcgaagccgcttcgcatgcctccggcgagcgcctggaacacggcgtctcgctgttgcagacgctggacggccaggaacttgagcgcctcgacaaccgcgcggcaggggtcatcgacttcatcgaactggagatcggcgacgaacgctga

SEQ ID NO: 4480 - DNA, 219 bp, Pseudomonas aeruginosa
atcatcagatacatagaccttcacctctcctgtttcataaaccgtcgaggccgcgacgatccttccgctaggcatcgtcccaccagctacatctcgaaaatcctgtcctcccgcctgggcaactatggtaggcgcactccaaataccaccctccagtttactgaaaacaacacgcccatcactaccacctacatgctctgttgcccgcctatatattag

SEQ ID NO: 4481 - DNA, 654 bp, Pseudomonas aeruginosa
ctgcgtgaaggcgatgctggatgcggtggagatagcggtgacggtgaagcaccgcatcggtatcaacgggcgcgacagctacgccgaactctgcgatttcgtcggccaggtacgcgaggccggctgccggagcttcaccgtgcatgcgcggatcgccatcctcgaagggctctcgcccaaggagaaccgcgaggtaccgccgctgcgctacgaggtcgcggcgcaattgaagaaggacttcccggacctggagatcgtcctcaacggcggcatcaagaccctcgaggcctgccgcgagcacctgcagaccttcgacggcgtgatgctcggtcgcaaggcctaccacaacccctacctgctggccgcggtggacagccagttgttcggcagcgaagcgccgccgctcagtcgcagcgaggccttgctccgtctgcgtccgtacatcgagcgacaccaggccgaaggcggcgcgatgcatcacgtgacccgccatatcctcggcctggcccagggcttccccggctcccggcgattccgccaactgctctcggtggacgtgcacaaggccgccgatccgctgcgggttttcgaccaggcgctggaacttctggcggggcgatagctcccattgagccgcgcctgcggctcgggtaa

SEQ ID NO: 4482 - DNA, 777 bp, Pseudomonas aeruginosa
gctggcctagaccatttgccagacgcctttcgcatgcccagctccgaccaactcccgcgcttcaccgccctgctcttcggactctccggcggcctggtggatttcggcgcccggaccctgtccctggcgctgctgcgcagccatccgcatagccctgccgaacacctccgcgacgccagtctgctgcccttcgccgaggcacaaagcttcctgttgcagcgcaagccgaacaagaacgagcgccagcgcctggagcaggccctcgacgaagccgccgaggaacaggccgaagccatcgccggtgccgtggccctgctggagagcctggacgaacaacggattccctacgcctggcaggacgagctaccggaatcggtctgccagcgccttgccgcgccgctcggccgagcggacgccctgatccccctcgccggcgcgcgcccctggccggcccccgatggctgctggcaggccctcgcccggctgggcatcgagcgcctcgacggctgcgtgctggtcagcgcccaaccgcgtcaactccaggccggactcaatgccgggctatggaccatcggcctggccgccagcgggccgtcgtgcggcctctcgccagccgactgggacgctctcggacataccgagcgcgaccgcttgcgcgccgacgccaccctggaactgtaccgcctgggcgtgcattccgtgatcgatcacctgggcgagctgcaaccctgcctgcacgacctcgccgtccgccgcctgaaaggagaaaaaccatga

SEQ ID NO: 4483 - DNA, 411 bp, Pseudomonas aeruginosa
cgcacttcttcccgctgctggaacgcctgctgcggattgatccggatcgcgcacatctgcgcccgacaggttaatctgttcggcatggacggacctttcggcgcccgccggaggtccaccgaagacttgtacgtcgagggaaataccatgccgaaagagagtctgctgcgcgaactatccgccctgcgcgagcaactggagcaacaaccgccgctgaacgaagagcagcgcgccgaactggaactcctgatcagggacatcgaactgaaactggccaacgaggacgccctcaacgaaggcagcctggtcgatggggtcaacctcgccgtcgagcgcttcgaggtcagccacccgaccctcgccggcacgctccgctccatcgtgcagagcctggccaacatgggtatctga

SEQ ID NO: 4484 - DNA, 813 bp, Pseudomonas aeruginosa
acgacttgccgaaatgaaaagccccggcatggccggggctttttcgtatccgcgtgttgcgaggcgttactggcgcaccaggcgtcggttgtccggtgcgacctccgccaggctgcggtagggattgatatccaggccgccacggcgtacgtagcgcgcgtagacgctgagcgcctgcggctgcaacaggcgctgcaggtcgaggaagatgcgttcgacgcactgttcgtggaagtcctggtgctggcggaaggaaaccaggtaggccagcaggctggccgggtccagcgccgggccccggtagtcgaccaccagggtgccccagtcgggctggccggtgaccgggcagttggacttgagcaggtggctgtagagctgctcctcgacgatccgcccggcgtcgcagcgcagcagttccgggcgcggctgctcgtagccgtcgacggcgatgtccagctcgtcgatgcagcgccccggcagacgcccgatgccctcctcggcaacctcgtcgaggctgcgcaggcgcacgcccacgggcgccccggcagcggccgagaggtctttctgcaataccgcgcgaagcgcctcgcgactatcgaaggcggactggttgagggaattgaggtaaagcttgaacgacttcgactcgatgatgttcggcgagtccgccgggatcgagaactcgccgatcgccaccaccggcttgccggccggggtcagccaggacagctcgtagcagttccagatatccacgccgcgataaggcagggtctcggcgctcaggccaagctcggcccatttcgccgtgcgtga

SEQ ID NO: 4485 - DNA, 963 bp, Pseudomonas aeruginosa
gctgcgcggcctcggctcggaacaacagatgcgccgccgcgaagcggaactgctgcgcgaactggcacgccatcccgacctcggcctgcgcctgaacggcccggatggcaacccctggttcgagcgcctgccgcagcctgcgcatcccggcctgcccgccaaccgcgaactcggcgccccgctggagcccggcaacgacgcttcgccgcgactcaccgtgatcctcgacatcagtcatcaccagcacttcctgcaacgcatgcgccagttgatctggctgaccatgagcctgtcggcgctggccacggcgctgctcggcgcctgggccaccggcgccagcctggcgccgctgcgacggatgcgcgaagtcgccgcgcgggtttccgccaactccctcaccacccgcctcgacgccagccggatgccagaggagctgcgcggactggccggcgagctgaacgccatgctggcgcgcctggaagaagccttccagcgcctctcggcgttctccgccgacatcgcccacgagttgcgcaccccgctcaccagcctgctgacccagacccaggtggtactgtcccgcccgcgctcgctggaggactatcgcgaggccctgcacggcaacctcgaggagctggaacggctcaccgcgatggtcaacgacatgctgttgctggccaaggccgaccacggcctgctggcgcccagccgccaggccctggacctgggcgcggaagtcgactcgctgctggagttctaccagccgctggcggaagaccacgatatccgcctgctgcgccaaggcagcctgagcctgccgggcgaccgcggcatgctgcggcgggtgctggccaacctgctggacaatgccctgcgcttcaccgccgatggcggcgagatccgcatccgtctcggcgaccggcgcctgagcgtggagaaccagggtccggcgattcctcctga

SEQ ID NO: 4486 - DNA, 795 bp, Pseudomonas aeruginosa
aacagcccaggggaatgtcacccatgccgaagcgttcgccggacagccagggttggccggccagggtctggtccggcacccgcagcaactcgccgcaggtctgcagcgcctttgcgatcagggcctcgtcgcgttgctccggcggcgtacgcagcgttccccagaacaggtcgcggaacggcccggcgagagtcgaggtggtccagtccatccacttgtcggcgtcggcgcggcgcaccgggtcctgcggatagaggtcgcccggcgcatagcgggcggccaggtagcggacgatggcgttggactcccagaggacgaagccgtcgtcctcgatcaccggcacccgaccgttcgggttcatcgcgcggaacgccggctcatccaccaggccgaacgccccgccggcatccaccgtccggtactccaggccagcctcctcggcgcaccacagcgccttgcgcacattgctcgagttcttccggccccagatggtcaacatactctgcgttccctcttcggttgatgcggcggatgggtcgccggagcgcccggacgacatgccgcaccctaccgaggatggaccgaagaaggaagacgcgccggctgatggtgactatcgacgcccttcatcttgtccggcctcagcctggaaatcgccgcccagggccagcgggcggccggagaacaggtgcggatagtgctgctgcaggtgagagaagaacagttcctccggcaggtcggcgaactggccgtgatcggccaggtattccatgtagcgctcgccctggcggttga

SEQ ID NO: 4487 - DNA, 2997 bp, Pseudomonas aeruginosa
gctcgagacgccgcctggcgtcttcatggaggattccgcatgttgttgctctggttagtcgtactggtactcggtgtcgcttacctcgcccatcggcgtaccccacccgctcccgcgctcggcatcagcgccgcctacctgatcctgatgggcgtgttcagccacgcgcccggctggctgctgctggtcttctggctgctctggctggcggtggcgcttcccctcgccctgcccgacctgcgccggcgcgtgctcagcggtccgctgttcgcctggttccagaaagtcctgccgccgatgtccgacaccgagcgcgaggccatcgaggcgggcaccgtgtggtgggatggcgaattgttcagcggccgcccggactggcagaaactgctcgactaccccaaggcgcaactcaccgaagaagagcaggccttcgtcgacggcccgaccgaagaactctgcgccatggtcagcgactgggacatcggccagcgcatggacctgccggaagaagcctgggccttcatcaagcagcacggcttcttcggcctgatcattcccaaggagtacggcggcaagggcttctccgccttcgcccactcgcaggtagtgatgaagctcgccacccgtagcggcgacctggcctcgacggtgatggtgccgaactccctcggcccggccgagctgctgctccactacggcaccgacgagcagcgccagcgctacctgccgagcctggccaagggcgacgacatcccctgcttcgccctcaccggcccctacgcgggctccgatgccggcggcatgaccgacgtcggcatcgtctgcaagggcgaatgggaaggtcgcgaggtgctcggcctgcgcctgacctgggaaaagcgctacatcaccctcggcccggtggccaccctcctcggcctggccttcaagtgccacgacccggaccatctgttgggcgacgaggaggacctgggcatcaccctggcgctgatccccaccgacacccccggggtcgagatcggccgccgccacgtgccgctgggcgccgccttcatgaacggtccgaactccggcaaggacgtgttcgtgccgctggagtacatcatcggcgggcaggaaatgatcggcaaaggctggatgatgctgatgaactgcctgtcggtcggacgctccatctcgctgccggcggtgggcaccagcgccggcaaggccagcagctacgtcagcggtcgctacgctcaggtccgcgagcagttcaacgtgccgatcgccgccttcgaaggcatccaggaggcgcttgcccgcatcggcggcaacgcctggctgatggacagcgcgcgaatcctcaccgccaacgcggtggacctcggcgagaagccctcggtgctttcggcgatcctcaagtaccacctcaccgagcgcggccgcgagtgcatcgcccatgccatggacatccatggcggcaagggcatcatcatgggcccgaacaactacctgggtcgttcctggcagggcgcgccgatcttcatcacggtggaaggcgcgaacatcctctcgcgcaacctgatgatcttcggccagggcgcgatccgttgccatccgtacgtactcaaggaaatggaactggcccagcgcgaggacaaggaccaggccgcccgcgagttcgacgcgctgctggtgaagcacatcggcttcgccgtcggcaacgccgccagcagcttcctcctcagtctcagctgcggccacctcggcaacgcgcccggcgaccgcatcagccgtccctacttccgcgcgctgaaccgcctggcggcgtccttcgccctgctcgccgacttcagcatgatgctgctgggcggcgaactgaagcgcaaggaacgcctctccgcgcgtctcggcgatgtcctcagctatctctacctgggctcggcggcgctcaagcgctaccacgacctgggcaacccggactacctgcatccgctgctgcgctgggccatggaggaaaacctcggcaagcccgaggcggcgctggaggacctgctgaacaacttccccagccgattcttcggctgcgcgctgaaggtcctggtactgcagttcggccgccggcacaaagggccgggcgacgaactggacgccgagatcgcggaaatcatcgaccgtccggacgacgacccggcgttgcagggcgatcatcgccggcgcgttcctgccgaaggacccgcaggacccggtcggtgccctcgcccacgccttcgacgcggtacgcgaaagcgccgcgctggagaaaaccctgcacaaggcgatcaaggaaggcagggtccagccgcaagcggggcagaacccgatcgatgccggcgccgccgccggcgtgctgagcgccgagcaggcgcaggccctgcaccaggccgaagcggcacggcgcaaggtgatcgacgtcgacgacttcgccaaggaggaactgcaactggccgacggcaggatccgctgacactccgcggcaaagcgacggtcgcaaccgacaaaggcgccttccggcgcctttgtcgtcttcacccacccaaacccgggcgattggctagaatcgacgggcacatccctgacgtacgggaggccatcatgctcaagctacttgccaccggcctggcagcctcgtttctcctcctgcccccggcgcaggccgcaccgcctgcgccctatggcgtgcagccgcaccagcaggcggtgcagcgcgctggcgaacagcgccaacgccagctccaggaacagcgccagcgcttcgacgaacaacgcctgcaattgcagcaggatcaactgcaacgccagcagcagaacctgcagcggcaacggcagcagcgacagatgcaggacaacctgatccgccagcagcaactggaccagcagcgctggcgcctggagcaggaccagcggcgcctcgacagcgaacgccggcaactggaaaaccgccggcgccagagccagtccccggcgatccgctga

SEQ ID NO: 4488 - DNA, 564 bp, Pseudomonas aeruginosa
aactggccggcgccgcgaaaccctttatactgcccagcttttttccagaggacccgtcatggccaactcctacctcgagcaccacctcgccctgctccagcacctgcgcaacatcctcggcgccctgggcgaggccgagcaggtgccggaagaaaaccacgggttgttcctcgagcgtttcgacgagctgatggacgaactgccgcgcgacccggaaggcgcccaatacctcggccaggacctgatttcccaggtcttccaccgctatccgcagatcgcccacctggtacctcgcgacctgctgtggttcttcggcggcgattgcctgcacttcatgccggacgaagagatcgacctgttccagcgcctcgacgagcgccgctacgaagccgaagagcgcggcgaaacgttcgactggaaccgcgaaaagcagttgctcgcgctgcccgaggacagcccgcggcactgagcccgccacggccaccggccgtcccgccccgaccgccatccgtgcgctcggggccgcctcccgccagcccaaacctcgctaccctttccgaataa

SEQ ID NO: 4489 - DNA, 1137 bp, Pseudomonas aeruginosa
catccgtcctggcgaagtgatcggggaaaccgcgctgatccagccgaaccgccgcgagacctccgcctacgcctccggcgcggcgtcggtgctgatcctccaccgacgtcacttcgccccgttgatcgccgacacggaattcctcaaccgcgcgctggccctcctctgttcgcgcctgcgcgaagcctccggtttcgtcgagagggtctgcctgcatcgcctggagtcgcgcctggcgcgccatctcctggccagcctggcgagcgaacagcccgagggagcctgcgcgacactaccgaccaaccagagcatcctagcagcgatgctcaacgccagccgcccgaagctcaacgcgcaactgcaaatatggaaacgcgaagggctgatcagctgccacaacgaccggatcctgatcaacgacctcggtcgcctacgacgcaaggccgaactgccggccgcgcccctgtcacccaggtaacagcctcgcccaccgcccgcctcacagactgctcgccgacacgagcaaccagggaggtagcggttatggatcgtccgaatcagccaggcggcaacgaaaccggttccgatcgcctgttcgaggaaagctggcgtgccgcgcaggctggcctgcgcaaacgcgcgcaacgccttgcgcgcggcaacagccatcgggccgaagaatggctgtcgagcaccgcggtcaaggcgatgctgttcctgcgccagtcaccggagcgggtacgcgacccccagggcttcctgttcctggtcctggaacacgtctacctggacagcgcgcgccaccagatccgcgaggaccgcctcatcgaccgcggcatcgacctgcacgatggccagttggagcgcttcgccgccgtcggctcgccgctggaacgcctggagcagctggaacgtctcgaccaggtggacaaggccctggcctcgctgtcgcgccaacagcagcagctcttcgagctgcgcttcatcgaagaactgccctatgccgacatcgccagccaactcggcatcgccccgccgctggtgcgcaagcgcgtgcagttgctgcgctcgcggctgagcgccgactttttcgccggcgacgtttcacaagacagacgcagccgcgttcattcctga

SEQ ID NO: 4490 - DNA, 312 bp, Pseudomonas aeruginosa
caagcgagtcgaggcccgtgcgaccggcccccctgcccgacgagcacctgcccattcaaggagagtcccatggctgaccccacggctgtgaatgcccagatcaccgatgccgtcacccagaccaacgtcaaggtggtcgccgaagccccggcccaggccatcgccgcgctctaccagatcgccagccattccgccggcctgtccctgcagaacgcagtctacagccagcaggccctgaaccagatctccaccgcggtggtttccaaggcggtgtcgatgatcatggcgatagaagacaagaaaggtatctga

SEQ ID NO: 4491 - DNA, 651 bp, Pseudomonas aeruginosa
tcccaggagtgcccagacatgttcggcttcggcaagaaatccgcgcccgcgcccgcgccatccggcgacagcgagcaagccgccgcccctggcgaggccggccggcagacgccagccagcggcggcagggcgtccgccaacggcgacgtgaagctgccgtcgcgcccttcgccgctggccggcatgagcgagcgcctgctcaagcagaccgaggcgccgccaccggacaccagcgccctgaacagtcaagtcgtgcaggcggtgcagatgagcaacagcgaaaccgccggctatgcgccgtcgcagatcgccatcgcgccgaacatgatgatcagccaggcctccgggctggtggcgcaatccgccgccagctacttcgacggagtcagcaagatcgccctggccagccaggcgatcctgctccggcagatgacccagaacatcgccgaaaacaagctggcccaggctgccgaggacgcgctcggcgcccttgccaccgacctgctgatgggcgctgccgccgcggtagccgcggcggccggggcgatcgaggcggaatcggccagcttcgccatcgacaagatcgaccagagcattgccaagtacagcgagaccctcgccagtcgcggcggcaaggacacccaatcgtag

SEQ ID NO: 4492 - DNA, 384 bp, Pseudomonas aeruginosa
gtcagtgcgcgctctaccgctccgaggaggatcgctactttccagttcgaagcctaccggcgcctcttcgcccaggtcctcaactggcgctcctatctgctgggcgccgacggccagggtgtcgagcactccaacgtacaggacgaagcgatccgcatggcgctcctgctcaactatgccgccgcggaccgccacggccgggtaccggtcgcttcgctggagaatgcccaacgcctgctggtgcaactgggcagcgcctactgggaggaaaccatcggcgccgtcgacctggccggcgcgccccatcgggaccgagagctgcagcgcttcgaagggttcgccgcccccgcctcggtcgtgcgcatctccacccgcagcagttga

SEQ ID NO: 4493 - DNA, 468 bp, Pseudomonas aeruginosa
ggagcgaccgatgagcgcctacgcacgctacatcagacgccgcgcgctcgccgccgcggaccgcccggcgcagcgttcgccggacgccagcgaggagacacgggaccaaccgccccccagcaggccggcgagcggaaagcgcctgctggaaatatcggacagcgatgcggccaagctcttggccgtgctgaaactgctcggatgagcacccaccccaggagaagcgtcatgaaggaagaactcgaaaccctcgtcacccaggtcaaggcactcctcaccgaatgcctgcaaggctggctccaggccctgtcccagggagacagcgtggacgacccggccagccttggacagttggcggtgcagttgagcaccgcctacagcaccctgcaggccgctgccgccgcctaccccggcgataccggcggcagcgcgcaggccccctcggcggacggcacgcagcagtactga

SEQ ID NO: 4494 - DNA, 966 bp, Pseudomonas aeruginosa
gcgccaatatcgagcttgcgtcctcatcgctcgatgggccggcaactgatcgattcttgcatatcaagcaagacaaggccacctgcggcggacgccaatggcctcctccgccttcgcttagggcatcgcctcaagcgtccgtcgcaggccataacgacacaacagcccttgggcaagaaaggagccggtgatgtagcgcacccgaaaggagacgaagacatgcacaaggacatttcaacatcaaaggtgttctatcgtcccatcgaggcggccatccgatgggctgggttgctgcggtatctcccgatgatcctggccacgatcgcgtcaccgcgtgtcctgcctcggtcgctgaactgccctcgatggaatgagtgccggctgcactcggaacgtatctatgacggcatcctcaacggagagctgccctacggcaagaacgggatcacgctcaatgatccgaagctgctcaattctctggatctgactgttcgccatgtcgatctaaaacgctggatgcgcacccactatcccgagcaccggccaggatttctgttcagccgtggcgaacgcatggcgcatcctttcatcaccatggaaacaggacaggcgatcctcgtggagcggctggcccttcaggccgcgcttgaacaagcccgacgtgagatgcgagaactgcaggagcagcacgacacgctactcaagcaatcctcggtgctgttggcatccaagcaatgcgagatcagcgaacgggcggaaacgacctatctcaacatcattggagggatgttgacgctgatgctgagccagtcgccttcaggcgtgccctattccagcttcaaaacgcaggaggcccttgtctctgcattggtcgcccactacggcggcaccatgggcatcactgagcgcaccttaaacggaaagttcgccaacgctaagaggtacgttcgtagcgcaagcgcatga

SEQ ID NO: 4495 - DNA, 462 bp, Pseudomonas aeruginosa
aagcgtatccacgcgccgcaacgcgcggcctgccagtgcatcgggtcgagcaccgccagccgcccggcagagtcgcccctgccgcgctcgacacgatgcgcgcgctcgccagcgagttgttcccgcaatggcaggaccgactggctcaagtatccggccgcccgcagcgacctcttgatcctgggaggccccatggcgaacgcacatgagctggcccgcggccacaagcggctgcgcgccctgatcgagttcgcggtcggcgagggctggcacgtcaagcgcacgccgggcgggcacctcaagttcaccaaggccggctgcgcggcgatctacacgagttggacagcgagtgaccaccgggccgaattgaacgcccgtgcgcagatccgccgcgccgagcgagaggcccgcatggcgccggccggcggtcgtggggactgcgaggggtgcggccatggctga

SEQ ID NO: 4496 - DNA, 1134 bp, Pseudomonas aeruginosa
gcacatcgtctcgccggcaccgacgaccgaacggctgcagtcgatccagcgcatggtcgccgaccagttgggcgatgcgctgccgcccgacttctcggcgagcgtgttgcagtccatcccggtgcaagccggcggactctatccgatctccgatgtctggtacatcgacgcgggcctggacacgcccgatcggctgcgcatccacatcgcgcagttcgcgcgcgagatcgccggggaggcaggcctggacgagtacatcgaggatcgcgccgatggcatcgggtttgcgtgccgcgcccgcggccaagccccgtcgccgctcggccgcgcggtgctgacgctcctcacttccctgacgggtcagcccgtcgccgaagcgggcctggacggcgcgcagctcgccaccgacctgccgaccctgttgcacggccagagccaaggccatggcagcggcgcaaggcgcttgagcgacacggcgttggtcaagctctttcggctgctccgcttggcccggcgtctgctggacctggaagccggcaccacggcgcccgggacgtgagcgagggaggtcgcatgtccacatcgcatccgctcaaccaggccgtgatcgcccaggcgctgtatgaccttcgcaacggccaactgcgccgctgcaaggccatgggcttcggcgaggccgagctggatgcgctcaagcaccccgcgctcatcagcgtgctggccaacgccagcgtctcgtggtgctcggtcacggtcaaccgcgaagtgctgcagcgcctgctcaaccaggcacaggacgtggagaaggaaatcgccacggtcgatcgcatgctgcggctgggggccagcacggagatggtcagccgcttctatggcctgacccatcaggaagtcgccctgcggcgggagatcctcggcctgcccaagcgcaaggggcgccaccccgtcctggacgagacccaggacaccgaactgtggcggcaatggaaagccgtgaccagcagcaggaacgtcgatctggaggacgagacctcgattctcgatgcggccatggacctggccgagggcatgtcactgccgctctcggtggtctgggccgcgatcaggaactgggtcgatcagggattgggctag

SEQ ID NO: 4497 - DNA, 1236 bp, Pseudomonas aeruginosa
gccatggccgtggacgacaccgccccacgagccccgcgtcaaggccccatcgcactcgccgacctgttcgacgctgcgctgaaggacctcacgcccaagccacatcccagcgcgccagcgcccatggcagtgcccacgcctgccgcgtccggcgacgccttcctgttcagtggcaatcggcacgagagcgtgccgcggcggctgttcctcgaccgccgcctgacaccgctggagcgcaacgcctggcaggtgttccggctgatgctcaacgacgacggcgtcacggcgttctcgacctatgagcagttgcgcccctggctggcgtccatgccctgcgcgggacaagcctcccacgagaccgtcgcgcgggcgctgacgctgctgcgcctgacgcgctggctgagcctcgtgcgacgacggcgcgaccccaagaccggccgcatcctcggaaacctctacgtcctgcatgacgaacccctgacaccgttcgaggccatgcagctcgacgccgactacctggccctggtcagccagtcgctggggcattcggccaaggccgttcaggtggtgggactcaacaccctccaggagatcgcggacgacccgatgttgtccggacgcaccttgccgtcgcggctgcaagtgctcgccgagcgcctggccgaccagggcatcaccgccaccgaaagttatccacaggaggatgcgatccacgattccgaagaagggcccgcgagccttcttcggaatggcgaacgcccctcttcggaatccgaagcagggccgaaacccgcgccagacggcgctcttcggaatccgaagcaggaccgtacagtacgtagtagtagtattaatgaagtacgtactaccgcgcaggcgcgtgcgctgggcgacctgcaatggcccaagcgcttcgcggaactgaaggcggaacagcaggccggagccaggatggcgttgcagcaggtggacgctgccctggggcaggccgtgctggacgaatgggccgcacggtgcggcaagcatggcatccgcaaccccgccggatatctgttcggcatcatccagcgcgccatgcgcggcgagttcaatgcgtgggccaagcagaccggcccagcaccgccaacaccatcggcggcgcgagcgccaccatccgagccgccgcgcaacgtcgtgccgcccgaggtggcccggcagcacatcgagcgcctgcgcgacctgctgcgcaagacctga

SEQ ID NO: 4498 - DNA, 588 bp, Pseudomonas aeruginosa
tgcggccgctgctgccgacccatccgaaaacgcagccactgccggcgaggacgaatccgcatgagcgatctgaaccagccgacccgctacttccggggcctgcaacagggagccttcatgcgcctggaacacgcggcctctctaaaaggccttttaaagccttttaaaggtaaaggggacttggaggcctgggccagccagtgcttcgccatgcgcgacgagttgatcggcttggcgcagcgacaagtgctgcaacaggccagtgggcatcccttccacctgctgcccgtggaactggcccagcagaccactggctcgggaacgacgttcctgcgctggcgcaggcacgaccgctcggccatgggcgtggccctgtggcaggagctgatggcgagcaccagcacgccggtcaacctgctggccgacctgcacgcgatcgagctgcagcgcatcacgctgaacatgcagatcagcctgttgcacaccctgggcaggcaggcacaggattgcgccagcaaggccgccgaggcggaagacgcctacctgcgccggctcacgtcctttcccgccgcaatgcgcgatcggtga

SEQ ID NO: 4499 - DNA, 2037 bp, Pseudomonas aeruginosa
acaacgggaagcggatggacggacatgcggctgtttctgtgcgagaagccctcccagggcaaagacatcggccggattctcggcgccacgcagcgcggtgaaggctgcctcaacggctccggcgtcacggtcacctggtgcatcggccatctcgtcgaagcggcagcacccgaggtctatgacgcggcgctcaagcgctggtcgttggagcagttgcccatcatccctcagcagtggcgggtcgaggtcaaaccgcagaccgccacgcaattcaaggtcgtcaaaacgcttctggcgaaggcgacccatctcgtcattgccaccgatgccgaccgcgagggtgaactgatcgcccgcgagatcatcgacctgtgcggataccgcggccccatagcacgcctgtggctgtcggcgctcaacgatgcgtccatccgcaccgcgctcgccaagctgcggccctcggccgagacgctgccgatgtattactcggcgctggcgcgctcgcgcgccgactggcttgtgggcatgaacctcagccggctgttcaccgtgctcgggcggcaggccggctacgacggcgtgctgtcggtcgggcgtgtacagaccccgacgctcaaactcgtggtagaccgcgaccgagagatcgcggccttcgagtccgtgccctactgggccatcgacgtgtccctgtccgcaggcggtcagacgttcaccgcgcagtgggtggcacccgatgccagcaccgacgacgccggccgctgcctgcagcagcccgtcgcacagcaagccgcgcagcagatccgcgccgcgggcagtgcccaggtggtgtcggtcgagaccgagcgcgtgcgcgaaggcccgccgctgctgttcgacctgggcaccctgcaggaggtgtgctccaagcagcttgggctggacgtgcaggagacgctggagatcgctcaggccctgtacgagacgcataaggccacgacgtacccgcgctcggattccggctacctgcccgaaagcatgttcgccgaggtgcctacggtcctcgacagcctgctcaagaccgatccctcgctgcgcccgatcacggagcagctcgaccgctccgtgcgttcgcgcgcctggaacgacggcaaggtgacggcgcaccacggcatcatcccgacgctcgaacccgcgaatctctccgccatgagcgagaaggaacgggcggtgtaccggctgatccgggcacattacctggcccagttcctcccgcaccacgagttcgaccgcaccgtggccgatctctcctgcggccagcagaagctggtggccacgggcaagcaggtcgtcgccaagggatggcgcctggtgccggccgaaccgcaagcggacgaggacggcgatggtgccgcgcgcagccaagtgctgcctgcgctgcgtgacgggatggcatgccagatcgccggggccgacatcaaggccctcaagacgatgccgcctaagccctatacccagggcgaactgatcaaggcgatgaagggcgttgcgcgtttcgtgaccgacccgcgcctgaagcagaagctcaaggacacgacgggcatcggcaccgaggcgacgcgggccaacatcatcagcgggctgatcgcccgcggctatatcgtgaagaagggtcgctccatccgcgcatcggatgcagcgttcacgctgatcgacgccgtgcccgcggcgattgccgaccccggcaccaccgccgtctgggaacaggcgctggacatgatcgagggcggacaactcaccctggatgtgttcatcggcaagcaggccgcctggatttcgcagttgatcgcgcagcacagcagcacctcgctgtccatcaaggttcctcaaggaccggcttgtccgcagtgtggcgcgcccacgcgccaacgcaccggcaagagcgggccgttctggtcgtgcagtcgctatcccgactgcaaaggcacgctgccggtcgaaaccggcacgtccaagcgtggtgcctcgcgcccacgcaagagcggccgcaaaggctcctga

SEQ ID NO: 4500 - DNA, 1755 bp, Pseudomonas aeruginosa
cgacgaccgggcctgccaatcagcccacgggtggttcttctttcctcccgagccgaaggcccctggggccttcggcgcctttctcctgcctttcaacgccccggccagggcgatggccctgcgccatacgaacaggagaccgacatgcacccgaaactttgcgcaccgccgcgcaacacgccgctgctctacggcagcgtctgcagcggcatcgaggccgtgagcctcgcttggcaaccgctcggcctcgaagccgcgtggttcgccgagatcgagccgttcccgagcgccgtgctcgcccaccgttacccccgcgtgcccaacctgggcgacatgaccacgatcgcccgccaggtccgcgccggcaccgtgcccgcgccagacctcctggtcggcggcacgccgtgccagtcgttcagcgtggccggcgcccgccgtggcctggctgacccgcgcggcgccctgacccttgcctatgtggagcttgcaaatgccatcgaccaaacccgccgccaagaccgccgcccgccggcaacgctcgtctgggaaaacgtccccggcgtcctcagcgaccgcagcaacgccttcggacacttcctgggcgcactggccggcgaaagccgtgcgctcgaaccgccagggcaaaaatgggcgcacgcaggttgtgtgtctggaccccggcgccgcatcgcctggcgcttgctcgatgctcaatatttcggcgtcgcccaacggcgccgtcgcgtgtttcttgtggcaagtggtggaggtggcgtcgatcccgccgaggtactttttgagcgcccaggcctgcgcggggattcttcgccgggcttcgcgccgtggcaagacgctgccggcgctgctggatcgggcgctgcggcagcaggctggtactcgggatatccaggactgaagcagccctacggcaaggccacggtgacgttcggattcggcgggggcaacaccgcaggacccatcgacgtcgcggcctgcctgaccgcggcgcccggccctaagaacgacttcgaggtcgagaccttcgtggcgcagtccgtcgcgggcagcatcagccacacgctcagcaccgccaacggcggcaagggctgcagcgaggacggcaccggcaagggcgtgccgatcattgccttcaccgcacagggctgcggggcggatgcgacgacgaaccatgcgccgacgctgcgtgccggcgggcatcgcctcagccacgcgaatgccggcgtcgtgccggcaatcgcgttcgcgcagaactcgcgcggcgagctgcggctggaatccggccacggccagcttgccgggacgctctccacgggtggcgccaagccaggccagggccggccgatggtgatcggcgtggcgctgcgcggtcgcaccgaaggcctggccgctgaactgggcgatggcgtctcgaccgcgctgcgcaccagcagcggcggtgccgacaagccccatgtgctggcaccggacttcgaggcacatttccgctacgactggaacgaccccggcccgggcgactggtcgcagtggcgggtacgtcggctgatgcctgtggagtgcgagcggctgcaaggcatgcccgacgactacacgctggtcccgtaccgcggtaagcccgccgccgacgcgccgcgctacaaggcgatcggcaactccatggccgtgccgtgcgtcgcgtggctgggccagcggctggtgcaatgcctgcacaagacgggatcgagcgctacggattga

SEQ ID NO: 4501 - DNA, 801 bp, Pseudomonas aeruginosa
tgtacgacgcggccggcaggtcgcgcgatccttcctcctgcattgccgacgcatcggcaacagccagcagccagggtgtcaaggctgccgtgggttcctcccacgccacccgccagttcgccccggcatctcaccggcgaacgctgcccaccgggcatcgatgccaccttcctccaacccacgggatgtatgccgcgtcccgtcaggggcgtgtcgtcaacccggtcgatatcaggactttccatggacaccatcacccgacaagaccgcatcacgctcaagaacctcaaggtcgcggatttcgcgagcgaggaaacgctgtgcttcaccgccaccgtcatgttcgacggcaggcccatggccgaagcccgcaatgacggacacggcggctcgacgttcgtgcgcgcgttgcaaggccaggccgcgctgctggcccaagccgaggaattcgccaagagcctgccgccggcatcgctcgacgtcgaacgcgaggacgacgagccacttctcatcgacatgacgctcgacttcctcgtggaccagttggccgatgccatgcacgcagagcgcaagctgcgcaccgcgttcaaccgcgacatcggcaacaaggtgctgttcatcaaggacggccggctgctgttcctcaagggcatcaagctcaaggccattgccgaccgcgcggcatatttcgcaaagctgcgcagccgacaggaccagcccatcgtcatcctggccgagctgccagcggacgaggcattcgccatctggaagcagcatgtcctgggcgacaagccccgctga

SEQ ID NO: 4502 - DNA, 408 bp, Pseudomonas aeruginosa
ttcgtcagcacatgccagcagccagggtttcaggctgccgcggggttctctccgcgcaacccaccagtccgcatcgcatccattgcgcggacgcgcgttcccaagacgctgatgctttttttcaaccgcgtgcgggagctgccatcccgtgagggacagggccccgcttttccaaggagcccatccatgtcccagcaagcctctttcggccgattcggtcaattggccttgacctactgcggcaagttcctgccgctcgaagtcctgcacagcgccgccggccactacatcggcacgcgcgataccgaaggtcccgtctcgcgggaatctcgtgagtacttccgcagccatgccgcggctcaacgtgccctcgaaagaggcggctggtcccagctcgccattccctga

SEQ ID NO: 4503 - DNA, 414 bp, Pseudomonas aeruginosa
tccaaatggaggaatcacgtcatgaaccagctactgccgcaggaagtcgtcgatcagatcgttcgggaagaacggcatttcagcgccgcgccccaagcctttttcgaggcatggaagcgtggtgtcgagatcgccggcccgcaatggtttggcgatggcacccgtgaaggtctgaaccaggccaagagcaagtgggatctgcgtcccgacatgctgcgcctcaacgacgccctcggcgtcctgagcagcggggaacgcatgtttctgtccgcgatggtcagcttctacaacgcgcgcgagggcggtgccatgctcaagcgctgccacttcaacgggttgtcggacttcgacggcctcgatctgcctcgtcgccaggtgatcgccgacctgctgctgaactacagcggttggtga

SEQ ID NO: 4504 - DNA, 1221 bp, Pseudomonas aeruginosa
cgactacgacatggtcgtcttcgacggtggcaataccagcggcgatgcatggaaacatgtcttcttcccgcgtcagcgcgagcactacttcgtttacgaagcctgacccaaccagccccttccgaggggctttttcttgcccgcggcgccggaaagcgggcgcggctcggtgcgctttcctgcgggccggtcgcccattccggacggcatccttgcttccatgttcgtcggcgttgccggcacatgcccaggcagtcgagaccttcgaggctgcaagcgcgggaaaccgtgctggtcgattcttcctacggacctaccgcgtccatccacgccacccacaagggacctctcccttgcgggcggggaatcccttgtttttcctcaaggagtttccccatggaccgttccctcatcaaatccatgatgccttcgctggtcgcaggccatgtgccccgcaacgtgcgatcgttcaagtaccgcgtgttcgatgatcagccgctgtcctcaacgctgggctttgccatcgacccccaacccttcgacggcaaggtggtcgccgcgaccgacgatgccatcgtcgtcaagctcaagccttccgagttcgcggtgctcgatcccagcctggtgaccacggttcctgccgaaggcgccaaggtgcatgtccaaccctatgcccgtcgtcgcttcgacggactgcgcgcggacacgccggaggtcatcaccgagaagacttcggatggcacgccgtacaccatcacgaggcacatcctcggctcggcgccggccaagctgcccattcccacgccgcagtgcatggagttgggccagctcatcgagcagttggaagagatgccggcccccgatcgcttccggcgcatcacccacatgctggtggatgccggtgcccgcgacttcacctgggtcgatcccacgccctccaagatcatcgagaccccgccggcgatcagcttcacggtctcgaccgcgaagttcgagggccgggtgacgatcctctacgaccgcggcggagacacctacgtggtggaactgcaccgtcagaacggtgaatcggtcgaactggtcgatcggcacgacgaggtgtatttcgacatgctcggcgaagtgctggagcggctcatcgacgacgggcgctggcgccagatcgacgtgagcatcctcgacgcgaaggcggcccgtaagcgccaagccgtcccggcatga

SEQ ID NO: 4505 - DNA, 477 bp, Pseudomonas aeruginosa
cgcccctcggctgacccgaggcacccgccacggcgttccagccattcctgccgcgtgccctacaggcccttcatcccatcgggtggagggcctttctctttttttacacaggagatttcatccatgtcactgcgattcaaaggcgcagacctgcgccccgtgctgaccgaagccatcgccaatcagtgccgcatcgtcctggtcaaggaccagggcgtgtacttcctcgccgagcgtggggagcgtcgcccggatggacgccagcaactgctcgcctacgccgtcggctgcaacccggacaccgacccgttcgatgactggtggcacctcgccggccgcgagctgggcggcgacgattttgcggagtatttcgacccgaaggacggcctgttcacgcgcctcctgcactcggcggacgatctcgtgctgtccgccaccgccacgcacctgtccttggccgtggtgcctcccgcctga

SEQ ID NO: 4506 - DNA, 654 bp, Pseudomonas aeruginosa
agcggcaacggccgcgcagccatcgcagcccccgcaccgggggcgttcttttgttcgcaccacggccatcgccgcgcatgcgcgttcgtctccagccgccaaggcacgccccgcgggccacagcgccggcatgccaccggagacgaccgcatgaacacatcatcgacctcgccgaggctgcacctgctgccggtgtcgctgcgcacggccaacgtcttcgtgctggcacaccatcaccgtccggtccaggctgcgaagttcgccctggccgtcacgctggtcgacagcgacctgatccgcggcgtggccatcgtcggccggccggtcgcgcgtcacctggacgatggctggacgctggaagtcacacggctgtgcaccgacggcacacccaacgcctgcagcaagctatacggcgcggcctggcaggcggcaaagtcgctgggctacatccgcctgatcacctacaccttacccgacgaaggcggcgccagcctgcgcgccgccggctggcggctgattggcgcgcgcggcggcggcgcctggagccgtcccagccgccccctcgccgatacccccgagcacctgcgccgccccaaatgcctgtggcaggcgccgggcggcgcggacaaagggaagcacccggatgccgattga

SEQ ID NO: 4507 - DNA, 738 bp, Pseudomonas aeruginosa
gggcgaagcggaggtctttgcaaactccgcgctcgcactcaagtacgacgatccagccaagtccacgcctgtcacggagagccaactgctggcaccccggcgatgggacgaccgcaagaacgacctgtgggccgtcttcaaccgcgtccaggagaacctcgtcaaaggaggcctgaacggacgcaaggccaacggccgcaatcagcgcacccgtccggtgcaaggcatcgaccagaacctgcgcctgaaccgggcgttgtggctgctggccgaaggcatgcgccagctcaaggcgtgatgccacgcggacctcgcccacctcgggcgaggccattcctctcatccaccgggtgccgtcggcggcccgtcattcatcatcaggagaaccatcatggcaaccccatcggcttccgagaaatcggttgcgcccatcgtcgtccccggccagctcacgctgcgtaccatccgcggcaagaacggcccgttcacggttggccgcctcgccacgcacctcggtacgttcgaggtcaaagacccggagctggagcagtaccccgaatgcaagtacgacggggaattcataatcaggtacatcttcccgaagtcctatccggtcggcggcggcatgcggttcgagatccgtgccagcctcgacggcatgacgctcaacggcatcgacaaactcagccgcgacgaagcccgcagcttcgccacccaggacgtcgatccgctcgatga

SEQ ID NO: 4508 - DNA, 501 bp, Pseudomonas aeruginosa
gttttccttcgctgcacctgcggcattccatcacccactgggggttcttccccacggggaggcctccagctcaacttttccaggaggcctctcatgggctggtatttctctccccaatcgcggtctgaactgatcacggaactgatcgcaccacagcagaccgagcgcgtcagcgcgaaggttatcgctcacgcattgcgcggcaacgtgctgtggtccgtggtcgaactgaccgccaaggtcgaaggtgtgcatcgtgatctcgcgccgggccagtccctgcgctacatccgctgcgatctgcttgagcgcagcggcaaccagtggggctataaaccgctggaagagtccatgcatccgtactattactcgtgcccgctgtcctatctggacctcgcaccggagcagtccgccgactggcgtgcaggcgttcgcgcctaccacgcacggcggcgcacacccacggctgtcacggcacccgccgcggcgctgttggcctga

SEQ ID NO: 4509 - DNA, 837 bp, Pseudomonas aeruginosa
cctaccgcgaccagtacctcaacaacatctacctggacggcttcacgccgatcaccgcggtggacgaggcgcttcacttcaatccgcacacccgacagttcgagccggactgagcggttttcttccaccccctggggcagtacttgccccagcgggcggtgctgttcccgttcatccgaggacaccaccatgcccgcaaacacttcttccacgctgtaccgcatcgacgaatgcccggacgtgatggccgacgcctgcgtcggcgatgaccagggcaacctgatcttcctgtccatctgggcgcgggacaccgccgtccagcagttccttgcacgcctgaccctcgggcgcgacgagcagggactggaccagttccacgtcatcaccgaccagggcggcagcgtcccggtattcatcggcaacgtcgatcgcctggaaaagcgcatcacgcgcgcctaccggcgaacgctgttcggttcgctgtccaacgtgtggctgttcgaccggcgctgcgtcaagcccgacaaggccaacgccagcgcattggcactgctgccacgtgacagcgcccaccggcttgaccgcctgtggatgctggtgcgggacacctgcccgttgccgctgctcgaccactggcgcgagaccgtgctggaactgctgcaaagccgcgagatgctggcccgccttccgtccgccctcgggccgctggaaggccatcggctcgccatcgacgtgccggcgctgagcttggcgctgggctccctgatccgcagtgacgcgctcaccgcctatccctatccggccaagatttggacgccggaagcggtggcggcttga

SEQ ID NO: 4510 - DNA, 531 bp, Pseudomonas aeruginosa
cacccacaaggacaagacgctccagcgggaattcaccgaacgcgaagacggctccatcgccgagacacgcatcctcaccgacaagttcgtgcctgtcatccgcgcgtgggacatgacgcctggctccccgacacggggcgaggtgttgaccattcgctgatccaccggacgcgctgccgtcctgctgtaccaactcgaaggagaaacaccatgatccccaatccgttcaagcggcctgcgccgcacaagcaaccgttgttcacaccgagtacgttgaagttgagcgagaaggtgcattggctggcccggcgaggcctgattgaccccttggcctatgtccagcgccatgtgcgcggggactggggcgagatcgatgaggccacccgccaagcgaacgacgtggcgatccaacaggacaacctgatgatttcgcagttcaggatcacgccggacctggcgctgatcgtcaagaccagcgaagaccaccagaccacggtggtccagcttcccgaagagcgggacctgatctga

SEQ ID NO: 4511 - DNA, 1272 bp, Pseudomonas aeruginosa
tccacccgggactcgccattcgcatcatcaccgatgcggggcgcagcgtcactgccatcgtgctgccgtccgaagactgagcacggttcacccgcaggccactcaggccagcatcttcaaccaccttcggccgcgcgccgatttccttcccaccacggggcatgccattgccccgctgggggtggtgcatgccccatttttcattggagcatcacaatgtccttcgatctcgaaaccactgccgctgacgccgcgcccgtacagggcgaactgctcgacgcggaatcatcccctctgaccctgagccttcaggatttcgtcggcgagttcggcgacgaactgctcgacgccctcaacagcgccaacccgcctgtctataccggccaaccgcaggcgcaccggcagctcatcgtcgccagcctcaaacgcaagctgttcccggcccaggccgaagtcgtccacgccgccgccgagctgctgatcgaccgtggcgaacgcgccgcgatcgtcaatggcgagatgggctgtggtaagacgaccgttggcatcgccgcggccgccgtgctcaacgccgaaggctaccgccgcactctggtcctgtcgccaccgcacttggtttacaagtggcggcgggagatccaggagacggtggccggcgccaaggtatgggtgctcaatgggccggatacgctcgtcaagctcctcaagctgcgtgagcagttgggcgtgcagcccacgggccaggagttcttcgtcctggggcgcgtcaggatgcggatgggtttccactggaagcccgtcttcacccagcggcgcacccgccacggcgacgtggcggcctgcccggactgcggcacggtcatcaccgacctcgacggcgagccggtcaacccggtcgcgctcgaagccgaggagtaccgcaggaagtgcagccattgcgctgcgcccctgtggacgctgatccgcccgcgcagcctgtccggcagcgaccagtcctcggccgtcctcaaagccctgaagcgcatcccgaccatcggggaagtcactgcgcagaagctgatgcagaagttcggtgacggcttcctggcctcgatgctgggcgacaacatccacgagttcatcaacctcatggatggcaacggcgagctggtgttttccgaccgtcaagccacgcgcatggaacgtgcgatggccaacatggagttcggctttggcgagggcggttatcaaccctcggagttcatcaagagggtgcgacgtgaagtcgtctga

SEQ ID NO: 4512 - DNA, 231 bp, Pseudomonas aeruginosa
agctgccgggacaatgtagctgggccttcgggccgcgccaacgccgtgaggcaaggcgttatctgcgagcatcaatgcgggtacggcgctaggctgggtggtatgaccaacgaaagtgaactgctgttaaacaccgttatgaatgacaagccaaagatgctgacaggcttgaaccaaaaggtatgcggtcggttgccctttatccgttttgggggcacacggacatcatga

SEQ ID NO: 4513 - DNA, 1353 bp, Pseudomonas aeruginosa
agccggctcgcgaaagcgggctttgaaaggcttgagccgtatgaggggaaactctcacgtacggttcttagggggggatgggccagcaatggcttgtccctacccgactacttgccgcaaggtacgttcgacctgctcatcgctgatgaagcgcatgagtacaagaacgggggcagtgcccagggccaggccatgggcgtgctggcggcgaaggctcgcaagaccttgctgctgactggcacgctgatgggcggctacggtgatgatctttttcacctgctgttccgagcccttccggggcggatgatcgaagacggctaccgcccgaccacgagcggcagcatgacctcggctgcgatggcgttcatgcgcgatcacggggtgttgaaggacatctactccgagagcaccggcacggcgcacaagacggccaagggcaccaaggtatcggtgcgcacggtcaaggccccgggcttcggccccaagggcgtcttgcgctgcatcctgccattcacgatcttcctcaagctcaaggacatcggcggcaacgtcctgccgccgtatgacgaggagttccgtgaagtcgcgatggacacggcgcaagccgcggcctaccgcgatctggcgggtcggctgaccgccgagctgaaacaggctctggcgcgacgcgatacgaccttgctgggtgtggtcctcaacgtgctgctggcctggccggattgctgcttccggtcggagaccgtggtgcatccgcgcacgcgcaacaccttggcgtttgtcccggctcagttcaacgagttcgagatcagccccaaggagcgtgagctgatcgacatctgcaaagaggagaaggcgcagggccgcaaggtcctggcctacacggtctataccggcacgcgcgacaccacgtcgcgcctgaaggtgttgctggagcaggaaggcttcaaggtggcggtgctgcgcgcgagcgtggatgccagccgccgcgaagactggatcgccgagcaactggaccgtggcatcgacgtgctcatcaccaaccccgagttggtcaagacggggctggacctgttggagttcccgacgatcgtgttcatgcagtcgggctacaacgtgtactcgctccagcaggcggcacgccgctcctggcgcatcgggcagaagcagcccgtgcgtgtgatctacctcggctacgccggttcctcgcagatgacctgcctggagctgatggccaagaagatcatggtctcgcagtccacctcgggcgacgtgcccgaatccgggctcgatgtcctgaaccaggacggtgattccgtcgaggtcgcactggcccggcaattggtcgccgcctga

SEQ ID NO: 4514 - DNA, 633 bp, Pseudomonas aeruginosa
ccgcgccgccgcgcgcggccaaggtatcggcatcgcaacagaagagccgatgccatgcccgcaatccatgtatcccggcacttggtcggcgccggcctcctggccgcagccctggccagtggctgcgcgaccaccacggcgccgctcgcacccgatgccatcgaggaagtctcggccgcgcccgaacccgaggcgcccgagtacatcccggtcgtgcgctacggccgctacacgctggtcgagttggcacccacggcagcgcagcgcgacctgctgttgcagaccatcgacgtgtccatgcccgaggatgcccgcgccacggtcggcgacgggatgcggcatgtgctcaagcgcagcggctacggcctttgcgagaccgcgcatgccgtgatcgaactgtacgcgctgccgctgccggcggcacatctgcatctcggccccatgaccttgcgccatgcgctgctcacgctggctgggccgtcctgggaactgcacgcggatgaccgcgcacggcaaatctgcttcgatcggcccggcgaccgtgcagtcgccgagtccccatccgggccactcgccaccgagacggtgcagacgttcccgctggcgcctgcggtttcgggaggccagccatga

SEQ ID NO: 4515 - DNA, 1155 bp, Pseudomonas aeruginosa
acggccaatggcagcgccagccgtagctgcccccgtatcgcagttcttgcgcgcactggtgctctctgcaggcgtgtatgccagcaccccccatgcccaggaggtcccgccaccggcctaccagcttgccgcccagcgcgcgggcatcccttcgacggtgctctacgccgtggccttgcaggagagcggcatccggcgcaacgggcgcatcgtcccatggccgtggtccctcaacgtcgccggccaatcgcgccgcttcgccacgcgcgccgacgcctgcgctggcctgcagcaggcgatgcgcgccacgccgcacacgcgcatcgacgcgggcctgggccagatcaaccttggctaccacaagcaccgcttcaccggcgcgtgcgatctgctggacccgtaccgcaacctcgccgttgccgccgagatcctgaaggagcagcacgcccccggcgaggactggctgctggcgatcggccgctaccaccgccccgctggcggcgagcccgccgtccgctatcggcgcagcgtgtcccgccaccttgcccgcgtgcagggcacgcgcccaaccgccgcggtcttcgccgcgcgccaggagacctccccatgacgaaaccccatccggtccaactcgcgctcacgggcctgctcatgctgctgtcaggcctgccgctggcctcgcgtgctggcgagccgctgatcgtggtcgaggaccgtggcggcacgtcggcattgccgtactacgaagccctgaacctccagccgcgcgccaacgcgccggcccgcccccccatcccgacgccccgggttcccgccacgccagcggacgaagccgcgatgctgccggtgcgcagcagcaagctcacgcccggtaccgtcgcgcggcgcgtgatcgaagcgcccggcctgcggccgttcgcggtcatcggcgacgacgaggcttcccgggtctggttgcagcgccgcgccgccgctttgcgtgaacgcggcgcggtcggcctggtggtcaacgtcgagaccgcgcagagcctggcacggctgcgcgctctggtgcctggcgtaccgctcgcgcccgtggccggcgacgacctggccgatcgcctgggcctgcggcactacccggcgctgatcacggccaccggcatcgagcaatga

SEQ ID NO: 4516 - DNA, 423 bp, Pseudomonas aeruginosa
attcatcccgctcatcaacaagggcggcggtgccggcctgcaagtcacggcgtacacgcagacgctctcggacatcgaggcccgcatcggaaatcgcgcgaaggccggccaagtgatcgggaatttcaacaatttattcatgttgcgcgtgcgcgagacggccaccgcggaactgctgacgaggcagttgccgaaggtcgaggtctatacaaccaccatcgtctcgggcgcgacggacagctcagacatccgcggcgcgacggatttcacgtcgaacacccaggaccgcatcagcatggccagcgtgccgatgatcgagccgtcacacgtcgtcggcctgcccaagggccagtgcttcgcgctgctgcagggcggccagctctggaaggtgcgtatgccgctgccggcgccggacccggatga

SEQ ID NO: 4517 - DNA, 951 bp, Pseudomonas aeruginosa
agtgatgccggcggacctgcagcaactggccgggtacatgcgccagagctacagcgaggccacgcagtggtgggagttcaccagctcgtcggccttgcaggatgcggccttgcccgacgacctgctggacgatgccgctgcggccgagcccggcgcggtggccaccggcgccgacgatggcgcgggcaacgaggccgtgccatgaaggatgccgcctcgaccgcgcagcgggagcagaaccatcgccaaggcttgatcgtcggcaccatcaccttaccgttccggctgctcggggtgctcattggctcgctgctgttttcgatcgtggtggagtgcgccggcatgcacctgttctggaaggaccagggctggcgccactcccagcagatgctgcggtacgaactcgggcacctgtccaaccacttcacgcgcagcgtggtggtacaggagcccgggcgcacggcgcacgagttggtggataccgggtacgagtgggtgttcgtgcgctcggggttgctggagcgcatgagccagaccgccgagcgcgtccgcgcgcccagccacgggcagagccgcaacttccgctactacatcagccaagtctatgtctgggccgaaagctacctgatcgctgcggccttcacgacgctcaccttcctggtgcgcctgctggtcctggtgctcacgctgccgctgatcctcacggcggcattcgtcggcctgattgacggcctggtgcgacgggatgtgcgccggttcggcgcgggccgcgaatccggcttcatctaccaccgcgcgaaggccagcctgatgccgttggccgtgctgccttgggtcacctatctcgctctgcccatatcggtgcatcctctggtcatcctgctgcccagcgcggcgttgctggggatggcagtcagcctgaccgcaggcagcttcaagaagtacttatga

SEQ ID NO: 4518 - DNA, 375 bp, Pseudomonas aeruginosa
cctggcgcgcgtgcgcgccggcatccagttccacctgacgccatcacgcgctcagccgcgcgacccctccgaactggccggcgactaccgcaccgagcgggccgcttcgccatcgccgaagacgactgcggagggcgagcaatgaacggcgcccaggtctcggcatttcaagccaacagcggtatcgcgccttccgcgatggcgaccgtcctggtcggcgtcgtgctcgcggtcctgctcgtgtggggcgtctgggccatccgaacggcctacgtggggtggtccgagagccgcctcaaccagcgccagttcctcggcgtctgcattcgcttcgtcgcgatgtacctcgtcctgagtttcttccttctgtcctga

SEQ ID NO: 4519 - DNA, 378 bp, Pseudomonas aeruginosa
  unsure (237): Identity of nucleotide at the above locations are unknown.
cctgaaaggcccgaccatgcacaaccgcaacctcacttcccgttttgcccagcgcgccgccgtggccatgggcgccgccgcgctgcccgcgctgtcgttcgcgcaaggtctgccgcaattggagaaccccaacgcgcggcaccggccaccggcatcatggagaccatccgcaactacgggtacgacatcatcatgctcgtggccctgctggtggtggcgtcgatgttcatcggcgtntggtaccacgcctacggcacctacgcggagatccacaccggccgcaagacgtggggccagttcggcctcacggtcgccatcggcgccgtgctgctcgtgatcggcatctggctgctcaccgaagccaccggcatcctgtaa

SEQ ID NO: 4520 - DNA, 1263 bp, Pseudomonas aeruginosa
  unsure (862): Identity of nucleotide at the above locations are unknown.
ctaccgccgctccacgggcgagctgcgtcagcgcgtgcgcggcatctacgagattcccggccgcggctatggcgacgaccccacggcgcgcgtgcgcaccgtgtccgatcgcgactgggtggtgacgctggacatcacggcggacgagtactacggcgccgagcaggtcaagcgcgccctggtgcgctatccgatcaaggtcacgcgggtggacgtcgatcccgcccgcaacccgttcggcctggcgctggactgctacgacggcgcgccccagcgcatcagtgcaccggagccgacgcgcccggcgccgagtggcctgtctccgcaagcgcctcaaggaggaaacaccccatgaagcatcctgtactcgcgctgctggggctactggccgtggccgcggcacccgttgcccaggcggtggagatcctgcgttgggaacgcatgccactggcagtgccgctgaaggtcggtcaggaacgcatcgtattcatcgaccggaacgtgcgcgtgggcgtgcccgcaggcgtgggcgagcgcctgcgcgtgcagagtgcgagcggcgcggtgtacctgcgtgccagcgagccgatcgagcccacgcggttgcaactgcaggacgccgacacgggcgcgctgatcctgctggacatcgtagccgaaccgcccaaggacggggaagccgagctggagccggtgcgcatcgtcgagggtgacagcgcaccgggacgctatggcgagcagcccgacagtgcggaggccccggcacgcgcccagggccaggcaggtgcgcggaccgcgcggcgcgaaactccggtccctgtcgtgctgacgcgcttcgccgcgcagaacttttacgcaccgntgcgcaccgtcgagccgcttccgggcgtcatgcgggtcaacctgccccgcgacctcgacctggacacactgatgccaacgctgccggtgcgcgcggccgtgctcgcgtcgtggcgcctggaagaccaatgggtgactgccgtgcgcctcaccaacaccggcgccgactgggtcgcgctcgacccgcgcgtgctgcaaggcgatttcctcaccgccaccttccagcacgaggcgctgggcccgcgcggcacgcccgaggacacgaccgtcctgtacctggtcacgcgcggccgcggcctcgcgcagtcgctgctgccggcgattcaccgcttcgaccctgccgtgcatctgccgcagccggacggcgacgagaacgccaaggaggcccgccatgcgcagtaa

SEQ ID NO: 4521 - DNA, 1542 bp, Pseudomonas aeruginosa
actggacgagaacccgtgggtgctccagctctatgcccaggacgaaccgagcttcgaccagtacatgcagaccttgcgcgattacgtgcagtcacgtgcgcgcggttcggcgttcaccgagttctacctgcgcttcttcggccaccacctgcgcgctgtggccaagcccggcggcctgttcgaggacacggtggtcacgcggctgcgctggcgcggccagacgcggcgcgtgcgcatggtggtgtaccgccgcgcgagcggtcagggacaggcaaaccgccgcggccagacacccgagcagatgctgggcatcgtttgcgatcgcctgtgcggcgggctggcgaatgccggcatccaggcccggcgcatggttgcagcggacgttcacgactggctgctgcgatggttcaacccgcgccccacgctgctcggtcctggggcggaggaccgggagcgcttctactcgctggcgcgctacccggacgagaccgaggccggcgagatcgagttggcgagcgggcgggatttcagccagcggttgttcttcgggcagccgcgctcggacgtggcgcaaggggcctggtacttcgacggcatgccgcaccgcgtgctgatcaccgaccggctgcgcatgccgcccggcacggggcacctgaccggcgagacccgcaagggggacgcgatcaacacgctgttcgaccagatgcccgaggacaccttgatgtgtctcacgatggtcgccacgccgcaggatgtcctggaatcggatctgaaccacctggcgaagaaagccgtgggcgagacgctggcgtcggagcagaccctcaaggacgtgcacgaggcccgctccctgatcggcagcgcgcacaagctctaccggggcacgctggcgttctacctgcgcgggcgcgacgaggcggaactggatcggcgcggcctggacctggcgaacgtcatgctcaacgccggcttgcaaccggtgcgcgaggacgacgaggtggcgccgctcaacagctacctgcgctggctgccgtgctgctacaaccccggcaaggatcggcgccgctggtacacgcagctgatgttcgcccagcacgcggcgaacctgtcgccggtgtggggccgcgcccagggcacggggcaccccggcatcacgatgttcaatcgcggaggcggcccgattacgttcgaccccttgaacaggttggatcggcagatgaatgcccatctgtttctgtttggccctacgggctcgggcaagtccgccacgctcaacaacctgctgaaccaggtgacggccatctaccggccgcggcttttcatcgtggaagccggcaacagcttcggcctgttcagcgacttcgcgcggcgcctgggcctgaccgtgaaccgggtcaagctggcccccggatcgggcatcagcctggcgccgttcgccgacgcacgccggctgatcgaaacgcccagcgacgtgcagacgctcgatgccgatgccctggacgaagaccagccaccggatgcctcggccatggaggcggatga

SEQ ID NO: 4522 - DNA, 909 bp, Pseudomonas aeruginosa
gcagcgcgacgtgctcggcgaactggagatcacggcacggctgatgatcacgggcggcgaagacaaggaagaagcgcggatgacgcgggccgaccgctcgctgatccgccagtgcatcctcgacgccgccgaacattgcgtggcggagaagcgcaccgtgctcacgcgcgatgtgcgcaatgcactgcgcatccgtggccaggacccgacgttgcccgagatgcgccgtgcgcggctgctggagatggcggacgcgatggacatgttctgccaaggcacggacggcgagatgttcgaccgcgacggcacgccgtggcccgaggccgacatcacgctggtcgatctggcgacctatgcccgcgagggctacaacgcgcagctctccatcgcctacatcagcctgatcagcacggtgaacaacatcgccgagcgcgaccagtacctgggacggccgatcgtcaacgtgaccgacgaaggtcacatcatcaccaagaacccgctgctcgcgccctatgtcgtgaaaattacaaaaatgtggcgcaagttgggcgcctggttctggctggcgacgcagaacatcgacgacctgccacgtgcagcggagccgatgctcaacatgatcgagtggtgggtgtgcctgtcgatgccgccggacgaggtggagaagatcgcgcgcttccgcgaactctcgccggcgcagaaggcgctgatgctctccgcacgcaaggaagcgggcaagttcaccgagggcgtcatcctctccaagagcatggaagtgctgttccgcgccgtgccgccaagtctctacctcgcgctcgcgcaaaccgagcccgaggagaaggcagaacgctaccaactcatgcagcagcacggcgtcagcgagctggatgccgccttcaaggtggctga

SEQ ID NO: 4523 - DNA, 468 bp, Pseudomonas aeruginosa
tcaacttccggggcgcatgacatgccagcagcttttatccggttcgcaccaagctggcgaacccttggcctggccgtagcgctgccggtgtctctggcggtgttcagcccggccaccttcgccgccgacgtggtggtcgtcaccgacagccgccacccggtcaagaccatgggtggcgagcgactgatcgagttggacgaaacgccccggatggaggccgagctttccgcgaatcttccagccgaccctgagcgggcagcagccatcgtccggcaaggcctgaaccagggaggcgccgaccttcagcgccgcatcgcgatggcctaccaaggcgtgaccgacgcatggagtttgggtgtcacgaccatcccggccgtggtggtggaccagcgctatgtggtctatggcgagccggacgtcgcccgcgccatcgcgcgcatcgagcagcaccggagggcgcagccatga

SEQ ID NO: 4524 - DNA, 1638 bp, Pseudomonas aeruginosa
ggacgacgcccaggcgcggcgccgcctggtgcgcaccgagatcgcgggcgtcgtcgccatcgtggcgctggaagccagcctgctgatgcaggcgggttgaggggagatggcgccatgacgctgttcacgaccgactacctggagtactacctgacgctggtgtcctggatcgtcaacaacggcatctgggccgtgctggtgtccagcggcgtcttcgcgctgcctttcgtggcgatcatcgtgcaggagtggttgaaggcccgtgcagaaggcgccgacgagggcaataaaggcgtgctgagcgccgcccgcatcgagaaccgggtcttcgtcgccatcgtggtggtgatgttcgcgggcatcccgttcatcgacgtggacctcaacaccatccagtacgacagctcacgctcggcccagtgccaggtcagtgtgccgcagccctcgaataccggctggtcgcaatctttcagcaccatcaacaaccagtcggcgaaggtgccggtgtggtgggcgttcatgcacacgctctcgcgcgccgtcaccggcgcttcggtggcggcaatcccgtgcggcacggacctgcggcagatgcgcatggagatcgacgcgactcgcattgacgacccagtgttggctcaggaagtagcggatttctcgcgggattgctatggggctgcgcgggcgaaattgttcatgcagcggcctcaactcgatgagcagcagatgcacgacgtgacctggatcggctcacgcttcttcacggacacgaacggctactacgacacataccgttccagcaccccgcgcgaggactggccctatgacagcacccgcgacgcagggcttgcgcaggtggccagcggtggcggctaccctacctgccgccagtggtggagcgatgggagcaatggcttgcgggcacgcttgctgggtcaggtggacccgagcctgctcaatcgcctggcgggctgggctggcttcctgagccgggccgaggtggacgattcggtgatccgcacgatcgcgtcaccgcggcagcagaagttgaaccaaggcagcgtctatacggactacggtggccagatcgacaagaccttgccaaacatcgtgacgcgggccacgggcgatgttgggatggcagtcggcgcgattgctgcatttccagccatggacgtcgcgaggcaggccctgcccatggtgcttgcattgctaaaaatggcgctggtcatctgcattccgctcgtgttggtcgtgggcacctatgacctgaagacggtcgtcacggtcagcgtcgtgcagtttgcgctgtttttcacggacttctggtttcagcttgcgcgctggatcgattcaacgatcctggatgcgctttatggctggggcttcggctggaaccggccgcataccaacttcgacccgctggtgggcctgaacaacgctttcggcgacatgctcctgatgttcgtcacgggcacgatgttcatcgtactgcccacgttctggatcatggccctggcttgggcgggcgttcgcgccggcaacgtgctccaaggcctcgctggtgccaccggagatgccaaggctgctggcgggaggggcggaagcattgcgatcaatgcagtttcgaagaagtga

SEQ ID NO: 4525 - DNA, 999 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtcgaatgctgcaggctcgcatcgcacgcagtgtgggcgtctcggagtccacggtcagccgcgttctggcgcgagcgggcatgtccaggttgagcgacctggagcccgtcgaagccgttgtgcgctacgagcacgaggcgcccggggacctgctgcacatcgacaccaagaagctcgggcgcatcgtgcggcccagccaccgcgtcacaggcaaccgtcgcgactcggtcgatggtgcaggctgggagacgctgttcgtggccatcgatgatcacgcaaggttggcgttcaccgccatgcatcccgatgagaagacggcgcaggcggtcctgttcctgcgcaatgccgtggcctattacgcccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccagtcagcgttgcgcgagtgggcctacggctggacctaccagaactcagcccatcgaaccgatgccctggcaagctggcaacaccactacaactggcatcgcccgcacagcggcatcggcggcatcgcgcctatgtccagactcaactcgtcaagaaataacctcttgacgcttcacatctag

SEQ ID NO: 4526 - DNA, 849 bp, Pseudomonas aeruginosa
cggtcgcgggggtcgccgccggactgcgcaacaccggatgagggaaggcggggggcaactttcggtgtcttgtgcggtgggggggcgctgtgtatcttggacagccttttcggcgccatacagtgccgtttcctgcaaatacgagattggccccacgaggcggatccagactttcgcttaccaattctaaggagcatatcgatgcgtgtgattctgctcggggcacccggtgccggcaaaggcacccaggcacggttcatcaccgagaagttcggcattccgcagatctccaccggcgacatgctgcgcgccgcagtcaaggccggcagcccgctcggccagcaggtgaaaggcgtgatggacagcggcggcctggtatccgacgacatcatcatcgccctgatcaaggaacgcatcaccgaggccgattgcgccaagggcttcctgttcgacggcttcccgcggaccatcccgcaggccgaagcgctgaaggacgccggtgtgaccatcgaccacgtggtcgagatcgccgtcgacgacgaggagatcgtgtcgcgtatcgccggtcgtcgcgtgcatccggcctccggccgcgtgtaccacaccgagcacaacccgccgaaggtcgccggcaaggacgacgttaccggcgaagagctgatccagcgcgaggacgacaaggaagagaccgtgcgtcaccgcctgtcggtctatcattcgcagaccaagccgctggtcgacttctaccagaagctgtcggccgccgaaggcaccccgaaataccacagcatcgccggcgtcggctcggtcgagcagatcaccgcgaaagtgctttcggccctgagctga

SEQ ID NO: 4527 - DNA, 840 bp, Pseudomonas aeruginosa
caccgacggcccgcttgcgggccgtcggcgtttccggggcggcgaaggctggtacaatcggcgtctttttcaccacgcggaaccgtcgatgtccactctgttggccctggatacctccaccgaagcctgctccgtcgccctgctccacgaggggcgggcgctcagtcactacgaggtgatcccgcgcctgcacgcccagcgcctgctgccgatggtccgcgacctgctcgacgaggccggcgtcgccctgtccgcggtggacgccatcgccttcgggcgcggtccgggcgccttcaccggcgtgcgcatcgccatcggcgtggtccagggcctggccttcgccctgcagcgcccggtactggcggtctccgacctggcgatcctggcccagcgggcctaccgcgagcagggtgcggagcgggtcgccgcggccatcgacgcgcggatggacgaggtctactggggttgctaccagttgcaacagggcgagatgcgcctggccggcagcgaagcggtactgccgcccgagcgggtcgccgtaccgtgggacgccgctgccgcggactggttcggcgccggcaccggctggggctacgtcgagcgcatgccgcagcgcccggccgcgctggacgcgagcctgctgccgcatgccgaggacttgctcagcctggccggcttcgcctgggcgcgcggcgaaggcgtggaggcggaacaggcgctgccggtgtacctgcgcgacaacgtggcgacgccgaaaaaagcgccctgaaaatgccgcgcagcggtaattgccaagcctttcggggctggctagagtgtggagacttccccgggttttga

SEQ ID NO: 4528 - DNA, 516 bp, Pseudomonas aeruginosa
gcagccatgcggcgatggccctggccagctacaactccaccgccagcctcaacatcgacgccggcgccgaggatgtcctcggcctcgacctctacgcctgagcggttccctgcgctcccgtggtttcccttccttatttcctcggttgtccatcctggaacgaggcggcctggcgcggcagcttctatccgcgcgaattgcgttccgccgactacctcggacactacggcggcatcttcaacgcggtcgagggcaataccaccttctatgcccggccttcggcggaaaccgtgcggcgctgggccgagacgatgccggcggggttccgcttctgtgccaagtttccccgcgatatcagtcacgaaggcgacctgcgcgaacggctcgaggccgccggcgacttcctcgaactgctggcgccgcttggcgaaagggtcagcccgctgtggctgcaactgtcggcggcgttcaccccgcagcgcctgggcgaactgctgtatttcctcgatgagctga

SEQ ID NO: 4529 - DNA, 831 bp, Pseudomonas aeruginosa
gcctgggctcgaatcttgcccgggtcgccttcggcgctttccatcaggcggcgcaggcgctggcgcggcgcgacctggaagcgacccgtgcggcgatgcctttcgaccgtatcaacgacctgttccgctgaacccgtgcgccgcctggcctggttgctgccattactgctgctggcgggggccatcggcgccctgcgctaccagtggctcgatctgccggcgcgctggaatccctggctgccgctggacgtgcgcgaaccgccgaacctgctgacccgctacaagctatggcggctggccgacgaccggagcctctgcgacgccgccctggccacctcgcaactgcgctaccagcgggtagccgacgacccgccatcggctacctgcccgttgagcaacagcctgcgcgtgcgtggggcggcgctggagttgagcagcagctttctcgccagttgcccgctggcggtgagctatgcgttgttcgagcggcacgtgctgcaaccggcagccctggacatctatggccagccgctggcgcgggtcgagcatgtcggcagcttcgcctgccgcaacgtctacaaccgcgaggacggtcggcgcagccagcatgcctcggccaatgccctggacatcagcggcttccgcctggccgacgggaggcggatccgcctggccacggactgggccggcgagagcgccgacgggcgcttcctgccccgcgtgcgggacggcgcctgcgccagtttcaatgcggtgctggggcccgactacaacgccgcccaccgggatcacttccacctcgacatgggcctatggaaggtctgccggtga

SEQ ID NO: 4530 - DNA, 780 bp, Pseudomonas aeruginosa
gcgcgcgcgggccaactctggcaaaatccgcgctttccccgacgattgcccgaccatgaccgattccgccgctcctcgcctgcatgtccaagccctgtccgccgattgcgccgaggctgcgcggcgctgggcggagcggctcggcctgccgctggcggcggacgacgaggcggagttcgccgtgcaggtcggcgagcagggcttgcaggtcttgcaactgggggcggactcccccggtccggtgcgggtcgatttcgtcgagggcgccagcgcccaccggcgcaagttcggcggcggcagcggacagatgatcgccaaggcggtcggcgtccagccaggcatccgcccgcgggtcctggacgccacggccggcctgggccgggatgggttcgtcctcgccagcctgggctgcgaggttaccctggtcgagcgccagccgctgatcgccgccctgctcgaggatggcctggagcgcgcccggcgcgatcccgacgtggcgccgatcgccgcgcggatgcgtctgctcggcggcaactcggcggacctgatgcgcgcctgggatggcgaggcgccgcaggtgatctacctcgacccgatgtttccccatcgcgacaagagcgcattggtgaagaaggaaatgcgtctgttccggccgctggtgggcgacgatctcgacgccccggcgctgttgcaggcggccctggccctggccagccaccgggtggtggtgaagcgcccgcgcaaggcgccgatcatcgaagggcccaagcccggctatag

SEQ ID NO: 4531 - DNA, 1197 bp, Pseudomonas aeruginosa
gaactcgaacgcagtttgcggaaggtgtcacatgtaccgccatatcccgctcgtcgccctgtccctgttttcctccctgttcctcgccgcctgcggcaacggcacgccgccgccagccgcggcgcgtccggcgatcgtcgtccagccccagccggcgggggaggtgagccaggcctttcccggcgagatccgcgcccgccacgagccggagctggccttccgcatcggcggcaaggtcatccgccggctggtggaagtcggcgagcgggtgaagaaggaccagcccctggccgaactcgatccccaggacgtgcgcctgcaactggaggcggcgcgggcccaggtcagtgccgccgaggccaacttgcagaccgtgcgcgccgagtaccggcgctaccgcaccttgctcgaccgcaacctggtcagccattcccagttcgagaacatccagaacagctaccgcgccggcgaggcgcggctgaagcagatccgcgccgaattcaacgtcgccgacaaccaggccggctacgccgtgctgcgctcgccccaggatggcgtgatcgccagccggcgcgtcgaggtgggccaggtggtggcggccggacagacggtcttcagcctggccgccgacggcgaacgcgaggtgctgatcggcctgccggaacacagcttcgaacgtttccgcatcggccagccggtgtcggtcgaactctggtcgcaacgcgacagacgcttcgccgggcatatccgcgagctctcgcccgcggccgatccgcaatcgcgtaccttcgccgcccgggtggccttcgacgaccgcgcgactccggccgaactgggccagagcgcgcgggtctacgtcgccgccgccgaggcggtgccgttatcggttcccttgtcggcgctgaccgcagaggccggccaggcgttcgtctgggtggtcgagccgggcagctcgaccctgcgccggcaggcggtgcgcaccggtccctatgccgaggaccgggtgccggtgctcgaaggcctgaaggctggcgactgggtggtggccaccggggtccaggtgcttcgcgaagggcagcaggtgcgtccgatcgaccgggccaaccgcacggtgaaactggcggccaaggagtagtcgcatgtccttcaacctttccgcctgggcgttgcagaatcgccagatcgtcctgtacctga

SEQ ID NO: 4532 - DNA, 321 bp, Pseudomonas aeruginosa
ccctcgccgccttcgtcggcgcgctgctgctgttccgcctggtgccgcagcagttcttcccgccctcggcgcgtctggagctgctgctggacatcaagctggcggagggcgcctcactgcgctctaccggcgaggaagtccagcgcctggaaaaaatgctgcagggccatgacggcatcgacaactacgtggcctacgtcggcactggctcgccccgcttctacctgccgctggaccagcaattgccggcggccagcttcgcccaggtggtggtgctggccaaggacctggagagccgcgaggcgctgcgcaagtggctga

SEQ ID NO: 4533 - DNA, 2874 bp, Pseudomonas aeruginosa
tctcgcgggtctggctggccaactgcaccgagggggcgtcggccagggacacgtcttccaggctcacgctcaggcgcgccgagggcggcagggcgatacgctcgcggtagaagacctcaccatcgaagctggcgttcgaagtcgattgctgggtaccgcagccggcgagaatgctggcggcgagcagcaatggcagttttttcatgggagcctcctttcagacggaacaaaaaaacgagcgggcctctgacccgggaaaccagcataggttgccgggccggaacagggaaaggtcgcaggatatttcagcggagcgacgcccgtccctcgcggggcgggcgccgggtttcagttggcggccgcgtcgttgctttcggcggcggcttcctcggcggggcgctccagcgccacctggcggatcgacagacggatctccgccggcagcacgcgcttggcggcgccttcggccagttcgccgagcagttcgtggtagctcagcttgccggcctcgtccttgcgcagcacgcgcaggtcgagaagggtctggatgaagtggcggaacaggctcttgtcgaagaactccggggcgttcaggccatgcaggatcgacaggcgctgggccatcacggtgcagaggttctccagttcctcggcggtcagggcgttctgccccgcgttgagcagcagggcgatggccatgtagaagcgctgcagggtctgggttaccgaacgagcgaggaggatcagcagcacgtattgccgcgagcttggcgccgggcggatgaaggtgtcgttctcctggcgcagcaggtcctgttccaccagggccgccagccactggtcgatcaccgcgtcgagttcgtccaggctccagcggatgaacagttccgcctgcaggtagggatagagcgcgcgggcgaagcgcagcaactgttcgcggctgatccgcgagttgctctggaagaagctggcgatcagcgccggcagggcgaagacgtggaggacgttgttgcggtagtaggtcgccagcaccgcgttctgttcgtcgagatagaggatgcggcccagcgcgtccttctgctcggccagcaggttcatgctcttcacgtattcgatcagggcctggccgtcgccgtccggcagggtcgcgctgggcgagtagggcaccttgcgcagcagcgccaggtagaggtcgaggattcgcgccagggcgctttcgtcgagggcctgtcggctggtggagagcagcgccagggcgaccaggttgaccgggttgatcgccgccgcgtcgttgaggtggcgggcgacgtccttggccagcaggttggtggtctgcggcagccagtcggggcggtattccgggccgaggtcctggtcctgccagtcgggctggtggcggtcgaggaactggtcgagatggatcggctcgccgaagttcacccagacctggccaaaacgctgcttcagggcgccgaccaccttgaacaggtcgaagatcgactccttcttcttggtcgcgccgcgcagttcgccgaggtaggtgcggccttccagcacgcgctcgtagccgatgtagaccggcacgaagacgatcggccggcgcgagtcacggaggaagctgcgcagggtgatggcgagcatgccggtgcgtgggtggagcatgcgcccggtgcgcgaacggccgccctcgacgaagtactcggtggagaagccgcgggagaacagggtgtgcaggtactcgttgaacaccgcggtgtagagctggttgcccttgaagctgcggcgcatgaagaaggccccgccgcggcgcaggatcgagccgatcaccggcatgttcaggttgatcccggcggcgatgtgcggcggggtcaggccgttgcggaacagcaggtaggagagcagcaggtagtcgatgtggctgcggtggcagggcacgtagacgatctcgttgccctgggccacgtcctgcacccgctcgatgtggttgaccttgacaccttcgtacagcttgttccagaaccagctgaggatgacttcgaggaagcggatcaccggataggagaagtccgaggcgatttcattggcgtagcgcagcgcgatgccttcggccttctcctgggatatccgttcgctctcgcattcctcgctgatcgcctggcgtaccagcggcgcgcgcagcaggcccttgaccaggttgcggcggtgcgacaggtcgggaccgatcaccgcggtcttcaggttgcggaagtgcacccggaggatacggttgaccatgcgcagcgtgcgctcgtggcccttgccctgttccaccagctcgcgcaggtggatcggcgcggagaactgcacgcgggtcttgcgtccgaggatcaggatgcgcgccagcttgcgcaggcgcccggtgaccgcccagttgtcggcgaacagcagcttccaggggctcgattcgctgtccggcgattgtccccagaacacgctgaccggaatgatctgcgcgtcgtcgagaccgttctggccgaccgcggcgagcatgcgcaccagggtcggcgaggcgccgcgcttatcctggcggccgagccagtcgggttcgggcgtcaggtagaagaacgccgccggctcgatggcgtcgcctaccgctaccggcatcaccggacgcggcagcccggccttgcggcattcggtatccactaccgcgagatcgctgaccgaaggctgttgcagcacgtagagcaccggcttgctgcggtcgatcttcagggtgaaggccgattggttgatggtttccgagcgtacccagaggtacagcaggcggcgcagggcgccaaaaccaaagcggcggaaagggtagcggggcatacggtgtctactggcagttga

SEQ ID NO: 4534 - DNA, 1719 bp, Pseudomonas aeruginosa
tccctgcgcgtttttcgcggccctggccggacaaggcggcggccgccggaacaggtaggggaccatgatcgaaacaagaaacctcggcaaacgcttcggctcgcgggtggcggtggacgacctgtccttccaggtggcgacgggggaggtactgggcttcctcggtccgaacggcgccggcaagtccaccaccatgaagatgctcaccggcttcctggcgcccagcgccggcaccgcgagcatcttcggcttcgacatccgcaaccgcacgctgcaggcgcagcggctgatcggctacctcccggaaggttcgccctgctacgcggaaatgaccgtgcagggcttcctcgatttcatcgccgagatccgtggctaccgtggtgccggcaagcgcgagcgggtcgcccgggcactggggctgctggaactggacgaggtgcgccggcagaccatcgaaaccctctccaagggcttccgccggcgtgtcggcctggcccaggcgatcctccacgaaccgcgggcgctggtgctcgacgagcccaccgacgggctcgatccgaaccagaagcaccaggtccgcgaactgatccgcggcctcgcgcaggagcgcatcgtgatcatctccacccatatcctcgaggaagtctcggcgctgtgcagccgcgccctggtgatcggcggcgggcggctgctggcggacagcacgccgctggagctggccagccgctcgcgctaccaccaggcggtgacgctctacagcgacgagcccctggatgccgtggcgctggcggtgctgccgggcgtggcgggcatcgaggagaaccccgccgaaggcagcctgaccgtcctggcgcagccgggcgcggtgatcttcccccaggtcagcgggctggtcgccgagcgcggctggcggatccgcgaactggacgtggagcgcggccggctcgacgaggtattccgcaacctgacccgggggacggaggcatgaagcaactgccggtgatcttcaagcgcgagctggcgagttatttcgccacgccgctggcctatgtgttcatcattatcttcctggtcctggcgggcgtgttcaccttctacctgggcaacttctacgaacgcaaccaggccgacctggcctccttcttcgccttccatccctggctctacctgttcctggttcccgcgctggccatgcgcctgtgggcggaggagcgcaagtccggctcgatcgagctgctgatgaccctgccgctgacccgcttcgaagccgtggccggcaagttcctggccgcctgggcgttcgccggaatcgcgctgctgctgaccttccccatggtgctcacggtgaactacctgggcgagccggacaacggtgcgattctcgccggctatctgggcagttggctgctggccggcggctacctggccatcggttcgtgcatgtcggccctggcgaagaaccaggtgatcgctttcatcctcgccgtggccgcctgcttcctgttcatgctcagcggctttccgctggtgctcgatgcgttcagccagtgggcgccgcagtggttgctcgatgcggtggcctcgctgagcctgctgacccgcttcgatgccgtcagcaagggcgtcatcgacctgcgcgacctgctgtatttcgtcagcctgatcgtcgcctggctggccgccacggcggtggcggtcgacctgaagaaagccgaatga

SEQ ID NO: 4535 - DNA, 2094 bp, Pseudomonas aeruginosa
cggtgcccgggaactggtgccgctgcgcaactacgccaggcgcgtcgaggaactgctgcgcgcctacgagcgcgaggcgaacggcaggattcgcctgcaggtgatcgatcccgagccgttctccgagaacgaggacaaggccaccgagttcggcctgcaaggaattcccctgcagcagggcggcgacaacctgtacttcggcctggccggcagcaacgccctggacggagtccaggtcatacccttcttcccgctcgatcaggaggagttcctcgaatacgacatcagccgcctggtgcagaccctggcacagccgcagcggccggtggtcggcctgatgtcgtcgctgccgctcaatggcggcttcgacatggccagccggcagccgacctcgccgtggatggtcatggaggaaatccgccagcaattcgacctgcgcagcctcaagagcgatgccacggaaatcccgccggaggtctcggtgctgctgctggtgcatcccaagcagttacccgagcagacgctatacgccatcgaccagttcgtcctgcgcgggggcaagctgctggcgttcgtcgaccccttcagcgaggccgacagcggcagcgatttcgccgctacgctggatggcgacaagtcgtccgacctcgcgccgctgttcgaggcctgggggctgcgcctgctgccgggcaaggtgctcggcgacggcgcctatgcgatgtccatcagtcttggccgggaccagcgtccggcccggcatccggcctggctcagcttgccgcgcgaggcgctggaccaggacgacatcgccactgccggcctggaaagcctgaccctggcgacgcccggcatcctcgaaaggctccccggagcgagcaccagcttcacgcctttgctgcaaagctcggcccaggcgatgccgttcgatgcctcgcgcttcggcctgctgcgcgaccccggcgatctgatgcgcgagctgcgcccgagcggccggcggcatactctcgccgcccgtatccaggggccggcgaagagtgccttcgcggagggcatcgaggggcatcgcgaaggcctgaaggaggcgcgcaacatcaatgtcatcgtcgtggccgataccgacctgctcagcgatcgcatgtgggtccaggtgcaggacttcttcggccagcgcgtgccgcagccctgggccgacaacggcgcgctggtggtcaacgcgctggacaacctgtcgggcaccgacgcgctgatcagcgtgcgctcccgcggccggttcagccggccgttcgtggtggtcgagcgcctgcagcgcgaggccgagacgagcttccggcaaaaggaggaccagctcaagcagcgcctcgccgataccgagcagcaactcgccgccctccagcagggcgccgccccggagaaggccgtcgaactgacgcccgaacagcaggccacggtgcgccagtacatgcaggagaagctgcgcatccgcaaggagctgcgcgaggtgcagtaccagttgaacgccgatatcgacgcactgggccgcaccctgaagctggtcaatatcgccctggttccctcgttgctcacggtcggcgtgctgctcggctggctctggcggcgccggcgcatggcccggggagggcattgacgcatgcggcgcaatacgctgatcgtcctgctggcgctggtggcggcgctggccggaaccttcgcctggctgcagcgcgagcgcgcaaccgaggtacctgccttgccggcggcagagcgctggctgccggaactggacagcgcgacgctgagtggcctgcacatgcagtttgccgacggttcgccggatatccgggtcgagcggcgtgcgggcgcgtgggtcctgccggccaaggccgactatccggccgaccggctacgcttgtcggcgctgctcgaggcgttggcagaggcgcgcaagctcgaggcgaagagcgccaacccgaagaaccacgcgctgcttggcctggcggagcgtggcgaggggcaggcgctacgcctgagcctgcattggcagtccggcgagcctctggtgctgctggtgggcaaggatgcgcagcatggcggtag

SEQ ID NO: 4536 - DNA, 516 bp, Pseudomonas aeruginosa
gcggtcgagggccaggaagaagcgctccaggtcgtcggcatcgttgtacaagcccagcgagacacgcaggggcgccgggtaccttggaggcgttgcagcagcggcatcgctcaatggtggccggcgcgcaccgcgatgccctgttcgccgagcaggtgggcgagatcggcgacgtgcacgccgtcgacgcagaagctggccagcgccgcctgtggttcgccgagcaggctgacgccgtcgcgcgccagcaggccggcgagcaggcgggcgtggagggcgccttcgtgggcggcgacttcggcttcgtccagggtggccagccagtcgatggtcgcgcctaggccgatcgccgcggaaaccgccggggtgcccgcctcgaagccgagcggagcggcatggaagctggcttcgtggaagccggtgtggcgtaccatctcgccgccgaactgccagtgcgccagttgctccagggcctgtgggcgaccccagagcacgccgatgccgtcggggccgtag

SEQ ID NO: 4537 - DNA, 1245 bp, Pseudomonas aeruginosa
cgcacccggcggcgctggcgagcaccgtcgggcgagcggggaggcgagctgggctcagttgtgcgcgtgcagcgcttcgttcagctcgatggcggtcttgttggtcttgcactccaccgcaccgttctgcgagttgcggcggaacagcaggtcgggctgaccggccaggtcgcgggccttgaccactttcaccagggcgttctgctcgtcgagcagggcgaccttggtgccggcggtgatgtacaggccggcctcgacgatgttgcgatcgcccagcgggatgccgatgccggcgttggcgccgatcaggcagccttcgccgacgctgatgacgatgttgccgccaccggaaagggtgcccatggtcgagcagccgccgcccaggtccgaccccttgccgacgaacacgccggcggatacgcggccttcgatcatgcccgggccttcggtgccggcgttgaagttgacgaaaccttcgtgcatcaccgtggtgccttcaccgatgtaggcgcccaggcgcacgcgggcggtgtcggcgatgcgtacgccggccgggaccacgtagtcggtcatcttcgggaacttgtcgacggagaagacttccagcagcttgcccttcagtcgcgcttccagttgcagttcggccagttcggccaggtccaccgcgccgatgttggtccaggccacgttcggcaggagcgggaagatgccgctcaggttcacagcgtgcggcttgaccaggcggtgggagagcaggtgcagcttgaggtaggcctccggggtggaggacggcgcggcgtcttccgccaacagggtggcgaccagcggcttctggctttccgccaggcgcgagagcagggccgactgagcggcgtcgatacccttcagggcgtcggccaactggtaggcctgctgcgaagtgaaggtcagcgcctggttgccggctgcgtagccaaggatcggtgcgacggcggcgacgatttcgctcgaaggcttgagcagcggcagcgcgtagaacacttccagccaggcttcctggcggttctgggtgccgacgccgaaggccaggctgaacagggattgcgacatgtgggtttcctcgaaacggagtggaacggtcaggccggacggcggctgagcagcaggcccagtcccgcgctgccgagcagcgcggcgcaaccgcggttgaacagacgccgggcccgctggccggcgagcagccggccgaggtggagcccggcatag

SEQ ID NO: 4538 - DNA, 462 bp, Pseudomonas aeruginosa
atcgtcgtggtgcgcttagccgcagggctgctgcggaccgccggtcatgctctcgacgctgtccagtacggcatggcccttgccgaccttctgcacgtcgtcgacgtcgcgcatgatgctgccgccgtcgctcatctggttgcgggtcttgatcaggttggtggtgatgtccagcaggctgcgaccggtagcgatcaggtcattggtggcgctgggggtgcaaggggtgttggcggaggcgacctgggcctggccgggttgcccgggctgggtggtgcggtagccctgggtcagtgcgttctgctggaggcagccggaggtggcggcgaacatcgaggcgagcagcagtgcggaagtaagtcccttgcttgtcatggcggcattcctttgtctgagtgggcgctgcaccccgtactccttcggggcgtcgtcctggccgacgctacggcgggcctggactga

SEQ ID NO: 4539 - DNA, 1863 bp, Pseudomonas aeruginosa
aatagctcggatgtactagtgcgggaaccttggccgggcgccccggtcgtcgccgcggagggggcggacgcgcggggtagagcggcggggctaggaaagaccgtacggattgtgcgaatgtcggatagctgcctaccgatcgcgatggtgcaatcgacgcagtcgcatcgtccagggacgaagccggagatccccgccctcatgcaaaccgtgtacaccgttctgaccctgctgctggtcgtcggcgccacccgcctggctgcccagttgctgcccttgccgctaccactgatccagatcgccgccggggccctgctggccttgccgtccctcggactgcacattgccctcgacccggagctgttcctcttcctgttcattccgccgctgctgttcgtcgacggctggcgtattcccaagcgggaagtctggcggatgcgctggccgatcctgatgatggcgttcggcctggtgttcttcaccgtggtcggtgccggctatttcatccacctgctgatcccggaaattcccctggcggcttccttcgccctcgccgccgtgctgtcgcccacggacgccctggcggtctcggcgatcacccaagggcggctgcccaatcgcctgatgcacctgctggagggcgaggcgctgatgaacgatgcctctggcctggtggcattcaagttcgccatcgccgcggcgatgaccggcgtgttctcgctggtggacgccagcctcaacttcctcctggtcgcggtcggcggcctggccatcggggtgttcctcagctggtcgctgggccgcatccgcgcctggatgatctcccgtggctgggacgacccggcgacccacgtggtactgatgctgttgctgccgttcgcctcctacatggtggcggaacacctgggcgtctccgggattctctcggcggtagcggccggcatgatgcagagctgggtcgacctgctgccgcggcagacttccacgcgcctgctcaaccgcagcgtctggtcgatgctggagttcgccttcaacggcgtggtgttcctgctgctcggcctgcagttgccggacatcatgaagtcggtggccaaccaccacggcgacctgctctggcgttcctcgctgctgctggcctacgtggcggcgatcaccgccgtgctgatgctgatccgctacggctgggtctatggctactggaagctgtcgctgcgcatcgaccgctggcgcggcaagagcccgcccgggctgagcggcatctccctgcgccgtctctccgccctcagtgcattgagcggcgtgcgtggtgcggtgaccctggcggcggtgctgtcggtaccgatgagcctgatggatggtagcgccttcccgcagcgcgacctgatcatcttcatcgccaccagcgtgatcctgatttccctgatcggcgcgaccatcggcctgccgctgctgctgcgcgggctgccggcgagcaacaatggcgcccacgagcgcgagcggcgcgaggcctggcgcaagaccgcggaggcggcgatccgggccctggagagcgaggaattgccgcaggtggaaggcaacgatgcggcgaatacttcgcgggtcgccgaggcgcgtgcgcagatcatggccgaataccgccagtcgctggataccgcaccgaccaccgatgaggcccgcgaccaggcccaagccctggagatcgccgacaaggccttgcgcctgaaggcgttgcgcgcgcagcgcctggaactgtaccggcagcggcgcaacaacgagatcgacgacgagaccctgggcgacatcctgcgcgagctggaccagcaggaaagctggctgaccaatcgcttcgcccgctgggtgtga

SEQ ID NO: 4540 - DNA, 933 bp, Pseudomonas aeruginosa
gtttctgcccggcaggccgggcacaaaggttttttgagagctaccactcaagaggatttcgaaatggcagaaattactgcagccatggttaaagaactgcgcgagcgtaccggcttgggcatgatggagtgcaagaaggcgctgaccgccgctggcggcgacatcgagaaggccatcgacgacatgcgcgctgccggtgcgatcaaggctgccaagaaggccggcaacattgccgccgaaggctcgatcgccgtcaagatcgctgccgacaacaaggccgccgtgatcatcgaagtcaactcccagaccgacttcctggccctccaggacgacttcaagggcttcgtcgccgagagcctggaaaaggccttcaacgagaagctgaccgacgccgctccgctggtcgaagcacgtgaggaagctcgtctggccctggtcgccaagaccggcgagaacgtcaacatccgccgcctgacccgcgtcgagggcgacgtggtcggcgcctacctgcacggccaccgcatcggtgtcgtggtcaacctgaaaggcggcaacccggaactggccaaggacatcgccatgcatgtcgccgccagcaacccgcagttcctgagcgcttcggaagtttccgaagaagcgatcgcgaaagagaaggaaatcttcctggcgctgaacgccgacaagatcgccggcaagccggagaacatcgtcgagaacatggtcaagggccgcatcagcaagttcctcgccgaagcgagcctggtcgagcagcctttcgtgaagaacccggaagtgaaggtcggcgacctggccaagcaggccggcgccgaaatcgtttccttcgttcgttacgaagtgggcgaaggcatcgagaaggccgaagtggacttcgctgccgaagttgccgctcaagtagccgccaccaagcagtaa

SEQ ID NO: 4541 - DNA, 936 bp, Pseudomonas aeruginosa
caaagacggtttcgactgtcgccccggaagaggctgcccgctgatgcgtgcggcctcttcgtcaaatggggaagcgttcggggcagcttccgcgttgccggcccgctcggcgggctcgcacgcaacgcaggcgcaaagtcgtctccgcccacgacggcccggccgtcacgtatttttatcgccgcaggagaaaaggtcatggctcagcaactgagcgctcgtcaacctcgctataaacgcattcttctaaagttgagcggcgaagccctgatgggctcggaggagttcggcatcgatcccaaggtgctggaccgcatggcgctggaaatcggccagttggtcgggatcggcgtgcaggtcggcctggtcatcggcggcggcaacctgttccgcggcgcggccctgtccgcggccggcatggaccgggtgaccggcgaccacatggggatgctggccaccgtgatgaacggcctggcgatgcgcgatgcgctggagcgctcgaacatccccgcgctggtgatgtcggcgatctccatggtcggtgtgaccgaccactacgaccgccgcaaggccatgcgccacctcggcggtggcgaggtggtgatcttctccgccggtaccggcaacccgttcttcaccaccgactcggcggcttgcctgcgcgccatcgagatcgacgccgacgtggtccttaaggctaccaaggtcgatggcgtgtacactgccgacccgttcaaggacccgaatgccgagaagttcgagcgcctgacctatgatgaagtgctcgaccgcaagctcggcgtgatggacctgaccgccatctgcctgtgccgtgaccagaacatgccgctgcgggtgttcaacatgaacaagccgggcgcattgctgaatattgttgttggtggtgccgaaggcaccctgatcgaggagggttga

SEQ ID NO: 4542 - DNA, 1854 bp, Pseudomonas aeruginosa
acaacagttcggccgcgttgcctacgcggcgacggtcgccgtgctgatggtcgctctctaccatctgccgcagcttgccggagccgtgctgctgctggcgctggtctggtggacgctggccaccgtgctggtgctcacctacccggaaagcgtcggctactggggcggccgctggcgccgcctgggcatgggcctgctgatcctgttgccggcctggcaggggctggtcctgctcaagcagtggccgctggccaatggcctgatcatcgccgtgatggtgctggtctggggcgcggatatcggcgcctacttctccggcaaggccttcggcaagcgcaagctggcgccgcgggtcagccccggcaagagctgggaaggcgtttacggcggcctggcggccagcctggcgatcaccctggcggtcggcctctaccgcggctggtccctcggcgcgctgctcctggccctgctcggcgcggcgctggtggtgttcgtctcgatcgtcggcgaccttaccgaaagcatgttcaagcgccaatccggaatcaaggacagcagcaacctgctgcccggccacggtggcgtgctggatcgcatcgacagcctgacggcagccatcccggtgttcgcggccctgctctgggccgctggctggggtgcgccatgagtcgaccgcagcggatcagcgtgctcggcgcgaccggctcgattggcctgagcaccctggacgtcgtccagcgtcatcccgatcgttacgaagccttcgccctgactggcttcagccgcctggccgaacttgaggcgctgtgcctcaggcaccgccccgtctatgcggtggtgccggagcaggccgcggcgattgccttgcagggcttgctcgccgcggcgggtgtccgcacccgggtgctgttcggcgagcaggcgttgtgcgaagtggccagcgcgcccgaagtggacatggtaatggcggccatcgtcggcgccgccgggctgccgtcgaccctggcggccgtcgaggccggcaagcgcgtactgctggccaacaaggaggcgctggtgatgtccggcgcgctgttcatgcaggcggtcaagcgcagcggcgcggtgctcctgccgatcgacagcgagcacaacgcgatcttccagtcgctgccgcgcaattatgccgatggcctggagcgggtcggcgtgcgccggatcctcttgaccgcctccggcggcccgttccgtgagacgccgctggagcagcttgcttcggtgacgccggagcaggcttgtgcgcacccgaactggtcgatggggcggaagatttccgtcgattccgccagcatgatgaacaaggggctcgaactgatcgaggcgtgctggctgttcgacgcccagccgagccaggtcgaggtggtgatccacccgcagagcgtgatccactcgatggtggactacgtcgacggttcggtgatcgcccagctcggcaatccggacatgcgcacgccgatttcctatgccatggcctggccggagcgaatcgattccggcgtttcgccgctggatatgttcgccgtcggtcgcctggatttccagcgccccgacgagcagcgcttcccctgcctgcgcctggcgagccaggccgcggaaaccggcggcagcgccccggccatgctgaatgccgcgaacgaggtggccgtggccgcatttctcgagcggcacatccgcttcagcgacatcgcggttatcatcgaggacgtgctgaaccgcgaggcggtgaccgcagtcgaatcgctcgatcaggtcctggctgccgatcgccgcgcgcgttcggtcgccgggcaatggttgacccggcacgccggctag

SEQ ID NO: 4543 - DNA, 729 bp, Pseudomonas aeruginosa
ccagcaggtacgcccggtcatcggttccgtggcgccggagagcctggccgcccaggccggcctggaggccgggcaggagctgctggcggtggatggcgagcccgtcaccggctggaacggggtcaacctgcagctggttcgccgtctcggcgagagcggtacgctggaagtgcgggtgcaggaaaaaggctcgaatgtcgattccacccaccaggtgcgtctggatggctggctgaagggcgaggacaatcccgatcccatcgcctcgctgggcatccggccctggcggccggccttgccgccggtgctggccgaactcgaccccaaggggccggcgcaggccgccgggctgaagctcggcgaccgcttgcagagcatcgatggcatcgccgtcgacgactggcagcaggtggtggacagcgtccgtgcccgtcccgggcagcgcgtccagctcaaggtgctgcgcgacggcgaagtgctggatgttgccctggaactggcggtgcgcggcgagggcaaggcccggagcggctacatgggggcgggggtcgccggtaccgaatggccggtggaaatgctccgcgaagtgagctacggaccgctggaggcggtgggtcaggcgctttcccgaacctggaccatgagcctgctaacgctcgactccataaagaaaatgttgctcggcgagctctcggtaaaaaacttgagcgggccgataaccattgctaa

SEQ ID NO: 4544 - DNA, 1275 bp, Pseudomonas aeruginosa
cttccagttccagtccaaggaattgaacgagtcgaaggccgccgccgaccgcgacatgctgaagaaactcaagccgaagctggaccaggccgtcgaggagaccatcaagaaaggtggttacgacatggtcatcgaacgtggcgccgtggtcgacgtcaagccgcaatacgacatcacccgccaggtgatcgagcggatgaaccagctgcgttgatgatgagtaccttgtcctacaccctgggccagctggccgcgcatgtcggcgcggaagtccgtggcgacgcggacctgccgatccagggcctggcgaccttgcaggaggccggaccggctcagctgagcttcctggccaacccgcagtatcgcaagtacctgcccgaaagccgtgccggcgccgtcctgctgacggctgccgacgccgacgggttcgccggtaccgcgctggtggtggccaacccctacctggcctatgccagcctgtcgcacctgttcgatcgcaaaccgaaggcggctgccggtatccatcctaccgccatcgtcgcggcggacgccgaggtcgatccgagcgccagcgtcggcgcctatgcggtgatcgagagtggcgcccgcatcggcgctggcgtcagcatcggcgcgcactgcgtgatcggagcccgtagcgtgatcggcgaaggcggctggctggcgccgcgggtcacgctctaccacgacgtcaccatcggcgcgcgggtgagtatccagtcgggcgcggtgatcggcggcgaaggtttcggtttcgccaacgagaagggcgtctggcagaagatcgcccagatcggcggggtgaccatcggtgacgacgtcgagatcggcgcgaacaccaccatcgaccgtggagcactgtccgatacgctgatcggcaacggtgtgaagctggacaaccagatcatgatcgcgcacaacgtgcagatcggcgatcataccgccatggccgcttgcgtcggcatttccggcagcgccaagatcggcaggcattgcatgctcgccggcggcgttggcctggtcggccatatcgagatctgcgacaacgttttcgtgaccggcatgaccatggtgacccgctcgatcaccgagccgggatcgtattcctccggtaccgccatgcaaccggcggccgaatggaaaaaaagcgccgcgcgcattcgtcaactggacgacatggcgcgtcgacttcagcagctggaaaaacgcctggctgccgtgacctcaagcggtgacgcttcatctgatgcgtaa

SEQ ID NO: 4545 - DNA, 801 bp, Pseudomonas aeruginosa
aatcatctgtgcggaacgcaaactatgagtttgatcgatcctcgcgccatcatcgatccgagcgccaggctggcggctgacgtccaggtgggcccgtggtccatcgtcggggcggaagtggagatcggtgaagggacggtgatcggtccgcacgtggtgctcaagggccccacgaagatcggcaagcacaaccgcatctaccagttttccagcgtcggcgaggatactcccgacctgaaatacaagggcgagccgacgcgcctggtgatcggtgaccacaacgtgatccgcgaaggcgtgaccatccatcgcggaaccgtccaggatcgcgcggaaaccaccattggcgaccacaacctgatcatggcctatgcgcacatcggccatgacagcgtgatcggcaaccattgcatcctggtgaacaacacggcgctggccgggcatgtccacgtggacgactgggcgatcctgtccggctacaccctggtgcaccagtactgccggatcggcgcgcacagcttttccggcatgggcagcgccatcggcaaggacgtcccggcctacgtgacggtcttcggcaacccggccgaagcccgcagcatgaacttcgaaggcatgcgtcggcgcggcttcagcagcgaggccatccatgccctgcggcgtgcctacaaggtggtctatcgccagggacataccgtcgaggaagccctggccgagctggccgaaagcgctgcccagttccccgaggtcgcggtgttccgtgattccatccagagcgcaacccgcggcatcacccgctga

SEQ ID NO: 4546 - DNA, 1140 bp, Pseudomonas aeruginosa
gccatggctgacggattacgcgtagccctggtcgccggcgaggcctccggcgacatcctcggggccggactgatgcaggcgctgcgggcgcggcacccggatatcgagttcatcggcgtcggtgggccgcgcatggaggccgaagggctgtccagctattttcccatggagcgcctgtcggtaatgggcctggtcgaagtactgggccggctgccggagttgttgcgacggcgcaagcgcctgatccgcacgctcatcgaggcccggccggatgtgatgatcggcatcgacgctcccgacttcaccctcggcgtcgaacacaagctgcgccaggctggcctgcgcaccgtgcattacgtcagcccttcggtgtgggcctggcggcagaagcgggtgctgaagattcgcgaagcctgcgacctgatgctggcattgttccccttcgaagcacgtttctacgaagagcatggggtgcccgtgcgtttcgtcggccaccccctggccaacaccattcccctgcaggcggatcgcgctgcggcccgcgcgcggctcggattgccggcggacggacaggtgctggcgctgatgccgggcagtcgcggcggcgaggtcggcaagctcggcgccttgttcctcgacaccgcccagcgcctgctcgtcgaacggccgggcctgcgtttcgtgctgccctgcgccagcgctgcacggcgcgaacagatcgagcagatgctccagggccgcgagcctctgccgctgacgctgctcgacggtgcgtcccatgaagcgcttgccgcctgcgatgcggtgctgatcgcctccggcaccgcgactctcgaggcgctgctctacaagcggccgatggtggtggcttatcgggtcgccgggttgacgtatcggattctcaagcgcttggtgaaaagcccgtacatctccctgccgaacctgttggccggacgcctgttggtgccggagctgatccaggacgccgcgactccgcaagcgctggccgcaaccctcttgccgctgctggacgacggctcacagcaggtggaattcttcgatgccatccatcgggccttgcgccaggatgcctcggcacaggcggcggaagccgtcctgcaactggtggagcgccgctga

SEQ ID NO: 4547 - DNA, 813 bp, Pseudomonas aeruginosa
gttgctggagcgtcgttacgaccgcctgatgagctacggcgcgccgtaagccatccggcgcactggtacgatcgacaagcccggcattcgccgggcttgtcgcatgaggagcgcaagcatgccggcggtgccgctcgaatcccgtctgttacaggccctggcgccctggcgcgaagcggggggctggtgcgtggcgttttccggcgggctggattccacggtgttgctgcatctgctcgcccaactggcccggagcgaagccttgccggcgctgtcggcgctgcatgtccaccatggcttgcaggctgcggcggacggttggccggcgcactgccaggtggtctgccggtcgctgggtatcccgctgcgggtcgagcgggtgcaggtcgccgttggcggcagcatcgagcaggcggcgcgcgacgcccgctatcgcgcattccaggcgaacctgggcgagggacaggtgctgctcaccgcgcagcacctcgacgaccaggccgagaccctgctgttccgcctgttgcgtggagcgggcctgcgcggcctggcggcgatgccggcgagccggccgctgggcggcggccgcctgtgccgacccttgctcggggtttcccgcgccgaactggaagcctatgcgcaggcgcaccggctggactgggtggaggatccttccaaccaggatccgcgcttctcgcgcaactacctgcgccgggagatcatgccgcgtctcgcctcccactggccgcaggccgtcgccggcatggcgcgctgcgcggcgcatctgcgcgaggccgaagacctgctggctga

SEQ ID NO: 4548 - DNA, 480 bp, Pseudomonas aeruginosa
ccactgggccggctgggagtcgttgcgcgatgccggcgacgatgccgacccgatctggcgcctggagagcggcgagctgcgtcgcggcgcggggcggatctggtggttgccggcggactggcgggcggcggcgggaccgttcgtctgggagcgtcccgctcatccattgcttcttcccggcaatggtcggctggcgttgctcggcgaggttccggcggggccgttgcgcgtcgactaccggcggggtggggaggtgctggccctggccgggcgcggtcgccgcgacctcaagcgattgctcaacgaagcgggcgtaccgagcttcctgcgcggtcgtttgccgctgctcttccgagccgacgaactgctcgcggtggccaacattcctggcctggacagtccccgcgaggggggctggcgactgtcctggagcccgccgacgaacgacccgggtttgagctagtaagccgtttccagtag

SEQ ID NO: 4549 - DNA, 1644 bp, Pseudomonas aeruginosa
cttctagggtttttcatgacgcgctacatcttcgtcacgggtggtgttgtttcttcattggggaaaggcatcgcttcggcttctctggctgcgatcttggaagcgcgtggcctgaagatcacgatgctcaagctggacccttacatcaacgtggacccgggcaccatgagcccgttccagcacggtgaggtcttcgtgacccaggacggcgccgagaccgacctggacctgggccattacgagcgcttcgttcgtaccaccatgacccagaacaacaacttcaccacaggccgcgtctacatggacgtgttgcgcaaggaacgccgcggcgactacctgggcgccaccgtgcaggtgatcccgcacatcaccgacgagatcaagcggcgcatcatcaagggcgccggcgatgccgacgtcgccctggtggagatcggtggcaccgtcggcgacatcgagtcgcagccgttcctcgaggcgatccgccaactgcgcgtcgagatcggcgccaagcgcgcgatgctgatgcacctgaccctggtcccgtacatagccaccgccggcgagaccaagaccaagccgacccagcactcggtcaaggagctgcgctccatcggcctgcaaccggacgtgctggtctgccgttccgaccacccgatcgacgtctcctcgcggcgcaagatcgcgctcttcaccaacgtcgaggagcacgcggtgatcgccctggaagacgtcgacaccatctaccgcatcccgtcggtgctgcatgcccagggcctggacgacatcgtcgtcgagcgcttcggcctggagtgcgggcaggccgacctgtccgaatgggaccgggtggtcgatgccaagctcaaccccgagcgtgaagtcaccatcgccatggtcggcaagtacatggaactgctggacgcgtacaagtcgctgatcgaggcgatgacccacgccggcatccagagccgcaccaaggtcaacctgcgctacatcgactccgaagacatcgagcagcagggcaccagcctgctggaaggcgtcgacgccatcctggtcccgggcggcttcggcctgcgcggcgtggaaggcaagatcagcaccgtgcagtacgcccgcgagaacaagattccctacctgggcatctgcctgggcatgcaggtcgcggtcatcgaatacgcccgcaacgtgctcggctggagcgacgccaactccaccgagttcgacaagtccagcggccacccggtggtcggcctgatcaccgaatggcaggacgcgaccggcgccaccgagatccgcaccgaagcttccgacctgggcggcaccatgcgcctgggcgcccaggagtgccagctgcagaccggcaccctggtgcacgattgctatgccaaggacgtgatcgtcgagcgccatcgccatcgctacgaagtgaacaacaacctgctgccgcaactggaacaggccggcctgaagatttccggccgctccggcgacggcgccctggtggaagtggtcgagtccccggagcatccgtggttcgtcgcctgccagttccacccggagttcacctccacaccgcgtgatggccacccgctgttcagcggtttcgtcaacgccgcgctgaaatattccgggaaggcctga

SEQ ID NO: 4550 - DNA, 330 bp, Pseudomonas aeruginosa
aggggtggcaagagccaccccttttcttctcaaggagttcgaggcttgaggttacgtagcccctactggctgttcgtggtgctgatcctggcgctggcgggcctgcaatatcgcctgtgggtcggcgatggcagcctggcgcaggtgcgcgacctgcagaagcagatcgccgaccagcatggcgagaacgagcgcctgctggagcgcaaccggattctcgaagccgaagtcgccgagctgaagaaaggcaccgagaccgtcgaggagcgtgcgcggcacgagctcggcatggtcaaggacggcgaaaccctctaccagctcgccaagtga

SEQ ID NO: 4551 - DNA, 843 bp, Pseudomonas aeruginosa
ggcagggcgaggcgggtgcccaactggtcccaaaagatcgccaccagggttccgccgatgacgttgccgatgccgaccacccagaagtgcacctggccctccatcgagcggtacatccagccggtctcgcaaccgccggcgaggacgatgccgatgccgaagagaatgccgccgatgatcgcattcgggcccatccagaagatcttcggcgcgacgcccaggcggatcgcggcgaaggtaccgatgcaggcggccgccatgccgagcaggatgccgaaggcggcgcgggtccggccggtggtccagaggtcccgtgcggcactggtgaagcagatctgcgcgcgctcgatcaggccgccgaacagcaggccgaacaggcaggccatgcccagcaccagcgatacctcgaagcgccaggcggcgaacagcgcggcgagcgccagcaccgccaggcccaggcgggcctgcaggcgtgcgcgtcgggccaggctttcggcgctgggcagggcgctggccgtggcgccgactttcagcggtgtgcgcaggaacggcagcaggctgatcttcacgccgatccaggcgccgccgacggtggcgaacatgaaggcccaggcgtgcagggaaaacatcgggataccggtgaagaacgccgccaggttgcagcccatcgccaggcgcgcgccgaagccggcgacgataccgccgaccagaccctgcagcaggcgacgtttgctggtcggccagcgcaggctgacgttgccggcccagagggcgcagcacagggcgccgaggaacatgccgatgatcatcactccgtcgatccggtccagcggcgtgccttga

SEQ ID NO: 4552 - DNA, 2094 bp, Pseudomonas aeruginosa
aacgcggttttctacactttccgtttcagtgggtcgcttagcggcccgccggcttccatcgttcaggagttcccagatgatcaagtcccgtgccgccgtcgccttcgcccccaacaagccgttggaaatcgtcgaggtggatgtggcgccgccgcagaagggcgaggtactggtgcgcatcgtcgccaccggcgtctgccataccgacgcgtacaccctgtccggccaggattccgagggggtgttcccgtgcatcctgggccacgaaggtggcggcatcgtcgaagcggtgggcgagggcgtgacctccctgcaggtgggcgaccatgtcatcccgctctacaccgccgagtgcggcaagtgcaaattctgcctgtccggcaagaccaacctctgccaggccgtgcgcgccacccagggcaagggcctgatgcccgacggcaccagccgtttctcctacaagggcgagccggtcttccactacatgggctgctcgaccttctccgaatacaccgtgctgccggaaatctccctggcgaagattcccaaggatgccccgctggagaaggtctgcctgcttggctgcggcgtcaccaccgggatcggtgccgtgctgaacaccgccaaggtggaagagggcgctaccgttgccatcttcggcctgggcggcatcggcctggcagcgatcatcggggcgaagatggccaaggccgcgcgcatcatcgcggtcgacatcaacccgggcaagttcgatatcgccagggaactgggcgccaccgacttcatcaatccgaaggactacgacaagccgatccaggacgtcatcgtcgaactgaccgatggcggcgtcgactactccttcgagtgcgtcggcaacgtgcagttgatgcgcgccgcgctggaatgctgccacaagggctggggcgagtcggtgatcatcggtgtcgccggtgccggccaggaaatcagcacccggccgttccaactggtcaccggccgcgtctggcgcggttcggcgttcggcggggtgcgcgggcgcagcgagctgccgagctatgtcgagaaggcgcagaagggcgagatcccgctggataccttcatcacccacaccatggggctggaggacatcaacgaggccttcgagctgatgcacgaaggcaagagcatccgcaccgtcattcattactgacaagccgtcgcggcgggccctgcggctcgccacgaccgtttcacggaggtcacgtgaaggattccctcgaactgatcggcagccagaagaccttcggcggctggcaccagcgttaccgtcatttttcccggaccctgaactgcgagatggtcttcgccatctacctgccgccccaggccgagccggaggcggcgctgccggccctgtactggctgtccggactgacctgtaccgacgagaacttcatgcagaaggccggcgcccagcgggtcgccgctgaactgggattggtactggtggcgccggataccagcccgcgcggcagcggtgtccccggcgatcccgacggcgcctgggacttcggcctgggcgcaggcttctacctgaacgccacgcaggagccctgggccgcgcactaccgcatgcacgactacgtggtacacgagttgccggcgctgatcgaggcgcatttcccggtgtcccggcggcgcggcatcagcgggcactcgatgggtgggcatggcgcgctggtttgcgcgctgcgcaacccggggcgctacctgtcgctgtcggccttcgcgccgatctgccatccgagcgattgtccctggggccagaaggcgttctcccgctacctgggcgaggacccggcggcctggcgcgagtgggatgcctgtgcgttgctcgagggtgcgtccgaacgcttgccgatcctggtcgaccagggcgagcgcgacgacttcctcgccgtccagctcaagccggaagcgatacgcaatgcggcggacaaggccggccacccgctggagctgcgtctgcaaccaggctacgaccacagctactacttcatcgccagtttcatcgaggatcacctgcgccatcatgccggggttctcaacggttga

SEQ ID NO: 4553 - DNA, 1572 bp, Pseudomonas aeruginosa
aatcacgccctgattccaaccagggcgttttttcatgcgaattggccatggctacgacgtgcatcgcttcggcgagggcgacttcatcaccctcggcggcgtgcgcattccccacaaacatgggctggtcgcccactccgacggcgacgtgctgctgcacgccttgtccgatgcgctgctcggcgcggcggcgctgggcgacatcggcaagcacttcccggacaccgacccgcggttcaagggcgccgacagtcgcgcgctgctgcgacacgtggtcgccatcgtcgccgagaagggctggaaggtcggcaacgtcgacgccaccatcgtcgcccaggcgccgaagatggcgccacacatcgagaccatgcgcgggttgatcgccgaggacctcggcgtcgcggtcgaccaggtcaacgtcaaggccaccactaccgagcggctaggtttcaccggacgcgaagagggcattgctgtacatgcggtcgctttgctgatggcccgatgagcgttctcggcgaactcgacctgctcgggccgcgcgcccatggggcagcctgcggcgaggcggtgctcaaggccgtggccgaggacttccaggtcgacgaggtgctggacattcccctcagcggtgaaggcgagcacctctggttgtgggtggaaaagcgcggattgaacaccgaggaggcggcccgtcgcctcggccgcgccgccggcgtgcagcagaagaacgtcagctacgccgggttgaaggaccgccaggccctgacccggcaatggttcagcctgcacctgccgggcaaggccgatcccgacctgggtgcagccgagggcgcggacctgcggattcttcgctgcacccgtcattcgcgcaagttgcagcgaggcgcgcatgccgccaacggcttcaccctgcgtctgaccgggctgcgggcggagcgtgcccttctcgacgcgcgcttggaacgtatcgccgcggacggcgtgcccaattatttcggcctgcaacgcttcggccacggcggcggcaacctggtcgacgcgcgcagttgcgcggaacaggacctgctgccggcgaaccgcaacctgcgttcgcgcttcctttccgccgggcgcagctacctgttcaatcgcctgctcgccgagcgggtcgcggagggtagctggaaccgggcagcggtcggtgacctgctggcctttaccgacagccgcagctttttcctcgctggcgaggaagaatgccgcgatgcccgtctggccgccctcgacctgcaccccaccggaccgctctggggcgagggcgatccgccgagcggcgccggcgtcctcgaacgcgagctggccctggccgggcgcgagccggcgctctgccgctggctggcgaaggcgggcatggcgcacgaacggcgcatcctgcggctccccatccaggggctggcgtggcattatccggaacctgatgttctgcaactggaattcgtcctgccggccggttgtttcgccaccgtagtggtgcgtgaaatcctcgacctggtaccgacagggcagacggaaaacccatgcgcatactga

SEQ ID NO: 4554 - DNA, 1080 bp, Pseudomonas aeruginosa
gtgagcgggtccgggcgtgtccagcgggaaaggaatcgcccgggcttgagtcgaactcatgcaagggataacgacatggcactcaaaaaagaagggccggagtttgaccacgatgatgaagtgctcctcctggagcccggcatcatgctggacgagtcgtctgccgacgagcagccttctccccgggcaactccaaaagccaccacttccttctcttccaaacaacacaagcacatcgactacacgcgcgcgttggacgcaacgcagctgtatctcaacgaaatcggtttctcgcccctgttgacgcccgaagaggaagtccacttcgctcgtctggcgcagaagggcgatcccgctggtcggaagcggatgatcgagagcaacctgcggttggtggtgaagatcgcccggcgctatgtcaatcgcggactgtccctgctcgacctgatcgaggaaggcaacctaggcctgatccgcgccgtggagaagttcgatccggagcgcggattccggttctcgacctacgccacctggtggatccgccagaccatcgagcgggccatcatgaaccagacccggaccattcgcttgccgatccatgtggtcaaggagctcaacgtctacctgcgtgcggcgcgggaactgacccacaagctcgaccacgaaccttcacccgaagaaatcgccaacctgctggagaagccggtcgccgaggtcaagcgcatgctcggcctgaacgaacgggtgacttcggtagacgtctctcttggtccggactcggacaagaccctgctggatacgctcaccgacgatcgccccaccgacccgtgcgagctgctgcaggatgacgatctcagcgaaagcatcgaccagtggctgacggaactcaccgacaagcagcgtgaggtggtgattcgccgcttcggcttgcgcgggcacgaaagcagcacgctggaagaggtcggccaggaaatcggcctgacccgcgagcgggttcgtcagatccaggtcgaggcgctgaagcgcctgcgggagatcctggagaagaatggcctgtcgagtgacgcgctgttccagtga

SEQ ID NO: 4555 - DNA, 2685 bp, Pseudomonas aeruginosa
cagatcgagagcttgccgcgggctgatatcgtcgggattgatcctcgacaattcatcgatcaccgggtgcggcaggctggcgaacaggtcgctctgcatcggcgaggcgggcttgccgctctgctggctcggcatctcgtgcggcaggctggtggtttccaggcgcttgaggtgttcgcgggcgcgctggattaccggggccggcacgccggccaactgggccaccgcgaggccgtagctctggctcgccggtcccggcagtacatggtgcaggaacacgatgcgttcattgtgctcggtcgcgttcaggtgcacgttggctaccgcgggctggctttccggcagtacggtcagttcgaaatagtgggtggcgaacagggtgaaggcgcgagtccgggccaggtcctcggccgctgcccaggccagcgacaggccgtcgaaggtgctggtgccgcggccgacctcatccatcagcaccaggctcttgtcggtggcgttgtgcaggatgttggcggtttcgctcatctccaccatgaaggtcgagcggccgccggcaaggtcgtcggacgagccgatgcgggtgaagatgcggtccaccagggacagctcgcagcgtgcagccggaacgaagctgccgatgtgcgcaagcagcacgatcagcgcggtttgccgcatgtaggtggatttaccgcccatgttcggaccggtgatcaccagcatccgggtgtcggcatccagcgccaggtcgttggccacgaacggtgtctccagcacctgctcgaccaccggatggcggccttgctcgatgtgcaggcaggtgtgttcgacgaaccgcgggcgattcaggtcgaggttcagcgcgcgttcggcgagattcgccagcacgtccagttccgccagcgccgaggcgctgtcctggagcggagcgaggtggccgatcaggcgttccagcagctcttcgtagagcgccttctcgcgggccagggcgcggctctgggccgacagcgccttgtcctcgaaggccttcagttccggcgtgatgaagcgctcggcgcctttcagggtctgccggcggatgtagtcggccggcgcctgttcggcctgcacccgtggcagctcgatgaagtagccatggatgcggttgtagccgaccttcaggttgggcaggccggtgcgggccttctcgcgcgcttccaggtccatcaggaattgcccggcgttttcgctcagcgcctgcagctcgtccagctcggcgtcatagccggtcttgatcacgccaccgtcgcggatcaccgctggcgggttgtcgatgatcgccttggccagcagttcggcgagttcgggataggtgccgatggtggtggccagcgcctgcaggtgcggcgcttccagttcggtcatggcgttctgcaggtccggcagcgccgccagcgcgtcgcgcaggcgcgccaggtcgcgagggcgggcgttgcgcaggccgatgcgggcgaggatgcgttcgaggtcgccgatttccttgagctgcggttgcaggttctcgaagcggtagcgttccagcaggcaggcgatggactcctggcgggcttccagtaccgcgcggtcacgcaacggacggttcagccagcggctcatcaggcggctggccatggcggtctggcagcggtcgaccaccgattgcagggtgttctcgcggccaccgctgaggttgatatccagctccaggttgcggcggctggcaccgtcgaggatcaccgtgtcatcgaggcggtcgtggcgcaggctgcgcaggtgcggcagggcggtacgctgggtttccttggcgtaggcgagcaggcagccggcggcgccgatggccagggtcaggttctggcagccgaagcctttcaggtcctgggtgccgaattgctggcagaggctcttgtgcgccgagtcgcgatcgaagtcccatggcgcgcggcgacgtacgccgcggcgcttctccgccggcaggccctgtggccagtcgtcgggaatcagcagctcggccgggttgaggcgctccagttcggccagcagggtttcccagccttttatctcctggacgctgaagcggccgctggtgatgtccagcacggcgaggccgaacaggcgctcgtcgccgaggatcgccgccagcaggttgtcgcggcgttcgtcgagcagcgcttcgtcgctcaccgtaccgggagtgatgatccgcaccacttggcgctccaccggccccttgctggtggccggatcgccgatctgctcgcagatcgccaccgactcgccgagcttgaccagcttggccaggtagccctccgcggaatggaagggaatgcctgccatcgggatcgccttgccgccggactggccgcgtgcggtcagggtgatgtcgagcagtttggcggccttcttcgcgtcctcgtagaacagctcgtagaagtcgcccatgcgatagaacatcaattggtcggggtgctgatgcttcagtttgaagtactgctgcatcatcggcgtgtgctgggagaggtcggtcatacgggccttcggaagcgggctttggacggtgcaaaagagggtaatgttaacccgattcgccggcctgtgtcgggtccgttcggaaccggcgcggaccctcaggtccgcgcctgtgcgggctgctttcagcgtgccgcggtatag

SEQ ID NO: 4556 - DNA, 1197 bp, Pseudomonas aeruginosa
gcaacggcgagaacccgggctagccgcgtctgcgggcaaccgttcggaacattcttcccgtcgggggtaggcgagcgacttgccctgtggaataatactgtctacttatacagttgttcgtggccgtccggccgccctgacttcgcgaggacttcaatggacgagaacaagaagcgcgccctggccgcggccctgggacagatcgaacgccaattcggcaaaggcgcggtcatgcgcatgggcgaccatgagcgccaggcgatcccggccatctccaccggctccctgggtctggacatcgccctcggcatcggcggcctgcccaagggccggatcgtcgagatctacggtccggaatcctcgggcaagaccaccctgaccctctcggtgatcgccgaggcccagaaacagggcgccacctgtgccttcgtcgacgccgagcacgcgctcgatcccgactatgccggcaagctgggcgtcaacgttgacgacctgctggtctcccagccggacaccggcgagcaggccctggaaatcaccgacatgctggtgcgctccaacgcggtcgacgtgatcatcgtcgactccgtggccgcgctggtacccaaggccgagatcgaaggcgagatgggcgacgcccacgtcggcctgcaggcacgcctgatgtcccaggcgctgcgcaagatcaccggcaatatcaagaacgccaactgcctggtcatcttcatcaaccagatccgcatgaagatcggcgtcatgttcggcaacccggaaaccaccaccggcggtaacgcactgaagttctacgcctcggtccgcctggacatccgtcgtaccggcgcggtgaaggaaggcgacgaggtggtgggtagcgaaacccgcgtcaaggtggtgaagaacaaggtttccccgccgttccgccaggccgagttccagatcctctacggcaagggcatctaccgtaccggcgagatcatcgacctgggcgtgcaattgggcctggtcgagaagtccggcgcctggtacagctaccagggcagcaagatcggccagggcaaggcgaacgccgccaagtacctggaagacaatccggaaatcggttcggtactggagaagaccattcgcgaccagttgctggccaagagcggcccggtgaaggccgacgccgaagaagtggctgacgccgaagccgattga

SEQ ID NO: 4557 - DNA, 1272 bp, Pseudomonas aeruginosa
cgctggacggtgggcgaagtgaccgacccagtcgagcagctgcgattgcccggcgtgggcggagaagccgccgagggtatggatctgcgccttgaccgcgatgcgctggtggaacacgcgaaccgcgctggcgccgtcgacgatgttgcggcccagggtgccgcgcgcctggaagccggggaataccacatggcattccgggcgccagaggttgtgcttgaagtgatggacgatacggccgccggtgcacatgccgctgccggcgatgatgaccgcgccgctcttgatccggttgatcgccatcgactcgtcggcgctgcgggttacgcgcagcaccggcagccattcctccaggcgggtggtgccggtgccgcgaatgtactcgcggtcgcggtcgtcgaactcgttgctgtggcgcaggtagatgccattggcacgggcggccatcgggctgtcgaggaataccgcctgttgcggcaggcggccctcctggtagaagcggccgaggtagtagagcaggtcctgggtgcggccgacggcgaacgacgggatcagcacgttgccgccgtcgcggtgcgcctggtcgagaatcgccgccagttcctccagggtgtcgttgctgtcgcggtgatcgcgatcgccataggtggattcgagcatcaccacgtcggcccggctcagcggcgagggcgcgcgcatcaacggcgagcaggtgttgccgaggtcgccggaaaacaccaggcggcgcggttgcacctggtcgtggaattgcacttcgacgatcgacgagccgaggatgtgcccggcgttgtgaaaggtcacccgcacgccacgagcgaccgccacggtgctgccgaggctgatcggccggcgcagcttgagcgcgcgttcggtgtcggcctgggtatacagcggcttgatgctcggcttgccgatccggttgcgccagcggttctcccagtcggcgtccttttcctggatgtgcgcggagtccagcagcatgagttccagcagttcgcaggtggcctcggtggcgaagatcgggcccttgaagccctcggccgccaggcgcggcagcaggccgctgtggtccaggtgggcgtgggagatgaccaccgcgtcgatgctcgcgggatcgaaggggaagggcgcgcggttgccgttgtcggcttcgcggcgcccctggcgcatgccgcattcgagcaggaccttcacgccatcgagggtttccagcagataacaggagccagtgacctcctgggcggcgcctag

SEQ ID NO: 4558 - DNA, 675 bp, Pseudomonas aeruginosa
tcgccaatggccggcgcatcgagcagcgcaccgaactgggcacccatgaggggctggagggcttcaagctgcacctgcgccgctgcggcttcgatccgatcagcttcgatgggcgcgacccggccgccttcgtctgtacgctctgggagatggagcagcgcctggagcggcgcgtgcaggagaagaacagcggcatcctccgctacccgctgccgattccctacggcatcgccgagacggtcaagggcttcggcttctatggcgccggcaacaacgccgcgcacaacctgccgctgccgggcaatccgcataacgacgaacaggcccggcaactgttcaaccagcatgcaaacgaactctgggtcgagcctgaggctctcgaattggcccgccggctgttcgccgagcagcgcggcgagcgtcccctcgaacgggacaacccgctggccctgcgccatcccatcgaaccgatcatcccgccgctgcgctatcgcgacgacgcctgctcgccgatggccgcgctggaccgcttctataccgaactggtggaggccaaccccgacctgcgcgcccgggtcggcaatcccgacgaattggccagcaaccgcctcggcggcgtgctcaaggcgctcaagcatcgggtcagcgagccggagagcgaactggaatcggtga

SEQ ID NO: 4559 - DNA, 432 bp, Pseudomonas aeruginosa
aggagtacagcaccacgatcaccagcggtacgtagaggaacaggtacaccagcgcggtggcgctccagagcaggtagggcctacgcatgggcgcctcccttgcgggcgcgcgcggcgcccatgccgagggcgaccagcagcaggatgcagccggtcagggcgatcgacagcgcgctgccgaacggccagtcgcgggagtcgaggaactggctcttgatcaggttgccgatcatgatgccgtcggtaccgccgaccaggtcggggatggcgaacattcccagcaccgggatgaataccagtgccgcgccggcggcgagagcgggaaggtcacccgccagaagcgttgccaacgaccggcgccgaggtcctgggcggcgtccagcagggccgggtcgtgtttctccaggttggcgtagagcggcaggatcatga

SEQ ID NO: 4560 - DNA, 273 bp, Pseudomonas aeruginosa
ctctggaacaccgtatgcaccgggcgcttctccggctcgacgccggcgaggtcctggccgttgaggcggatctcgccgctgtccggctggtcgaagccggcgagcatgcgcaggagggtggtcttgccgcacccggaagggccgaggagggtgaagaattcgccggtgttgatcgtcaggctgacattgtcgacggcggtgaagtcgccgaagcggcgggtcacgttgcggatctcgagcaaggggggcgtcattcgtctggagaggcagtaa

SEQ ID NO: 4561 - DNA, 1626 bp, Pseudomonas aeruginosa
ccgcgcaggtgcagggtctcggcgaggaacagggcgccggcgatggcggcgaacaccgcttccagggacaggatgatcgccgcatgggaagcgatggcgtgcttctgcgccaccacctgcagggtgaagccggtgccgacgccgagcaggccgccgtatagcagggcgggaccggcctggacgatggcgtccccagtggatttcctcgaagaccagtgccagcagcaggctgaccgccgcgcaggtggcgaactgcaggaaggccaggcggatcgggtcgtagcggctggcgaacaggcctaccagcaggacgtgcgcgccccagaccaccgcgccggccagttgcagccagtcgccggaggcgacctggaagcccgggccgatgctcagcagggccatgccgagcaccgccagcgacgcccccagccaggtgcccgcgccggtgcgctggccgaacagcaggccgagcaacggcacgacgatcacgtagagcccggtgatgaagccggagttggtcacgctggtgaacagcaggccgacctgctgcaggttgatcccggtggtcagggcgacgccgaggatcacaccggcgagcaactgtccgcgattgaagggttgcgcgccgtcgcgtcgcgagcgcagcatcagcagtggcaccagcaccagggcaccgaggacgaagcgcaggccggtatagaggaacggcccgatggcgtccatccccaggcgctgggcgacgaacgacaccccccagatcatggcggtgatcagcatcaggacatcggcacgcagggcttggcttcgcatggctcgctcgacggggcggggagggtccgccactctgccagcaagccggggtgtttgaaaagacgaacgcggtgtacgaggtatccctcattcggcttgaccggtccgccctcggtcggcatcctgagcgccgcctcggctgggccgaacaaactaggacatgtcatggcttcttacgagatcctgatcgccgacgatcaccccctgtttcgcagcgctttgcaccaggccctcaccctcgggctgggccccgacgtgcgcctggtggaagccgccagcatcgccgaactggaagcgcggctgaacgagaaggccgattgggatctggtcctgctggacctcaacatgccgggggcctatggcttctccggcctggtgctgttgcgcgggcaatacccgcaggtgccggtggtgatgatctcggcacaggaggaggccgcggtggtgcagcgctcccgcgagttcggcgccagcggcttcattcccaagtccagtccgctggaaaccctgcagcaagcggtgcgcgcggtgctcgacggggacacctggtggccgccgcaggatgccgccgccgaagccctcagcgaggaggccaaggccgccagcgccgggctcgccagcctcaccccgcaacagttcagggtactcaccatggtctgcgaagggttgctgaacaagcagatcgcctacgacctgaacgtttccgaggcgacggtgaaggcccacgtcacggcgatcttccgcaagctcaacgtgcgcacccggacccaggccgcgctgctgctgcaacaaatggagacggttcccgcttctcattga

SEQ ID NO: 4562 - DNA, 864 bp, Pseudomonas aeruginosa
tgcagctgcgagaacaggcggatctcggtgtcggtgatgcgtcgcaccaggtgcttggcttcgagctgcgagggatgttccaggcccgccgcggcgagcatctcggccaggcccttgagggtgttgcgatggaagttgcgcacccgctcggccttgtccggcaccaccagcgcgcgctggcgcagcgggtcctgggtggcgacgccggtcgggcacttgttggtatggcagctctgcgactggatgcagccgatggcgaacatgaagccgcgcgccgagttggcccaatccgcgccggtggccaggacgctggcgatatcgaaggcgctgacgatcttgccgctggcgccgaccttgatcttgtcgcgcaggttgaggccgaccagggtgttgtggacgaacagcaggccttcgcgcagcggcacgccgatatggtcggtgaactccagcggcgccgcgccggtgccgccttccttgccgtcgacgacgatgaagtcggggaggatgccggtctccagcatggccttggcgatgcccatgaactcccatggatggcccaggcagaacttgaagccgaccggcttgccgccggacagttcgcgcagctgggcgatgaactgcatcagctcgatcggcgtggagaaggcgctgtggcgcgacggcgaaacgcaatcctcacccatcggcacgccacgggtggcggcgatctcgggggtgaccttgtgcttgggcaggataccgccgtgtcccggcttggcgccctggctgagcttgatctcgatcatcttcacctgcgggtcgagggcctgggcggcgaagcgctcagggtcgaacttgccatcgcgggtgcggcacccgaagtag

SEQ ID NO: 4563 - DNA, 972 bp, Pseudomonas aeruginosa
cgctcgccgacgaagcgttcagccggcccagcccagcaccagcgcagccaggacgaggtagcggagcgtcttggccaggccgacgatcagcaggaaactccagcagggctcacgcatgatgccggccaccagcgtcagcggatcgccgatgaccggcacccaactgagcagcagggtccagcggccgtagcggcgatagtgtcgctgcgccctgagcaactgcacctcgcccacgggaaaccagcggcgaccgcggaaatgctcgaggtagcgacccagccaccagttgacccaggaacccagcacattgccgacgatggccagcgccagcagccacgcgaccgactggccgccgcgcagcagcaaggcggccagcacggtttccgactgcaacggcagcagggtcgccgaaccgaacgccgagaggaacagcccggcgtacgcggcccagtcagtcaacacccgaacgctcccagcgccattcgcatccccactccaatccggaaaaaactgacctgggacagccgtcccgaggccggcgaagcataccctggcaggcaagggcatttccccggttatccgaaaaggaggcaggccatgttcattcccggccatctgcatctcgcctcggccagcgaagtcgaccgccaggcattcgatatccacctgcgctaccgggtcctggaggccgaggcccgcccggtggccgtacacttcgacatggagggccggatcgacggccagcctttcagcgaaagcttcgaactgccgcgcgacgccgccgtgcatttcgccagccgtgccagtcgcctggcccggcgccacggcctgcgcttgcggcagggaccgatcgtgcgccagcgccgcgagtacgacgctatgttcgacgacctgcgccgacgcctgaaactcaagagcggcgaagcgatcgacctcgaccgctacctgcgcggcgaggccggggcatcctga

SEQ ID NO: 4564 - DNA, 933 bp, Pseudomonas aeruginosa
cagaaaaagtcagcagctttcagatctgctgataggagaattgctatgaacttttccagcgataccatcgagctgttcctcgccgtcctcgaccgcggctccttttccggcgccgcccgtgccttgggtcgagtgccttcggcggtgagcatgggcatcgccaacctggaggcggagctgggtttcgcccttttcgagcgaacccaccgcgaagcccgtcctacggcgctggccagggccctggcaccgcaagcgcggatgatcgccgagcagctcgcccagttgcaggtgcatgcgctggaactctcccagggattggaaagccgcctgtcgctcggcgtggttgcggacatcgacagcgggcggctgttcggcgccctccgcaccctttccgagcgctacccgctgctcgatgtcgaggtgctcagcgcggcgcaggacgatgccctcgccctgctccatggcggccgcatcagcctgtgcttcggattcgccggcatcagcgtgaacccgcaggagcgcttccagtatgtcggcgcggaatcgctggtcgcgaccatctcgccgcgccatcccgccctgcagaagccggggcaggcgctgtacctggaagagctggtgaacgtgcggcagatcctggtcgccagttgcgacctaccgttggccgacacccgtccgctgattgccggcgcctgctggcgcaccgacagcctgggcacggcgctggaaatggtcgaggcggggatcggctggggcaatttcccgttgtcccgggtcgcgccgctgctggcaacgggaaggctggtacgcctggacttcaggaataccaagaacgagctgaaactgcctgtccacgctatctggctgaaaaaccagccattgcgcaaggccgcccaggaactggttggcatgctggccacccgtcccgattga

SEQ ID NO: 4565 - DNA, 441 bp, Pseudomonas aeruginosa
gaccgaccaccaggccggcgacggcaagggcaaacaccagcagggccttggcgagttcgagatgatgggcgttcatgggcttacctgtcggagggaaagcctgacgctagacgccgaacattgcagttgtgcaatcagtcccggtccgcttgcggcgaaaccgctccgctcgccgaaagcaggcccagcgcatgctccagcgccgcatccaggaccttgtcgcgcgccacctcgctcgcctgggcacgcgcgagaagcaccgcgccgaccgacaagcaggtgagcacccaggcccggttctcgtcgcccatcagttcggccagccgccgttgccgctgttccagggcgcgttcgaaggtttcccgcacctcgggccctgcccggcccacctcggcggccagcgccggaatcgggcagcccatgtcggcatgctgcgcatga

SEQ ID NO: 4566 - DNA, 444 bp, Pseudomonas aeruginosa
ctgcccttgcggcgccccagcaacaccttgccgtcccgcaagatcaggacgcccacgcctacctgcggtgccggcatcgtcgtactcctgcttcgggatcagagatggagcgtaccgctcatgtacaacgccgccttgccggagatgaccacccgctcgccgcgcacgtcgcattccaggcgccccttgcgcgccccgccctgctcggcgctcagccgggtcttgcccaggcgctgcgcccagtacggcgccagggaggtatgcgcggaaccggtcaccgggtcttcgttgacgccgacgttgggcccgaaccagcgcgagacgaaatcgaagcgctggctgcgcgcggtcaccgccaccccgcggcacggcaagcccttcagccgggcgaagtcaggcgccagggcggcgatcgtcttttcgtcgtcgaccaccacgaggtaa

SEQ ID NO: 4567 - DNA, 435 bp, Pseudomonas aeruginosa
tcgacccgagcccgcggcttctggatctccgggaaggacgccagctcaatcgactgtcgatcctggccgaaggatatctccagctacgcagcctcaccgagcacacccgcttcctgcgccaggagatcgaccgggagcagcgcaagtcactgctcgaccccctcacccaattgtggaaccgggccggcttccacgcgctgcaccagcatgaactggagttggcgcgggccagcgaccagcgcatcggcatcatctacagcgatatcgaccatttcaaacgtatcaacgacaccctggggcaccgggccggcgacagcgtcctccgcgaggcggcttcgcgactgcgcgcggcgctgcggccggaagatctcctggcgcgtttcggcggcgaggagttcgtggcgatggtccgggtccgcgagaccacggaactga

SEQ ID NO: 4568 - DNA, 258 bp, Pseudomonas aeruginosa
cctacacccacgtcgccggcaaggtcctggccgaagccctgcgcggccaggccgagcgcttcgacgctttcgccggcctgccgcactaccccttccccggcggcaagctgttccgcgtaccgttcaccgccatcggcgcctggtactacagcctgcgcgacaagctcggggtctagtccgcgtcgacagaacggcaccccggggtgccgttttttccatccgctcctcaaccttcgctacggatctgcgcatgactga

SEQ ID NO: 4569 - DNA, 726 bp, Pseudomonas aeruginosa
aacccggctattagtcctggaaggcgaggcttggttccgcaacgcccacctttcctgagtatcgtcccgatcgccgttttccgccgcctcggcgccgatgcccgcccctctggcgagacgacgacccgccgcccccaggcgacgaaacggcgtccgcctttatgcaattcgcatatactccggctcgccgcgagaaaaccggagcatgcgcgatctcggcgacatcgacgcatatccccgccgcagcctcgtacacggcgtcgaaaccgcgcgccgccccggacgacagagcctccggcacggcgaaaactaaggattcctgagcttccatcttgtccagatttgcccaaccttgagcgagcgggccaacgggacgggagttgtatggatgctaggtacccggctaaaagccgcaagaatcagagcgggatactcgcagaaacagttgggcatgctggtgggaatggacgagttttccgccagcgcacggatgaaccaatacgaacgcgaacggcactcccccaacatgcggacttccgaacagctggccatggtcctccaggtccccatggcctacctctattgccccgaggacgagctggccgagctcatcctcaaggtgtccagcctgacacccgagttcaagaaagagctgacgcgtttcatcgaacagttgctcgcggcccagggatcaaccagccgccagcctgtacgcacaaggagtga

SEQ ID NO: 4570 - DNA, 345 bp, Pseudomonas aeruginosa
actgtgaacaaaagcttggattcagactcgataaccaccgccataatggccctgcgtcgcctacgcgacacgcacccggagcagtaccgggagctgctgccgttgtgcgcctcggggctggtggagaccctggtcggacagagcgacggggacgaccgcaggaaggccgagacgcagagcgagaccatcgcccgctggacctggctgcagttgctcggctgggcccagaacaacagcctcagccagcagcagatcgaaagcctctacagcatcgtcgaaggcatccgcagttgccggccgctgatgcaggagcgcgcccgtctcctgcaactggcgcgaggctga

SEQ ID NO: 4571 - DNA, 276 bp, Pseudomonas aeruginosa
ggtggcatcggcgaacttcttgaactgccaggccggtccgcccatataggtggggctgccgtagacgatggcatcggcttcgacgagccgagcaacttcgtccagttcttcaagcgcgaggacggccaggtgcgccgaagccttccgccgcgaacagcatggcggccgaacgccagccttgccgcagcgcacagagcgcacgtgacctggcgcccgcagcgctccggcctgattcgcagtttcgtcacgccggcgcgcggcctggcgcaaatgtga

SEQ ID NO: 4572 - DNA, 585 bp, Pseudomonas aeruginosa
tcgacgagaacgacatcgccgcgcgtagcgacccgcacggcgatcatgtcgacgcgccgctcgccgagctgccaccgatgccgccgcccgcccagggctgagcccaccttcccagcatgtttccccagcggtgccctcggggcgccatggcttcctattgtccgaacacaggcaacccatgaagaaatccctgctatgctccaccctagccctggcggtagcctgtgccgcccaggccgcgccgaagaccgtcgacatcatggtcgtctacaccaccgcggcgacccagaccgcaaatggccgcgacatcgatgcgcggatcgccagctacatcgagttcgccaacaccgcctacgagaagagcggcgtcaacctgcgcctgcgtctggtgcacaagcagcgcctggactgggccgactacccgacggtgaccggcgccaacctcgatcgcttcatgcgcgacccgcaggtgcagcgcctgcgcgagcagtacggcgccgacctggtcagcctggtcaaccgctcgcagaacagcggcaacggctacatcacctgcggcatcggctacatgggctcgggcgataa

SEQ ID NO: 4573 - DNA, 621 bp, Pseudomonas aeruginosa
aaccgtgcgcatggcgctgctcagcgaacgcgccgatggcgccctggcctacaacccggcgcagagcgtcgaactgtcggtcagcggcaacgagttcagtcgcctggagaagaccttcgactaccgtcccgccgccgaccagcgcaacctctacgtggcggtctggagcgacagcggcgccagcctgctggtcgacgagatgaacctgcaggaagcccaggccgcgccgccgagcgtaccgccggcgccgaaacgcatcgcctacgacttcgagagcggcatcggcggctggagcggcgtgcatgccagcgcccgcgccacgcgcgtcgccagcgccgggcggctggccctggaagcctaccagcggcgctacgccggcaccggcgcgagcaccagcctgctgggcaacctggaagcaggccggacctacgcgttcagcgcggacgtacgggtcggcgacggtcgcggctcgcaggccatgacctatgcctacctctacctggaaagccagggtcggcccggcgaatacctgcccctgggctacaaggtggtcgagaatggccgctgggccatcctgcgcggccaggtgcaattgccgaaggggccgatcaagcgtgctga

SEQ ID NO: 4574 - DNA, 615 bp, Pseudomonas aeruginosa
tcacttcggtttccctcgtttccgaggggcctgcccaccttcccaggagtacccccgatgacaagcgaccgcctggccggctacagccgcctgatggctaccctgaccctgctgttgatcgccggcatgctgctgctcaacgccgcgtgctggatcttccccgaccttgccagcgagcacggcctcggtttcgctctcaccgccaccggtgtcgccggcgacctcggcgttgtggcgcgggacatgccgctctggcaggccctcggcggcatcctcctgtcgagcctgccgctgctggtcctggccagtggactgcaggcgctgcgaaggctgttccagcactacgggcgcggcgagtatttctgcgaagacgccgcggcgctgctcggcaaggtcggcctgtgcctggcttgctgggtgctggcgaacttcctgctggaaccgctgctgacagtctgggtcaccttcctccaaccccaggggcaacgcatcgtcagtctcagcttcggttcggcggaactggtcagcctgttcgccgccgcctcggtgatggtgatcgcgcgcatccagcgcaaggccgccctgctcgccgaggaaaaccgccagttcgtctga

SEQ ID NO: 4575 - DNA, 552 bp, Pseudomonas aeruginosa
gcaactaccttggctatccggttcatgcgcccgacggcaccccgtacggcaccgtctgcgtactcgacagccgaccgcgcgactattcggccgaggaacgagccctgctggaagaattgcggcgcaaggtcgaggcgctgctggcggaaaccgtctcatgacctaaggtcaatcggataccgcggcgcacaaccgcgccgcctccgcccgccagacgaggaccttccgtgcacgcccgccgcctgccccgcctcttgccgctcgccctcgccttcctgctttcgcccgccgccttcgctgccgacacgccagccgccgagctgctgcgccaggccgaagccgaacgcccggcctacctcgacacgctccggcaactggtcgcggtggacagcggtaccggccaggccgaaggcctcggccagttgtccgcgctgctcgccgaacgcctgcaggcgctcggcgcgcaagtccgcagcgcaccggcgacgccctcggccggcgacaacctggtggccaccctcgatggcaccggcagcaagcgcttcctgctga

SEQ ID NO: 4576 - DNA, 918 bp, Pseudomonas aeruginosa
tccgcgagctgtccgccgactagcgccgacgcccgcagccagcctcaggtacggaagcgaccgagcaccacgcgcaagccagccatgtgctccttgaccctctggttggccgaaagcactgcggcggtcccttcgtgggcctgctcggagagtccggagacgttggtgatgttgcggtcgatgtcctgggccacctggctctgttcctcagcggcggtcgcgatctgctggttgaggccgtccagttcttccaccgtggcgacgatgcgccccagcgcctgggccgcgctgtcggcctcgacgaggttgctctgggcatggctggcgctaccgcgcatggcggcgaccgcatcgttggcgccgtcctgcaactgctcgatcaacccctggatctcctgggtcgactgctgggtacggttggccagcgaacgcacttcgtccgccaccacggcgaagccgcgcccggcctccccggcccgcgccgcctcgatggcggcattgagcgccagcaggttggtctgctcggcgatgctgctgatcaccgtaagcacctggccgacactgccggcatgctggtgcagggtgttcagcgccagggcggtctgttccagttcctccgccaacgcaccggtctggctgctggcgtgctccaccagacgccgtccctcgtgggccagggccgcggcgtcgcgcgtggagtgcgccgcatggttggcgtggcgggcgacctcggccacggtggcgctcatctcgttcatcgcggtggccacctggtccaggtcctggtgctggcgcgccacctggtcgccggcgccgagcgcctgctccagggcctcggccacgtccttgtcggtctctgccgcgctgcgcttgacgttcgccagcaaaccgctgacgtcctggcgcatccgctcgtag

SEQ ID NO: 4577 - DNA, 333 bp, Pseudomonas aeruginosa
cgatccgcggcgtcgccacccgccacctgcaacgctggctgcagagcgagcaggacaacccgcaggacccatggaaaaccaccggcgtccatcccacttcgctgcgcctgcgtggcgagggagtcgccgagatcgaaggctggcgttgcgacgccagccaggaaatcgccttcgccagcgagcgcgacgggcgtcccgccgccttcgaaggctgtagcctggcgatcggcaaccgcgccgacgacatcgacttccccgccggtgcgcgattgttcgccagcgatggcatggtctacaccgacggctaccgcgacgccgagcgctggcgggtaa

SEQ ID NO: 4578 - DNA, 228 bp, Pseudomonas aeruginosa
ccttatcaatgtgactttctcctatggtggtcaccaaagccccgggggccgctcatccctccggggctttccccccgcctgctgcctctcccctccttgatacagcagcccatcgcagttcaacgaggaaacccgatgaaactcagcattgtcgccctgggcctgttgtccatggcaggggtgctcatctgcacctatctgatcctgaaatcgctcagcgccatctga

SEQ ID NO: 4579 - DNA, 1038 bp, Pseudomonas aeruginosa
aatccctcgccctgctccgctctccctgccgaagtcccgatgcgcccagaaccgaccaacgcccccgccgccctctcacgccgcttctccgttgcgccaatgatggactggaccgatcgccactgccgcttcttcctgcgccagttgtcccgtcacaccttgctctacaccgagatggtcaccaccggcgcgttgctgcacggcgatcgccagcgcttcctccgctacgacgaatgcgagcacccactggcgctgcaactgggcggcagtgtgccggcggaactggcggcctgcgcgcggctggcggaagaggccggctacgacgaggtcaacctcaacgtcggctgccccagcgaccgggtccagcacaacatgatcggcgcctgcttgatggggcatccggcgctggtggctgactgcgtgaaggcgatgctggatgcggtggagatagcggtgacggtgaagcaccgcatcggtatcaacgggcgcgacagctacgccgaactctgcgatttcgtcggccaggtacgcgaggccggctgccggagcttcaccgtgcatgcgcggatcgccatcctcgaagggctctcgcccaaggagaaccgcgaggtaccgccgctgcgctacgaggtcgcggcgcaattgaagaaggacttcccggacctggagatcgtcctcaacggcggcatcaagaccctcgaggcctgccgcgagcacctgcagaccttcgacggcgtgatgctcggtcgcaaggcctaccacaacccctacctgctggccgcggtggacagccagttgttcggcagcgaagcgccgccgctcagtcgcagcgaggccttgctccgtctgcgtccgtacatcgagcgacaccaggccgaaggcggcgcgatgcatcacgtgacccgccatatcctcggcctggcccagggcttccccggctcccggcgattccgccaactgctctcggtggacgtgcacaaggccgccgatccgctgcgggttttcgaccaggcgctggaacttctggcggggcgatag

SEQ ID NO: 4580 - DNA, 561 bp, Pseudomonas aeruginosa
cggcggcgacgccggactggcttgcgaccgcttcgccgtggcagtcggcaaggacatcctcggagtcattcccggacgtatttccaccgaagtcgacgcgcgcctgtcgttcgacagcgaggccaccctcgcccgcgcccaccgcctgatcgagctgtacgacgaacagggcatcgaccgcgagcgggttctgatcaagatcgcctccacctgggaaggaatccgcgccgccgagattctggaacgcgagggcatccagaccaacctgaccctgctgttctccttcgcccaggcggtggcctgcgccgacgccggggtgttcctcatctcgccgttcgtcgggcgcatctacgactggtacaagaagagcgagaaccgcgactacgccggcgccgaggatcccggcgtgcagtcggtctcgcgcatctatcgctactacaaggccaacggctacaagacggtggtgatgggcgccagcttccgcaatctcggccagatcgagcaactggccggctgcgaccgcctgaccatcagtcccgacctgctgcaacaactggctga

SEQ ID NO: 4581 - DNA, 1113 bp, Pseudomonas aeruginosa
cgaagcctctttctccttcagcgtagctcctggcagcacatcgaggatgccatcggaaaacagcgacaggctgaaggaaggcggcaactccatgacccggtcgtcataggtcgcatcgtcgaacaggcccaccggcaggccacggccctccaggtagctcgcctgcccttcgacgaacaacacaggaagcggcaggtggccgccgatgctgtaggtcaggctgttcttctccaggtcgatgaccccgccgagcatggtcacgtgcttgcccaacttggtgttgatcaggccgcggttgatgtgcgccagcacctcggacggcttgaactccgggagcgtgccgttgcgcctcgactcatagagcaggcgcgtggtcatgaacttcagcagcaccgtgacgaaggccgaggaagcgccatggccggaaacgtcggccaggtagaacgccacgcgtcgctcgtcgacccggaagtagtcgacgaagtcgccggagagatacagcgacggaatgatccggtgggaaaactccagcccctcgatgctccacggcgtcaccggaagcatgttcatctgcacctggcggccggcgttctggtcttcctgaagcaggttcaggctggcctgcaattcgcggttggcggcttccagcttgtcgcggtagcgctggttctcgacccgcaggtaggcgcgatccagggcccggcgcaccgaatgctcgagcaccgcgaggtcttccaggggcttgatcaggtagtcggcggcgcccaggcgcaaggcttccaccgcatcgctcatcacgccggctccggaaagtacgatgatcggcgtttccgaagcggtctggcggatgcggcggatcagttcgaggccgtcgatctgcggcatgcgcaaatcgcaaatgaccaggtccggctgttcgctttcgaagatctgcaggccctgcagaccgttgagggcctgcaacaccttgaagttgctgtcttccaagtaggcggcgaggctttcgcgcaccacctcgtcgtcatcgatgatcagcagcgtggcactgactttatgcatgggtcatccaggcaaacggcgccggaaacagtgggtcctaggcgcttattgtaa

SEQ ID NO: 4582 - DNA, 417 bp, Pseudomonas aeruginosa
cctttgccggaaaatccgcctttgtccgtccgatcccgtccgcacggtataaactttgacgataatcgccaggattgccagtcgccctcccatcgccccgaccatgaggatcagcccatgcagcccatcgagcacaactacagcgagaagcgcgacttcatccgcatgaagctcgacaccccggtcaccatccgctgcgaaggccgcgagtcggtggccctgtgccgggacctgtccgccagcgggctgctgctggaagcgcaaagcgaactggctccgggcgaccacctgcgggtgagcatcccgtccacccacgagacgctcaccggcctggaactggaagcccgcgtggtgcgctgcgaacgcctcggcccgggtcggcatagcctggggctgagcatcgtcgcgatccactga

SEQ ID NO: 4583 - DNA, 417 bp, Pseudomonas aeruginosa
aagagttacgagatggctgacagacaattgctacacacggcccatatcccggtgcgctggggcgacatggacagctacgggcacgtcaacaacaccctttatttccagtacctggaagaggcccgggtggcctggttcgaaaccctcggcatcgacctggaaggcgctgccgaggggccggtcgtgctgcaaagcctgcacacctacctgaagccggtggtgcatccggccaccgtggtggtggaactgtacgccggcaagctgggcaccagcagcctggtactggaacatcgcctgcgcaccctggaagatccgcaaggcacctatggcgaaggccactgcaagctggtctgggtgcgccacgcggaaaaccgttcgacgcccgtgccggacagcatacgcgccgcgatcgcctga

SEQ ID NO: 4584 - DNA, 459 bp, Pseudomonas aeruginosa
ctcaggcgcccggataggccgcgtcgagcacgatctccagggcgtccgggcgccagaactcctggtcgaactcgaccaccctctgcccctccgcgtaactcagtcgctccaggtacagcgccggtgaacccggcgccagttgcagcggctcggcctgggccgcgttcagcgcggtcgggtgcatcgccagttggcagcgcgtcggctgcaggccgaaacgctcgcgcagcaggctcatcagcgaagtatcgaggtcgtggtccagcaggcctgggcaccacccggcatccagggcgatcagttcgatcagcaccggacgctcgtccacccagcggcgccgttgcaggaaatacaccggcgcgctgtcctccagccccatccgcttggccagccaggcgccggctgcacgccgctcggcgtgcagcgtctcggtacgcggctggcgtccctgggcgctga

SEQ ID NO: 4585 - DNA, 411 bp, Pseudomonas aeruginosa
accatttgccagacgcctttcgcatgcccagctccgaccaactcccgcgcttcaccgccctgctcttcggactctccggcggcctggtggatttcggcgcccggaccctgtccctggcgctgctgcgcagccatccgcatagccctgccgaacacctccgcgacgccagtctgctgcccttcgccgaggcacaaagcttcctgttgcagcgcaagccgaacaagaacgagcgccagcgcctggagcaggccctcgacgaagccgccgaggaacaggccgaagccatcgccggtgccgtggccctgctggagagcctggacgaacaacggattccctacgcctggcaggacgagctaccggaatcggtctgccagcgccttgccgcgccgctcggccgagcggacgccctga

SEQ ID NO: 4586 - DNA, 561 bp, Pseudomonas aeruginosa
aaggagaaaaaccatgagccgcgcccgtcaccgctttctagacgaactggccgaacgcttcgccagccatggcgccgagccctatggcgaggcagtcagccaggccgagcacgcgctgcagtgtgcgaccctggccgagcgcgccggttgctcggacagccttgtagtcgccgccctgctgcacgatatcggccacctctacgaagacccggcgcagatcgacgaggaggacctgcgccacgaggaattcggcgcacgcctgctgcgcgagctgttcccagagtcggtctggcagccggtgcgcctgcacgtatcggccaagcgcttcctctgcgcggtggacccgagctaccacgccagcctgtcgccggcctcccggcacagcctggtgctgcaaggcgggccgttcgacgagcgtgccgccgcggcctacatcaaggcgccctatgcccaggacggcctgaccctgcgccgcctcgacgacctggccaaggacccggccatgcgcaccccagaactgacgcacttcttcccgctgctggaacgcctgctgcggattga

SEQ ID NO: 4587 - DNA, 1836 bp, Pseudomonas aeruginosa
cggctggcagatcctgcgcagcgtgcgcgacgccgggatgaccgtaccggtgctgttcctgaccgcccgcgatgccgtagaggaccgcgtgcgcggcctcgaacaaggcgccgacgattacctggtgaagccgttcgccttcgtcgaactgctcgcccgggtgcgcaccctgctgcgccggggcagccagcagttgcaggagaccaccctgcaactggccgacctcgaactcgatttgctgcgccgccgggtgcaacgccagggcaagcggatcgacctcaccgccaaggagttcgccctgctcgaactgctgctgcggcgcagcggcgaggtgctgcccaagtcgctgatcgcctcgcaggtctgggacatgaacttcgacagcgataccaacgtcatcgaggtggccatccgccgcctgcgcgccaaggtcgacgacgactacccgcagcgcctgatccataccgtgcgcggcatgggctacgttctcgaagagcgcgacgaatgagcgccgggttcggctcgcggatgtccctcggcgtccgcctgagcctgctgttcgccgcctgcacggcggcggtctcgctgatcgccggattgatcttcagcagggccatcgacgagcatttcgtcgagctcgaccatatggcgatgtccgccaagctcgcggtgtttcgcgatgagctgcgcggcctcggctcggaacaacagatgcgccgccgcgaagcggaactgctgcgcgaactggcacgccatcccgacctcggcctgcgcctgaacggcccggatggcaacccctggttcgagcgcctgccgcagcctgcgcatcccggcctgcccgccaaccgcgaactcggcgccccgctggagcccggcaacgacgcttcgccgcgactcaccgtgatcctcgacatcagtcatcaccagcacttcctgcaacgcatgcgccagttgatctggctgaccatgagcctgtcggcgctggccacggcgctgctcggcgcctgggccaccggcgccagcctggcgccgctgcgacggatgcgcgaagtcgccgcgcgggtttccgccaactccctcaccacccgcctcgacgccagccggatgccagaggagctgcgcggactggccggcgagctgaacgccatgctggcgcgcctggaagaagccttccagcgcctctcggcgttctccgccgacatcgcccacgagttgcgcaccccgctcaccagcctgctgacccagacccaggtggtactgtcccgcccgcgctcgctggaggactatcgcgaggccctgcacggcaacctcgaggagctggaacggctcaccgcgatggtcaacgacatgctgttgctggccaaggccgaccacggcctgctggcgcccagccgccaggccctggacctgggcgcggaagtcgactcgctgctggagttctaccagccgctggcggaagaccacgatatccgcctgctgcgccaaggcagcctgagcctgccgggcgaccgcggcatgctgcggcgggtgctggccaacctgctggacaatgccctgcgcttcaccgccgatggcggcgagatccgcatccgtctcggcgaccggcgcctgagcgtggagaaccagggtccggcgattcctcctgagcgcttgccgcgcctgttcgaccggttctatcgtgccgatccggcgcgccgcgaaggccagggtgaacacgccgggctcggcctggcgatctgccgctccatcgtccaggcccacggcggcgagatccgctgcgagtctgccgacggctggacccgtttcgtcatcgatttcgctcgcccgcgccgatga

SEQ ID NO: 4588 - DNA, 999 bp, Pseudomonas aeruginosa
agcggcgcacctcgcggtagacgatggtgttcagggcgaccaggttggcgctcagttcgctgctcatcgggcgatcctcgtcaggttcttctccaccagcgacacgaacagctcctccaggcgattggtcttgttgcgcaggctcagtacctcgatgccttgtgcacccagttgggcgaacaggtcgttgatgccctggctcttctccacctgcacttcgagagtgtggtcgtcgaccagccgcgtcggatagccgtcgagggtcggcggcagggcctggacgttcttcaggtcgagcaggaaggtttccgaatgcagggtcatcagcaggtcgcgcatgctggtgttctgcacgatctcgccgtggtcgatgatggcaatgttgcggcagagctgctccgcctcttccaggtagtgggtggtgaggatgatgctgatgccttcctggttgagttctgtgaggaagctccacatcgaacgacgcagctcgatgtcgaccccggcggtgggctcgtcgaggatcagcaggcgcggctggtggaccagtgcgcgggcgatcatcaggcgccgcttcatgccgccggagagcatccgcgaggcttcgttgcgcttgtcccacaggcccagttgggtcaggtagcgctcggcgcgctccttggcgatcttcgccgggatgccgtagtagccggcctgggtcacgacgatgtcgaagaccttctcgaactggttgaagttgaactcctgcggcaccacgccaaggcaacgcttgaggccggccgggtccttgtcgaggtcgtggccgaacaccgagaccgaaccgctggtcttgttcaccagggtcgagagaatcccgatggtggtggacttgcccgcgccgttggggccgagcaaggcgaagaaatcaccttcggcgacgtccaggtcgatgcccttgagggcctggaaaccgttgccgtaggttttcgtcaattgacggatggacagggcggaactcattag

SEQ ID NO: 4589 - DNA, 666 bp, Pseudomonas aeruginosa
caaaatgcaacagtagccggctcaggtcagttcggtcattaccgcggtgcggaacgccgggcgctcgcgcaagcgcaggtaccaggcctcgaggtggggcagcggcgggcgctcgatgggcatctcgaaccaggcgtagatgaaacagcccaggggaatgtcacccatgccgaagcgttcgccggacagccagggttggccggccagggtctggtccggcacccgcagcaactcgccgcaggtctgcagcgcctttgcgatcagggcctcgtcgcgttgctccggcggcgtacgcagcgttccccagaacaggtcgcggaacggcccggcgagagtcgaggtggtccagtccatccacttgtcggcgtcggcgcggcgcaccgggtcctgcggatagaggtcgcccggcgcatagcgggcggccaggtagcggacgatggcgttggactcccagaggacgaagccgtcgtcctcgatcaccggcacccgaccgttcgggttcatcgcgcggaacgccggctcatccaccaggccgaacgccccgccggcatccaccgtccggtactccaggccagcctcctcggcgcaccacagcgccttgcgcacattgctcgagttcttccggccccagatggtcaacatactctgcgttccctcttcggttga

SEQ ID NO: 4590 - DNA, 402 bp, Pseudomonas aeruginosa
tgggcgtgttcagccacgcgcccggctggctgctgctggtcttctggctgctctggctggcggtggcgcttcccctcgccctgcccgacctgcgccggcgcgtgctcagcggtccgctgttcgcctggttccagaaagtcctgccgccgatgtccgacaccgagcgcgaggccatcgaggcgggcaccgtgtggtgggatggcgaattgttcagcggccgcccggactggcagaaactgctcgactaccccaaggcgcaactcaccgaagaagagcaggccttcgtcgacggcccgaccgaagaactctgcgccatggtcagcgactgggacatcggccagcgcatggacctgccggaagaagcctgggccttcatcaagcagcacggcttcttcggcctga

SEQ ID NO: 4591 - DNA, 411 bp, Pseudomonas aeruginosa
aggtcctggtactgcagttcggccgccggcacaaagggccgggcgacgaactggacgccgagatcgcggaaatcatcgaccgtccggacgacgacccggcgttgcagggcgatcatcgccggcgcgttcctgccgaaggacccgcaggacccggtcggtgccctcgcccacgccttcgacgcggtacgcgaaagcgccgcgctggagaaaaccctgcacaaggcgatcaaggaaggcagggtccagccgcaagcggggcagaacccgatcgatgccggcgccgccgccggcgtgctgagcgccgagcaggcgcaggccctgcaccaggccgaagcggcacggcgcaaggtgatcgacgtcgacgacttcgccaaggaggaactgcaactggccgacggcaggatccgctga

SEQ ID NO: 4592 - DNA, 591 bp, Pseudomonas aeruginosa
tccgccagcagcaactggaccagcagcgctggcgcctggagcaggaccagcggcgcctcgacagcgaacgccggcaactggaaaaccgccggcgccagagccagtccccggcgatccgctgaaactggccggcgccgcgaaaccctttatactgcccagcttttttccagaggacccgtcatggccaactcctacctcgagcaccacctcgccctgctccagcacctgcgcaacatcctcggcgccctgggcgaggccgagcaggtgccggaagaaaaccacgggttgttcctcgagcgtttcgacgagctgatggacgaactgccgcgcgacccggaaggcgcccaatacctcggccaggacctgatttcccaggtcttccaccgctatccgcagatcgcccacctggtacctcgcgacctgctgtggttcttcggcggcgattgcctgcacttcatgccggacgaagagatcgacctgttccagcgcctcgacgagcgccgctacgaagccgaagagcgcggcgaaacgttcgactggaaccgcgaaaagcagttgctcgcgctgcccgaggacagcccgcggcactga

SEQ ID NO: 4593 - DNA, 846 bp, Pseudomonas aeruginosa
cagttctgccgggtagccggagcttcacaccccttcgccgcacacgtccccactgattgctctgcagcgagcatgtcgtacctcgccggagctgccgatcaatctggcgaaggcgcaggcatgcactcgaacgagtcaacggaagaccgctgttcacgccactacaccctgctgcaacggtgcccgctgctgcacgggctgcccgatctgctgcggcacgtggcgacccatgcgtcggagcgccggttgcgcgacaaggacgtcctgttcctcaagcacgaccctgaagacttcatcggcctggtcctcggcggacacctctataccgtgctctacgggccggacgggcgggaactgatcgtcaatgacatccgtcctggcgaagtgatcggggaaaccgcgctgatccagccgaaccgccgcgagacctccgcctacgcctccggcgcggcgtcggtgctgatcctccaccgacgtcacttcgccccgttgatcgccgacacggaattcctcaaccgcgcgctggccctcctctgttcgcgcctgcgcgaagcctccggtttcgtcgagagggtctgcctgcatcgcctggagtcgcgcctggcgcgccatctcctggccagcctggcgagcgaacagcccgagggagcctgcgcgacactaccgaccaaccagagcatcctagcagcgatgctcaacgccagccgcccgaagctcaacgcgcaactgcaaatatggaaacgcgaagggctgatcagctgccacaacgaccggatcctgatcaacgacctcggtcgcctacgacgcaaggccgaactgccggccgcgcccctgtcacccaggtaa

SEQ ID NO: 4594 - DNA, 540 bp, Pseudomonas aeruginosa
cggttatggatcgtccgaatcagccaggcggcaacgaaaccggttccgatcgcctgttcgaggaaagctggcgtgccgcgcaggctggcctgcgcaaacgcgcgcaacgccttgcgcgcggcaacagccatcgggccgaagaatggctgtcgagcaccgcggtcaaggcgatgctgttcctgcgccagtcaccggagcgggtacgcgacccccagggcttcctgttcctggtcctggaacacgtctacctggacagcgcgcgccaccagatccgcgaggaccgcctcatcgaccgcggcatcgacctgcacgatggccagttggagcgcttcgccgccgtcggctcgccgctggaacgcctggagcagctggaacgtctcgaccaggtggacaaggccctggcctcgctgtcgcgccaacagcagcagctcttcgagctgcgcttcatcgaagaactgccctatgccgacatcgccagccaactcggcatcgccccgccgctggtgcgcaagcgcgtgcagttgctgcgctcgcggctga

SEQ ID NO: 4595 - DNA, 441 bp, Pseudomonas aeruginosa
gcaccgcctacagcaccctgcaggccgctgccgccgcctaccccggcgataccggcggcagcgcgcaggccccctcggcggacggcacgcagcagtactgaagcctcgccacgacaccccgcgcaccgcgcgtctatcgcagaggagtccgcgcatgtcgatctcggaagaattgggaaggaatctggtccagctggcgcaacgctggctgaaacgccccctcaccagcgaagaacacgagcagttgagacagttccagctcggcctcggcaacgacgccagcagcgatccggccgtgcacgcgcgacagcaggccgaacaggtgatcgagaacggccggcagcgttccgaaggctccatccgccagatcctgcagaacgtccagcaggcctcgacccaggccctccgcgcccaggacagcggcgagcaggcgattcttga

SEQ ID NO: 4596 - DNA, 336 bp, Pseudomonas aeruginosa
ttcaggagaatcaccatgagcttcccaaccgcagtaaacaaccagatcaccgatgccgtcacccagtccaacgtcaaggtgatcggtgaagccccggccatggcgctgggctcgatcttccagaccatggcccactccaccggcatcctgttcgagaattcggtagctgcccagcaacagcagaacgccctggccctggccgcttccaacatgggcgtgatgcagatctacagtctggataccagcgccgccggcggcgccaccgagaagatcggccagctgggcgtggccgacaacctcaccagcctgctgacggtgctcaaagcgctgccctga

SEQ ID NO: 4597 - DNA, 261 bp, Pseudomonas aeruginosa
atagaggtcacgccaacaaacgccaccgagcgttcaggagtgaccgccatgtcgcagacccctgtactcccgccgaacgagcgccgcatcctgcggctcgatgaagtcgaagcgaagtccggcttcaaacgcgcccacatctacaacctgatgaagaagcgccagttccctcaggcgctgcgcctgggcgtgcgcgctgtcggctgggattcgatcgaaatcgaccagtggatcgccgagcgcctcaaccaccggacctga

SEQ ID NO: 4598 - DNA, 888 bp, Pseudomonas aeruginosa
cccgctctcccgcggacttcccattcccagccggagagcgccatgcaggtcgtgtccatcatttcaacgaagggcggcgtcggcaagaccacgacggccgccaacctgggcgggctcgccgcggacgcgggcctgcgcgtgctgctgctcgatctcgacgtgcagcccaccttgtcctcctactacgaactgacccagcgcgcgccgggcggcatctatgagctgttggccttcaacgagcgcgaccttggccagctcgtgtcccgcacgatcatcgcgggcctggacctggtgctgtccaacgaccaccggggcgagctgaacacgttgttgctgcatgcgccggatggccgcctgcggttgcggcatctgctgccagcacttgctcccctcctacgacctggtgctgatcgacacccagggcgcgcgttccgtgctgctggagatggcggtgctcgcctccgatctcgcgctgtcgcccgtcacgccggagatcctcgcggcacgcgagctgcggcgcggcaccatgcagttgctcgaagacattgcgccgtaccggcacctgggtatcgaaccgccgccgctgcacttgctcatcaaccgcgtccacccggtgtccgccaacgcacggctgatccagcaggccctgcgcgacctgttccaggacagcgccggcatccgcgtgctcgccaccgacgtgccggccatagaagcgtatccacgcgccgcaacgcgcggcctgccagtgcatcgggtcgagcaccgccagccgcccggcagagtcgcccctgccgcgctcgacacgatgcgcgcgctcgccagcgagttgttcccgcaatggcaggaccgactggctcaagtatccggccgcccgcagcgacctcttga

SEQ ID NO: 4599 - DNA, 1764 bp, Pseudomonas aeruginosa
acgcccgtgcgcagatccgccgcgccgagcgagaggcccgcatggcgccggccggcggtcgtggggactgcgaggggtgcggccatggctgacatgacctcgcaggacatggcaggcaagctgctcgcggccggcttcgagcgcagcggcccagcggctacggccttgagcgacccgatcgcggacacgcccatggtcgtgacgcttgaccagttgcggccctacgaccatgacccgcgcatgaagcgcaacccggcttacgaggaaatcaaggcgtccatccgcgagcgcggcctggacgcggcgccggctatcacgcgccggcccggcggggaccactacatcatccgcaacggcggcaacacgcggctggcgatcctgcgcgaactctggtcggagaccaaggaagaacgcttcttccgcatatcgtgtctgttccgaccatggccggagcgcggtgaaatcgtcgcgctgaccggacatcttgccgagaacgaactgcgcggtggcctcacgttcatcgagcgcgcgctcggcgtcgagaaagcacgggagttctacgagcaggagagcggcgccgccctgagccagtcggaactggcccgccgcctggcggccgatggcttccccgtccagcggtcgcacatcacccgcatggccgacgcggtgcgctacctgctgcccgccattcccaccgtgctttatggcggccttgggcgccaccaggtcgagcggctgtcggtcatgcgcacggcctgcaaacgcacctgggagcactacgccaaggaccgctcgctgccgctggacttcgacagcttttttcaggaggtgctggcgcagttcgacacgcagggcgacgagttcgcgccgcagcgcgtgcaagacgagctgatcggccagatgtccgagctgctgggcatcggctacgacgtgctggcgctggatctgaccgaatcggaaagccgccaccgggcgctggtcagtgacccgacgccacctgcggcgcagccggcgttgccttcgcccaccgccggcacgccgactccgccgggcgcagcatcgtccatcgccacgcctgcagcggcggacggtcctccacccgccagccctccggcgtccgagcccaccttgcgccacgacgacaaggcggctagcgaagcggccacgggaagcccggcggctgcaccgagcgatctgcttcgtgagcacatcgtctcgccggcaccgacgaccgaacggctgcagtcgatccagcgcatggtcgccgaccagttgggcgatgcgctgccgcccgacttctcggcgagcgtgttgcagtccatcccggtgcaagccggcggactctatccgatctccgatgtctggtacatcgacgcgggcctggacacgcccgatcggctgcgcatccacatcgcgcagttcgcgcgcgagatcgccggggaggcaggcctggacgagtacatcgaggatcgcgccgatggcatcgggtttgcgtgccgcgcccgcggccaagccccgtcgccgctcggccgcgcggtgctgacgctcctcacttccctgacgggtcagcccgtcgccgaagcgggcctggacggcgcgcagctcgccaccgacctgccgaccctgttgcacggccagagccaaggccatggcagcggcgcaaggcgcttgagcgacacggcgttggtcaagctctttcggctgctccgcttggcccggcgtctgctggacctggaagccggcaccacggcgcccgggacgtga

SEQ ID NO: 4600 - DNA, 852 bp, Pseudomonas aeruginosa
ctgccttccgccgcatgcggatgctggcggctccctgtccaccagcgagcgatcaccatggcaaccagcaacgaaccattgcagctcaacctcggctccctgcgcagcgcaatgtcgctgacgctgcacacccaccacgcctcgcgcatctggcatggccgcgccgccgccgaggggcgaccgggcatcgtcggcctgaacggctacatcgccgtcatgaacaaaatgaagcgcggctcggagcaggacgacccgtacagcgactggtggatgctgcgcatcgaggacaagctcgaccagaccaagaccacgctgcagacgctgcgcgaacaggtggaccaggccctggccggcgtgcccgccgcgttgaccctgggcgagaacctcaacgtgcagcccgtcaagctgccgctgttcgtcaatgcgcagttgggctttgccgctgtctatctcctggccgactacgacgacatcgcgcgcaagctgatcctcgcccaccacaccgcgctgatcgaccgcagcaccttagagcgctggctcaacgagggcgcgcacgcgctgcgcagcctgttctcgctggcccagcagtatcgctattcgggctgcacccgcgacgatttcgcggcgaagaatgccgcagcgcgggccgcgctggagaagttcggcgagttgccgcaggacgtgctcgaaggcacgcgccgctcgaagtttgcgccacccatcgtgcgccgtggtctgcaacagcgcggtgagagtcctgccgcagccgctaccagcgtcgatggtgatgcggccgctgctgccgacccatccgaaaacgcagccactgccggcgaggacgaatccgcatga

SEQ ID NO: 4601 - DNA, 654 bp, Pseudomonas aeruginosa
acatgcagatcagcctgttgcacaccctgggcaggcaggcacaggattgcgccagcaaggccgccgaggcggaagacgcctacctgcgccggctcacgtcctttcccgccgcaatgcgcgatcggtgattgcgccgggcatcccagcacgcgcccggcgccgaccaggtgcgggtatttcaaccaccaaggagattgcaacatgagcacgcatttttcgggcgaaggcaacatcggctcgccccccgagtaccgggagttccccaacggcaacgacgaaccgcggcgcttgttgcggctgaacgtgtatttcgacaaccccgttcccaccaagggcggcgactatgaggatcgcggcggcttctgggcgccggtggaaatctggcaccgcgacgccgcgcactggaaggacctctaccagaagggcatgcgcgtgctggtcgtcggccgcatggagcgcgaaccctggaccgacaacgaggatcagccacgtgagacttggcagatcaacgcgcgcagcgtcggcatcctgccgttccgcatcgagtccgtcgtcctgagccccaaatcgcaggagaccgcacaggacgcgcagcccaagccccaggccgcccaggaaccggctgcgccgaaggagcccaagcgcaggaagtga

SEQ ID NO: 4602 - DNA, 600 bp, Pseudomonas aeruginosa
tccggcggggggcggccgcagtacgttgccgccccccatgtcatcgcgagctatccccaggggatagcgccaccagcgtccaccggcttccacgcgctcccgaacatcgcggctcccgactcgcacatcgccggccgcacgccatccccgccgcagccatcccatctcgtgaaagcggtcgctgccgcatgcagcttgtttgctgctgccccaacaggcgctcggcatcctcgatcccagcaactccatgaacaacgggaagcggatggacggacatgcggctgtttctgtgcgagaagccctcccagggcaaagacatcggccggattctcggcgccacgcagcgcggtgaaggctgcctcaacggctccggcgtcacggtcacctggtgcatcggccatctcgtcgaagcggcagcacccgaggtctatgacgcggcgctcaagcgctggtcgttggagcagttgcccatcatccctcagcagtggcgggtcgaggtcaaaccgcagaccgccacgcaattcaaggtcgtcaaaacgcttctggcgaaggcgacccatctcgtcattgccaccgatgccgaccgcgagggtgaactga

SEQ ID NO: 4603 - DNA, 507 bp, Pseudomonas aeruginosa
accgcgaccgagagatcgcggccttcgagtccgtgccctactgggccatcgacgtgtccctgtccgcaggcggtcagacgttcaccgcgcagtgggtggcacccgatgccagcaccgacgacgccggccgctgcctgcagcagcccgtcgcacagcaagccgcgcagcagatccgcgccgcgggcagtgcccaggtggtgtcggtcgagaccgagcgcgtgcgcgaaggcccgccgctgctgttcgacctgggcaccctgcaggaggtgtgctccaagcagcttgggctggacgtgcaggagacgctggagatcgctcaggccctgtacgagacgcataaggccacgacgtacccgcgctcggattccggctacctgcccgaaagcatgttcgccgaggtgcctacggtcctcgacagcctgctcaagaccgatccctcgctgcgcccgatcacggagcagctcgaccgctccgtgcgttcgcgcgcctggaacgacggcaaggtga

SEQ ID NO: 4604 - DNA, 540 bp, Pseudomonas aeruginosa
cgctcgacttcctcgtggaccagttggccgatgccatgcacgcagagcgcaagctgcgcaccgcgttcaaccgcgacatcggcaacaaggtgctgttcatcaaggacggccggctgctgttcctcaagggcatcaagctcaaggccattgccgaccgcgcggcatatttcgcaaagctgcgcagccgacaggaccagcccatcgtcatcctggccgagctgccagcggacgaggcattcgccatctggaagcagcatgtcctgggcgacaagccccgctgatccagcctcaccgcaccgtcatggccgccccgcactcgttgcggggcttttctttgtccctgcgcacatcaatcggggctggaccagatgccgatttccaactgacgtggcgcggcaccctcacgaagctgctcgcatgttcgctgattcgtcagcacatgccagcagccagggtttcaggctgccgcggggttctctccgcgcaacccaccagtccgcatcgcatccattgcgcggacgcgcgttcccaagacgctga

SEQ ID NO: 4605 - DNA, 954 bp, Pseudomonas aeruginosa
actacagcggttggtgagccggtccccggcacatcttcatcactgcgttcacgcgaccccatgagggacatgcgcctcgttcgaggccatgtccctcgcgttttctccccgcccagtgccatccggcatcaggcggttcccctgcggatgccacccaccggggtcaattcccggtggcgggggttgtctccatcattattctgttggagaaatcccatgtcccagaatcccaatccctttctacgcggctactggaatctgaaaatcgtccgcacgctgtccatcagccacgaggacggaagcccgcatgtctggcgaaacatccacccgagccagcagcacctctgcgacgcggcgctggtttcttctccctgcatcgtcaccagcgacttcgcggtggtcaggactggcaccgaacctgtcggcgccgcactgatcgccgaatgcgacgcggctgaaggggtcagcggcgaaggcgtggtgggtgccgtggtgtacgcgatccacggcgacgacttcgacggccgccccgtccacattggcgacacttattcggccgaggccgcacgggaagtcgtgcagcggttgagcttcgagaccggctactacagccggtgctgggaaatcagcagcgcgcacatcagccacgaaaccggccagtacctggccaacctggctgacctcgcgacgccggaagcctttttgttcgttgcgttccgggttccctacagcccggcgatcggcgtcaagctgatttccacgccctggacggaccagcacctgcaggacgtcgaggagatctccgccgagcagcttcggcaggagcactgcagcaagggcatgccggacgacctggcacagatccttgcactggccggccaggccgacgtgcgcatcctcatcctcgatgccgacgcacccgtgttgccgggcctcccgctggccggcgaatag

SEQ ID NO: 4606 - DNA, 375 bp, Pseudomonas aeruginosa
ctgccacacacatccccggccttccttttcatcaccgcatgccggcccgtctcccaccagggagccgggccggcgcactttcacaggagcgatcccatgttccccgacctcatcacacccgcatccgacttcgagcaccagcttggagcctgcgtcaacgccatgagccaggacgatgccatcggccagatcctggtattcgagcgcatgcgtggcgccctgcacatgcgccatatcgccagcgccgacctaatgaacaccgacattgacgactacgacatggtcgtcttcgacggtggcaataccagcggcgatgcatggaaacatgtcttcttcccgcgtcagcgcgagcactacttcgtttacgaagcctga

SEQ ID NO: 4607 - DNA, 465 bp, Pseudomonas aeruginosa
ccgaagccatcgccaatcagtgccgcatcgtcctggtcaaggaccagggcgtgtacttcctcgccgagcgtggggagcgtcgcccggatggacgccagcaactgctcgcctacgccgtcggctgcaacccggacaccgacccgttcgatgactggtggcacctcgccggccgcgagctgggcggcgacgattttgcggagtatttcgacccgaaggacggcctgttcacgcgcctcctgcactcggcggacgatctcgtgctgtccgccaccgccacgcacctgtccttggccgtggtgcctcccgcctgaagcggcaacggccgcgcagccatcgcagcccccgcaccgggggcgttcttttgttcgcaccacggccatcgccgcgcatgcgcgttcgtctccagccgccaaggcacgccccgcgggccacagcgccggcatgccaccggagacgaccgcatga

SEQ ID NO: 4608 - DNA, 1119 bp, Pseudomonas aeruginosa
cgttgtcagcgacatgccaggcaaccatcggtcttcgaggttgcggtgcagttcccactgcgtgaccgagccagctcgcaccgcatccatccgcgagcggccaccagcctctggtggcggatgctttcgccttatcaacccaccgcggggttacgcaccttccccgcatgcgtgggccggtgtgtctccgcttcatcccaatggagattcaccatgaacaccacgtccaacgagaaatcgtatttcgacctccacgcctcgggcatcggctacgtccagcgtgtccgtgaagtgcccgtccggggcggccgccgtgcgcagccgttcctggcttgcaccatcgccgcgctggtcggccccgcccgggaccccagctaccgctacttcgacgtcaaggtctcgggtgccgaggccaagaagctcgttcagcgctacatcggcgttgacgatcccaagcagcgcccgctggtgcgctttcgcctcggtgacctgtggggcgatgcgtacatccgcgacaagggtgagcagaagggtcatgccgccgcgtccctcaaggcgcgactgctcaaggccgaactgatcgaccgggccgaactggcttcgatcgagcagcacgagctgatcacccgcggcatcggctatctcaatcgtgtgaaggacgtcaccccaaaggctggcgactcgttcctctcttgcaccgtcgcggcactggcagggcctgtcgatgaaccggagtatcggtacttcgacaccatcgtcgccaccccggaagccgagcacctggttcgccggtgcgttcaggccatcgagggtgaccgcaaggtgctgatcgcctcccgtctgaacgacatgaagatcgatccgtacatccgcaccaagggtgagcacgccggggagccggccgcaagcctggaatcgacgctggtccacatcggtctcatcaagatcgacggcacccaggtctatccgacgagccaggcgcaacccgaggcgccgccggccgaagacgcatccgcgtccgaagccgacgacgccatcgacacggccaccgagcccgccgagcgcgagcccgaggcgcaagtcgaagagcaggagccggcattggctgcttcgttctga

SEQ ID NO: 4609 - DNA, 972 bp, Pseudomonas aeruginosa
tacggcatggcccctcacggggccttgtcgcttctcttcccgcatccgccgcgtccccatgacgcgcgcttgcgcatttcatcccccgagttccgcgtggtctcaccgccgcgcggttgtcgcatttctcaaaggagatcagccatgtctctggcatcccgttttgctccgcaatccccgatcctgcgctccgatcgtccactctcggacgaccgcattcgtgccgtcgttccgtcgatcttcgccgacgctccgcatgggagtcggtccgatcgatatgcctacataccgacctcgaccgtgctgaccaagctgcgccaggagggcttcgagcccttcatggtgtgccagacacgcgtgcgcaacgaagaccggcgcgagtacacgaagcacctcatccgacttcgccatgcgagccagatcaacggcgacgaggcgaacgagatcatcctgctcaacagccacgacggcacgagcagctatcagatgctcgccggcatgttccggttcgtctgccacaacggcctggtttgcggtgacaccaccgccgacatccgcgttccccacaagggcgacgtggccagccaggtgatcgaaggtgcctacggagtcctcgaaggcttcgagcgcgtgcagaacgcgcgcgatgcgatgcgcaccatcaacctcgatgagggcgaagcggaggtctttgcaaactccgcgctcgcactcaagtacgacgatccagccaagtccacgcctgtcacggagagccaactgctggcaccccggcgatgggacgaccgcaagaacgacctgtgggccgtcttcaaccgcgtccaggagaacctcgtcaaaggaggcctgaacggacgcaaggccaacggccgcaatcagcgcacccgtccggtgcaaggcatcgaccagaacctgcgcctgaaccgggcgttgtggctgctggccgaaggcatgcgccagctcaaggcgtga

SEQ ID NO: 4610 - DNA, 783 bp, Pseudomonas aeruginosa
tgccacgcggacctcgcccacctcgggcgaggccattcctctcatccaccgggtgccgtcggcggcccgtcattcatcatcaggagaaccatcatggcaaccccatcggcttccgagaaatcggttgcgcccatcgtcgtccccggccagctcacgctgcgtaccatccgcggcaagaacggcccgttcacggttggccgcctcgccacgcacctcggtacgttcgaggtcaaagacccggagctggagcagtaccccgaatgcaagtacgacggggaattcataatcaggtacatcttcccgaagtcctatccggtcggcggcggcatgcggttcgagatccgtgccagcctcgacggcatgacgctcaacggcatcgacaaactcagccgcgacgaagcccgcagcttcgccacccaggacgtcgatccgctcgatgaagagcaaggggcgcagcctgcggcaacgccggccaagcccaccaaggcgtccaggcccgccaagcccgcacccgtgcaggcgtccgcggacccgatggtcgataccacgccctttggcgtggatgcgccgccacctgctgaggctgctgcccccggcagcacccaagacggtgaccccgcgctcttcggcctgctgtggccgctgggcgagtccgtgaaactggattcgaccatcgaccgccgcgctttgcgtgcacagatcgcccgcctgggcgagctgggctacgcgctggacttcaagacgcaggagtggagccgccaggccgaactgcaacctgcgtga

SEQ ID NO: 4611 - DNA, 1245 bp, Pseudomonas aeruginosa
tccgcagtgacgcgctcaccgcctatccctatccggccaagatttggacgccggaagcggtggcggcttgacccaccctcggaggcacgccttggcgtgcttccgtcattcatccccgccaaccaggagacttccatggctctcatgttcccgcggctcgcccgcaatttcgccaaaaatgggtactacccgaccgacgaacccacgctcgaaagagccctcaacgcactgatgcccagcgacgggccgatgtgcatcctcgatccctgcgccggtgaaggcgtggcaatcgccgaagcctctcatgccctcgggcgcgaacaggccaaggcgttcgccgtcgaattcgacgccgagcgggcgcgccatgcccgcggcctggtcgatcactgcctgcacgcggacctgatggacacgatgatctccaagcagtccttcggactactgtggctgaatccaccgtatggcgacctgtccaaggacgtcaacggcaacatcggctatcagggccagggccgtgcccgcctcgaaaagctgttctatcagcgttcgctgtcgctgttgcaatacagcggcgtgctggtcttcatcgtccccggctacgtgctcgacgcggagctggtcggctggttgacgcgccactacaccgatctgcgtatctaccgagcggtggaaacgcagttcaagcaggtggtgatcttcggccgccgggtccgtcagcgggagctggcacccgatggcgtcaaggccgtgcgcaatctgctgctgcaggttgggcttggcgaagtcgaagccgaggaactgccgagcgaatggccgttcctgccgtacatcgtccccgccagtccggccgagccggagcatttcttccgcgtgacgatggagcccgaacagttcgccgacgaggttggccggctgcaaggcctttggccgtcgctggacacgcacttggggaccgcgcagcagtcgctgcgtccaccggcgcgggccttgtcccactggcatctcgccctggctctggccgcgggcgcgatctccggcgtcgtgcgctcccagacggggcgcgtgctcgtcgtcaaaggtgacacccacaaggacaagacgctccagcgggaattcaccgaacgcgaagacggctccatcgccgagacacgcatcctcaccgacaagttcgtgcctgtcatccgcgcgtgggacatgacgcctggctccccgacacggggcgaggtgttgaccattcgctga

SEQ ID NO: 4612 - DNA, 480 bp, Pseudomonas aeruginosa
tcgaccgtggcgaacgcgccgcgatcgtcaatggcgagatgggctgtggtaagacgaccgttggcatcgccgcggccgccgtgctcaacgccgaaggctaccgccgcactctggtcctgtcgccaccgcacttggtttacaagtggcggcgggagatccaggagacggtggccggcgccaaggtatgggtgctcaatgggccggatacgctcgtcaagctcctcaagctgcgtgagcagttgggcgtgcagcccacgggccaggagttcttcgtcctggggcgcgtcaggatgcggatgggtttccactggaagcccgtcttcacccagcggcgcacccgccacggcgacgtggcggcctgcccggactgcggcacggtcatcaccgacctcgacggcgagccggtcaacccggtcgcgctcgaagccgaggagtaccgcaggaagtgcagccattgcgctgcgcccctgtggacgctga

SEQ ID NO: 4613 - DNA, 594 bp, Pseudomonas aeruginosa
agcagcaggaagcgcggcgcgtgggtggtccgtgccggcgcgaacaggtgttcggcgtctggttgctggaacagcgccgcgtcgatgtttggcaggtcgaggcgggcttcagacacgacggcctttctcatcaaccagcggctcgccgtcttccttgttgaacgcgccgcgctgcggttgcggcagaaggtcgagcacggcttccgatggccggcacaggcgcacacccagcggcgtgaccacgatcggccggttgatgagaatgggatgctggagcatgaaaccgatcaggtcgtcgtcgctccacttcgggttgcccaggtcgagttcggcatagggcgtacctttctcgcgcagtatgtcccgcaccggcacgcccatcgccgcgatcagcgcctggagcgtgtcgcggccgggcggcgtcttcaggtactcgatgatggtcggttcctcgccgctgttgcggatcaggcccagcacgttgcgcgatgtgccgcaggctgggttgtggtagatcgtgatggtgctcatggatgcctcttggagattacgaagtggtcgcgcggcgttcgtaccagccgcgtgagcggttga

SEQ ID NO: 4614 - DNA, 480 bp, Pseudomonas aeruginosa
atcaatgtgcaaaccacagttgggtttgcgggttgcgctatgtgttggactgcaaaagcgggtagctcccagttcgcattcctgactgaccgcgccgccgcgcgcggccaaggtatcggcatcgcaacagaagagccgatgccatgcccgcaatccatgtatcccggcacttggtcggcgccggcctcctggccgcagccctggccagtggctgcgcgaccaccacggcgccgctcgcacccgatgccatcgaggaagtctcggccgcgcccgaacccgaggcgcccgagtacatcccggtcgtgcgctacggccgctacacgctggtcgagttggcacccacggcagcgcagcgcgacctgctgttgcagaccatcgacgtgtccatgcccgaggatgcccgcgccacggtcggcgacgggatgcggcatgtgctcaagcgcagcggctacggcctttgcgagaccgcgcatgccgtga

SEQ ID NO: 4615 - DNA, 636 bp, Pseudomonas aeruginosa
tttgcccgcagccgtgcgcgaggtgaacggccaatggcagcgccagccgtagctgcccccgtatcgcagttcttgcgcgcactggtgctctctgcaggcgtgtatgccagcaccccccatgcccaggaggtcccgccaccggcctaccagcttgccgcccagcgcgcgggcatcccttcgacggtgctctacgccgtggccttgcaggagagcggcatccggcgcaacgggcgcatcgtcccatggccgtggtccctcaacgtcgccggccaatcgcgccgcttcgccacgcgcgccgacgcctgcgctggcctgcagcaggcgatgcgcgccacgccgcacacgcgcatcgacgcgggcctgggccagatcaaccttggctaccacaagcaccgcttcaccggcgcgtgcgatctgctggacccgtaccgcaacctcgccgttgccgccgagatcctgaaggagcagcacgcccccggcgaggactggctgctggcgatcggccgctaccaccgccccgctggcggcgagcccgccgtccgctatcggcgcagcgtgtcccgccaccttgcccgcgtgcagggcacgcgcccaaccgccgcggtcttcgccgcgcgccaggagacctccccatga

SEQ ID NO: 4616 - DNA, 2223 bp, Pseudomonas aeruginosa
tcacggccaccggcatcgagcaatgaagccatgtcaggcaaacagccggtcgaggttctgctacgcccagcggtggagctatacaccgtcgcggcgtgtgcaggcgccgcgtttctgtgcctggtggccccatggtcgctcgcgctgagcccggccatgggcatcggcagcgccttggcgttcggcgcctacggcgcgatccgctaccgcgatgcccgcatcatcctgcgctaccggcgcaacatccgccgtctgccgcgttacgtgatgaccagcaaggacgtgccggtcagccagcagcgcctattcgtggggcgcggctttctctgggagcagaagcacacgcatcggctgatgcagacgtaccggcccgagttccgccgctacgtcgagccgacgccggcctaccggctggccaggcgcctggaggaacggctggagttcgcgccattgccgctctctcgcctgccgaagctcaccggctgggacgtgcctttcaaccccgtgcgcccgttgccgcctgtcggcggcctgccaaggctgcacggcatcgagcccgacgaagtggacgtcagcctgccgctgggcgagcgcgtcgggcactcgctggtgctgggcaccacgcgggtgggcaagacgcgcctggccgaattgttcgtcacgcaggacatccgccgcaggaatgctgccggcgagcatgaggtcgtcatcgtcatcgaccccaagggggatgccgatctcttgaaacggatgtacgtcgaagcccagcgcgctggccgcgaaggcgagttctacatcttccacttgggctggccggaaatcagcgcccgctacaacgccgtgggccgcttcggtcggatctcggaagtggcgacacgcatcgcggggcagctctccggcgaaggcaacagcgcggcgttccgcgagttcgcatggcgcttcgtgaacatcatcgcccgcgccctggtggaactggggcagcgcccggactacatgctgatccagcgccacgtcatcaacatcgacgcgctgttcattgagtacgcccagcactactttgccaagacggagcccaaggcctgggaggtgatcgtccagatcgaggccaagctcaacgagaagaacatcccaaggaacatgatcgggcgcgagaagcgtgtggtggcgctggagcaatacctctcccaggcgcgcaactacgaccctgtgctcgatggcctgcgctcggcggtgcgctacgacaagacctacttcgacaagatcgttgcatcgctgctgccgctgctggaaaagctcacgagcggcaagatcgcccatctcctggcgccgaactactccgacctggccgacccgcgcccgatcttcgactggatgcaggtcatccgaaagcgggccatcgtctatgtgggtctggatgcgttgtctgacgccgaggtcgccgcagcggtcggcaattcgatgttctctgacctggtttcggtggccggacacatctacaagcacggaatcgacgatggcctgcccggcgcagtggctggcgctcgcgtgccgatcaacgttcatgccgacgaattcaatgaactgatgggcgatgaattcatcccgctcatcaacaagggcggcggtgccggcctgcaagtcacggcgtacacgcagacgctctcggacatcgaggcccgcatcggaaatcgcgcgaaggccggccaagtgatcgggaatttcaacaatttattcatgttgcgcgtgcgcgagacggccaccgcggaactgctgacgaggcagttgccgaaggtcgaggtctatacaaccaccatcgtctcgggcgcgacggacagctcagacatccgcggcgcgacggatttcacgtcgaacacccaggaccgcatcagcatggccagcgtgccgatgatcgagccgtcacacgtcgtcggcctgcccaagggccagtgcttcgcgctgctgcagggcggccagctctggaaggtgcgtatgccgctgccggcgccggacccggatgaagtgatgccggcggacctgcagcaactggccgggtacatgcgccagagctacagcgaggccacgcagtggtgggagttcaccagctcgtcggccttgcaggatgcggccttgcccgacgacctgctggacgatgccgctgcggccgagcccggcgcggtggccaccggcgccgacgatggcgcgggcaacgaggccgtgccatga

SEQ ID NO: 4617 - DNA, 750 bp, Pseudomonas aeruginosa
tctgtgcgatccgtaagagggcttgccaggcgcgctggtccccattcaccccgccgccgagccaattgcccgccgacgtgggaggcagcagtggcaggcccgcggcctgcgattcggcaggacaagcgaccccagccgccgccaccacgcggcgcatttcgtcacacagcgctcggaccgcctcgctcaactgcgtccgatgcccggcctcctgctgctgcaggacggccagttgcgcgagctgctccaggcccattcgcgccctggcgaacgggtcctgcgccacggcggccagttcggttccacatgccggacacgcggtcgccccgtccgccaacgcttgcacggcctcgtagagcttcgcgtacgacacctcgccggcgcgggccgcgagttgcgcggaagacgcttgccacagtccctggacgcggtaggcctctgccagcaacgcttgcaggcgggcctgggtcacctcgtgaatggcaggcgggttggcgtccagctgagcctggacatacggtagccgtccttgctgctgcggcgtacccagcagccagtccacgcaggtttgataggtcgcgccaggtgacatgcgctgcgccaaagcttgttccaggccctcgaccgctgcgatcttctgcgggtaggcggcgatggtctgttcggagttcgccaactgcaggcgacgctgcgccagctgcgccgcctgcacgccggcaagcatcaggtcctgatcgagcgaggggttga

SEQ ID NO: 4618 - DNA, 402 bp, Pseudomonas aeruginosa
tcacacaggaatggcgcgatggtggcttcgatctggctgcgcgccgcgcatcgcggcgtgcccacttttttcgtgacggccctcgtgctgggccagtccccgatggcattggccgagtccccggcgcagcgccaggagttggtcgccgcgctgcgccagctcgacgcgctggaacgcaccgtcgcggacagcgccgcgcatgcccccatccagccgggcgagcgctaccacttcgattacccacggctgctggctgacctggcgcgcgtgcgcgccggcatccagttccacctgacgccatcacgcgctcagccgcgcgacccctccgaactggccggcgactaccgcaccgagcgggccgcttcgccatcgccgaagacgactgcggagggcgagcaatga

SEQ ID NO: 4619 - DNA, 357 bp, Pseudomonas aeruginosa
  unsure (257): Identity of nucleotide at the above locations are unknown.
gtttcttccttctgtcctgacctgaaaggcccgaccatgcacaaccgcaacctcacttcccgttttgcccagcgcgccgccgtggccatgggcgccgccgcgctgcccgcgctgtcgttcgcgcaaggtctgccgcaattggagaaccccaacgcgcggcaccggccaccggcatcatggagaccatccgcaactacgggtacgacatcatcatgctcgtggccctgctggtggtggcgtcgatgttcatcggcgtntggtaccacgcctacggcacctacgcggagatccacaccggccgcaagacgtggggccagttcggcctcacggtcgccatcggcgccgtgctgctcgtga

SEQ ID NO: 4620 - DNA, 990 bp, Pseudomonas aeruginosa
cgaactctggatttgctgcggcctgtccggcgccgccggcctgctggtcggcgcgccgctgtcctgggtgttccgcacgatcgcgctggcgccgacgttcgtcgtcctgggcgtggcgctcggcgtcttcatcggcggcggcatcctgcgccgcctcaagcgtgggcgtcccgacacctggctgtatcggcaactgcaatggcgcatcgccacgcgccatccgctgatggcaggctgggtcggtggccatgtgctgatctcgcgctcgggcttctggtccacccgcaggagcatgcgatgagccgcttcaaaaacgagattacccatctgcaggcgcacatcaagaccttgcgcctgggcgcgggcgcgctggtcgtcgtcgccctggtcatgggcggcggctggtggagcgcgccgcgcgacctgaccatccacgtcccgcccgacctgcgctccggcagtacccgcaagtggtgggaagtgccgcccgaatcggtctatgcgttcacgttctacgtgttccagaccctcaaccgctggccaaccaatggcgaagaagactactcgcgcaacctccacacgctctcgccgtacctcaccccgtcctgccaggccttcctgcgggcggactatgactaccgccgctccacgggcgagctgcgtcagcgcgtgcgcggcatctacgagattcccggccgcggctatggcgacgaccccacggcgcgcgtgcgcaccgtgtccgatcgcgactgggtggtgacgctggacatcacggcggacgagtactacggcgccgagcaggtcaagcgcgccctggtgcgctatccgatcaaggtcacgcgggtggacgtcgatcccgcccgcaacccgttcggcctggcgctggactgctacgacggcgcgccccagcgcatcagtgcaccggagccgacgcgcccggcgccgagtggcctgtctccgcaagcgcctcaaggaggaaacaccccatga

SEQ ID NO: 4621 - DNA, 1677 bp, Pseudomonas aeruginosa
ctgccgtgcgcctcaccaacaccggcgccgactgggtcgcgctcgacccgcgcgtgctgcaaggcgatttcctcaccgccaccttccagcacgaggcgctgggcccgcgcggcacgcccgaggacacgaccgtcctgtacctggtcacgcgcggccgcggcctcgcgcagtcgctgctgccggcgattcaccgcttcgaccctgccgtgcatctgccgcagccggacggcgacgagaacgccaaggaggcccgccatgcgcagtaacggcctgctcaagtggctgatgatccctgtcgccatcctggtgctgttcgccggtatccggctgttctcgggtggaggcggcacggcgccacccgcggcggacaacggcgcccagctcacgcccgaggaaatgaaggcgctgggcatcgaaggcgacaccccgcgcgacaccgtggcgacgctcgttgcccaagtgaagcagttgcgcaccgagcttcagaccgcgctctcggacaacaagtcgcagcgtgaagagaaccagcggctgcgccagcgcgagaactccatcgaccagcgcatcaactcggcgctcgaatccgagcggtccaacctgcgccgcgaccaagagccaggcggcccagcgcgcgccagccagaccgaatggctgctcgccgacctgcagcggcgcctggacagcatcggcgggcgcggcggcggccatgcggacctgcccgtgggcctggggctgcagggcggcgacgaggcccgcatggagggcggcgtgcggtgggtcgagccggacgacgcaaagccccccgaggggcgcaacggggggcgtggcgcgagcggcggcatgagcttccccacgatcttcggcccggcccagagcacgctcttaaccaccactgaaaccgtggccaacgcgggcgcccgcgccgccggggtcaagagtgccaagccggtctataccgtgccgaccaactcgacgctgatgggatcggtggcgatgacggccctgatcggccgcgtgccgatcgacggcacggtcaacgatccctatccgttcaaagttctggtcgggccggacaacctgaccgccaatggcatcgacattcccgacgtggccggcgccgttttcagcggcaccgcctcgggcgactggacgctctcgtgcgtgcgcggtcaggtgcgcagcatcacgttcgtcttcaacgacggcacgattcgcacgatccccgaagaccgcgagggcaaccagcagaacaaccaacagcgcgacggcttgggctggatcagcgatccccacggcattccttgcgtcagcggcgagcggcgcagcaacgcccagcaatacctcggctcgcaggccctaatcaccgcggccggtgccggtgtggcctcgctcatcgagagtgacagcggccgcatgtcctatgtcggctcggacggctccatcggcaccgtgggcatcaccggccaagaagcggtcggccagattctcgcgggcggtgtccgggacatgtcggcctgggtcaacaagctctacggccaagccttcgccgccgtctatgtccaacccggcgccaaggttgccgtccacctcgaaaagccgctcgccatcgacttcgatcccgaaggccgcaaggtcgatcaccgcgcaggagaaagccatgcccttgaacttgactaa

SEQ ID NO: 4622 - DNA, 3225 bp, Pseudomonas aeruginosa
ccgcacgatgatggacatctggcagcaggaggccggcgacggcggtggcgcagccggacggaatgccggtcgccaactgctcgatgcgcgccagagcctgcgtcggccgctgaccgacgccgacatgcaggccgcgcctgccgagcagatgcgctatacgcgcaccgcccgcaacgaggttcatcgccagttccagcgcctgcccaatcccgatctcgtgatgtacgtgtacccgcacctggccggcaccgatcccgtgccggtgccgggctacacgaccgtcttcccgctgtaccagcgcattcagtacgcgatgccgggcgagcgcgtggaggactactgatgcggtggaaacttccctggtcgaagctgacgggcgccagcatcagcggcccggctggcgatgagcagccggacggctggcagcgccacgttgatgccctgcagcaggtcggcatccccgaacccggcgccccggtgcagggccgcaggccggcgaccgtggccgaggagcaggcgctgtacgacgtcgccccgtccttcgtggaactgctgccctgggtggagttcttgcccgagtctaaggcgatgctgttggaggacggtcaatccgtggccgccttcttcgagctggtgccgctgggcaccgagggccgggagcctggctggctcgcgcatgcccgcgacgccttggaaaacgcgcttcaggacagtttcgatgaactggacgagaacccgtgggtgctccagctctatgcccaggacgaaccgagcttcgaccagtacatgcagaccttgcgcgattacgtgcagtcacgtgcgcgcggttcggcgttcaccgagttctacctgcgcttcttcggccaccacctgcgcgctgtggccaagcccggcggcctgttcgaggacacggtggtcacgcggctgcgctggcgcggccagacgcggcgcgtgcgcatggtggtgtaccgccgcgcgagcggtcagggacaggcaaaccgccgcggccagacacccgagcagatgctgggcatcgtttgcgatcgcctgtgcggcgggctggcgaatgccggcatccaggcccggcgcatggttgcagcggacgttcacgactggctgctgcgatggttcaacccgcgccccacgctgctcggtcctggggcggaggaccgggagcgcttctactcgctggcgcgctacccggacgagaccgaggccggcgagatcgagttggcgagcgggcgggatttcagccagcggttgttcttcgggcagccgcgctcggacgtggcgcaaggggcctggtacttcgacggcatgccgcaccgcgtgctgatcaccgaccggctgcgcatgccgcccggcacggggcacctgaccggcgagacccgcaagggggacgcgatcaacacgctgttcgaccagatgcccgaggacaccttgatgtgtctcacgatggtcgccacgccgcaggatgtcctggaatcggatctgaaccacctggcgaagaaagccgtgggcgagacgctggcgtcggagcagaccctcaaggacgtgcacgaggcccgctccctgatcggcagcgcgcacaagctctaccggggcacgctggcgttctacctgcgcgggcgcgacgaggcggaactggatcggcgcggcctggacctggcgaacgtcatgctcaacgccggcttgcaaccggtgcgcgaggacgacgaggtggcgccgctcaacagctacctgcgctggctgccgtgctgctacaaccccggcaaggatcggcgccgctggtacacgcagctgatgttcgcccagcacgcggcgaacctgtcgccggtgtggggccgcgcccagggcacggggcaccccggcatcacgatgttcaatcgcggaggcggcccgattacgttcgaccccttgaacaggttggatcggcagatgaatgcccatctgtttctgtttggccctacgggctcgggcaagtccgccacgctcaacaacctgctgaaccaggtgacggccatctaccggccgcggcttttcatcgtggaagccggcaacagcttcggcctgttcagcgacttcgcgcggcgcctgggcctgaccgtgaaccgggtcaagctggcccccggatcgggcatcagcctggcgccgttcgccgacgcacgccggctgatcgaaacgcccagcgacgtgcagacgctcgatgccgatgccctggacgaagaccagccaccggatgcctcggccatggaggcggatgagcagcgcgacgtgctcggcgaactggagatcacggcacggctgatgatcacgggcggcgaagacaaggaagaagcgcggatgacgcgggccgaccgctcgctgatccgccagtgcatcctcgacgccgccgaacattgcgtggcggagaagcgcaccgtgctcacgcgcgatgtgcgcaatgcactgcgcatccgtggccaggacccgacgttgcccgagatgcgccgtgcgcggctgctggagatggcggacgcgatggacatgttctgccaaggcacggacggcgagatgttcgaccgcgacggcacgccgtggcccgaggccgacatcacgctggtcgatctggcgacctatgcccgcgagggctacaacgcgcagctctccatcgcctacatcagcctgatcagcacggtgaacaacatcgccgagcgcgaccagtacctgggacggccgatcgtcaacgtgaccgacgaaggtcacatcatcaccaagaacccgctgctcgcgccctatgtcgtgaaaattacaaaaatgtggcgcaagttgggcgcctggttctggctggcgacgcagaacatcgacgacctgccacgtgcagcggagccgatgctcaacatgatcgagtggtgggtgtgcctgtcgatgccgccggacgaggtggagaagatcgcgcgcttccgcgaactctcgccggcgcagaaggcgctgatgctctccgcacgcaaggaagcgggcaagttcaccgagggcgtcatcctctccaagagcatggaagtgctgttccgcgccgtgccgccaagtctctacctcgcgctcgcgcaaaccgagcccgaggagaaggcagaacgctaccaactcatgcagcagcacggcgtcagcgagctggatgccgccttcaaggtggctgagaagatcgaccgggcacgtggcatcgagtcgccgaccctggacctgccctga

SEQ ID NO: 4623 - DNA, 792 bp, Pseudomonas aeruginosa
atctgccgtacaccggagaacgccatggaacagaaacgtccttccattccgatgcaggtgcaggcgttccgccgtcggcactggcggcccagctggccttggacagtggccgcagcgctggttgcactgctgctgatctggctcgtgtcccgttggcccgggcagtccacgcctcagacttcagcgccagtcagcgagacgcaggtggctgggcctccgtggcagatgggcaatccggaaggacgcttcacgctgacgctctacgcggacctcgaatgcccgttctgccggtcctatttcccagtgctcaagcgttgggtggccggcaatgcggacgtggccttgcaatggcatcacctcccgttggcagcgcatgagccggccgcgtccgcggaagcgcgcctggcggaatgcgcgggccaagccagcggtcatgccgccttctggcaggccgtcgagtgggtatatgcccacacgcgcagcgacggtcagggcttgcccgaggacctgcgttaccccgaccttacgccacccatcgagcagtgcatcgcgagcgagcggcccgacgcggcgattcgcgcccaaactgcggaagccacgagcagcggcgtgaccgccacgccgtcgctgcggctgcacgatcgcgaaaccggcaaggcgatcctgctgcagggtccgatcgagggcgatgccttgctgtcggccatggacatgctcgcggccggcgatcccgccgccacacctactacatcggaaatgcctgccgacgtcgtcggcgacatgcccaggtag

SEQ ID NO: 4624 - DNA, 417 bp, Pseudomonas aeruginosa
gggcgatccggtgcccgaccgcctcgaccagttgcagaagggcaatccaggagccaggccatgagcgcggcgcgcatgacttggcgccccttgcgctggctgttcagccggcgtgcggcgaaggcgctgctgtggacggtgctgatcgttgccgacgcggtcgcggccaacatcgccggcatctacttggtcggcagcgtggccggctgggagcggtggctcgccgccgcgggttacttcttcgtgtggcggctgtgtctatacggggcgacggtgtacgggtggatctggatgcgccgccggctgctggtacgtgaggacgacgcccaggcgcggcgccgcctggtgcgcaccgagatcgcgggcgtcgtcgccatcgtggcgctggaagccagcctgctgatgcaggcgggttga

SEQ ID NO: 4625 - DNA, 789 bp, Pseudomonas aeruginosa
gctgatccgcagcgctgtagcaccgacggcccgcttgcgggccgtcggcgtttccggggcggcgaaggctggtacaatcggcgtctttttcaccacgcggaaccgtcgatgtccactctgttggccctggatacctccaccgaagcctgctccgtcgccctgctccacgaggggcgggcgctcagtcactacgaggtgatcccgcgcctgcacgcccagcgcctgctgccgatggtccgcgacctgctcgacgaggccggcgtcgccctgtccgcggtggacgccatcgccttcgggcgcggtccgggcgccttcaccggcgtgcgcatcgccatcggcgtggtccagggcctggccttcgccctgcagcgcccggtactggcggtctccgacctggcgatcctggcccagcgggcctaccgcgagcagggtgcggagcgggtcgccgcggccatcgacgcgcggatggacgaggtctactggggttgctaccagttgcaacagggcgagatgcgcctggccggcagcgaagcggtactgccgcccgagcgggtcgccgtaccgtgggacgccgctgccgcggactggttcggcgccggcaccggctggggctacgtcgagcgcatgccgcagcgcccggccgcgctggacgcgagcctgctgccgcatgccgaggacttgctcagcctggccggcttcgcctgggcgcgcggcgaaggcgtggaggcggaacaggcgctgccggtgtacctgcgcgacaacgtggcgacgccgaaaaaagcgccctga

SEQ ID NO: 4626 - DNA, 786 bp, Pseudomonas aeruginosa
agtgtggagacttccccgggttttgatcatgcgtatcgacggtctttcttcctcttcgttgccgctggagcgcagcgcccgaccgggctccgcggtcacgccgtatcgcgacgtgcagcgcgaggtcgaggcgcggcgcgagcagccggcgccggtttccggcagccagggcttcgagcaggcgccgcaggcgcgcaaggtccaggccagttcggcgggcggcgacagcctgccggtcagcgcccgcgacctgctggcgttccagcgcccggtaagcagccatgcggcgatggccctggccagctacaactccaccgccagcctcaacatcgacgccggcgccgaggatgtcctcggcctcgacctctacgcctgagcggttccctgcgctcccgtggtttcccttccttatttcctcggttgtccatcctggaacgaggcggcctggcgcggcagcttctatccgcgcgaattgcgttccgccgactacctcggacactacggcggcatcttcaacgcggtcgagggcaataccaccttctatgcccggccttcggcggaaaccgtgcggcgctgggccgagacgatgccggcggggttccgcttctgtgccaagtttccccgcgatatcagtcacgaaggcgacctgcgcgaacggctcgaggccgccggcgacttcctcgaactgctggcgccgcttggcgaaagggtcagcccgctgtggctgcaactgtcggcggcgttcaccccgcagcgcctgggcgaactgctgtatttcctcgatga

SEQ ID NO: 4627 - DNA, 510 bp, Pseudomonas aeruginosa
gctgagtccgcgacggattgccgtggaagtacgccacccggcgttcttcgacaaaggcgaggacgagcgcctgctcaaccgccacctgcgcgagcgtggcgtggagcgcatctgcctggattcgcgggcgctgttcagttgccgttcggacgatccggcggtgctccacgcccagtcgaagaagccgcgcctgccgatccgtccggcggccttcagcgatacgccacaggtgcgtttcatcggcggtcccgacctgccggccaacgaggtgttccttttgccctgggtcgacaaggtggccgactggatcgaggccggcctgactccatacgtattcctgcatacccccgacaatcacctggcggcccagcaggcccagcgtttccatgcgctgctgggccagcgcctgccaggcttgccggcgctacccgagccgatcccggccccggaagtggagcaactgggcctgctctgagcgcggcgctcgacgctccaccggcctgcgcctag

SEQ ID NO: 4628 - DNA, 585 bp, Pseudomonas aeruginosa
gttctccgccgcgctggagcgggtcgctgccgcggtcgaggcggcccgtgcgttgccatttccgttcaccctctgcgcccgcgcggagaacttcctgcatggtcgcgaggatctcgacgacaccctgcggcgtctgcgcgcctacgccgatgccggcgccgatgtgctctacgcgcccggtttgaaccgccgcgaacagatcgtcgcggtgctcgaagcggtggcgccgaagccggtcaacgtgctggtcggttcgccgcgcctggagctgtcgctggacgagctggaagccctcggcgtcaagcgcgtgagcctgggctcgaatcttgcccgggtcgccttcggcgctttccatcaggcggcgcaggcgctggcgcggcgcgacctggaagcgacccgtgcggcgatgcctttcgaccgtatcaacgacctgttccgctgaacccgtgcgccgcctggcctggttgctgccattactgctgctggcgggggccatcggcgccctgcgctaccagtggctcgatctgccggcgcgctggaatccctggctgccgctggacgtgcgcgaaccgccgaacctgctga

SEQ ID NO: 4629 - DNA, 1203 bp, Pseudomonas aeruginosa
gctatgcgttgttcgagcggcacgtgctgcaaccggcagccctggacatctatggccagccgctggcgcgggtcgagcatgtcggcagcttcgcctgccgcaacgtctacaaccgcgaggacggtcggcgcagccagcatgcctcggccaatgccctggacatcagcggcttccgcctggccgacgggaggcggatccgcctggccacggactgggccggcgagagcgccgacgggcgcttcctgccccgcgtgcgggacggcgcctgcgccagtttcaatgcggtgctggggcccgactacaacgccgcccaccgggatcacttccacctcgacatgggcctatggaaggtctgccggtgagcgcgcgcgggccaactctggcaaaatccgcgctttccccgacgattgcccgaccatgaccgattccgccgctcctcgcctgcatgtccaagccctgtccgccgattgcgccgaggctgcgcggcgctgggcggagcggctcggcctgccgctggcggcggacgacgaggcggagttcgccgtgcaggtcggcgagcagggcttgcaggtcttgcaactgggggcggactcccccggtccggtgcgggtcgatttcgtcgagggcgccagcgcccaccggcgcaagttcggcggcggcagcggacagatgatcgccaaggcggtcggcgtccagccaggcatccgcccgcgggtcctggacgccacggccggcctgggccgggatgggttcgtcctcgccagcctgggctgcgaggttaccctggtcgagcgccagccgctgatcgccgccctgctcgaggatggcctggagcgcgcccggcgcgatcccgacgtggcgccgatcgccgcgcggatgcgtctgctcggcggcaactcggcggacctgatgcgcgcctgggatggcgaggcgccgcaggtgatctacctcgacccgatgtttccccatcgcgacaagagcgcattggtgaagaaggaaatgcgtctgttccggccgctggtgggcgacgatctcgacgccccggcgctgttgcaggcggccctggccctggccagccaccgggtggtggtgaagcgcccgcgcaaggcgccgatcatcgaagggcccaagcccggctatagcctggaaggcaagtccagccgctacgacatctatccgaagaaggccctgggcaagggctga

SEQ ID NO: 4630 - DNA, 462 bp, Pseudomonas aeruginosa
cctgcaacgctggcagccggcgctgtgcatgctgaaacagtggaacgggcgcagcttcatgatgcgcgagggcgcccccgcccaggcccggcgcaaagaagtacggccgcacctggcgccgccgccggccagcgaggttcgccgcctggccgcggagtggggcgagcgggtggaggaggggcgcgaatacgacctcgacctggaaatggctgcgttcagcgtcaccctcagcggtcacgcgctgttcgacgtcgacctgcaaccgtcggcctatcggatcgccaaggcggtgcgcctgctgtcgcgggtggcattgctggaaatgagcaccggcctgccgctgggccactggtttccgagcaaactgtgtccgcgcaagcgctgggcgctgggccagttgcgcgaggcggtgggcgaggtggcggagcgctcgccgcggccgctggcggacctgcgcgatga

SEQ ID NO: 4631 - DNA, 1170 bp, Pseudomonas aeruginosa
tgggttctgtatttttactataccgcccagtataagaactcgaacgcagtttgcggaaggtgtcacatgtaccgccatatcccgctcgtcgccctgtccctgttttcctccctgttcctcgccgcctgcggcaacggcacgccgccgccagccgcggcgcgtccggcgatcgtcgtccagccccagccggcgggggaggtgagccaggcctttcccggcgagatccgcgcccgccacgagccggagctggccttccgcatcggcggcaaggtcatccgccggctggtggaagtcggcgagcgggtgaagaaggaccagcccctggccgaactcgatccccaggacgtgcgcctgcaactggaggcggcgcgggcccaggtcagtgccgccgaggccaacttgcagaccgtgcgcgccgagtaccggcgctaccgcaccttgctcgaccgcaacctggtcagccattcccagttcgagaacatccagaacagctaccgcgccggcgaggcgcggctgaagcagatccgcgccgaattcaacgtcgccgacaaccaggccggctacgccgtgctgcgctcgccccaggatggcgtgatcgccagccggcgcgtcgaggtgggccaggtggtggcggccggacagacggtcttcagcctggccgccgacggcgaacgcgaggtgctgatcggcctgccggaacacagcttcgaacgtttccgcatcggccagccggtgtcggtcgaactctggtcgcaacgcgacagacgcttcgccgggcatatccgcgagctctcgcccgcggccgatccgcaatcgcgtaccttcgccgcccgggtggccttcgacgaccgcgcgactccggccgaactgggccagagcgcgcgggtctacgtcgccgccgccgaggcggtgccgttatcggttcccttgtcggcgctgaccgcagaggccggccaggcgttcgtctgggtggtcgagccgggcagctcgaccctgcgccggcaggcggtgcgcaccggtccctatgccgaggaccgggtgccggtgctcgaaggcctgaaggctggcgactgggtggtggccaccggggtccaggtgcttcgcgaagggcagcaggtgcgtccgatcgaccgggccaaccgcacggtgaaactggcggccaaggagtag

SEQ ID NO: 4632 - DNA, 1788 bp, Pseudomonas aeruginosa
tcgcatgtccttcaacctttccgcctgggcgttgcagaatcgccagatcgtcctgtacctgatgatcctgcttggcgcggtcggcgcgctgtcctacagcaagctggggcagagcgaagacccgccgttcaccttcaaggccatggtggtgcagaccaactggccgggcgccagcgccgaagaggtggcccggcaggtcaccgagcgtatcgagaagaagctgatggaaaccggcgactacgatcgcatcgtgtccttctcccgccccggcgtctcgcaggtgaccttcatggcccgcgaggacatccattccagcgagatccccgaactctggtaccagatccgcaagaagatcagcgacattcgcgccaccttgccgcaaagcatccagggcccgttcttcaacgacgagttcggcaccacctacggcaacatctatgcgctcaccggcaagggcttcgactacgcggtgatgaaggactatgccgaccgcctgcaactgcaattgcagcggatcaggaacgtcggcaaggtcgagctgatcggcctgcaggacgagaagatctggatcgacctgtccaacaccaagctggccaccctcggcctgcccctggcggcggtacagaaggcgctggaggaacagaacgcggtggcctcctccgggttcttcgagaccgccagcgaccgcgtgcagttgcgcgtttccgggcgtttcgattcggtgaaggagatccgcgacttccccatccgcgtcggcgaccgcaccttccgcatcggcgacgtggccgaggttcgccgcggcttcaacgatccgccggcgccgcgcatgcgcttcatgggcgaggacgccatcggcctggcggtagcgatgaagccgggcggcgacatcctggtgctgggcaaggccctggaaaccgagttcgcccgcctgcagcagtcgctgccggccggactggaactgcgcaaggtgtccgaccagccggcggcggtacgtaccggggtcggcgagttcatccgggtgctggccgaggcgctggtgatcgtcctgctggtgagcttcttctccctcggcctgcgcaccggcctggtggtggcgctgtcgatcccgctggtgctggcgatgaccttcgccgccatgcattacttcggcatcggcctgcacaagatctccctcggcgccctggtgctggcgctgggattgctggtggacgacgcgatcatcgcggtggagatgatggcggtgaagatggagcagggctacgaccgtctcaaggcggccgccttcgcctggaccagtaccgccttcccgatgctcaccggcaccctgatcaccgccgccggcttcctgccgatcgccaccgcgcagtccggcaccggcgaatacacccgctcgctgttccaggtggtgaccatcgccctggtggtctcctggttcgccgcggtggtcttcgttccctacctgggggccaagctgctgccggacctggccaggttgcacgcgcagaagcacggcggcagcgccgatggctacgatccctatgctacggccttctaccagcgcttccggcgtctggtggagtggtgcgtgcgctaccgcaagacggtgatcgtcctgaccctcgccgccttcgtcggcgcgctgctgctgttccgcctggtgccgcagcagttcttcccgccctcggcgcgtctggagctgctgctggacatcaagctggcggagggcgcctcactgcgctctaccggcgaggaagtccagcgcctggaaaaaatgctgcagggccatga

SEQ ID NO: 4633 - DNA, 930 bp, Pseudomonas aeruginosa
gggaccatgatcgaaacaagaaacctcggcaaacgcttcggctcgcgggtggcggtggacgacctgtccttccaggtggcgacgggggaggtactgggcttcctcggtccgaacggcgccggcaagtccaccaccatgaagatgctcaccggcttcctggcgcccagcgccggcaccgcgagcatcttcggcttcgacatccgcaaccgcacgctgcaggcgcagcggctgatcggctacctcccggaaggttcgccctgctacgcggaaatgaccgtgcagggcttcctcgatttcatcgccgagatccgtggctaccgtggtgccggcaagcgcgagcgggtcgcccgggcactggggctgctggaactggacgaggtgcgccggcagaccatcgaaaccctctccaagggcttccgccggcgtgtcggcctggcccaggcgatcctccacgaaccgcgggcgctggtgctcgacgagcccaccgacgggctcgatccgaaccagaagcaccaggtccgcgaactgatccgcggcctcgcgcaggagcgcatcgtgatcatctccacccatatcctcgaggaagtctcggcgctgtgcagccgcgccctggtgatcggcggcgggcggctgctggcggacagcacgccgctggagctggccagccgctcgcgctaccaccaggcggtgacgctctacagcgacgagcccctggatgccgtggcgctggcggtgctgccgggcgtggcgggcatcgaggagaaccccgccgaaggcagcctgaccgtcctggcgcagccgggcgcggtgatcttcccccaggtcagcgggctggtcgccgagcgcggctggcggatccgcgaactggacgtggagcgcggccggctcgacgaggtattccgcaacctgacccgggggacggaggcatga

SEQ ID NO: 4634 - DNA, 1872 bp, Pseudomonas aeruginosa
agaaagccgaatgagggggagtcgatgaaacgcgtgttgtcctctggcgccgggctgttgctgatcgcgctggcgttcctggccttcaacatggtctccggcctgctgttcagcggcgcgcggctcgacctgaccgagcagaagctctacaccatcagccccggcaccaagcggatcctggccggcctcgacgagccgatcaacctgtacttcttctattcggatagcggtgcccgggaactggtgccgctgcgcaactacgccaggcgcgtcgaggaactgctgcgcgcctacgagcgcgaggcgaacggcaggattcgcctgcaggtgatcgatcccgagccgttctccgagaacgaggacaaggccaccgagttcggcctgcaaggaattcccctgcagcagggcggcgacaacctgtacttcggcctggccggcagcaacgccctggacggagtccaggtcatacccttcttcccgctcgatcaggaggagttcctcgaatacgacatcagccgcctggtgcagaccctggcacagccgcagcggccggtggtcggcctgatgtcgtcgctgccgctcaatggcggcttcgacatggccagccggcagccgacctcgccgtggatggtcatggaggaaatccgccagcaattcgacctgcgcagcctcaagagcgatgccacggaaatcccgccggaggtctcggtgctgctgctggtgcatcccaagcagttacccgagcagacgctatacgccatcgaccagttcgtcctgcgcgggggcaagctgctggcgttcgtcgaccccttcagcgaggccgacagcggcagcgatttcgccgctacgctggatggcgacaagtcgtccgacctcgcgccgctgttcgaggcctgggggctgcgcctgctgccgggcaaggtgctcggcgacggcgcctatgcgatgtccatcagtcttggccgggaccagcgtccggcccggcatccggcctggctcagcttgccgcgcgaggcgctggaccaggacgacatcgccactgccggcctggaaagcctgaccctggcgacgcccggcatcctcgaaaggctccccggagcgagcaccagcttcacgcctttgctgcaaagctcggcccaggcgatgccgttcgatgcctcgcgcttcggcctgctgcgcgaccccggcgatctgatgcgcgagctgcgcccgagcggccggcggcatactctcgccgcccgtatccaggggccggcgaagagtgccttcgcggagggcatcgaggggcatcgcgaaggcctgaaggaggcgcgcaacatcaatgtcatcgtcgtggccgataccgacctgctcagcgatcgcatgtgggtccaggtgcaggacttcttcggccagcgcgtgccgcagccctgggccgacaacggcgcgctggtggtcaacgcgctggacaacctgtcgggcaccgacgcgctgatcagcgtgcgctcccgcggccggttcagccggccgttcgtggtggtcgagcgcctgcagcgcgaggccgagacgagcttccggcaaaaggaggaccagctcaagcagcgcctcgccgataccgagcagcaactcgccgccctccagcagggcgccgccccggagaaggccgtcgaactgacgcccgaacagcaggccacggtgcgccagtacatgcaggagaagctgcgcatccgcaaggagctgcgcgaggtgcagtaccagttgaacgccgatatcgacgcactgggccgcaccctgaagctggtcaatatcgccctggttccctcgttgctcacggtcggcgtgctgctcggctggctctggcggcgccggcgcatggcccggggagggcattga

SEQ ID NO: 4635 - DNA, 984 bp, Pseudomonas aeruginosa
cgcatgcggcgcaatacgctgatcgtcctgctggcgctggtggcggcgctggccggaaccttcgcctggctgcagcgcgagcgcgcaaccgaggtacctgccttgccggcggcagagcgctggctgccggaactggacagcgcgacgctgagtggcctgcacatgcagtttgccgacggttcgccggatatccgggtcgagcggcgtgcgggcgcgtgggtcctgccggccaaggccgactatccggccgaccggctacgcttgtcggcgctgctcgaggcgttggcagaggcgcgcaagctcgaggcgaagagcgccaacccgaagaaccacgcgctgcttggcctggcggagcgtggcgaggggcaggcgctacgcctgagcctgcattggcagtccggcgagcctctggtgctgctggtgggcaaggatgcgcagcatggcggtagcttcgtacgacgactgggcgacccgcaggcctggctgatcgacaagcgcctgccgttgccgaacaacgagctggagtggctcgaccggcggatcgccacgctgcccttcgcccgggtgcgcgaactgcaactgcgctatccgaagggcgaacgcctggatctctatcgcgacgacgccgggcagccgaacctgcaggtccggcaattgcccacagggcgcaagctggcctatgaggcagcggccaacggcgcggcggcgctgttcgccgacctgcgtttcgccgatgtagcgccgctggcgcaggtgggattcagacaggcgccattgctcctggcgttcagcctgcggacgttttccggcgcgcgcctggatggcgagattcggcgccagggcgagcaatactggttgttgccgaagagcgtcgagggcttcgccgagggcgaggtcgccgcccatcctgactgggcctatcggatcgaagaggatcgctaccgcgccctggcccggcacctgccggagctgctggcgcgctga

SEQ ID NO: 4636 - DNA, 456 bp, Pseudomonas aeruginosa
cgccgtcgcgcgccagcaggccggcgagcaggcgggcgtggagggcgccttcgtgggcggcgacttcggcttcgtccagggtggccagccagtcgatggtcgcgcctaggccgatcgccgcggaaaccgccggggtgcccgcctcgaagccgagcggagcggcatggaagctggcttcgtggaagccggtgtggcgtaccatctcgccgccgaactgccagtgcgccagttgctccagggcctgtgggcgaccccagagcacgccgatgccgtcggggccgtagagcttgtggccggagaatgcgtagaagtcgcagcccaggcccggcaggtcgtggcgtccgtggacgctgccctgggcgccgtcgaccagggtccaggcaccgcgctcgcgggccagctggatcaactccaccaccggttgccaggtgccgagaacgttggacaactggctga

SEQ ID NO: 4637 - DNA, 462 bp, Pseudomonas aeruginosa
acagtacctcggccgggttgccggcgtgcagccagtgggcgacgcggctgcgcgcggcctcgaaggcccgggtggcacgctcgccggggacatgttgggcgcggtggacgttggcggcgccgccgaggtagtagccgttcagggcgtcgagtacggcctgtggcttctgggcggtggcggcgctgtcgaggtaggtcaggccttccgcggcgaaggcggaaaaggccggaaagtcggcgcgccagggagacggcagggacatggcggacactgtgcgaggacggttacaggggaaagggtagcgcacccggcggcgctggcgagcaccgtcgggcgagcggggaggcgagctgggctcagttgtgcgcgtgcagcgcttcgttcagctcgatggcggtcttgttggtcttgcactccaccgcaccgttctgcgagttgcggcggaacagcaggtcgggctga

SEQ ID NO: 4638 - DNA, 348 bp, Pseudomonas aeruginosa
ccggccaggtcgcgggccttgaccactttcaccagggcgttctgctcgtcgagcagggcgaccttggtgccggcggtgatgtacaggccggcctcgacgatgttgcgatcgcccagcgggatgccgatgccggcgttggcgccgatcaggcagccttcgccgacgctgatgacgatgttgccgccaccggaaagggtgcccatggtcgagcagccgccgcccaggtccgaccccttgccgacgaacacgccggcggatacgcggccttcgatcatgcccgggccttcggtgccggcgttgaagttgacgaaaccttcgtgcatcaccgtggtgccttcaccgatgtag

SEQ ID NO: 4639 - DNA, 678 bp, Pseudomonas aeruginosa
tgccgtagagaacgtaggtcattgcttctcccgaggcccgggtcttcccgggccctgccgataggtcgccgaaaggtgatcgccggattatgccacgtcgttccgcccctgtgcggtctcggggctaccgcgctcgggagcggcgtgacggcagatagccgtggacgggcgggcggacagggagccgggctgtttccctggccgggaacggagagagcgcaggttgaacaggtcgattcggctcgctggagagcatccttaccggtactttcggaatgctccggtccgcgctgtacaatccttcccccgccgaggagatttcccatgagttgcatcggtcgccagatagaccaattacgcctgcagataccgggcttcgcctgcaagcccggctgccacgattgctgcgggccggttaccgcctcgtcggaagagatggcccgcctgccgctgaagagcgaggccgaacacgacgccgccctggccgagtggaactgcgtccatctcggaccgaacggctgcgaggcctatgaggaacgtccgctgatctgccggctgttcggcaccacgccgaacctgccctgcccggaggggcgggggcccgaagtgccggtggcggagcaggtggagcgacaggtgcatgcgctgatcgccagcactcgccaggtgctggtgtag

SEQ ID NO: 4640 - DNA, 690 bp, Pseudomonas aeruginosa
cagctgctcgaccagggcggcctgcaggcgtttgcacaggtcggggtcggcgagcggctggttgcgcgcatcggtgatgtagaagacgtcctccacgcgctcgccgagggtggcgatcttggcgttctgcaccgacaggtcgaaatccaggaagatgccgccgatccgcgccagcaggccggggcggtcgggggcgatgacttcgagcaccgagacctggcgcagcgcgtcggtggagatggtcacctgcggggcgaaggcgaagtgcttgagctggcgcggcacccggcgctggatgatggtcgggtagtcgtcggggttcttcaatgcgtcgataagcccctcgcggatctcggcgatgcgctccgggttgttgccgatggagtcgccgtcggcgtcgagcacgatataggtatcgagggtgaactggctggtggaggtgatgatccgcgcgtcctggatgctcaggttgagctggtccatggcggccacggtgaccgcgaagaaatcgtgctggtcggcggcgtagatgaagatctgcgaaccgctctcgaactcgcgctgggtggtttccttgatcagcaccagcggcgtgccgtcgtccgggtgctggaggatcgcctcggtgtgccaggccacgtcgccggcggtgtggcgcaggaagtagtcgtcgccgagctggctccataa

SEQ ID NO: 4641 - DNA, 2178 bp, Pseudomonas aeruginosa
ctgctcggcatcgtcctggtcgatgccgttgcgtaccagttggtcgagggccgcggtctgcgtctggcggatctgctcctcgcggtccaccgggttctccaggccgcggcgcagggcgcgcttggtctcggtgtagagctgccggagcaggctggcgcgccaggagttccagagcgtcgggttggtggcgttgatgtcggccacggtgagcacgtacaggtagtcgaggtgggtctggtcgccgaccagttgggcgaaatcgaagatcacctgcgggtcggagaggtccttgcgttgcgcggtggtcgacatcaccaggtggttctgcaccagccaggacaccagttgggtgtcccagagcggcaactggtggctctggcagaaggcctcggcgtccaccgcgccgagttccgagtggtcgccgccacggcccttggcgatgtcatggtagagaccggcgatgtagatcagttccggcttgggcagacgatcgatgatcttgctcgccagcggatatttctcggccatctccggccgattcagcttgcgcaggtgcttgatcaggttgagggtgtgggcgtccaccgtatagatatggaacaggtcgtgctgcatctgcccgatgatatggccgaactccggcaggtagcggccgaggatgccgtagcggttcatccgccgcaggttgcggtggataccctggctgctcttgaacagctcgatgaacaggctggtgttgcggatgtcgtggcggaactcgtcgtcgatcaggtgtcggctgtcgcgcagcaggcgaatggtgtcggcgcgcacgcccttgatttccgggtgctgggccatcagcacgaagatttccaggagggcgaacggggtgcgcttgaagacgttcgggtgcgtcacctcgatgtagccgtcgcgcaactggaagcgactgttcagcggttggatctgcaccggctgctcgcagggcaggatgacttcctcgaagtgctggatgatcaggtcgttcagctcggagatcgccatcaccacccggtagtacttctgcatgaagcgttcgaccgccagcttgacgtcgttgtcttcgtagccgaacagacgggcgatgctgcgctggtgatcgaacagcaggcgatcctcggcgcgcccggcgagcatgtgcagggcatagcggacccgccagaggaactcctggctggaagccagcatgctgcactcgctttccaccaggaagccttcgcgcaccagggcgtgcaggttgaggctgccgaactggcggcgggccatccagaggatggtctggatgtcgcgcaggccgccgggggagcccttgacgttgggctcgaggttgtactcggtgtcgttgtacttggcgtggcggcgctgctgttcgtggcgtttggccaggaagaactccttgctcggccacatgtgcgcgctgccggtaacccgcagcatgcgctggcgcaggctgtcagggccgcagatggtgcggcattccatgagggtggtgatcaccgtcaggtcggcgcgtgcttcctccgcgcactgctgcaccgagcgcacgctctggccgacttccaggccgatgtcccagagcagggtgaggaagccttcgatcggctcgcggaagctctcctggtcctcgctgtcgaggaggatcagcaggtcgacgtcggagtaggggtggagttcgccgcggccgtagccgcccacggcgaccagggcgatgtcggcgtcgtctccccagtcgaagcgctgccaggcctgttgcaggatctggtcgacgcaccaggcgcgatcttcgatcaggcggcggatgtcgcggccgctgttgaagcggttgtcgagcacttcgcggaattgccggatggccttcttgaaggcggcgatcgggctggacttcaaggccagttccgcctggaactgcccgcgatcgaacaattcgggatccacctgcggcatgcggccttcctttatctgctagcggttgggttcgatacgcgagcgccccgtcttggtgcgtttttgcgctgtattggtgcgcgcgctgcgccgaatcggggcgtcggccccgccggaatggggcggggcgtcgaggcgcacggctggcagcaaaagccgggccggatcaggctgccgaggtgcgcgggaaggtttcgtcgttgcgcagggtga

SEQ ID NO: 4642 - DNA, 195 bp, Pseudomonas aeruginosa
cccgacttatcgaggaactatcatgtcccaagtcaacatgcgcgatatgctgaaggccggtgtgcacttcggccaccagacccgttactggaacccgaaaatgggcaagttcattttcggcgcgcgcaacaagatccatatcatcaacctcgaaaagaccctgccgatgttcaacgaggccctgaccttcgttga

SEQ ID NO: 4643 - DNA, 1503 bp, Pseudomonas aeruginosa
caatcgctgggcgaagaagcgtcttctgcccggcgtcgccggccacaaggccggtgtcgatgccgtcagggcggtgatcgaggtctgcgccgaggcaggggtcgaggtcctcaccctgttcgcgttctccagcgagaactggcagcgtccggcggacgaagtcagcgcgctgatggagctgtttctcgtggccctgcgccgcgaggtgcgcaagctcgacgagaacggcatccgcctgcgcatcatcggcgatcgcacgcgtttccatccggagttgcaggcggccatgcgcgaagcggaagccgccactgccggcaatacccgtttcctcctccaggtcgccgccaactacggcggccagtgggacatcgtccaggccgcacagcgcctggcgcgcgaggtccagggcgggcacctggcggcggacgatatctccgccgagctgctccagggctgcctggtgaccggcgaccagccgctgcccgacctgtgcatccgcaccggcggcgagcatcgcatcagcaatttccttctctggcagctggcctacgccgagctgtatttctccgacctgttctggcccgacttcaagcacgcggcgatgcgggctgccctggcggatttctccaagcgccagcgccgcttcggcaagaccagcgagcaagtcgaggccgaggcccgtccgtcatgctgaaacaacggatcatcacggcgctggtgcttttgcccatcgcgctgggtggttttttccttctcgaaggggcgttcttcgccctgttcatcggcgcggtggtgagcctgggggcctgggaatgggcgcgcctggccggctatgaacaacagttcggccgcgttgcctacgcggcgacggtcgccgtgctgatggtcgctctctaccatctgccgcagcttgccggagccgtgctgctgctggcgctggtctggtggacgctggccaccgtgctggtgctcacctacccggaaagcgtcggctactggggcggccgctggcgccgcctgggcatgggcctgctgatcctgttgccggcctggcaggggctggtcctgctcaagcagtggccgctggccaatggcctgatcatcgccgtgatggtgctggtctggggcgcggatatcggcgcctacttctccggcaaggccttcggcaagcgcaagctggcgccgcgggtcagccccggcaagagctgggaaggcgtttacggcggcctggcggccagcctggcgatcaccctggcggtcggcctctaccgcggctggtccctcggcgcgctgctcctggccctgctcggcgcggcgctggtggtgttcgtctcgatcgtcggcgaccttaccgaaagcatgttcaagcgccaatccggaatcaaggacagcagcaacctgctgcccggccacggtggcgtgctggatcgcatcgacagcctgacggcagccatcccggtgttcgcggccctgctctgggccgctggctggggtgcgccatga

SEQ ID NO: 4644 - DNA, 1356 bp, Pseudomonas aeruginosa
gagatgagtgcgctttacatgatcgtcggcaccctggtagccctgggtgtgctggtgacgttccacgaattcggccacttctgggtcgcgcgacgctgcggggtgaaggtcctgcgcttctccgtcggcttcggcacgccgctggtgcgctggcacgaccggcacggcaccgagttcgtggtggcggccattccgctgggcggctacgtcaagatgctcgacgagcgcgaggcggaagtaccggcccatctgctcgaacagtccttcaatcgcaagacggtccgtcagcggatcgccatcgtcgcggctggtcccatcgccaatttcctactggcgattctgttcttctgggtcgtcgccctgctcggtagccagcaggtacgcccggtcatcggttccgtggcgccggagagcctggccgcccaggccggcctggaggccgggcaggagctgctggcggtggatggcgagcccgtcaccggctggaacggggtcaacctgcagctggttcgccgtctcggcgagagcggtacgctggaagtgcgggtgcaggaaaaaggctcgaatgtcgattccacccaccaggtgcgtctggatggctggctgaagggcgaggacaatcccgatcccatcgcctcgctgggcatccggccctggcggccggccttgccgccggtgctggccgaactcgaccccaaggggccggcgcaggccgccgggctgaagctcggcgaccgcttgcagagcatcgatggcatcgccgtcgacgactggcagcaggtggtggacagcgtccgtgcccgtcccgggcagcgcgtccagctcaaggtgctgcgcgacggcgaagtgctggatgttgccctggaactggcggtgcgcggcgagggcaaggcccggagcggctacatgggggcgggggtcgccggtaccgaatggccggtggaaatgctccgcgaagtgagctacggaccgctggaggcggtgggtcaggcgctttcccgaacctggaccatgagcctgctaacgctcgactccataaagaaaatgttgctcggcgagctctcggtaaaaaacttgagcgggccgataaccattgctaaagtggcgggcgcttcagcccagtctggcgtgggggattttctcaatttcctggcctatctgagcattagcttgggggttctcaacctgctgccgatccctgtccttgatggcgggcatctgctgttctatctggttgagtgggtgcgcgggcgcccattatccgaacgggtacaggcttgggggatgcagatcggcatcagtctggtcgttggcgtgatgttgctcgctctggtcaacgatctgagtcgtctgtag

SEQ ID NO: 4645 - DNA, 999 bp, Pseudomonas aeruginosa
cgacgacaagaccgtctcggtgaccttcgtcgtcgacccgggcaagcgcgcctacgtcaaccgcatcaatttccgcggcaacaccaagaccgaagacgaagtgctgcgccgcgaaatgcgccagatggaaggcggctgggcctccacctacctgatcgaccagtccaaggcccgcctggagcgcctcggctacttcaaggaagtcaacgtcgagaccccggcggttcccggcaccgacgaccaggtcgacgtcaactacagcgtcgaagagcaaccgtccggctcgatcaccgccagcgtcggcttcgcccagagcgccggcctgatcctcggcggctcgatcagccagaacaacttcctgggtaccggcaacaaggtcagcatcggcctgacccgcagcgaataccagacccgctacaacttcggcttcgtcgacccctactggaccgtcgacggcgtcagcctcggctacaacgccttctaccggaagaccgactacgacgaactcgacgtcgacgtcgccagctactcggtgaacagcctgggcgccggcatgagcatcggctacccgatcagcgagacctcgcgcctgacctatggcctgagcgtgcagcgcgaccagatcgacaccggccgctacaccgtggacgagatctacgacttcctcgacaaggaaggcgacaacttcaccaacttcaaggcttccatcggctggtccgaatcgaccctgaacaagggcgtgctggccacccgtggtcactcgcagagcctgaccctggaaaccaccctgccgggcagcgacctgtcgttctacaagatcgactaccgcggccaggtcttcgccccgctgaccgacaactacaccatgcgcttccacaccgagctgggctatggcgacggctacggatccaccgagcgcctgccgttctacgagaactactacgccggcggcttcaactcggtgcggggcttcaaggacagcacgctggggcctcgtag

SEQ ID NO: 4646 - DNA, 546 bp, Pseudomonas aeruginosa
taccgagtaacgaaaccatgctttgtgcaggagtgcatcgtgcgtaagttcacccagttcgtcctgatcaccgcagccatcatggcggctccttcggcgttcgctgaaatgaagatcgcggtgctcaactaccagatggcgctgctcgagtccgatgccgccaagcaatacgccgtggatgccgagaagaagttcggcccccagctgaacaagctgaagaacctcgagcgcgacgccaaggctctgcaggacaagctggtttccaacggcagcaagatgtcccagggcgaccgcgagaaggccgagctggacttcaagcagaaggcccgtgacttccagttccagtccaaggaattgaacgagtcgaaggccgccgccgaccgcgacatgctgaagaaactcaagccgaagctggaccaggccgtcgaggagaccatcaagaaaggtggttacgacatggtcatcgaacgtggcgccgtggtcgacgtcaagccgcaatacgacatcacccgccaggtgatcgagcggatgaaccagctgcgttga

SEQ ID NO: 4647 - DNA, 483 bp, Pseudomonas aeruginosa
cgtttttttgcgtcacccttttctgaacaggctccccctaacatgatggacatcaacgagattcgcgaatacctgcctcatcgctatcctttcctgctggtggatcgggtggtagagctggacatcgagggcaagcgcattcgcgcctacaagaatgtcagtatcaatgagccgttcttcaacggacatttccccgagcacccgatcatgccgggcgtgctgatcatcgaggcgatggcccaggcggccggtatcctcggtttcaagatgctcgacgtgaagcccgccgacggcaccctttactacttcgtcggttcggacaagctgcgcttccgccagccggtcctgccgggcgaccaactgcaactgcacgccaagttcatcagcgtgaagcgcagcatctggaaattcgactgccacgctaccgtcgacgacaagccggtatgctcggctgaaatcatctgtgcggaacgcaaactatga

SEQ ID NO: 4648 - DNA, 1671 bp, Pseudomonas aeruginosa
ccgtatctgtcgcctggtgacaagcggcgggcgacgtcaatagcggaaagtcctgccccttcctgccaagtgccattcacagcgaaatttccttcggctcgcacgtcattccgtgtgtgtccgaaacacgcggccttctacccgggaggtcggctgacaacaatccgccacaagcggaacaggggagttatccatgcaagaattcgccactcaggtcgtcgacctgctcaacggccttatctggggcaagatcctcatctggctgctggtcggttgcggcctgtacttcaccgtgcgcctggggctgatccagttccgccacttcggtcataccttcagcgtgctcaagggcagccgccagtcggacgactcgggaatctcctcgttccaggcgctctgcacctctctggcggcgcgggtcggtaccggcaacgtcgccggcgtggcggtagcgatcacgctcggcggtcccggcgcagtgttctggatgtgggcgatcgccctggtggggatggcgaccggcttcgtcgaggcgaccctggcccagttgttcaagattcgcgacgacaagggccagttccgtggcggcccggcctactacatggagaagggcctgggcgcgcgctggatgggcatcctgttctcgatcttcctgatcatcgccttcggtttcgtcttcaactcggtgcaggccaataccatcaccggtgccatgcagggcgccttcggcgtgccgacctggatcagcggcatcgccgtggtgatcctcaccgcgttgatcatcttcggcggcctgcgttccatcgcgcgcttctccgaactggcggtacccttcatggcggtggcctacctgctgctggcggtgggcatcatcctgttcaacctcagcgaactgccgggcgtcctggcgatggtggtgaagagtgccttcggctggcacgaggccgccgccggcggcatcggcgcggcgatcctcaacggcttcaagcgcggcctgttctccaacgaagcaggcatgggctcggcgcccaacgccgccgcctcggccacgccctatccgccgcacccggcgtcccagggctacgtgcagatggccggcgtgttcatcgataccctgctgatctgtaccgcttccgccgccatcatcctgctggccggaccgcaggaaggcgagggcatcatgctggtgcagaatgccctgaccagccaggtcggcgactggggccgctatttcctggcggtgatcatcctgttcttcgccttcacctcgatcgtcgccaactacttctatgccgagaactgcctggtattcctcgagcacaaccacctggcgggcctgttgatcttccgtctgatcgtgctggcgatggtgatgttcggcgcgctggcttcgctgccgttcgtctggaaccttgccgacgtgtcgatgggcctgatggcgatcaccaacctgatcgccatcctgctgctgtccaacctcgcgatcaagctggccaaggactacaacgcccagcgcaaggccggcaagctgccgaccttcgacgccagccagttcccggaagtccagcagaagctcgagccgggcatctgggacgaccgccgcgcctgagcgcggggcgggcgaggcttctcggcgcagccgaggcgcatcgtccgctcttgaacctgtag

SEQ ID NO: 4649 - DNA, 1224 bp, Pseudomonas aeruginosa
ctttgccaccgggcccggtacaatccgggccttgtcgtttttgcgttatttctgctccggggccttcatgaccgtatccttcgttcacctgcgtctgcataccgaattctccctggtcgacggcctggtccgggtcaagcccctggccaaggcagtggcagggctgggcatgccggcggtggcggtcaccgaccagagcaacatgtgctcgctggtgaagttctacaagaccgccatgggcgccggcatcaagccgatctgcggggccgacatctggctcgccagccgcgaggaagatggcccgctcagtcgcctgagcctgctggcgatgaacgcgaagggctatcgcaacctcaccgagctgatttcccgcggttggagcgaaggccagcgcaacggcgagatcatcatcgaacgcgactgggtcaaggaggcggcggaaggcctgatcgcgctgtccgcggccaaggagggcgagatcggccacgctctgctcgacggcgaggaagccaaggccgaggcgctgttgcgcgagtggatggaggtgttccccgagcgcttctacgtcgaagtgcaacgtaccagccgggtcaacgacgaggagcacctccacgcggcggtggctttggcgtcacgctgcaacgcgccgctggtggcgaccaacgacgtgcgcttcatcaagcaggaagacttcgaggcccacgagacccgcgtctgcatcggcgaggggcggaccctcgacgatccgcggcggccgcgtacctattcggaccagcaatacctgaagtcgccggcggaaatggccgagctgttcagcgacctgccggaagcgttggaaaacaccgtcgagatcgccaagcgctgcaacatcgaggtgcagctgggcaagtacttcctgccggacttccccacgcccaatggcatgggcatcgacgactacctgcggcacgcctccttcgaaggtctcgaggagcgcctggaggtgctgttgccgaaggacaccccggactacgaggccaagcgccaggtctatgtcgatcgcctgaacttcgaactcgatatcatcatccagatgggtttccccggttacttcctcatcgtgatggacttcatcaagtgggcgaagaacaacggcgtaccggtaggccccgggcggggctcgggcgccggctcgctggtggcctacgtgctgaagatcaccgacctcgatccgctggcctatga

SEQ ID NO: 4650 - DNA, 2061 bp, Pseudomonas aeruginosa
ggcctacgagcaggaagaaatgctccgcgacttcctcaagagcgacgaggaagccgccgagatctgggagatggccctcaagctggaaggcatcacccgcggtaccggcaagcacgccggtggcgtggtgatcgcgccgaccaagctgaccgacttctcgccgatcgcctgcgacgaggaaggcggcggcctggtgacccagttcgacaaggacgacgtggaggcggccggcctggtgaagttcgacttcctcggcctgcggaccctgaccatcatcaagtgggcgatggagatcatcaaccgcgagcaggccaagaagggcctggagccggtgaacatcgacttcatcccgctggacgacaagccgacctattcgctgctgcagaaggccgagaccactgcggtgttccagctcgaatcgcgcggcatgaaggagctgatcaagaagctcaagccggactgcctggaagacctcatcgcactggtggcgctgttccgcccgggtcctctgcagtcgggcatggtggacgacttcatcaaccgcaagcacggtcgcgccgagctgtcctatccgcaccccgattaccagtacgccggcctggagccggtgctcaagcccacctacggcatcatcctgtaccaggaacaggtgatgcagatcgcccaggtcatggccggctataccctcggtggcgcggacatgctgcgccgggcgatgggcaagaagaagcccgaggaaatggccaagcagcgcggcggtttcatcgagggttgcaagaacaacggcatcgatgccgacctcgcgggcaacatcttcgacctggtggaaaaattcgccggctacggcttcaacaagtcgcactcggcagcctacggcctggtctcctaccagaccgcctggctgaagacccacttcccggcgccgttcatggccgcggtactcaccgcggatatgcagaacaccgacaaggtggtgacgctgatcgaagaatgccggcacatgaagctgcgcatcgtggcgccggacgtgaacaactccgagttccgcttcaccgtcgacgacgatggccggatcgtctatggcctgggcgcgatcaagggcgtcggcgaggggccggtggaggcgatcaccgaatgccgcgccgaaggcgggccgttcaacaccctgttcgacttctgcgaccgcgtcgacctgaaacgcatcaacaagcgcaccctggaagcgctgatccgcgccggtgcgctggatcgcctggggccgcactaccacgacgagctaaaggcctaccaggctaccgtcgacctcaaccgcgccgtgctgctggcggcgatggaggaagcgatccaggccgccgagcagaccgcgcgcagccacgacagcgggcacatggacctgttcggcggagtcttcgccgagccggaggcggatgtctacgccaaccaccgcaaggtcaaggagctgaccctcaaggaacgcctgaagggcgagaaggacaccctcggcctgtacctgaccggccatccgatcgacgagtacgaaggcgaggtgcggcgcttcgcccgccagcgcatcgtcgagctgaagccggcgcgcgatacccagacggtggccgggctgatcgtcaacctgcgggtgatgaagaacaagaagggcgacaagatgggcttcgtcaccctcgacgaccgctccggacggatcgaggcctcgctgttctccgaagccttcgccgcggcccagtcgctgctgcagaccgacgcgctggtggtggtcgagggcgaggtcagccaggacgacttctccggcggactgcgcctgcgcgccaagcgcgtgatgagcctggaggaggcgcgtaccggcctggcggagagcctgcggatgaagctgcacgccgacctgttgaagggcgatcgcctgcgctggctgggcgagctgttcaaccgccatcgcggttcctgcccgatcaccctggactacaccagcgccgacgccaaggccctgctgcagttcggcgagagctggcgggtggatccggcggacgatctgatccaggcattgcgtga

SEQ ID NO: 4651 - DNA, 999 bp, Pseudomonas aeruginosa
ggcgccaaacggaaacggcccactagaatctgcgcacgacggaagcctatgaacccgaactttcttgatttcgaacagccgatcgccgacctgcaagccaagatcgaagagctgcgcctggtgggcaacgacaatgcgctgaacatcagcgacgaaatctcgcgtctgcaggacaagagcaaggcgctcaccgaaaacatcttcggcaatctgtccagttggcagatcgcccagctcgcgcgccatcccaagcgtccctataccctcgactacatcggctacctgttcagcgatttcgaggaactgcacggcgaccggcatttcgccgacgacccggcgatcgtcggtggcgttgcccgcctcgacggttccccggtgatggtcatcggccaccagaaaggccgcgaagtccgtgagaaggtccggcgcaacttcggcatgccgcgtccggaaggctatcgcaaggcctgccgcctgatggaaatggccgaacgcttcaagatgccgatcctcaccttcatcgacacgcccggcgcctacccgggcatcgatgccgaggaacgcggccagagcgaggcgatcgcctggaacctgcgggtgatggcgcgactgaagacgccgatcatcgccaccgtgatcggcgagggcggttccggcggcgcgctggccatcggtgtctgcgaccagttgaacatgctgcaatactccacctattcggtgatctcgccggaaggctgcgcctccatcctctggaagaccgccgagaaggcgccggaagccgccgaggccatgggcatcaccgccgagcgcctgaaaggcctgggcatcgtcgacaaggtcatcgacgaaccgctgggcggcgcccatcgcgatccggcgagcatggccgaatcgatccgtggcgaactgctgacgcaactgaagatgctccagggcctggaaatgggtgagttgctggagcgtcgttacgaccgcctgatgagctacggcgcgccgtaa

SEQ ID NO: 4652 - DNA, 1398 bp, Pseudomonas aeruginosa
gccatccggcgcactggtacgatcgacaagcccggcattcgccgggcttgtcgcatgaggagcgcaagcatgccggcggtgccgctcgaatcccgtctgttacaggccctggcgccctggcgcgaagcggggggctggtgcgtggcgttttccggcgggctggattccacggtgttgctgcatctgctcgcccaactggcccggagcgaagccttgccggcgctgtcggcgctgcatgtccaccatggcttgcaggctgcggcggacggttggccggcgcactgccaggtggtctgccggtcgctgggtatcccgctgcgggtcgagcgggtgcaggtcgccgttggcggcagcatcgagcaggcggcgcgcgacgcccgctatcgcgcattccaggcgaacctgggcgagggacaggtgctgctcaccgcgcagcacctcgacgaccaggccgagaccctgctgttccgcctgttgcgtggagcgggcctgcgcggcctggcggcgatgccggcgagccggccgctgggcggcggccgcctgtgccgacccttgctcggggtttcccgcgccgaactggaagcctatgcgcaggcgcaccggctggactgggtggaggatccttccaaccaggatccgcgcttctcgcgcaactacctgcgccgggagatcatgccgcgtctcgcctcccactggccgcaggccgtcgccggcatggcgcgctgcgcggcgcatctgcgcgaggccgaagacctgctggctgaactggccgccatcgacctccgggcctgccgccaaccctcggaactggattggccggactggctggatctgccccggatcgccctggagcctctgcgccgcctcagcgctgcgcgccagcgcaacctgctgcgggcctggctggggcagctgacgcggttgccggacagtgaccactgggccggctgggagtcgttgcgcgatgccggcgacgatgccgacccgatctggcgcctggagagcggcgagctgcgtcgcggcgcggggcggatctggtggttgccggcggactggcgggcggcggcgggaccgttcgtctgggagcgtcccgctcatccattgcttcttcccggcaatggtcggctggcgttgctcggcgaggttccggcggggccgttgcgcgtcgactaccggcggggtggggaggtgctggccctggccgggcgcggtcgccgcgacctcaagcgattgctcaacgaagcgggcgtaccgagcttcctgcgcggtcgtttgccgctgctcttccgagccgacgaactgctcgcggtggccaacattcctggcctggacagtccccgcgaggggggctggcgactgtcctggagcccgccgacgaacgacccgggtttgagctag

SEQ ID NO: 4653 - DNA, 501 bp, Pseudomonas aeruginosa
aatattccgggaaggcctgagcatggcacagaagatcgttcgcgtcggcgatatccagatcggcaacgacctgccgttcgtgctgttcggcggcatgaacgtgctggagtcgcgcgacctggccatgcaggtctgcgaagaatacgtacgggttaccgagaaactcggtatcccctatgtgttcaaggccagcttcgacaaggccaaccgttcctcgatccactcgttccgtggtccgggcctggaagagggaatgaagatcttcgaagagatcaagaagaccttcaaggtaccggtcatcaccgatgtccacgagccgttccaggcccagccggtggccgaggtctgcgacatcatccagctgccggccttcctctcgcgacagaccgacctggtggtggcgatggccaggaccaacgcggtgatcaatatcaagaaggcccagttcctcgcgccccaggagatgaagcacatcctgaccaagtgcgaggaagccggtaa

SEQ ID NO: 4654 - DNA, 558 bp, Pseudomonas aeruginosa
agcggacgtgatcctggacaacggcatcgtcggcagcgcctgcgcgccttccggtgcttccaccggttcccgcgaggccctcgagctgcgcgatggcgacaagagccgttacctgggcaagggcgtgctgaaagccgtggccaacatcaacggcccgatccgcgacctgctgctgggcaaggacgcggccgaccagaaagccctcgaccacgcgatgatcgagctggacggcaccgagaacaaggccaagctgggcgccaacgcgatcctcgcggtgtccctggctgccgccaaggccgccgcacaggccaagggcgtaccgctgtacgcgcacatcgccgacctcaacggcactcccggccagtactccatgccggtgccgatgatgaacatcatcaacggcggcgagcatgcggacaacaacgtcgatatccaggaattcatggtccagccggtcggcgcgaagaacttcgccgaggcgctgcgcatgggcgccgagatcttccatcacctcaaggccgtgctgaaggcccgtggcctgaacaccgccgtcggtga

SEQ ID NO: 4655 - DNA, 813 bp, Pseudomonas aeruginosa
agaaaggcaccgagaccgtcgaggagcgtgcgcggcacgagctcggcatggtcaaggacggcgaaaccctctaccagctcgccaagtgagctgacgacccttctcccgatgacgacttccgaccttcccgccttctggacggtgatccccgccgccggcgtgggttcgcgcatgcgcgccgaccgcccgaagcaatatctcgatcttgccggtcgcaccgtgatcgagcgtaccctcgattgtttcctcgaacacccgatgctcaggggcctggtggtctgcctggccgaggacgatccctactggcccgggctggactgcgccgccagccggcatgtgcagcgcgccgccgggggcgccgagcgcgccggctcggtgttgaacggcttgctgcgcctgctggagttgggggcacaggccgacgactgggtgctggtgcatgacgccgcgcggccgaacctgacccgcggcgacctcgaccgcctgctcgaagaactcgccgaagatccggtcggcgggctgctggcggtgccggcgagggacactctcaagcgctccgaccgcgacggccgggtcagcgaaaccatcgaccgctcggtggtctggctggcctatacgccgcagatgttccgcctcggcgccctgcaccgggcgctggccgatgcgttggtggccggcgtggcgatcaccgacgaggcttcggcgatggagtgggccggctatgcgccgaagctggtggaagggcgcgccgacaacctgaagatcaccaccccggaagacctgctgcgcctgcagcgcagttttccgcactga

SEQ ID NO: 4656 - DNA, 1200 bp, Pseudomonas aeruginosa
ttattccttgaaacgcggttttctacactttccgtttcagtgggtcgcttagcggcccgccggcttccatcgttcaggagttcccagatgatcaagtcccgtgccgccgtcgccttcgcccccaacaagccgttggaaatcgtcgaggtggatgtggcgccgccgcagaagggcgaggtactggtgcgcatcgtcgccaccggcgtctgccataccgacgcgtacaccctgtccggccaggattccgagggggtgttcccgtgcatcctgggccacgaaggtggcggcatcgtcgaagcggtgggcgagggcgtgacctccctgcaggtgggcgaccatgtcatcccgctctacaccgccgagtgcggcaagtgcaaattctgcctgtccggcaagaccaacctctgccaggccgtgcgcgccacccagggcaagggcctgatgcccgacggcaccagccgtttctcctacaagggcgagccggtcttccactacatgggctgctcgaccttctccgaatacaccgtgctgccggaaatctccctggcgaagattcccaaggatgccccgctggagaaggtctgcctgcttggctgcggcgtcaccaccgggatcggtgccgtgctgaacaccgccaaggtggaagagggcgctaccgttgccatcttcggcctgggcggcatcggcctggcagcgatcatcggggcgaagatggccaaggccgcgcgcatcatcgcggtcgacatcaacccgggcaagttcgatatcgccagggaactgggcgccaccgacttcatcaatccgaaggactacgacaagccgatccaggacgtcatcgtcgaactgaccgatggcggcgtcgactactccttcgagtgcgtcggcaacgtgcagttgatgcgcgccgcgctggaatgctgccacaagggctggggcgagtcggtgatcatcggtgtcgccggtgccggccaggaaatcagcacccggccgttccaactggtcaccggccgcgtctggcgcggttcggcgttcggcggggtgcgcgggcgcagcgagctgccgagctatgtcgagaaggcgcagaagggcgagatcccgctggataccttcatcacccacaccatggggctggaggacatcaacgaggccttcgagctgatgcacgaaggcaagagcatccgcaccgtcattcattactga

SEQ ID NO: 4657 - DNA, 495 bp, Pseudomonas aeruginosa
ttccaaccagggcgttttttcatgcgaattggccatggctacgacgtgcatcgcttcggcgagggcgacttcatcaccctcggcggcgtgcgcattccccacaaacatgggctggtcgcccactccgacggcgacgtgctgctgcacgccttgtccgatgcgctgctcggcgcggcggcgctgggcgacatcggcaagcacttcccggacaccgacccgcggttcaagggcgccgacagtcgcgcgctgctgcgacacgtggtcgccatcgtcgccgagaagggctggaaggtcggcaacgtcgacgccaccatcgtcgcccaggcgccgaagatggcgccacacatcgagaccatgcgcgggttgatcgccgaggacctcggcgtcgcggtcgaccaggtcaacgtcaaggccaccactaccgagcggctaggtttcaccggacgcgaagagggcattgctgtacatgcggtcgctttgctgatggcccgatga

SEQ ID NO: 4658 - DNA, 588 bp, Pseudomonas aeruginosa
ccgggctgcgggcggagcgtgcccttctcgacgcgcgcttggaacgtatcgccgcggacggcgtgcccaattatttcggcctgcaacgcttcggccacggcggcggcaacctggtcgacgcgcgcagttgcgcggaacaggacctgctgccggcgaaccgcaacctgcgttcgcgcttcctttccgccgggcgcagctacctgttcaatcgcctgctcgccgagcgggtcgcggagggtagctggaaccgggcagcggtcggtgacctgctggcctttaccgacagccgcagctttttcctcgctggcgaggaagaatgccgcgatgcccgtctggccgccctcgacctgcaccccaccggaccgctctggggcgagggcgatccgccgagcggcgccggcgtcctcgaacgcgagctggccctggccgggcgcgagccggcgctctgccgctggctggcgaaggcgggcatggcgcacgaacggcgcatcctgcggctccccatccaggggctggcgtggcattatccggaacctgatgttctgcaactggaattcgtcctgccggccggttgtttcgccaccgtag

SEQ ID NO: 4659 - DNA, 1122 bp, Pseudomonas aeruginosa
cgtcctctattccggtaccgtggcggcggccatcgaagggcgcttcctgaaggggccggccttcgccttctcgctggtctcgcggttgacggacaacctgcccaccgccatgcacttcgcccgcctgctggtctccgcccacgagcgcctggccgtgccgccgcgtaccgtgctcaacgtcaatatcccgaacctgccgctggatcgcgtacgtggtatccaactgacccgcctcgggcaccgtgcccgtgccgccgcaccggtgaaggtggtcaatccgcgcggcaaggaaggctactggatcgccgcggccggcgatgccgaggacggcgggccggggacggatttccacgcggtcatgcaaggctacgtgtcgatcaccccgttgcagctggaccgcaccttccacgaagccttcggcggcctcgacgagtggctgggaggactgacgtgatgtccgaagacctgcatcgccgaggtatcggcatgacctcccagcgtacccgagagcgcctgatccagcgcctgtacgaagaaggcctgtccaacgcccacgtgctcgaggtgatccgccgcacgccgcgtcatctgttcgtcgacgaggcgctctcgcatcgcgcctacgaagacaccgccctgccgatcggccacaaccagaccatttcccagccgttcatggtggcgcggatgaccgagttgctgctggcggccggcccgctggacaaggtcatggagatcggtaccgggtccggctaccagaccgcggtgctggcgcaactggtcgagcgggtcttctccgtcgagcggatccaggcgttgcaggacaaggccaaggagcgtcttgcggagctaaacctgcgtaatgttgtctttcgttggggcgatggttgggaaggctggtcggcgttggctccctacaatggaatcatcgtcaccgcggcggccacggaagtcccgcagtcgttgctggaccagttggccccggggggccgtctggtgatcccggtcggtggcggcgaggtccagcaactgatgctgatcgtccgcaccgaggacgggttcagccgccaggtactcgactcggtacgtttcgtcccgctgctcaacggcccgatcgcctga

SEQ ID NO: 4660 - DNA, 909 bp, Pseudomonas aeruginosa
acgaaagcgaagaagatggataagggggaaggattgaggctagcagcgaccctgcggcaatggactcggctctatggtggctgccacctgttgcttggggccgtcgtctgttcccttctcgccgcctgttcgtcgtcgcctcccggcggggtcaaggtcgtcgatcgcaacggttccgcgcctgccgctgcgcggcgtacgccggtcaccagcgggcagtacatcgtgcgccgcggcgacaccctgtattccattgccttccgcttcggctgggactggaaagccctggccgcgcgcaatggcatcgcgccgccctataccatccaggtcggtcaagctatccaatttggtgggcgggcatcggcgcaaccgtccgtcgcgaaaaacacgccggtcgtcgctgcgcccgtggcgaccaagcctaccccggttccacccgcagttagtacgtcggtacctgtcaagcccgcaccggctccggcctcgaccacgaccccacccagcagcggcgcgactcccgtcgtcacggggcctgcggtgggggggtgggcatggcccgcgagcggtactctgatcggccgttttgcctcaaacggaagtttgaataaagggattgatatagccggtcaattgggccagcctgtcctggctgcgtctggtgggaccgttgtatacgccggtagtggtttgcggggctacggcaagttggtcatcatcaaacacaacgagacctacgtgagtgcctacggtcacaaccgcaggctgctggtgcgggaagggcaacaggtcaaggtagggcaatcgattgccgagatgggctccacaggaaccgatcgggtgaagctgcacttcgagattcgccgccagggtaagcctgtcgatccactgcaatatttgccacgtcgctga

SEQ ID NO: 4661 - DNA, 492 bp, Pseudomonas aeruginosa
gcgagcaggcagccggcggcgccgatggccagggtcaggttctggcagccgaagcctttcaggtcctgggtgccgaattgctggcagaggctcttgtgcgccgagtcgcgatcgaagtcccatggcgcgcggcgacgtacgccgcggcgcttctccgccggcaggccctgtggccagtcgtcgggaatcagcagctcggccgggttgaggcgctccagttcggccagcagggtttcccagccttttatctcctggacgctgaagcggccgctggtgatgtccagcacggcgaggccgaacaggcgctcgtcgccgaggatcgccgccagcaggttgtcgcggcgttcgtcgagcagcgcttcgtcgctcaccgtaccgggagtgatgatccgcaccacttggcgctccaccggccccttgctggtggccggatcgccgatctgctcgcagatcgccaccgactcgccgagcttgaccagcttggccaggtag

SEQ ID NO: 4662 - DNA, 435 bp, Pseudomonas aeruginosa
tccctttccgtttctaccctggagaacagtgatgaccctgatggagtccgacctgaccgcactggccgcccgcctcggcgaaagccttcgttacctgggcgagcaggtcagcacggcggaatcctgcaccggtggcggcatcgccgaggcgatcacccgcatcccggggagttcgggctggttcgaggctggctacgtgacctactcgaaccgccagaagaccctccagctggaggtgcccgagtcgctgttcccggcagtcggcgcggtcagccgggaagtggtcgaggccatggtgcgcggcgcccagcggcacagcggggcgcgtttcgcggtggcggtgagcggtgtcgccgggcccgacggtggctcgccggaaaagccggtaggcacggtctggctggcttgggccgacggcgagcggctggtcagtga

SEQ ID NO: 4663 - DNA, 975 bp, Pseudomonas aeruginosa
ggctctcgaattggcccgccggctgttcgccgagcagcgcggcgagcgtcccctcgaacgggacaacccgctggccctgcgccatcccatcgaaccgatcatcccgccgctgcgctatcgcgacgacgcctgctcgccgatggccgcgctggaccgcttctataccgaactggtggaggccaaccccgacctgcgcgcccgggtcggcaatcccgacgaattggccagcaaccgcctcggcggcgtgctcaaggcgctcaagcatcgggtcagcgagccggagagcgaactggaatcggtgagcggtcgggtcatcaccgcgctcaacgaggaggcggtggtgtccgcctgcctggccaaccagggcggactcaacctggttgccagctacgaagcgttctgcgtgaagatgctcggcgcggtgcgccagaccctgatcttcgcccgccagcagaaggaattccggcgtccggccggctggctgggctggccgctggtcgctacttcgcatacctgggagaacggcaagaaccagcagtcgcaccaggacaccaccttctgcgatgccctgcttggcgagatgagcgacatggtccgggtgctcttcccggccgatcacaacagcgccctggcgctgctaccgacgatctaccgcagccggggccaactggcctgcctggtgatccccaagcgcgaccggccgatggtgttcgacgccgtccaggccgagcgcctggcccgcgacggcgcgatcctggtcgaggagcgctgcggctccgatccgctgctgctgatcgccaacggcagctaccagctcgaacagatgcgccgcgccgcgcagcgcctggccgaggccgggcaggcctaccggctggtctacctgcaggagccgggacgcttccgcgcgccgcgcgatcgctgggaggtcgaggcggtggccgacgaggcgctggtggaacgactgttcccggatag

SEQ ID NO: 4664 - DNA, 1080 bp, Pseudomonas aeruginosa
tcgttccagttgaacagatacagcttctcggcggcggtggcctgggcggctcctgccatgagggttgcgacgagcaacagctttttcatcatggttccttgttacggggtggcagggctccggaaaccggagcagggcaaggccgcgggcctctccgggaggcccgcgggtttcggcggatcaatggcccttgatggcgctgggggagagtttcgaggcgatcacgatcagcaccagggtgagcagcatcagcagggtggagacggcgttcacttcgggcgtcacggcgatcttgatcatggtgtagatctgcgtcggcagggtggcgaagccgccgccggcggtgaagaaggtgatcacgaagtcgtcgatggacagggtgaaggccatcagcgcgccggcgacgatgcccggcatgatcagcggcagggtcaccaggcggaagctctgccagggcgtggcaccgaggtcgcgggccgcctcggtgaggctttcgtccatgcccgacatgcgcgcctgcaccaccagggcgacgaagccgaccgagaaggtgatgtgcgcgagggtcaccgagagcatgcccaggctcatgttcaggccgatgaagaagatcaccagcgagacccccatcaggagttccggaatggcgatcggggtcagcaccagcaggggcagcacgcgcagcttgaagcgatgcagggcgaccccggcgagggtgccgagcagggtcgccacgctggccgaaaccagcgcgatgaccagcgagttggcggcggcctggagcatgtcgcggttgccgaacagcttgcggtaccagtccagggtgaagcccacccactcggcgttcagccgcgagtcgttgaaggagtacagcaccacgatcaccagcggtacgtagaggaacaggtacaccagcgcggtggcgctccagagcaggtagggcctacgcatgggcgcctcccttgcgggcgcgcgcggcgcccatgccgagggcgaccagcagcaggatgcagccggtcagggcgatcgacagcgcgctgccgaacggccagtcgcgggagtcgaggaactggctcttga

SEQ ID NO: 4665 - DNA, 684 bp, Pseudomonas aeruginosa
ataccagtgccgcgccggcggcgagagcgggaaggtcacccgccagaagcgttgccaacgaccggcgccgaggtcctgggcggcgtccagcagggccgggtcgtgtttctccaggttggcgtagagcggcaggatcatgaacggcaggtgcacgtagaccatgcacaggatcaccgcgaacggggtgaacatcaggctgatcggctgcgcgccgaacaggtccagtgcggcgttgatcccgcgggtcagggcaccggacggcgagaggatgatcatccaggcgtagacgcgtaccagcaggttgctccaaaacggcaggatcaccagcaggatcagcaggttgcgccacttcgccggggcccgggcgagggtggtcgccaccgggtaggcgagcagcaggcaggccagggtggtgaccagggcgtagccgaaggatttgacgaacagttgcaggtacacccagctctcggtgagccgggtgtagttctccacgctgaggtcgtagacggtctgcccgtcctcgctgtacatccagggcgccaggccgccgtagtcgccgggaaagcggaacgaggcgaacagcatgatcagcgccggaaccaggaagaagaacagcagatacgcttgcggcggccagaccagcagccacttgccgaggttctttctcatcgtctcaggccctga

SEQ ID NO: 4666 - DNA, 966 bp, Pseudomonas aeruginosa
aatttcgcggtcgctttccagcccgtttcctcgagtcttcgatgttccttcgcccgtcctttccgtatcgggagcctgcccgatgagccatgccgtttcccgcttgcgccaggagcgcctggcgcgcagcctgaaacccttcgtcgcgcgcggttcgcgcatgccgcgctgcgaaggctgtcggctgctgccgagctattgcatgtgcgcctggcggccgcgggtcgaggcgcgcgcaggcatgtgcctggtcatgcacgacatcgaggcgctgaaaccgaccaacaccggctggctgatcgccgataccgtggccgacaccttcgccttcggctggtcgcgcaccgaggtcgacccgcgcttgctggagttgctggccgacccgcagtggcagccatacctggtgttccccggcgaatacgtggcggcggagcgggtggtgaacgaggtcgccccgctggcggaaggcaagcgaccgctgttcatcctgctcgacgcgacctggaccgaggcgcgcaagatgttccgcaagagtccttacctggagccgttcccggtgctcagcctgctgcccgagcagctctcgcgctatcgcctgcgtcgctcgacccgtggcgagcacctgtgcaccgccgaagtggcggcgctgtgcctggagctggctggcgacgaggccgcgggcgaggcgctcggcgcctacctggaggtgttcagcgagcgctacctgggcgccaagcggcacattccgctggacgaggccagcccggcgcaccgtgccctggcgccgttccgtggctgagtgtcaggccgggcgcgcttcggcggcgagcttgcgcggccacaactgcgccaccagcatgcccgccagcatcagcgcgcaaccgaaatagccgcgcaggtgcagggtctcggcgaggaacagggcgccggcgatggcggcgaacaccgcttccagggacaggatga

SEQ ID NO: 4667 - DNA, 210 bp, Pseudomonas aeruginosa
  unsure (23): Identity of nucleotide at the above locations are unknown.
aaccggttccgccgccgggccgntggcgatcccacctggcggggccaccggcagattcctacggggcagcagatcgagatcttccagggcgtcgagatcggccgcccgtcgcgcatgtacgcccgcgccgagggcgccggcgagcgggttttgacggtggaagtgtcgggcaacggcgcgcctttcgccgaaggccgggcctacctgtga

SEQ ID NO: 4668 - DNA, 663 bp, Pseudomonas aeruginosa
gcccagccaggccgcaaactggcggcccgtgcggaattgccgtgcatcaccggcggatgccgccaccgcgctggcgctgatcgggccgatgccttccaccgccagcaggcgctggatgcgggcatcgccacgtacgtgagcctgaatctgtcgctccagtcgagcgatgcgcgcctccagcgtctgcaattcatctttcaattcacgcaacagctcgcccatcggggccggcaagggcgccggttcggtagccgtgaccgtttcgagcaaggccatcgtcgccgctcgcccacgtcgcgtcgcgatcagcccgaactcgcccagcaagccacgcacctcattgcacaacgccgtgcgggcccgcaccagacgactgcgcacccgatgcaccgactgcacggcctgctgctctgcgctcttcaccgggacatagcgcatgctcggacgactggcggcttcgcagatcgcctcggcgtcgtgtgcatcgtgcttgtcccccttgacgtttggtttgacgaactgcggtgcgatcatgcgtatcgtgtggcccagctcccgcaactcgcgcgcccagttattgcgcactgccgcaggcctccttcgcccaccaagccacggcgggcagtttggcgaaagaaatcccgcacctggtgccccccttga

SEQ ID NO: 4669 - DNA, 726 bp, Pseudomonas aeruginosa
  unsure (178),(207),(466): Identity of nucleotide at the above locations are unknown.
cggtggaagtgtcgggcaacggcgcgcctttcgccgaaggccgggcctacctgtgaacgggcagaacggaggaacgccatgatgggcgtcaacgcgaacatttccgagtccctcaccgggaccatcgaagcccctttcccggagttggaggcgccgccggcgaaccccatggaggtgntgcgcaactggctggaacgcgcccgccgntacggcgtgcgcgagccgcgggcactggccctggccacggtcgacgggcagggccggccgtcgacgcggatcgtggtgatcgccgagctgggcgagcgcggggtggtgttcgccacccacgccgatagccagaagggccgcgaactggcacagaacccctgggcctcgggggtgctgtactggcgcgagagcagccagcagatcatcctcaacggccgcgccgaacgcctgcccgacgagcgcgccgacgcccagtggntgagccgcccgtaccagacccacccgatgtcgatcgcctcgcggcagagcgaaaccctcgccgacatccacgccctgcgcgccgaagcccggcgcctggcggaaactgacggcccgctgccgcgcccgccgggctactgcctgttcgaactgtgcctggagtcggtggagttctggggcaacggcaccgagcggctgcacgagcgcctgcgctacgaccgcgacgaaggaggctggaagcaccgctacctgcaaccgtga

SEQ ID NO: 4670 - DNA, 993 bp, Pseudomonas aeruginosa
ttcccagggggcaagggcgttgaatcgttcacgaggaatggggtatgtggtcgcccaaattcaaggggggcaccaggtgcgggatttctttcgccaaactgcccgccgtggcttggtgggcgaaggaggcctgcggcagtgcgcaataactgggcgcgcgagttgcgggagctgggccacacgatacgcatgatcgcaccgcagttcgtcaaaccaaacgtcaagggggacaagcacgatgcacacgacgccgaggcgatctgcgaagccgccagtcgtccgagcatgcgctatgtcccggtgaagagcgcagagcagcaggccgtgcagtcggtgcatcgggtgcgcagtcgtctggtgcgggcccgcacggcgttgtgcaatgaggtgcgtggcttgctgggcgagttcgggctgatcgcgacgcgacgtgggcgagcggcgacgatggccttgctcgaaacggtcacggctaccgaaccggcgcccttgccggccccgatgggcgagctgttgcgtgaattgaaagatgaattgcagacgctggaggcgcgcatcgctcgactggagcgacagattcaggctcacgtacgtggcgatgcccgcatccagcgcctgctggcggtggaaggcatcggcccgatcagcgccagcgcggtggcggcatccgccggtgatgcacggcaattccgcacgggccgccagtttgcggcctggctgggcctagtgccacggcagcactccacgggcgggcagcagcgcttgggcaacatcagcaagcgcggcgatacctacttgcggaccttggtcatccatggcggcccgtgcagtcgtggggttgttgcgccaacaagaccgatgcccgccagccgctggctgcaaggtctgctgcaacggcgtcctgccaatgtcgtcgccgttgccatggccaacaagaatgcccggatcctttgggccttactcagccgggagacatgctaccggcccggttga

SEQ ID NO: 4671 - DNA, 324 bp, Pseudomonas aeruginosa
cgccagcgggtactggagacgggccaggcgatccgcctgatgagcgaagatatggacaatacctcggcgctggtcggcggcctggcggaaaaggcccaggacatttccaaggtcctcgacgtgatccgcggtatcgccgaacagaccaatctcctggcgctcaacgcggccatcgaggcggctcgcgccggcgagcagggccgcggtttcgccgtggtcgccgacgaggttcgcgccctcgcccatcgcacccaggaatccacccgcgagatcgagcagatgatcgccaacatccaacagaagaagacgtccagggacacatga

SEQ ID NO: 4672 - DNA, 198 bp, Pseudomonas aeruginosa
ccatcaacaccgctgccgccaacagtgttagatctgatcctggccttgtcgaccgaaacgctggtcaagcgctccactgcggttaaggcctggccccttctctgggcctggctgccagtcttgattgcaagctccaacgagtgcggcgataagaagggagtttcaagcgggcaagcccaaaaactgcatagtgcgtga

SEQ ID NO: 4673 - DNA, 768 bp, Pseudomonas aeruginosa
atggatttttcaattaatcccccccagcgaattgtctttgtgggactaggaacgattgcccagtccttccttcctctcctttctaaggttcacgacttatctactttagaaatctacgcgatcgatccaaaaacaccaccgcttattgagtactttgctaacagttttggcttaaaatttatcaactctgcaattgatcaaatcaactatcgcgacattcttgtgccgattcttggtgaagggacggttctaataaatctatcaaccgatgtctcaagtcttgccctgatagaattatgccgctccgcaggggctctttatttatacacatgcattgagccgtggaagggcggatatgatgacccaaccataccactgcataagcgaactaactatcacttaagagaacaaatgctgtctctgaaaaagaggctaggctcaggggtgacggctctcgtggcgcatggcgcgaatcctgggttggtatcccacttcgttaaacgtgctcttttagatttagcggaagagatattgggtgattgtaaaaagccctctaataaagagcagtgggctatcctaagccaaagattgggtgtcaaagtaatccatgtcgcagagtacgactcgccaatttctcataaatctacggagaagggtgagttcgtaaatacttggtcagtgcctgggttcctaaatgagtccccacaaacggcagagttggggtggggaaatcaccaacgaattccacccccggatgcgtcaatgcat

SEQ ID NO: 4674 - DNA, 576 bp, Pseudomonas aeruginosa
ttttcacttgcacatcacgcactatgcagtttttgggcttgcccgcttgaaactcccttcttatcgccgcactcgttggagcttgcaatcaagactggcagccaggcccagagaaggggccaggccttaaccgcagtggagcgcttgaccagcgtttcggtcgacaaggccaggatcagatctaacactgttggcggcagcggtgttgatggtcatgtgtccctggacgtcttcttctgttggatgttggcgatcatctgctcgatctcgcgggtggattcctgggtgcgatgggcgagggcgcgaacctcgtcggcgaccacggcgaaaccgcggccctgctcgccggcgcgagccgcctcgatggccgcgttgagcgccaggagattggtctgttcggcgataccgcggatcacgtcgaggaccttggaaatgtcctgggccttttccgccaggccgccgaccagcgccgaggtattgtccatatcttcgctcatcaggcggatcgcctggcccgtctccagtacccgctggcgtcagttgtcagccgccttcaccatggggtatgggcgcgcg

SEQ ID NO: 4675 - DNA, 2865 bp, Pseudomonas aeruginosa
gcggccgaagcgtacccacggctggtcggcgaatcgctcgcgggcggcggcgaggaagtagctggaaacgtcggtgaacaggtagtccacctccgcccctcgctgcaccagcggcgccaaccgggcgatcaccgtgcggctggcggcggcggtgccggcgccaagctccagcaggcgccagcgccgttgcggctggcgctcgacgatggcggcgatggcctcggccatggcctcgtgcagcgcctgggcatgcaggccctggctgtacatggcctcggcgatgcgcgccgagccctgcgggaacatcagcgccgccgggctgatccgcccggccagttgctcgccgagggattgcgcgctgtcacgcaggtaggcgaccagctcggccggccagagcgccgccggcgcgcagccggcgaacgccgtccaggcgtcctccggactctgcgcgggacgctcggcgcagcccagccagccctcgccctcggcgcgcaggtagccgccctcctccagctggcgcaaccagtggcgcagcaggcgctggcgcgcctcggcgatacccaggcgctggcacagggtggcgaagtccagcggcgtcgcactggcgaacagaccgctgccggccagccaggcggccagcgaggcgaggcaggcacggtcgagtgcggccaccgccgcggcgatgccctcctcgctgccccagtcgcggcgcaaggcctgggccgcccgctggcgcaccgcgtcgagcgccgtacgcggatcctcgccagcctccgccggcgcatgcagggtgacgaagctggccaggctgcgctcgtgggtctcgccgagcaccacggtggccgccagattgacctgcggatgagcgcacagcgcggcgtccagctcggccagttcgatgcggtggccgcgaatcttcacctggtcgtcctcgcggccgaggaactcgatgctgccgtcggccagatagcggccgaggtcgccggtgcgatacaggcgacggccatcggggtgacggacgaagcgttcggcggtgcgctgcggatcgccggcgtagccgagcgccaggcccaccccgccgatatggatctcgccgcgcacgcccggcgggcagcgccgcccgcgggcatccaggacttccacgctctgcccgcgcagggcacggccataagggatgctggccagctcggtgtgctgcgggcggatcggctgctcgatcgaccagatcgccgcctcggtggcgccgcccaggctgaacagcgcgctgtccggccagcgccgccaccatcgggtcggcaggctgaccggaatccagtcaccggaccagagcacgcagcgcggtcccggcaggtgacgttgcggctcgctctccaggtaatcgatgagcatctggccttgggccggcaccgagttccacagggtgatggcgtggcgttccagcagttccgcccagtgcgatggatcgctgccgcgcgccgggtccgggaggaccacctgggcccccgccgcggtggcgccgaagaagtcgtagaccgagaggtcgaagctcagctcggcgaggccgaggacgcggtcgttggcgtcgacgccgtagcgctggttgatgtcgagcagcgtgttgctcaccgccgcatggctgagcatcacgccctttggcgtgccggtggagccggaggtgtagatcacgtaggcgaggtcgtccgccgccacctccgccgcgggcggtggcggccaggcgctgtcggcggccagccggtcgatggccacgcaggcgcagccgacgtccgggacatcgctttccaggcagaccagcgcgaccacttcggcgctggcgaggatcgcctggcgccgcagcggaggctggcggatgtccaccggcacataggcggcgccggcctggaggatgccgatcaccgcgaccaattgcgcggcgcttttcggcagcatcaccgcgacccgccggccacggcccgcgccgtgcgcttccaggacgcggcgcagggcggtggcgtgctgggcgacctggcggtagctgtagctgccggcggcatcgtggatcgccgtggcgtcgggggtcagcagggcacgctcggcgaaaccggcggcgatgctccgggcactaccgggcaacgcctgcggcggcgcctcgacgggttccgtggcatcgccgtcggtccaggcgcgcgggctctgcgccaggcgccggagcagcccgacgaagtcgtcgaacatggcttccgcctggccctcggggaacaacccgaggcgtacgtcccagccgatctccaggccgccgaactggtcggtgacctggcagtccagccagacctgcggggtctggctgatcatgtagcgtggcgcgcgcggcgcctcgccatcgccgagcaggcgctgcacgctgccgatgccactggtgaacaccaccggcatcaggtcggcgccgcgaccgcgccggcgcgccagttcgcgcagcaggtcgacgccgctgaaggtcgggtggtcgaggtcgtcgaacatctgctcgccgatgcgtcgggcacgctcgacgaaactgtcgccgtggcggctgtccactgccagcaggctgagcgcggtgaagtcaccgagcacctgcgccagctgcggatgcagcggcggccggttgagtaccgtcaggttgagacagaacgccggtgcctggctccagcgaccgatggtctcggcgaaggccgccaaggccacgccggcagcgctcaggccgtgttcgccggcgcgcgcgccgagcgcctgccaggcggcctcgtcgaggcgcgcgtggaagtgccggaagcgcgtggaccgggtgtccggctgcacccgcagcggcaggtcgggacgccccggtag

SEQ ID NO: 4676 - DNA, 414 bp, Pseudomonas aeruginosa
cgacactcgccgagtgcgcgggtcatgctctcggccaggcggcgacgatcgaccttgccattgccgttcaacggcaggcttggcaggcaccacaggcgttcgggccgcatcgcctggggcaggcgttgctccaggccggcctggagcgcggcggcgtcgagcccgagtcccggcgccagcgcctcgaccagggcgagccgttcgctgcgccacaggcaacgcggcgccagtcccgcagcggcgagatcggccaacaggctcggcaactccgccaggcgcagcggccggtcgtcgagcaaggccgcaccgagcagcgccagtggcgactcgcatagcaggtccaccagcaacaggcggccctgcgggcgcagcagcgccgccgccagcgccaggccttcgcggctggcctcgtag

SEQ ID NO: 4677 - DNA, 447 bp, Pseudomonas aeruginosa
cgaccgaggtgctcggcatgtagcaggccgtcgtccagcgcctgcaccacgatccgttccggcaagcgggtggcggcggcgtcgatgaggacgcggctgcgttcgaagagggtcagttccagccccgggcgcaacagcgaggccatgccctggtcgagccagagcccggcgcgggtatccagcaccgccacccgcaggcgttcgccggcagccggcgtcggcagcgcttcgagcaggcgcgccaggggcctcgcggccgtccggcaggcgcgcggccaccgcctgcggcgccagccagggatcgaggagcagcgcggccggcgcctgttcgccggcgagcaggccgcgcagagcgttgcccatcgcggtcagccccgcggcctgccagccgagccggcgcaacgcctcgtcgagcgacggcagcgcgctggcggcggagtccgctag

SEQ ID NO: 4678 - DNA, 1842 bp, Pseudomonas aeruginosa
ttccatggagccttcggcccgtggcgccaggcgcggtaccagcaccgcgccgaggctcgccacgccaccgccgagcaccgccgcgcaggcgctatccacgccagcctgggcgcacagcgcggcctccacctcgcccaactcgatgcgctggccgcgcactttcacctgctggtcgacccgaccgaggaattccagggtaccgtcgccccagtagcgaccgcgatcgccggtgcgataccagcggccctgggcatcgtggacgaagcgccgggcgctgagttcgggatcgttgcgatagccgcgggccaggctggcgccgccgatccacagctcgccgaccaccaggtccggcacgtcgcgcccgtgggtgtcgaccacccggtaggcctgtcccggcaatggccggccgtagggaatcgaacgccagtgcggcggcaccgtatcgacgctctgcaggttcgaccagatgcccgcttcggtagcgccacccagcacatgcaggcggcagccttcggcacaacgtgggcgcaggcggccgggcaggtccagggccacccagtcgccggacagcagcaccgcccgcagactgcgatagtcggcctggctcgccggcaggctgagggccatctccagcaaggccggcgccgagttccacaggctcaccgcatgccgctggatagcctccgcccaggcagcggcatcgcgcgcctgttcctgggccggcaggaccaggctggcaccggcgccgaggccgccgaacaggtcgaagaccgacagatcgaagtccagcgcggagaccgccagcaagcgatccgatgcgttcacccgcagcaggtcgagcagcgcgtcgatggtattgatcgccgccgcgtggctgacctcgacgcccttgggcaccccggtggagcccgaggtgtagatcacataggcactcgcctgcggcgccagcggcacgggggcggccagcgccgggccgcgcagcaggcgctggacatccaggcgcggcggcaaggcctgcggatcgtcctcctcggtgatcgccaggcataccccggcggcctcttcgatcaggcgccgccgtgcgggcggctggtcgatgtccagcggcacgtagcaggcgcctgcggcgagcacgccgaataccgccgcgacctgctgcggtccgcgcggcaggctgacctcgaccgcgtcgccagggcgcaccccggcttcgcgcaggccgccggcgatgcgcagcgcacgctcggccagttcgccgcgggtgacacgttggtcgcgatagagcagcgcgtcggcatccggcgcctcggcggcgcgaaggaagaagtcgcgatgcagggtgcgcgccgtggcgcatgccggctggccgttgagcagggcccggcgcgcctgctgcgcccagggcaacggcagatcggcgggctgctcccaggcgctgtcgcagagacgctggagcagccccacgtaggcttcgaacatggtttccggcaggccttcggggaacaggccgacgacgctgtcccaggccagcaggataccgtcgcccacccggtagagctggtggtcgagccagacctgcggggtctgcgagagcatgtcgtggagatcgccgaaagcgtcgcggaaggccgccgggacgaagccctcctcgcccaggttgctggcgaacaccaccggcgccgagcgtggctggcccctgccggcgcgcctcgcggagcacctccagggcggggaatgcggcgtggtcgatggctccgtggaggttgcgctggaagctcttcaccgcctcggcgaaggacaccccggcctgcatccggcactccagcagcaacagggtggtga

SEQ ID NO: 4679 - DNA, 720 bp, Pseudomonas aeruginosa
ggagaaattccgcgctttcgctccagcgcgccaggaccagcgcgaaggcgcagccgaacacgctggacaaggtcacgccatgctgcgcggcaagacgctccaggcgccggctctcgccggcggaaagctggaatgccaggcgccgggtgcgcggctggcggatgctttccggcgcgcaggccaacggcagggccggcgcgtccggcaagcgcggcaggcgttccagccagtagtcgcgggcccgcgccgcggcctcggcgcgttgcgccgcacggtgcgccaggtagtcggcgaaatgcagcgccggcggctccgccaggcgctccggcgccaggtaggcaacgcccagttcggccagcagcaggcgcaggctttcgacatcggcggcaagcaggtcgagactcagccagaggcgatcctcgccgcccggcatgcgcaccagcccgagcaggaacacctggccgcgctccaccgccaggcattcatgggcgcgccagtcgcgcagcgcctgccagtcgcgctcggcctcgtccacctgcaaggtgcgccagtcctgcaggtcgaagcaggacagcggcggcgtcggaaggatctgctggcgaccgtcgaggaagcgcgcccgcaacatcgggtggcgttgacgcacgcactccgccgccgcggccaggcgctgcgggtcgacatcccgcgcgcggaattccaggaaggcatggcagctga

SEQ ID NO: 4680 - DNA, 405 bp, Pseudomonas aeruginosa
cgttgcccagcacctcgccggcgccacgtcccagccagtaggcctgctgcacggaagacagctcgaacggctgatcgcgatcctgcgccgtcggcagcgcgaccgttgccggggcggacagccggtccgcgcaggccagcaggtcgagccaggcccccaggcaggggcgctgcgccaactgggcgaagtccagcgtcgagccacgcgcgcgcaggcgttcctgcaggtacatcaggcggatcgagtcgaggccgcagcccagcaggtcgtcgtcgtccgccagggcgcgcacgtcggcaagcggttcaccgagcaggtcggcgagctgctcggtcagccagtcgcgcagggcggtacgggaatcggggggcagatccatgggggctccctagggcaagcatctga

SEQ ID NO: 4681 - DNA, 198 bp, Pseudomonas aeruginosa
ggtcggttgccagttcctggcaacgattatcaaatgcgaccttatctcacttgcctgggaggcctggccggcaatgctttagacagccggactgtttcgttagatgcagcgtcatcccgcagcggcgacacccctcccgtggccgggtcgggggtcgtcgcggagactcagcggatctcgctgggggagatgccgtag

SEQ ID NO: 4682 - DNA, 1752 bp, Pseudomonas aeruginosa
aaaagccccgcaatcgaaaggcgcgggcttgcgcggtccctgccgcccgccaatgataataaatctcatttcccagcaatggcaatcgaccgcatccacggagatcgcatgacttcctcgcccgtcaccccatcggccgtcgacgacgcccccgactggcccgccgccttcgtccgccgctatctcgacgccggccactggcaggaccagaacttcgccgaagccctggccgccagcgccgcgcgccatccgcggcggatcgcgctctgcgacgacgaccagcggctcagctatgccgacctgctccagcgctgccgccgcctggcagccggactgcgccaggccggcctcgcacatggcgacacggtagtgctgcacctgcccaacggcatcgccttcgtcgagacctgcttcgccctgttccagctcggcgtacgcccggtgctcgccctccccgcccatcgccagcatgagatcagcggtttctgccgcttcgccgaggccaaggcctacatcggcgccgaacggatcgacggcttcgacccacggccgatggcccgtgagctgctcgccagcggcgcctgccggatggcgctgatccacggcgaggccgaggcgccgctgcaagcgctggcaccgctgtaccaggccgacgcgctggaagactgcgccgcccgcgccgaggatatcgcctgcttccagttgtccggcggcaccaccggcacgccgaagctgattccccggcgtcatcgcgagtatctctacaacgtccgcgccagcgccgaggtctgcggcttcgacgagcacacggtgtacctcaccggcttgccgatggcgcacaacttcactctctgctgccccggagtgatcggcacgctgctggccggcggccgcgtggtggtcagccagcgcgccgatcccgagcattgcttcgccctgatcgcccgtgaacgggtcacccacaccgccctggtaccgccgctggcgatgctctggctggatgcccaggaaagccgccgcgccgatctatccagcctgcgtctgctccaggtcggcggctccaggctcggcagcagtgccgcgcaacgcgtcgaaccggtgctcggctgccagttgcaacaggtgctgggaatggccgaggggctgatctgctacacccgcctggacgatccgcccgaacgcgtgctgcatacccagggccggccgctgtcgccggacgacgaagtgcgggtggtcgacgccgagggccgcgaggtcggccccggcgaggtcggcgaactgaccgtgcgcggtccctacaccatccgcggctactaccgcctgcccgaacacaacgccaaggccttcagcgcggacggcttctaccgcaccggcgaccgggtcagccgcgacaaggacggctacctggtggtggagggccgcgacaaggaccagatcaaccgcggcggcgagaagatcgccgcggaagaggtggagaacctgctgatagcccatccgcaggtgcacgacgccaccgtcgtggcgatgcccgacagcctgctcggcgagcgcacctgcgccttcgtcatcccgcgccagccggcgccctcggcgctgaagctgaagcaatacctgcacgcctgcgggctggccgcgttcaaggtgccggaccgcatcgagctggtcccggccttcccccagaccggcatcggcaagatcagcaagaaggacctgcgcgagcgcctgcgccgcgagctggaggcccgcgcatga

SEQ ID NO: 4683 - DNA, 642 bp, Pseudomonas aeruginosa
cgccgatgccgcgcctgcgcctggcctgcttcccccatgcaggcggcagcgccagcttcttccgtagctggagcgaacgcctgccgccagacatcgacctgcttgccctgcagtacccgggtcgcgaggaccgcttcaacgaggcgccggccacccgcttggaggacctcgccgacggcgccgccctcgccctgcgcgatttcgccgacgcgcccctggcgctgttcggccacagtctcggcgcggcgctggcctacgaaaccgccctgcgcctggaaagcgccggcgcgccgctgcgccacctgttcgtctccgcccatccggcaccgcaccggcaacgcggcggcgcgttgcaccgcggcgacgaggcggcgctgctggaggacgtccgccgccagggtggcgccagcgagctactcgaggacgccgacctgcgcgcgctgttcctgccgatcctgcgcgccgactaccaggcgatcgagacctaccgacgggcgcagcccatcgccctggcctgcgccctcgacgtcctcctcggcgagcacgacgaggaagtcagcgccgccgaggcgcaggcctggagcgacgccagccggactcccgccaggctgcggcactttcctggcggccacttctacctga

SEQ ID NO: 4684 - DNA, 1791 bp, Pseudomonas aeruginosa
tcgagcacctgctgcgccgcctcgcacatcccgacgccctttcccgagaggttgcatgatgaaaactcccgaagactgcaccggcctggcggacatccgcgaggccatcgaccggatcgacctggatatcgtccaggccctcggccgccgcatggactacgtcaaggcggcgtcgcgcttcaaggccagcgaggcggcgattccggcacccgagcgggtcgccgcgatgctccccgagcgcgcccgctgggccgaggaaaacggactcgacgcgcccttcgtcgagggactgttcgcgcagatcatccactggtacatcgccgagcagatcaagtactggcgccagacacggggtgccgcatgagccggctggcgcccctgagccagtgcctgcacgccttgcgcggcaccttcgagcgcgccatcggccaggcgcaggcgctcgatcgtccggtcttggtggcggcgtcgttcgagatcgacccattggacccgctgcaggtattcggtgcctgggacgaccggcaaacgccctgcctgtactgggaacagcccgagctggcgttcttcgcctggggctgcgccctggagctgcaaggccacggcgaacagcgcttcgcccggatcgaggaaaactggcaattgctctgcgccgacgccgtggtcgagggcccgctggcgccgcgcctgtgcggcggattccgcttcgatccgcgcggcccgcgcgaggaacactggcaagccttcgccgatgccagcctgatgctcgccggcatcaccgtgctgcgcgagggcgaacgctaccgggtactctgccaacacctggccaagcccggcgaagatgccctggccctggccgcctaccactgctcggcgctactgcgcctgaggcagccggccagacgccggccctcggggccgaccgctggcgcgcagggcgacgcttcggcgcaggagcgcaggcaatgggaagccaaggtgagcgacgcggtaagcagtgtccgccagggacgcttcggcaaggtcgtgctggcccgcacccaggcccggcctctcggcgacatcgagccgtggcaggtcatcgaacacctgcgtctgcaacatgccgacgcccagctgttcgcctgtcgccgcggcaacgcctgcttcctcggcgcctccccggaacgcctggtccgcattcgcgccggcgaggcactcacccatgccctggccgggaccatcgcccgcggcggcgatgcccaggaagatgcgcggctcggacaggccctgctggacagcgccaaggacaggcacgaacaccagttggtggtggaggcgatccgtacggccctggaacccttcagcgaggtgctggaaatccccgatgcgcccggcctgaaacgactggcgcgagtccagcacctgaacacgccgatccgcgcccgcctcgccgacgcaggcggcatcctgcggctgctgcaggcgctgcatccgacccccgcggtgggcggctacccacgcagcgcggcgctggactacatccgccagcacgaagggatggaccgtggctggtacgccgcgccgctgggctggctcgacggcgaaggcaacggcgatttcctggtggcgctgcgctcggccctgctcacgccgggccggggctacctgttcgccggctgcggtctggtaggcgattcggaaccggcccacgagtatcgcgaaacctgccttaagctcagtgccatgcgggaagctctatccgccataggcggcctggacgaagtgcccttgcagcgcggcgtcgcctga

SEQ ID NO: 4685 - DNA, 1332 bp, Pseudomonas aeruginosa
ggttcagcatccgcccggcgcggcctgggccaggcgctcgagggcggtgcgatccacttgttgggtatccactttgacataggcggcggcctcctcggccaccaccacggcgtctgccacaccgggcaacgccctgaatcgctggaccagcaccgcgtcctgcagcgcggcgggcgcgagcggcaggcgaatgctggtcacataaggcggttcgcgcatggtaacagcaatcgccagccagagggcagcgagcaccgcgcatccgatgaacaccatgctcagcccgccgtgctggaacatccagccgccgaggatgccgcccagcgccgcgccgaggaactggctggtggaatacacccccatcgccgtgcccttgccgccggccggcgagaccttgctgaccagcgacggcagcgaggcttcgagcaggttgaaggcagtgaagaacaccaccgtgccgaccaccagcatggccaggctgtgaccgaagaccaggaagaacagttcgcaggccagcagggtcgccaccgcgccggtcagcacgcgcttcatgcgacgcttcttctcggcgtagatgatgaacggcaccatgccgaagaaaccgaccagcagcgcggtcaggtagacccaccagtgctgctccttgggcaggcccccctcgtgcaccagtgccagcggcaaggcgacgaagctggccatgaggatggcgtggaggatcaggatgccggcgtccaggcgcagcaggtcgccgtgcttcagggtcggcagcagggcctggcgcgccacgctggattcgcggtgctgggtcatgtggtccggctgcgggacgaagaacaggatcagcagcaggccgaccagcgccatcccggcggtgaaccagaacagcccatgcaggccgaacagatgggtcagcaccgggccgagcaccatggccacggcgaaggagacgccgatgctcatgccgatcatcgccatcgccttggtccggtgctgctcgcgggtgaggtcggagagcagcgccatcaccgccgccgagatcgccccggcgccctgcaggacgcggccggcgatcaccccccagatggagtcggcattggccgcgagggccgcgccggcggcgaagatcagcagcccgacgacgatcaccgggcgccggccgatgcggtcggaaatggtcccgaagggaatctgcaggatcgcctgggtcaggccataggcgccgatggccaggccgatcagcgccggggtcgcgccggccaggtcctggccgtaggtggccagcaccggcaggaccatgaacatgccgagcatgcggaaggcgaataccagtga

SEQ ID NO: 4686 - DNA, 3060 bp, Pseudomonas aeruginosa
gtcgtgcataacaccctcatggaagaaaccgctgcagggcaaggcctcatgcccctgccgatggcgccgccgcccgctcctgggcggccggggcaatgcccgcgccggaaaaatgccgcgcattctaccagtccgccccctcgcggcacaggcgcgccactttgccgcgcgctagcggccagccgtataatcagcggttttcgcccgccatgcgaggccgctgtggataagatcctgattcgtggggcgcgtacccacaacctgaagaacgtcgacctcacactgccacgcgacaaactgatcgtgatcaccggtctttccggttccggcaagtcttccctggctttcgacacgctctatgcggaaggccagcggcgctacgtggaatccctctcggcctacgcccggcagttcctgtcgatgatggagaagccggacgtggacaccatcgaagggctgtcgccggcgatttccatcgaacagaagtccacttcccacaacccacgctccaccgtgggtacgatcaccgagatctacgactacctgcgcctgctttatgcccgcgtcggtaccccgcgctgcccggaccacgacatcccgctggaggcgcagaccgtcagccagatggtcgaccaggtcctggccctgccggaaggcagcaagctgatgctgctggcgccggtgatccgcgagcgcaagggcgagcacctggcggtgttcgacgagatgcgcgcgcatggcttcgtccgcgcccgggtcgacggcaagctctacgaactcgacgaagtgccgaaactggataagcagaagaagcacagcatcgatgtggtggtggaccgcttcaaggttcgcgcggacctccagcaacgcctggccgagtcgttcgagaccgccctgtccctggccgacggtatcgccctggtagcaccgatggacgaggacgaggatgtcgaggagatcatcttctcggcgcgcttcgcctgcccggtctgcggccactctatcagcgagctggaacccaagctgttctccttcaacaacccggccggcgcctgtccgacctgcgacggcctcggcgtgaagcaattcttcgacgcgcgccgggtggtcaacggcgagttgaccctggccgagggcgcgatccgcggctgggaccggcgcaacgtctattacttccagatgctcggttcgctggcccagcattacggcttcagcctggaagaacccttcgacgaactcggcgccgagcaccagaaggtggtgctctacggctccggccgggaaaacgtcgacttccgctatctcaacgaccgcggcgacatcgtcaagcgttcgcatcccttcgaaggcatcctgccgaacctggagcggcgctaccgcgagaccgagtcggccacggtccgcgaggagctggccaagttcctcagcacccagccctgcccggattgccacggtacccgcctgcgccgcgaggcgcggcatgtgtgggtcggcgaccggacgctgccggcgatcaccgcgatgccggtcggcgaagcctgcgagtatgccgccggactcagcctgaccggccgccgtggcgagatcgcggcgaagatcctcaaggaaatccgcgaccgcctgcaattcctggtcaacgtcggcctcgactacctgaccctcgaccgcagcgccgacaccctgtccggcggcgaagcccagcgcatccgcctggccagccagatcggcgccggcctggtgggagtgatgtacatcctcgacgaaccctcgatcggcctgcaccaacgcgacaacgagcgcctgctcggcaccctcacccacctgcgcaacctcggcaacacggtgatcgtggtcgagcacgacgaggacgcgatccgactcgccgactacgtcgtcgacatcggtccgggcgccggcgtgcacggcggccaggtagtggcggaaggtacgcccgaccaggtgatgaaccaccccgactcgctgaccggcaagtacctttccgggcgcaagaaaatcgcggttccggccaagcgcaccccgcgcgacaagaagaagctgctgaagctgaaaggcgcccgcggcaacaacctgcagaacgtcaacctggaaatcccggtcggcctgttcacctgcatcaccggggtctcgggctccggcaagtcgacgctgatcaacaacaccctgttcccgatcaccgccaccgcgctgaacggcgcgactaccctggaagtggcgccgtatgactcgttcgacggcctgcagcacctggacaaggtggtcgacatcgaccagagcccgatcggtcgtaccccgcgctccaacccggcgacctataccggcctgttcacgccgatccgcgaactgttctccggcgtgccggaggcccgctcgcgcggctacggtcccggccgcttctcgttcaacgtcaagggcggccgttgcgaggcctgccagggcgacggcgtgatcaaggtggagatgcacttcctgccggacatctacgttccctgcgatgtctgcaagggcaagcgctacaaccgcgagaccctggagatccgctacaagggcaagagcatccacgaggtgctggagatgaccatcgaggaagcccgcgagttcttcgacgcagtccccgccctggcgcgcaagctgcagacgctgatggacgtcggcctgtcctacatcaagctgggccagagcgcgaccaccctctcgggcggcgaggcgcaacgggtcaagctgtcccgcgagctgtccaagcgcgataccggcaagaccctgtacatcctcgacgaaccgaccaccggcctgcatttcgccgacatccagcaactgctcgacgtgctccaccgcctgcgcgaccacggcaacaccgtggtggtgatcgagcacaacctggacgtgatcaagaccgccgactggctggtcgacctcggccccgagggcggctccaagggtggccagatcatcgccaacggtacgccggagcaggtggccgagatgccccagtcgcacaccggccacttcctcaagccgttgctggaacgcgatcgcgcctga

SEQ ID NO: 4687 - DNA, 1404 bp, Pseudomonas aeruginosa
aaaagcccccttcctaggaagggggccgggggcctcatcaggccatcagtccagcttcaggccgagggcgtcggcgacgcctttgccgtaggccgggtcgaccttgaggaacaggccgatctggcgacgctggatctgttccggtacatcgcggatgtcttcggcgatgttggcgaacagccgctgcttctgctcgtcggtgaacagatggaacagcgcggcgggctggctgtagtagtcgtcgtccacccggtggttccagtggtccgccgcgccctccaggctcagcggcggctcggagaagtcaggctgctcctgccactggttgaagctgttcggctcgtaggtgacgcgctgatgggcgttgttgccgtccacccgcatgccgccgtcgcggtggtagacctggtgcgggcaacgcgcggcgttcaccgggatctggtggtggttgacgcccaggcgatagcgatgggcgtcgccgtaggagaacagacggccctggagcatcttgtccggcgagaaaccgataccgggcaccacgttggccggcgtgaaagcggcctgctcgacctcggcgaagtagttgtccgggttacggttcagctcgaagaagcccacttcgatcaacgggtagtcgccgtggggccagaccttggtcaggtcgaacgggttgtagcgataggtggccgcttccttctcgggcatgatctgcacgtacatcttccagcgcgggaagtcgcctttctcgatgctctcgtacaagtcgcgctgcgaactctcgcggtcctgggcgatcacttcggcagcctcggcgttggtcaggttctcgatgccctgttgggtcttgaagtggaacttgacccagaagcgctcgttgttcgcattgatgaaactgaaggtatggctgccgaaaccatggatgtgccgatagctcttcggcaggccgcggtcgctgaagtcgatggtcaactgatgcagcgactcggggaggtgagagaaaaagtcccacttgaaggtcgcattgcgcaggttggtgcgcgggtcacgctttaccacgtggttgagatcggggaatttgagcgggtcacgcaggtagaacaccggggtgttgttgccgaccaggtcccagttgccctgctcggtgtagaaacgcatggagaagccgcggatatcgcgctcggcatccgccgcgccgcgctcaccggcgacggtggagaagcgcaggaacatatcggtcttcttgccgacctgggagaagatcttcgcccgggtgtagggggtgatgtcatgggtgacggtgaaggtgccgtaggccgcggagcctttcgcatgcatgcggcgctcggggatcacttcgcgatcgaagtgggcgagcttctcgaggaaccacacgtcctgcagtaa

SEQ ID NO: 4688 - DNA, 1071 bp, Pseudomonas aeruginosa
ttacgacgatcaggcagtggccttgtcgtctttcttaagacttgccggcggccagttatcgaggcgcataccgagggacagaccacgggaagccagaacgtccttgatttcggtcagggacttcttgcccaggttcggcgttttcaacagctccacttcggtgcgctggatcaggtcaccgatgtagtagatgttttccgccttcaggcagttggccgaacgtacggtcagttccaggtcatcgaccgggcgcaggaggatcggatcgatctcgtcttcctgctcttcaacgacgggttcgctgtcgcccttgaggtccacgaacgctgccagctgctgttgcaggatggtagcggcgcgacggatagcctcttcgggatccagggtgccgttggtttccaggtccaggaccagtttgtccaggttggtgcgctgctcgacacgggcgttttccaccacgtaggagacacgacggaccgggctgaacgatgcgtcgagctgcagacggccgatgctgcggctttcgtcttcatcgctctgacgtgcgtcggcaggctcgtagccacggccacgagctaccttcagcttcatgttcagcgcgccgttgtctgccaggttggcgataacgtggtcaccgttgatgatctcaacatcgtgatccagctgaatatcggcagcagtcacaacacccgagcccttcttagccagggtcagcgtcacttcatcacgaccgtgcagcttgatggccagacctttcaggttcagcaggatctcgattacatcttcctgcacaccttcgatcgccgagtactcgtggagtacgccgtcgatctcggcctcgaccactgcgcagccaggcatggaggacaacaggatgcgacgcagcgcgttgcccagggtgtgaccaaaaccacgctcgagaggctcgagcgtgatcttggcgcgggtttgactgaccacctgcacatcgatgtggcggggggtcaggaactcatttaccgaactctgcatggatgcacctattttctagcccttacttggagtagagctcgacaatcaggttttcgttga

SEQ ID NO: 4689 - DNA, 348 bp, Pseudomonas aeruginosa
aacccttgcgacgggaagcttcctggtagtaaccgcggaactgacgctccagcacgccgtagatgcgacgtactttctgcttttcacgcagctgcagaccgtagtcggacagacggccacgacgctggccatgctggccaggaacgttttcagccttgcacttcgagtcgagggcgcgggcgccgctcttcaggaacaggtcggtgccttcacggcgagacagtttgcacttgggaccaatgtaacgagccatttctcactgtctcctattacacgcgacgctttttcggcggacggcagccgttatgcgggatcggggttacgtcggtgatgctggcgatcttgtag

SEQ ID NO: 4690 - DNA, 1014 bp, Pseudomonas aeruginosa
cagttgccatggttagagaatctcctcgacgctcttgccacgcttggccgctactgcttccggagcctgcatgttcttcaggcccttgaaggtggcgtaaaccacgttcaccggattggtggagccatagcacttggccaggacgttctgcacaccagccacttccagaacggcacgcatggcgccgccggcgatgatgccggtaccttccgaagccggctgcatgtacaccttggaggcgccatgggcggacttggtcggatactgcagggtggtgccgttcagatcgacttggatcatgttgcggcgagcggcttccattgctttctggatggcggccggcacttcacgcgccttgccacgaccgaaaccaacgcgacccttgccatcacccaccacggtcagtgcggtgaaagcgaagatacggccaccttttacggttttggcgacgcggttaacctgaaccagcttctcgatgtagccttcgtcgcgcttttgctcgttgtttgccataacttagaactccagtccgccttcacgagcggcatcagccagcgctttcacacggccgtggtacttgaagccagaacgatcgaacgccacctgggtgacgccggccgctttggcgcgctcggcgaccagttgaccaactttcttggctgcatcgatgttgccggtggcaccttcgcgcaggtctttgtccagggtcgaggcgctggccaggaccttgccgccgtcggccgcaatgacctgggcgtaaatgtgctgggaagagcggtacacgcagaggcgtacggtttccagctcgcgcatcttcaggcgtgccttgcgagcgcgacgcagacgggtttctttcttgacgctcatttgctatgccctacttcttcttggcttctttacgacggacgacttcgtcggcgtaacgcacgcccttgcctttgtaaggctccggcggacggaagtcgcgaatttcggcagcaacctgaccgaccagctgcttgtcgatacccttga

SEQ ID NO: 4691 - DNA, 594 bp, Pseudomonas aeruginosa
accggtttctgggtcgacttgaagacacgaattttcttaccgtcttctaccttgaagccaacgcggtcagccttgctggtttcagtattgaagatggcgacgttggagacgtgcagaggcgcctccttctcgacgataccgccctgttggccgagcatcggattgggcttggtgtggcgcttgatcaggttcaccccgccgacgaccagacggtcgtcagcgagaaccttcagcaccttgccacgcttgcccttgtccttgccggcaatgacgattacttcgtcgtcacgacgaatcttttgcatgacggctactccttacagcacttcgggggcgagcgagacgatcttcatgaacttctcggtacggagttcacgagtcactggcccaaagatacgggtgccgatcggctcctgcttgttgttcagcaggacggcggcgttgccgtcgaagcggatgatggaaccgtcggtacgacgcacgccgtgcttggtgcgaacgaccacggcagtcatgacctggcccttcttcactttgccgcgcggaatcgcttccttgacggtgaccttgatgatgtcgccgatgccggcgtaa

SEQ ID NO: 4692 - DNA, 438 bp, Pseudomonas aeruginosa
tcacttacctgcttgctgattgagcacagttttaacgcgagcgatgtcgcgcttaacctgcgagagcaggtgagactgccccaactggccagttgctttctgcatgcgcagattgaactggtcgcgcagcaggccgagcagttgctcgttcagctgctcaacggatttttcacgaagttcattcgctttcatcacatcaccgtccgcttaacaaaggaggtggcgaggggcagctttgcagcagccagggcgaaagcctcacgcgccagctcttcggaaacaccctcgatctcgtacaggaccttgcccggctggatctgggctacccagtactcgaccccacccttacctttacccatacgaacttcgaggggcttcttggtgacaggcttgtcagggaatacgcggatccagatcttgccgccacgcttcacgtga

SEQ ID NO: 4693 - DNA, 273 bp, Pseudomonas aeruginosa
cgaccagcagaggtacggccttcaccaccaccatgcgggtggtcgaccgggttcatcgccacgccgcgaacggtcgggcgaacaccacgccagcgcgtagcaccggctttacccagcgaacgcaggctgtgctcggagttcgagacttcgcccagggtcgcacggcactcagccaggactttacgcatttcaccggagcgcagacgcagggttacgtacgcaccttcacgcgcgaccagctgggcggaagcgccagcggagcgagcgatctga

SEQ ID NO: 4694 - DNA, 681 bp, Pseudomonas aeruginosa
atacgcgttcctggttcatcccagcagctcctcgaacttcttcacggcggacacggtgaccagcaccttgtcgtaggcgatcaggctgacggggtcggaaccttggacatcacgtacatcgacgtgcgccaggttgcgcgcagcgaggtacaggttctcgtcgacaccatcggtcacgatcagcacgtctttcagacccagggtgtccagcttggcaaccaggcccttggttttcggtgcatcgacagcgaagtcggcaacgacgaccagacggtccagacgaacgagctcggcaaggatggagcgcagtgctgcgcggtacatcttcttgttcagcttctgttcgtggctacgcggtttagcggcgaaagtggtgccgcccccacgccagatggggctacggatggtgccagcacgagcacgaccggtgcccttctgacgccacggcttcttgccaccaccagagacttcggagcgagtcttctgcgccttgctgccctgacggccgccagccatgtaggccacgactgcctggtgcaccagggtctcgttgaattcgccaccaaaggtacgctcggagacttcgatagcctgagcgccgttcacattcaattgcatctcagcttcccccttaaccgcgagccttggctgccggacgcacgatcacatcaccgccggtag

SEQ ID NO: 4695 - DNA, 297 bp, Pseudomonas aeruginosa
aaggaggcgcaattgtacggatgcccccacagggtgtcaatatttaaccaacgaacgaaaaaaggggccccggagggccccttttctgatggcaggatcagcgattactcgatgatcttggcaaccacgccggcgccaacggtacggccgccttcgcggatcgcgaagcgcaggccatcttccatggcgatcggagcgatcagggtgacaaccatcttgatgttgtcgcccggcattaccatctctacgccttccggcagttcgcagttaccggtcacgtcggtggtacggaagtag

SEQ ID NO: 4696 - DNA, 348 bp, Pseudomonas aeruginosa
ccggactcttcgtcggtcttgacacggaacgacgggtcttcctgggccagcttgccgagggcgatacccatcttctcctggtcagccttggtcttcggctctacagcgaccgagattaccggctcggggaagtccatgcgctcgaggatgatcggcttctcgatcgagcacagggtgtcaccggtggtgacgtccttcatgccgatcagggcagcgatgtcgcctgcgcgcacttccttgatctcttcacgctggttggcgtgcatctgcaccatccgaccgacgcgctctttcttgcctttcaccgagttcaggacggagtcgccggaactcaggacgccggagtaa

SEQ ID NO: 4697 - DNA, 4242 bp, Pseudomonas aeruginosa
tgcttagttaccgctcgagttcagcgcttcggtcagtgcggcttccgcctcgctggcactcacacgctgcggcttgccgaggtcgcgctgacgcttgcgctcgctgtggtaagccagaccggtaccggccgggatcaggcgacccacgaccacgttctctttcagaccacgcaggaagtcgcgcttgccggtgaccgccgcctcggtgaggacgcgggtggtctcctggaacgacgccgcggaaatgaacgactcggtcgacagggaagccttggtgatacccagcagaacgcgctcgtacttggccgggaacttgtcctcggtaccgagctgttcgttctcttccagcacctgggtgagttccacctggtcgcctttgatgaagctggagtcgccggactcgctgacttcgaccttgcgcagcatctgacgcaggatggtctcgatgtgcttgtcgttgatcttcacgccctgcagacggtagacgtcctggatctcgttgacgatgtacttcgccagcgagctcacgcccagcaggcgcaggatgtcgtgcgggttgctcggaccgtcggagatgacttcgccgcggttcacctgttcgccttcgaacacgttcaggtgacgccacttcggaatcagctcctcgtacggatcgctgccatcgttcggcgtgatgaccaggcggcgcttgcccttggtctctttgccgaaggagatggtgccgctgatttccgccaggatcgaaggctctttcggacgacgagcctcgaacaggtcggcaacgcgcggcagaccaccggtgatgtcacgggtcttcgaggtttcctgcgggatacgcgcgacaacgtcaccgatgctcaccttggcgccgtcggtcaggttgaccagggcgttggccggcaggaagtactgcgccggtacgtcggtacccggcagcagcaggtccttgcccgcggcatcgatcagcttcacggccggacggatgtccttgccggcagccggacggtccttcggatccatcacttcgatgttggtcaggccggtcagttcgtcggtctgacgcttgacggtgatgccctcttccatgcccacgaaggccacggtaccgtccacctcggtgacgatcgggtgggtgtgcgggtcccacttggcgacgatagcgcccgggtcgaccttgtcaccttccttgaccgagatcaccgcgccgtacggcagcttgtagcgctcgcgctcgcgaccgaagtcgtcggcaaccgccagttcgccggaacgggaaaccgcgaccagcgcgccgtcggcacgaaccacatgcttcaggttgtgcaggcggatggtgccgccgttcttcacctggacgttgtcggccgcggaggtccggctggccgcaccgccgatgtggaaggtacgcatggtcagctgggtgcccggctcaccgatggactgggcagcgatgacaccgaccgcctcgccgatgttgacgcgatggccacgggccaggtcgcggccgtagcacatggcgcagatgccatgacgggtttcgcaggtgatcggggaacgcaccaccacttcgtcgacgctcatcacttcgaggaagtcgacccacttctcgtcgatcagggtgccggccggcacgatgacctcgtcgctgcccggcttgaacacgtcgcgcgcgatcacacggccgagcacgcgctcgccgagcggttctaccacgtcgccgccttcgatgtgcggcgacatcagcaggccgtgctcggtaccgcaatcgatctcggtcactaccagatcctgggccacgtcgaccagacgacgggtcaggtaaccggagttcgcggtcttcagcgcggtatccgccagacccttacgagcaccgtgggtggagatgaagtactggagtacgttcaggccttcccggaagttcgcggtgatcggggtctcgatgatcgagccgtccggcttggccatcaggccgcgcatacctgccagctgacggatctgggccgcggagccccgcgcacccgagtcagccatcatgtacatggagttgaaggactcctggtcgacttccttgccctcgcgatcgacgaccttctctttcgagaggttggccatcatcgccttggacacttcgtcgttggccttcgaccacaggtcgatcaccttgttgtacttctcgccctgggttaccaggccggaggcgtactggctctcgatctccttcacttcgtcggtggcggcgttgatgatccgcgccttctcgtccgggatgacgaagtcgttgacgccgatggacacgccggaaatggtcgagtaggcgaaaccggtgtacatcagctggtcggcgaagatgacggtgtccttcagacccaccacgcgatagcagtggttgatcagcttggagatcgccttcttcttcatcgactggttgaccacgtcgaacggcaggccggccggaacgacctggaacagcagcgcgcggccgacggtggtgtcgacgatacgggtattggcggtcagttggccgtcttcacccttgatcttttcgttgatgcgcactttcacgcgagcgtgcagggacgcctggccgctgcggtaggcgcggtcgacttcctgcaggtcggcgaaggccatgccctcgcccttcgcgttgatcgcttcacgggtcatgtagtacagacccattaccacgtcctgcgacggaacgatgatcggctcgccgttggcgggcgacaggatgttgttggtggacatcatcagcgcgcgcgcttccagctgggcctcgagggtcagcggaacgtggacggccatctggtcaccgtcgaagtcggcgttgtacgcggcgcagaccagcgggtgcagctggatcgccttgccttcgatgaggaccggctcgaacgcctggatgcccagacggtgcagggtcggcgcacggttcaggagaaccggatgctcgcggatgacttcggcgagaacgtcccagacctcgggcagctcgcgctcgaccattttcttggcggccttgatggtggtggccataccacgaccttccagcttgccgaagatgaacggcttgaacagctccagggccatcttcttcggcagaccgcactggtgcaggcgcagggtcgggcccacggtgatcacggaacgaccggagtagtccacgcgcttgccgagcaggttctgacggaagcgaccttgcttgcccttgatcatgtcggccagcgacttcagcggacgcttgttcgagccggtgatggcgcgaccgcgacggccgttgtcgagcagggcgtcgacggcttcctgcagcatgcgcttttcgttgcgcacgatgatgtccggagcggccaggtcgagcaggcgcttcagacggttgttacggttgatcacccgacgatacaggtcgttcaggtcggaagtcgcgaagcgaccgccatccagcggaaccagcggacgcaggtccggcggcagcaccggcaggacggtcaggaccatccactcaggcttgttgccggagccctggaaggcttccatcagcttcaggcgcttggacagcttcttgatcttggtttccgagttggtctgcggaatctcttcgcgcaggcggccgatctcgtgctccagatcgatggcgttgagcagttcgtgaacggcttcggcgcccatgcgagcatcgaaatcgtcaccgaactcttcgagggcctcgaagtattgctcgtcgttcagcagctggcccttttccagggtggtcatgcccggatcgatcaccacgtagctctcgaaatagagcacgcgctcgatatcgcgcagggtcatgtccagcagcaggccgatacgggacggcagcgacttcaggaaccagatgtgggcaaccggcgaagccagctcgatgtggcccatgcgctcgcggcgcaccttggccagggcgacttccacgccgcacttctcgcagatcacaccgcggtgcttgaggcgcttgtacttgccgcacaggcactcgtagtccttcaccgggccgaagatcttggcgcagaacaggccgtcgcgctccggcttgaaggtacggtagttgatggtttccggctttttaacttcgccgaaagaccaggaacgaatcatctcgggcgaagccaggccaatacggatggcatcgaactcttcgatttgaccctggtttttcaacagattaagcaagtctttcaaggcctttcctcctcacggacccggtgcgaccggccttga

SEQ ID NO: 4698 - DNA, 444 bp, Pseudomonas aeruginosa
cgctcgggctgtagacgcaaggtcgtcgcttacttgagctcgactttggcgcctgcttcttccagggctttcttggcggcttcggcttcttctttcgaagcgccttccttcaccacgcccggagcgccgtctacgacggccttggcttctttcagacccagaccggtcagttcgcgaacgaccttgatcacgttcactttcttgtcgccagcttcggccaggacgatggtgaactcggtctgctcttcggcagcggcagcagccgggccagcagcggcaacggtagcggcagcagcggtaacgccgaacttctcttccatcgccttgatcagttcgaccacttgcatgacggacatttcggatacggcgttgatgatgtcttcgttggtcagagccatgactctaattcctgtattgggggacggcctgcggccatcgtattaa

SEQ ID NO: 4699 - DNA, 900 bp, Pseudomonas aeruginosa
gggatgcgttttcagctagaccttttcgacctgactgaactccagctccaccggggtagagcggccaaagatgagcacggccacttggatccggctcttctcgtagttaacttcttcgacgacaccattgaagtcggcgaaaggaccatcgatgacacgaacggtctcgcccggctcgaacagggtcttcggcttgggcttgtcgccgctatcggccacgcgacgcaggattgcatcagcctcacgatcggtgatcggagccggcttgtcggcagtcccgccgatgaagcccatgacacgcggggtatccttcaccaggtgccaggtaccttcgttcatttccatctgaaccagcacatagccagggaagaatttgcgctcgctcttgcgcttctggccgttccgcatctccaccacttcttcggtgggaaccagaatctcgccgaactcttcttccatgccagcaagcttgacacgctcgatcagcgagcgcatgacatgcttctcgtagcccgagtatgcatgcacaacgtaccaacgcttagccacggcgcacccttaacctacaatcatggaaaccaaccaacccagcagggaatcgagcccccacagcagcagcgccattaccagcactaccgcgaccacgatcagcgtggtctgagttgtttcttgacgactcggccatacgaccttgcgaatctcgacgcgcgcttccttagcaagactaaagaaggcctgccccttggccgtttgcagagccaggaaagcagcgatcaccgccagaacgagaataccgagaacgcgatacaggattggttgagccgaaaagtactgattgcccacaacggcaaccacaaccagaacggcaaccaagagccatttcaagagatcaaaacgtga

SEQ ID NO: 4700 - DNA, 363 bp, Pseudomonas aeruginosa
cgaccaccttcttccttggacagcacgtacacttcgcactcgaacttggtgtgcggcttgatggtgcccggcttggccagaacctggccacgctctacgtcttcacgcttggtgccacgcagcaggataccaacgttctcaccagcacgaccttcgtcgagcagcttgcggaacatttcaacgccggtgcaggtggtcttggtggtcgccttgatgccgacgatttccacttcttcctggaccttgatgatgccgcgctctacacgaccggttaccacggtaccgcggccggagatcgagaacacgtcttcgatcggcatcaggaacggctggtcgatggcacgaaccggctccggaatgtag

SEQ ID NO: 4701 - DNA, 594 bp, Pseudomonas aeruginosa
cgtggcgcgcgcggcgcctcgccatcgccgagcaggcgctgcacgctgccgatgccactggtgaacaccaccggcatcaggtcggcgccgcgaccgcgccggcgcgccagttcgcgcagcaggtcgacgccgctgaaggtcgggtggtcgaggtcgtcgaacatctgctcgccgatgcgtcgggcacgctcgacgaaactgtcgccgtggcggctgtccactgccagcaggctgagcgcggtgaagtcaccgagcacctgcgccagctgcggatgcagcggcggccggttgagtaccgtcaggttgagacagaacgccggtgcctggctccagcgaccgatggtctcggcgaaggccgccaaggccacgccggcagcgctcaggccgtgttcgccggcgcgcgcgccgagcgcctgccaggcggcctcgtcgaggcgcgcgtggaagtgccggaagcgcgtggaccgggtgtccggctgcacccgcagcggcaggtcgggacgccccggtagcgcgtcgagacgcgccagccaccagtcgcggtcgcgctgccaggctggcgactggcgtcggcgctgctcgacgccgacatag

SEQ ID NO: 4702 - DNA, 507 bp, Pseudomonas aeruginosa
gaaccgcttcccagcactcggccagcgcttgctcatgggcttccagcggctcctccgccgagggctcgtgacgacactcgccgagtgcgcgggtcatgctctcggccaggcggcgacgatcgaccttgccattgccgttcaacggcaggcttggcaggcaccacaggcgttcgggccgcatcgcctggggcaggcgttgctccaggccggcctggagcgcggcggcgtcgagcccgagtcccggcgccagcgcctcgaccagggcgagccgttcgctgcgccacaggcaacgcggcgccagtcccgcagcggcgagatcggccaacaggctcggcaactccgccaggcgcagcggccggtcgtcgagcaaggccgcaccgagcagcgccagtggcgactcgcatagcaggtccaccagcaacaggcggccctgcgggcgcagcagcgccgccgccagcgccaggccttcgcggctggcctcgtaggcgtgcagcgcggcgaagctga

SEQ ID NO: 4703 - DNA, 702 bp, Pseudomonas aeruginosa
ggacgcggctgcgttcgaagagggtcagttccagccccgggcgcaacagcgaggccatgccctggtcgagccagagcccggcgcgggtatccagcaccgccacccgcaggcgttcgccggcagccggcgtcggcagcgcttcgagcaggcgcgccaggggcctcgcggccgtccggcaggcgcgcggccaccgcctgcggcgccagccagggatcgaggagcagcgcggccggcgcctgttcgccggcgagcaggccgcgcagagcgttgcccatcgcggtcagccccgcggcctgccagccgagccggcgcaacgcctcgtcgagcgacggcagcgcgctggcggcggagtccgctagccagtccagccagcgccggcgcaaaccgtcgtctagctccagcggcgcctccagcagcgcgccgaggatttcccgggtgagtaccgcctcggcctctgccaggccggcgaagggctgtgcggccggtagttccatggagccttcggcccgtggcgccaggcgcggtaccagcaccgcgccgaggctcgccacgccaccgccgagcaccgccgcgcaggcgctatccacgccagcctgggcgcacagcgcggcctccacctcgcccaactcgatgcgctggccgcgcactttcacctgctggtcgacccgaccgaggaattccagggtaccgtcgccccagtag

SEQ ID NO: 4704 - DNA, 1557 bp, Pseudomonas aeruginosa
agctggtggtcgagccagacctgcggggtctgcgagagcatgtcgtggagatcgccgaaagcgtcgcggaaggccgccgggacgaagccctcctcgcccaggttgctggcgaacaccaccggcgccgagcgtggctggcccctgccggcgcgcctcgcggagcacctccagggcggggaatgcggcgtggtcgatggctccgtggaggttgcgctggaagctcttcaccgcctcggcgaaggacaccccggcctgcatccggcactccagcagcaacagggtggtgaagtcggcgatcacctcgccgatacgcgggtcgtcggcatgccgatcgaacaacggcacgttgaggagaaattccgcgctttcgctccagcgcgccaggaccagcgcgaaggcgcagccgaacacgctggacaaggtcacgccatgctgcgcggcaagacgctccaggcgccggctctcgccggcggaaagctggaatgccaggcgccgggtgcgcggctggcggatgctttccggcgcgcaggccaacggcagggccggcgcgtccggcaagcgcggcaggcgttccagccagtagtcgcgggcccgcgccgcggcctcggcgcgttgcgccgcacggtgcgccaggtagtcggcgaaatgcagcgccggcggctccgccaggcgctccggcgccaggtaggcaacgcccagttcggccagcagcaggcgcaggctttcgacatcggcggcaagcaggtcgagactcagccagaggcgatcctcgccgcccggcatgcgcaccagcccgagcaggaacacctggccgcgctccaccgccaggcattcatgggcgcgccagtcgcgcagcgcctgccagtcgcgctcggcctcgtccacctgcaaggtgcgccagtcctgcaggtcgaagcaggacagcggcggcgtcggaaggatctgctggcgaccgtcgaggaagcgcgcccgcaacatcgggtggcgttgacgcacgcactccgccgccgcggccaggcgctgcgggtcgacatcccgcgcgcggaattccaggaaggcatggcagctgacgttgcccagcacctcgccggcgccacgtcccagccagtaggcctgctgcacggaagacagctcgaacggctgatcgcgatcctgcgccgtcggcagcgcgaccgttgccggggcggacagccggtccgcgcaggccagcaggtcgagccaggcccccaggcaggggcgctgcgccaactgggcgaagtccagcgtcgagccacgcgcgcgcaggcgttcctgcaggtacatcaggcggatcgagtcgaggccgcagcccagcaggtcgtcgtcgtccgccagggcgcgcacgtcggcaagcggttcaccgagcaggtcggcgagctgctcggtcagccagtcgcgcagggcggtacgggaatcggggggcagatccatgggggctccctagggcaagcatctgaggtcggttgccagttcctggcaacgattatcaaatgcgaccttatctcacttgcctgggaggcctggccggcaatgctttag

SEQ ID NO: 4705 - DNA, 960 bp, Pseudomonas aeruginosa
ctggagcgaacgcctgccgccagacatcgacctgcttgccctgcagtacccgggtcgcgaggaccgcttcaacgaggcgccggccacccgcttggaggacctcgccgacggcgccgccctcgccctgcgcgatttcgccgacgcgcccctggcgctgttcggccacagtctcggcgcggcgctggcctacgaaaccgccctgcgcctggaaagcgccggcgcgccgctgcgccacctgttcgtctccgcccatccggcaccgcaccggcaacgcggcggcgcgttgcaccgcggcgacgaggcggcgctgctggaggacgtccgccgccagggtggcgccagcgagctactcgaggacgccgacctgcgcgcgctgttcctgccgatcctgcgcgccgactaccaggcgatcgagacctaccgacgggcgcagcccatcgccctggcctgcgccctcgacgtcctcctcggcgagcacgacgaggaagtcagcgccgccgaggcgcaggcctggagcgacgccagccggactcccgccaggctgcggcactttcctggcggccacttctacctgagcgaggggcgcgacgcggtgatcgagcacctgctgcgccgcctcgcacatcccgacgccctttcccgagaggttgcatgatgaaaactcccgaagactgcaccggcctggcggacatccgcgaggccatcgaccggatcgacctggatatcgtccaggccctcggccgccgcatggactacgtcaaggcggcgtcgcgcttcaaggccagcgaggcggcgattccggcacccgagcgggtcgccgcgatgctccccgagcgcgcccgctgggccgaggaaaacggactcgacgcgcccttcgtcgagggactgttcgcgcagatcatccactggtacatcgccgagcagatcaagtactggcgccagacacggggtgccgcatga

SEQ ID NO: 4706 - DNA, 534 bp, Pseudomonas aeruginosa
gcggcctggacgaagtgcccttgcagcgcggcgtcgcctgaaaacgaagaccccctgcggcccgagggcggcagggggtcttcgaaggtctgcccgtggcgcggacgggccgcgccgcaagggcgtcgcttagaacggaatgtcgtcgtcgaagctgtcgtattcctgggccggttgcggcgccggttgctgctgcggggccggacgcgactgctgctgcggggcctgctgcgggcgctgcatgggctcgcgcggggcgcgctgcgaatcgtcgccggaagggcggccgccgagcaactgcatgttgccgttgatgtcgaccacgatctcggtggtgtagcgatcctgaccgtcctggccctgccacttgcgggtgcgcaggctgccttcgacgtacacctgggaacccttgcgcaagtactcgccggcgatctccgccaggcgggccgaataacaccacgcggtgccatacggtacgctcctgttgctggccggtctgcttgtccttccagctctcgctggtggcgagggtga

SEQ ID NO: 4707 - DNA, 591 bp, Pseudomonas aeruginosa
acccaccagtgctgctccttgggcaggcccccctcgtgcaccagtgccagcggcaaggcgacgaagctggccatgaggatggcgtggaggatcaggatgccggcgtccaggcgcagcaggtcgccgtgcttcagggtcggcagcagggcctggcgcgccacgctggattcgcggtgctgggtcatgtggtccggctgcgggacgaagaacaggatcagcagcaggccgaccagcgccatcccggcggtgaaccagaacagcccatgcaggccgaacagatgggtcagcaccgggccgagcaccatggccacggcgaaggagacgccgatgctcatgccgatcatcgccatcgccttggtccggtgctgctcgcgggtgaggtcggagagcagcgccatcaccgccgccgagatcgccccggcgccctgcaggacgcggccggcgatcaccccccagatggagtcggcattggccgcgagggccgcgccggcggcgaagatcagcagcccgacgacgatcaccgggcgccggccgatgcggtcggaaatggtcccgaagggaatctgcaggatcgcctgggtcaggccatag

SEQ ID NO: 4708 - DNA, 444 bp, Pseudomonas aeruginosa
ccctggccgagggcgcgatccgcggctgggaccggcgcaacgtctattacttccagatgctcggttcgctggcccagcattacggcttcagcctggaagaacccttcgacgaactcggcgccgagcaccagaaggtggtgctctacggctccggccgggaaaacgtcgacttccgctatctcaacgaccgcggcgacatcgtcaagcgttcgcatcccttcgaaggcatcctgccgaacctggagcggcgctaccgcgagaccgagtcggccacggtccgcgaggagctggccaagttcctcagcacccagccctgcccggattgccacggtacccgcctgcgccgcgaggcgcggcatgtgtgggtcggcgaccggacgctgccggcgatcaccgcgatgccggtcggcgaagcctgcgagtatgccgccggactcagcctga

SEQ ID NO: 4709 - DNA, 1425 bp, Pseudomonas aeruginosa
cgcggttccgcgctgcagatcacccgcacgatgccatcgcgacggatgattttgcagttacggcacagcttcttgaccgatgcacgaactttcatcaccaactcctcgaaccttacgggtctatcagcgcagcatgccgctgccgtagcccttcaggttggctttcttcatcagggattcatactggtgagaaacgaggtgagattgcacctgggccataaagtccatgacaaccacgaccacgatcaacagcgaggtcccgccaagatagaacggcacgtgcgccgcaaccaccaggaactggggcagcaggcagacagccgtcatgtacagagcaccgaacatggtcaaacgggtcagcacgccatcgatgtagcgagcggactgttcgcccggacggatgcccggaataaatgcaccggacttcttgaggttctccgccacgtccttcgggttgaacatcagcgctgtatagaagaagcagaagaaaacgatccctgcagtgaacagcaagatgttcagcggctgccccggagcgatcgcttgcgcgacgtcctgcaaccaacccaagccttccgactgaccgaaccaggagcccagggacgccgggaacagcaggatactgctggcgaaaatcgcgggaatcacacccgccatgttcaccttcaacggcagatggctggtctgcgctgcaaacaccttgcggccttgctggcgcttggcgtaatgcaccgcgatgcgacgctggccacgctcgatgaacaccacgaacgcgatgatcgccacggccagcaggccgacgccgatcagggcgaagatgttgatgtcaccttgacgggcagactcgaaagactgaccgatggcgcgcggcaggcctgcaacgataccagcgaagatcaacatcgagatgccgttgccgacaccgcgctcggtgatctgctcgcccagccacatcatgaacatggcaccagccacgaaggtggtgacagccacgaagtagaagccgaagtcgttggagaaggctacgccctggctgcccaggccaacggacatgccgatggcctggaccagtgccaggactacagtaccgtagcgggtgtactggctgatcttgcgacgcccagactcaccctctttcttcaactgctccagctgcgggctgatagcggtcatgagctgcatgatgatcgatgccgagatgtacggcatgatccccagtgcaaagatactcatgcgctccagcgcgccgccggaaaacatgttgaagaggctaagaatggtcccctcgttctgccggaacagtgccgccaagcgatcggggttgatgcccggaactgggatgtgcgcgccgatccgatagacgatgatcgccaggaacaggaaacgcagacgtgcccagagctcggacagaccgccgttgcttag

SEQ ID NO: 4710 - DNA, 648 bp, Pseudomonas aeruginosa
cgcagagagagcaccttgcttagccatttagtcctcgaatttaccgccagctgcttcgatagccgcacgcgcacccttggtggcggcgatacctttcagggtgaccgcacgaccaacttcgccggacagcatgactttgacgcgctgtacgtgctggttgatcaggttggcatccttcagggtctgcaggctgacgacgtcgccttcgaccttggccagctcggaggtgcgtacttcagcacgatccatggccttcagggaaacgaagccgaacttcggcaggcgacggtgcagaggctgttgaccaccctcgaagcccggagcgaccttgccaccggagcgggaggtcagacctttgtgaccacggccaccggtcttgcccagaccgctaccgatgccacggcccggacggtgcttttcgcgacgggcacccggcgcggaacgcagatcgttcagttgcatggattaaccctccacacgcagcaggtagtaggccttgttgatcatgccgcggttctcaggagtgtcctgaacttcgacggtatgattgatgcgacgcaggccgagacccttgacgcaagccttgtgattggccagacggccgttcaggctcttgaccagagtgactttgacagttgccatggttag

SEQ ID NO: 4711 - DNA, 666 bp, Pseudomonas aeruginosa
atgtgctgggaagagcggtacacgcagaggcgtacggtttccagctcgcgcatcttcaggcgtgccttgcgagcgcgacgcagacgggtttctttcttgacgctcatttgctatgccctacttcttcttggcttctttacgacggacgacttcgtcggcgtaacgcacgcccttgcctttgtaaggctccggcggacggaagtcgcgaatttcggcagcaacctgaccgaccagctgcttgtcgatacccttgatcaggatatcggtctggctgggggtttcagcgacgatgccggccggcagttcgtaatcaaccggatgggagaagccgagggacagggacagcacttggcccttggcctgcgctttgtaaccaacgccgaccagctggagcttgcgctcgaagccctggctgacgccgactaccatgttgttcaccagagcacgggtggtaccagccatggcgcgagtctgctggtcgccgttacgcgcagcaaaacgcagctcaccgctgtcctggatcacttcgaccgaaggatggaccttgagctccagagcacctttggcgcccttgatggacagttgctgaccagccagtttgatttcaacgccggcaggcagcttgacggggttcttagcaacgcgagacatgctgattccccttag

SEQ ID NO: 4712 - DNA, 222 bp, Pseudomonas aeruginosa
acgccaggcgaaacaaacccaggctcaggggagccgggtattctagagatcacgccaaaacgaatcaagccccatgaggggcttgattcgatgtcgcgatcaacggtgccgactggcgacaccgttcgctgcgattaccagctggctttcaccagacccggtacgtcgccgcgcatggcggcttcgcgcagcttgttacggctcaggccgaacttgcggtag

SEQ ID NO: 4713 - DNA, 642 bp, Pseudomonas aeruginosa
cgcttcagctcgcggttcttcatgctctctttagccatgttcctactccaatcagttacggaacgggaatttgaaagcacgcagcagggcgcgaccttcgtcatccgtacgagcggtggtggtcagggtgatgtccaggccacgcagcgcatcgatcttgtcgtaatcgatttccgggaagatgatctgctctttcacgcccatgctgtagttgccgcgaccatcgaaggacttggcattcaggccgcggaagtcacgcacgcgcggcagggagatggacagcagacgatccaggaactcgtacatccggtcgctacgcagggtgaccttgacgccgatcggccagccttcacggatcttgaagcctgcgatggacttacgagcgtaagtcacgaccggcttctgaccagtgatcttttccagatcggctacggcgttctcgatgatcttcttgtcaccgaccgcctcgccaagacccatgttcagggtgattttggtaacgcgcggaacttccatcacgttcgccagctgaagctcttctttcagcttgggcgcgatttccttccgataaatttctttcaatcgtgccatggtgatctacctagcagcctcaagcctgaaccggtttctgggtcgacttga

SEQ ID NO: 4714 - DNA, 639 bp, Pseudomonas aeruginosa
ccttactaccacgatgagccagaccacggttgtggccggtcatttgtttgcggaacttcgtacgcttgggttgcagcatttgcgtactccttacctagcagcttttttacgaggagcgggtgctaccggcttcagctcttcctggcggccaccgatgacctcgcccttgaagatccaaaccttgacaccgatcacaccgtaagtggtgtgcgcttcgtaggtggcatagtcgatatcggcgcgcagggtgtgcaggggcacacgaccttcgcgataccattcggtacgggcgatttcagccccacccagacgaccgctgacctgaatcttgatgcccttggcaccaatgcgcatggcgttctgtacggcgcgcttcatggcgcgacggaacattacgcgacgctccagctgctgggctacgctctgcgcaaccagcatggcatcgagttccggcttgcggatttcctcgatgttgatgtgcacgggcacacccatttgcttggtcaggtcctggcgcagtttctcaacatcttcacctttcttgccgatcacgatgccgggacgagcggtgtggatggtgatgcgtgcggtttgagccggacgatgaatatcgatacggcttacggacgcgctttttag

SEQ ID NO: 4715 - DNA, 768 bp, Pseudomonas aeruginosa
gcgccgttcacattcaattgcatctcagcttcccccttaaccgcgagccttggctgccggacgcacgatcacatcaccgccggtagcgccgggaacggcacccttgaccagcagcagattgcgttcagcatcgacgcgcacgatctccagggattgaacggttacccgctccgcacccagatgaccggacattttcttgcccttgaacactcgaccaggagtctggcactggccgatggaacccgggacgcggtgggaaacggagttaccgtgggtgttatcctgaccacggaagttccagcgcttgatggtgcccgcgaagcccttacccttggactcgccggtaacgtctaccatctggcctgcctggaacagatcgacagtgatctggtcaccagcggcatactgctcttcgcccagacggaattcccacacgccgcgaccggcggcgacattcgccttggcaaagtgaccagcttgcgctttggtaacgcgagaagcacgacgctcgccggcggtgacttgcactgcacggtagccatcggtttcttcagtcttgaactgggtgacgcgattcggctcgacctcgatgaccgtaaccggaatagagacaccttcctcggtgaaaatgcgggtcatgccgcatttacgaccgacaacaccaattgtcatgttgtaaacctcttgagtgtacggggctttcacccgctatggccgcccatttcagagcgttacacgaccaatgccgaaggcattagccgaggctga

SEQ ID NO: 4716 - DNA, 555 bp, Pseudomonas aeruginosa
ccattacacaccctccacgttcaggcccatgctgcgcgcggagccagcgatggtacgtacagcagcgtccagatcagcagcggtcaggtcagcctgcttggtcttggcgatctcttccagctgggcacgggtaacggtgccgactttctgggagttcggacgagcggagccgctggtgatgccagctgcttttttcagcaggacggcagccggggtgctcttggtttcgaaggtgaagctacggtcgctgtaaacggtgatgatcacaggagtcggcaggcccggctcttggccttgggtcttggcgttgaacgccttgcagaattccatgatgttcacgccgtgctgacccagggcagggccgaccggcggcgacgggttggcctgaccggcctttacttgcagcttgatataagcctggattttcttagccatttgctactccaaattcgggtacaagcgcctgaaggctccccggttgctttcgcgtttatcccagtgacgacaaaaccccgcagccttgggctgcggggtgagggatgcgttttcagctag

SEQ ID NO: 4717 - DNA, 312 bp, Pseudomonas aeruginosa
caaccggaacaccagaggttcgtccactccggtcctctcgtactaggagcagcccctctcaaatctcaaacgtccacggcagatagggaccgaactgtctcacgacgttctaaacccagctcgcgtaccactttaaatggcgaacagccatacccttgggaccggcttcagccccaggatgtgatgagccgacatcgaggtgccaaacaccgccgtcgatatgaactcttgggcggtatcagcctgttatccccggagtaccttttatccgttgagcgatggcccttccatacagaaccaccggatcactaa

SEQ ID NO: 4718 - DNA, 471 bp, Pseudomonas aeruginosa
tccgcccggccagttgctcgccgagggattgcgcgctgtcacgcaggtaggcgaccagctcggccggccagagcgccgccggcgcgcagccggcgaacgccgtccaggcgtcctccggactctgcgcgggacgctcggcgcagcccagccagccctcgccctcggcgcgcaggtagccgccctcctccagctggcgcaaccagtggcgcagcaggcgctggcgcgcctcggcgatacccaggcgctggcacagggtggcgaagtccagcggcgtcgcactggcgaacagaccgctgccggccagccaggcggccagcgaggcgaggcaggcacggtcgagtgcggccaccgccgcggcgatgccctcctcgctgccccagtcgcggcgcaaggcctgggccgcccgctggcgcaccgcgtcgagcgccgtacgcggatcctcgccagcctccgccggcgcatgcagggtga

SEQ ID NO: 4719 - DNA, 603 bp, Pseudomonas aeruginosa
aatccaccgagcagtgcagtacgcaggcatcccggccgatactcagctcggggcgcaggaccggccactggtcgagcgccgcgcaggcgtggtcgaggcgttcgcggacccgctccaggtgcgcctggaaagcggcctcgtcgagccccgcgcaggcatgcacggtcagccgctgccagggcacctcgggcagcacgcgctgccaggcgttgtcctcgatcaccgcgcgcagcatcgggtggcgctcgaccatggcgttccaggccgcctccaggcgcgccggatcggtgtcgaccggccagtcgtactcggcgtacagctggcaggcgttaccgccgtagtcgaaggccgcctggcggcccagcacgtaggcggcctgcaccggggtcaatgggaagcgctggtgggccaggtcgggttcggcgcgccagccagggccgccttccaggtgttccagcagggcctcgcgctcggcccgcaggcgctcggcgaggccggcgtcgagggcgccctggggggcgcgatagcgcaggcggcccgcctcgctccagagttcgatgcgccggctgcggcaggtttccagcagttcgccgaggctcatag

SEQ ID NO: 4720 - DNA, 504 bp, Pseudomonas aeruginosa
caggccgtcgtccagcgcctgcaccacgatccgttccggcaagcgggtggcggcggcgtcgatgaggacgcggctgcgttcgaagagggtcagttccagccccgggcgcaacagcgaggccatgccctggtcgagccagagcccggcgcgggtatccagcaccgccacccgcaggcgttcgccggcagccggcgtcggcagcgcttcgagcaggcgcgccaggggcctcgcggccgtccggcaggcgcgcggccaccgcctgcggcgccagccagggatcgaggagcagcgcggccggcgcctgttcgccggcgagcaggccgcgcagagcgttgcccatcgcggtcagccccgcggcctgccagccgagccggcgcaacgcctcgtcgagcgacggcagcgcgctggcggcggagtccgctagccagtccagccagcgccggcgcaaaccgtcgtctagctccagcggcgcctccagcagcgcgccgaggatttcccgggtga

SEQ ID NO: 4721 - DNA, 765 bp, Pseudomonas aeruginosa
gcagggcccggcgcgcctgctgcgcccagggcaacggcagatcggcgggctgctcccaggcgctgtcgcagagacgctggagcagccccacgtaggcttcgaacatggtttccggcaggccttcggggaacaggccgacgacgctgtcccaggccagcaggataccgtcgcccacccggtagagctggtggtcgagccagacctgcggggtctgcgagagcatgtcgtggagatcgccgaaagcgtcgcggaaggccgccgggacgaagccctcctcgcccaggttgctggcgaacaccaccggcgccgagcgtggctggcccctgccggcgcgcctcgcggagcacctccagggcggggaatgcggcgtggtcgatggctccgtggaggttgcgctggaagctcttcaccgcctcggcgaaggacaccccggcctgcatccggcactccagcagcaacagggtggtgaagtcggcgatcacctcgccgatacgcgggtcgtcggcatgccgatcgaacaacggcacgttgaggagaaattccgcgctttcgctccagcgcgccaggaccagcgcgaaggcgcagccgaacacgctggacaaggtcacgccatgctgcgcggcaagacgctccaggcgccggctctcgccggcggaaagctggaatgccaggcgccgggtgcgcggctggcggatgctttccggcgcgcaggccaacggcagggccggcgcgtccggcaagcgcggcaggcgttccagccagtag

SEQ ID NO: 4722 - DNA, 411 bp, Pseudomonas aeruginosa
atctcatttcccagcaatggcaatcgaccgcatccacggagatcgcatgacttcctcgcccgtcaccccatcggccgtcgacgacgcccccgactggcccgccgccttcgtccgccgctatctcgacgccggccactggcaggaccagaacttcgccgaagccctggccgccagcgccgcgcgccatccgcggcggatcgcgctctgcgacgacgaccagcggctcagctatgccgacctgctccagcgctgccgccgcctggcagccggactgcgccaggccggcctcgcacatggcgacacggtagtgctgcacctgcccaacggcatcgccttcgtcgagacctgcttcgccctgttccagctcggcgtacgcccggtgctcgccctccccgcccatcgccagcatga

SEQ ID NO: 4723 - DNA, 1554 bp, Pseudomonas aeruginosa
acgggtcacccacaccgccctggtaccgccgctggcgatgctctggctggatgcccaggaaagccgccgcgccgatctatccagcctgcgtctgctccaggtcggcggctccaggctcggcagcagtgccgcgcaacgcgtcgaaccggtgctcggctgccagttgcaacaggtgctgggaatggccgaggggctgatctgctacacccgcctggacgatccgcccgaacgcgtgctgcatacccagggccggccgctgtcgccggacgacgaagtgcgggtggtcgacgccgagggccgcgaggtcggccccggcgaggtcggcgaactgaccgtgcgcggtccctacaccatccgcggctactaccgcctgcccgaacacaacgccaaggccttcagcgcggacggcttctaccgcaccggcgaccgggtcagccgcgacaaggacggctacctggtggtggagggccgcgacaaggaccagatcaaccgcggcggcgagaagatcgccgcggaagaggtggagaacctgctgatagcccatccgcaggtgcacgacgccaccgtcgtggcgatgcccgacagcctgctcggcgagcgcacctgcgccttcgtcatcccgcgccagccggcgccctcggcgctgaagctgaagcaatacctgcacgcctgcgggctggccgcgttcaaggtgccggaccgcatcgagctggtcccggccttcccccagaccggcatcggcaagatcagcaagaaggacctgcgcgagcgcctgcgccgcgagctggaggcccgcgcatgagcgccgcctgggtccggccgttccgcctgacgccgatgccgcgcctgcgcctggcctgcttcccccatgcaggcggcagcgccagcttcttccgtagctggagcgaacgcctgccgccagacatcgacctgcttgccctgcagtacccgggtcgcgaggaccgcttcaacgaggcgccggccacccgcttggaggacctcgccgacggcgccgccctcgccctgcgcgatttcgccgacgcgcccctggcgctgttcggccacagtctcggcgcggcgctggcctacgaaaccgccctgcgcctggaaagcgccggcgcgccgctgcgccacctgttcgtctccgcccatccggcaccgcaccggcaacgcggcggcgcgttgcaccgcggcgacgaggcggcgctgctggaggacgtccgccgccagggtggcgccagcgagctactcgaggacgccgacctgcgcgcgctgttcctgccgatcctgcgcgccgactaccaggcgatcgagacctaccgacgggcgcagcccatcgccctggcctgcgccctcgacgtcctcctcggcgagcacgacgaggaagtcagcgccgccgaggcgcaggcctggagcgacgccagccggactcccgccaggctgcggcactttcctggcggccacttctacctgagcgaggggcgcgacgcggtgatcgagcacctgctgcgccgcctcgcacatcccgacgccctttcccgagaggttgcatga

SEQ ID NO: 4724 - DNA, 1653 bp, Pseudomonas aeruginosa
aaactcccgaagactgcaccggcctggcggacatccgcgaggccatcgaccggatcgacctggatatcgtccaggccctcggccgccgcatggactacgtcaaggcggcgtcgcgcttcaaggccagcgaggcggcgattccggcacccgagcgggtcgccgcgatgctccccgagcgcgcccgctgggccgaggaaaacggactcgacgcgcccttcgtcgagggactgttcgcgcagatcatccactggtacatcgccgagcagatcaagtactggcgccagacacggggtgccgcatgagccggctggcgcccctgagccagtgcctgcacgccttgcgcggcaccttcgagcgcgccatcggccaggcgcaggcgctcgatcgtccggtcttggtggcggcgtcgttcgagatcgacccattggacccgctgcaggtattcggtgcctgggacgaccggcaaacgccctgcctgtactgggaacagcccgagctggcgttcttcgcctggggctgcgccctggagctgcaaggccacggcgaacagcgcttcgcccggatcgaggaaaactggcaattgctctgcgccgacgccgtggtcgagggcccgctggcgccgcgcctgtgcggcggattccgcttcgatccgcgcggcccgcgcgaggaacactggcaagccttcgccgatgccagcctgatgctcgccggcatcaccgtgctgcgcgagggcgaacgctaccgggtactctgccaacacctggccaagcccggcgaagatgccctggccctggccgcctaccactgctcggcgctactgcgcctgaggcagccggccagacgccggccctcggggccgaccgctggcgcgcagggcgacgcttcggcgcaggagcgcaggcaatgggaagccaaggtgagcgacgcggtaagcagtgtccgccagggacgcttcggcaaggtcgtgctggcccgcacccaggcccggcctctcggcgacatcgagccgtggcaggtcatcgaacacctgcgtctgcaacatgccgacgcccagctgttcgcctgtcgccgcggcaacgcctgcttcctcggcgcctccccggaacgcctggtccgcattcgcgccggcgaggcactcacccatgccctggccgggaccatcgcccgcggcggcgatgcccaggaagatgcgcggctcggacaggccctgctggacagcgccaaggacaggcacgaacaccagttggtggtggaggcgatccgtacggccctggaacccttcagcgaggtgctggaaatccccgatgcgcccggcctgaaacgactggcgcgagtccagcacctgaacacgccgatccgcgcccgcctcgccgacgcaggcggcatcctgcggctgctgcaggcgctgcatccgacccccgcggtgggcggctacccacgcagcgcggcgctggactacatccgccagcacgaagggatggaccgtggctggtacgccgcgccgctgggctggctcgacggcgaaggcaacggcgatttcctggtggcgctgcgctcggccctgctcacgccgggccggggctacctgttcgccggctgcggtctggtaggcgattcggaaccggcccacgagtatcgcgaaacctgccttaa

SEQ ID NO: 4725 - DNA, 573 bp, Pseudomonas aeruginosa
gatcctgattcgtggggcgcgtacccacaacctgaagaacgtcgacctcacactgccacgcgacaaactgatcgtgatcaccggtctttccggttccggcaagtcttccctggctttcgacacgctctatgcggaaggccagcggcgctacgtggaatccctctcggcctacgcccggcagttcctgtcgatgatggagaagccggacgtggacaccatcgaagggctgtcgccggcgatttccatcgaacagaagtccacttcccacaacccacgctccaccgtgggtacgatcaccgagatctacgactacctgcgcctgctttatgcccgcgtcggtaccccgcgctgcccggaccacgacatcccgctggaggcgcagaccgtcagccagatggtcgaccaggtcctggccctgccggaaggcagcaagctgatgctgctggcgccggtgatccgcgagcgcaagggcgagcacctggcggtgttcgacgagatgcgcgcgcatggcttcgtccgcgcccgggtcgacggcaagctctacgaactcgacgaagtgccgaaactggataa

SEQ ID NO: 4726 - DNA, 1440 bp, Pseudomonas aeruginosa
gcagaagaagcacagcatcgatgtggtggtggaccgcttcaaggttcgcgcggacctccagcaacgcctggccgagtcgttcgagaccgccctgtccctggccgacggtatcgccctggtagcaccgatggacgaggacgaggatgtcgaggagatcatcttctcggcgcgcttcgcctgcccggtctgcggccactctatcagcgagctggaacccaagctgttctccttcaacaacccggccggcgcctgtccgacctgcgacggcctcggcgtgaagcaattcttcgacgcgcgccgggtggtcaacggcgagttgaccctggccgagggcgcgatccgcggctgggaccggcgcaacgtctattacttccagatgctcggttcgctggcccagcattacggcttcagcctggaagaacccttcgacgaactcggcgccgagcaccagaaggtggtgctctacggctccggccgggaaaacgtcgacttccgctatctcaacgaccgcggcgacatcgtcaagcgttcgcatcccttcgaaggcatcctgccgaacctggagcggcgctaccgcgagaccgagtcggccacggtccgcgaggagctggccaagttcctcagcacccagccctgcccggattgccacggtacccgcctgcgccgcgaggcgcggcatgtgtgggtcggcgaccggacgctgccggcgatcaccgcgatgccggtcggcgaagcctgcgagtatgccgccggactcagcctgaccggccgccgtggcgagatcgcggcgaagatcctcaaggaaatccgcgaccgcctgcaattcctggtcaacgtcggcctcgactacctgaccctcgaccgcagcgccgacaccctgtccggcggcgaagcccagcgcatccgcctggccagccagatcggcgccggcctggtgggagtgatgtacatcctcgacgaaccctcgatcggcctgcaccaacgcgacaacgagcgcctgctcggcaccctcacccacctgcgcaacctcggcaacacggtgatcgtggtcgagcacgacgaggacgcgatccgactcgccgactacgtcgtcgacatcggtccgggcgccggcgtgcacggcggccaggtagtggcggaaggtacgcccgaccaggtgatgaaccaccccgactcgctgaccggcaagtacctttccgggcgcaagaaaatcgcggttccggccaagcgcaccccgcgcgacaagaagaagctgctgaagctgaaaggcgcccgcggcaacaacctgcagaacgtcaacctggaaatcccggtcggcctgttcacctgcatcaccggggtctcgggctccggcaagtcgacgctgatcaacaacaccctgttcccgatcaccgccaccgcgctgaacggcgcgactaccctggaagtggcgccgtatga

SEQ ID NO: 4727 - DNA, 834 bp, Pseudomonas aeruginosa
ctcgttcgacggcctgcagcacctggacaaggtggtcgacatcgaccagagcccgatcggtcgtaccccgcgctccaacccggcgacctataccggcctgttcacgccgatccgcgaactgttctccggcgtgccggaggcccgctcgcgcggctacggtcccggccgcttctcgttcaacgtcaagggcggccgttgcgaggcctgccagggcgacggcgtgatcaaggtggagatgcacttcctgccggacatctacgttccctgcgatgtctgcaagggcaagcgctacaaccgcgagaccctggagatccgctacaagggcaagagcatccacgaggtgctggagatgaccatcgaggaagcccgcgagttcttcgacgcagtccccgccctggcgcgcaagctgcagacgctgatggacgtcggcctgtcctacatcaagctgggccagagcgcgaccaccctctcgggcggcgaggcgcaacgggtcaagctgtcccgcgagctgtccaagcgcgataccggcaagaccctgtacatcctcgacgaaccgaccaccggcctgcatttcgccgacatccagcaactgctcgacgtgctccaccgcctgcgcgaccacggcaacaccgtggtggtgatcgagcacaacctggacgtgatcaagaccgccgactggctggtcgacctcggccccgagggcggctccaagggtggccagatcatcgccaacggtacgccggagcaggtggccgagatgccccagtcgcacaccggccacttcctcaagccgttgctggaacgcgatcgcgcctgattgccgggcgctcatga

SEQ ID NO: 4728 - DNA, 420 bp, Pseudomonas aeruginosa
cgagccatttctcactgtctcctattacacgcgacgctttttcggcggacggcagccgttatgcgggatcggggttacgtcggtgatgctggcgatcttgtagccgcaagcattcagagcgcgaacggcggactcgcggcccgggcccgggcccttgacgttgacgtccaggttcttcagaccgtattccagggcagcctggccggcacgctcggccgctacctgggcagcgaacggggtgctcttacgcgagccgcggaaaccggaaccaccggaggtcgcccaggacagtgcgttgccctgacggtcggtgatggtcacgatggtgttgttgaaagacgcgtggatgtgggcgatcccatcgaccactgtctttttgactttcttacggggacgagcagcaggttttgccatgactag

SEQ ID NO: 4729 - DNA, 762 bp, Pseudomonas aeruginosa
atttctttcaatcgtgccatggtgatctacctagcagcctcaagcctgaaccggtttctgggtcgacttgaagacacgaattttcttaccgtcttctaccttgaagccaacgcggtcagccttgctggtttcagtattgaagatggcgacgttggagacgtgcagaggcgcctccttctcgacgataccgccctgttggccgagcatcggattgggcttggtgtggcgcttgatcaggttcaccccgccgacgaccagacggtcgtcagcgagaaccttcagcaccttgccacgcttgcccttgtccttgccggcaatgacgattacttcgtcgtcacgacgaatcttttgcatgacggctactccttacagcacttcgggggcgagcgagacgatcttcatgaacttctcggtacggagttcacgagtcactggcccaaagatacgggtgccgatcggctcctgcttgttgttcagcaggacggcggcgttgccgtcgaagcggatgatggaaccgtcggtacgacgcacgccgtgcttggtgcgaacgaccacggcagtcatgacctggcccttcttcactttgccgcgcggaatcgcttccttgacggtgaccttgatgatgtcgccgatgccggcgtaacggcggtgggaaccgccgagcaccttgatgcacatcacacgacgcgcgccgctgttgtcagcgacatcgagcatggattgagtctgaatcatataatttctccgacccctagtccttag

SEQ ID NO: 4730 - DNA, 612 bp, Pseudomonas aeruginosa
actggtcgcgcagcaggccgagcagttgctcgttcagctgctcaacggatttttcacgaagttcattcgctttcatcacatcaccgtccgcttaacaaaggaggtggcgaggggcagctttgcagcagccagggcgaaagcctcacgcgccagctcttcggaaacaccctcgatctcgtacaggaccttgcccggctggatctgggctacccagtactcgaccccacccttacctttacccatacgaacttcgaggggcttcttggtgacaggcttgtcagggaatacgcggatccagatcttgccgccacgcttcacgtgacgggtcagcgcacgacgcgcggactcgatctgacgagcagtaaggcggccacggctagtggccttcagtgcgtactcaccgaagctgaccttactaccacgatgagccagaccacggttgtggccggtcatttgtttgcggaacttcgtacgcttgggttgcagcatttgcgtactccttacctagcagcttttttacgaggagcgggtgctaccggcttcagctcttcctggcggccaccgatgacctcgcccttgaagatccaaaccttgacaccgatcacaccgtaa

SEQ ID NO: 4731 - DNA, 270 bp, Pseudomonas aeruginosa
atcttgatgcccttggcaccaatgcgcatggcgttctgtacggcgcgcttcatggcgcgacggaacattacgcgacgctccagctgctgggctacgctctgcgcaaccagcatggcatcgagttccggcttgcggatttcctcgatgttgatgtgcacgggcacacccatttgcttggtcaggtcctggcgcagtttctcaacatcttcacctttcttgccgatcacgatgccgggacgagcggtgtggatggtgatgcgtgcggtttga

SEQ ID NO: 4732 - DNA, 1227 bp, Pseudomonas aeruginosa
agatcgataaacggaccttttttcagtgaacgtggcactgtggtatccctctatttacttgcggcggcggacgatcatgttatcggtacgcttgttcgagcgagtcttcttacccttggtctgaagaccccacggcgataccggatgacgaccagcagaggtacggccttcaccaccaccatgcgggtggtcgaccgggttcatcgccacgccgcgaacggtcgggcgaacaccacgccagcgcgtagcaccggctttacccagcgaacgcaggctgtgctcggagttcgagacttcgcccagggtcgcacggcactcagccaggactttacgcatttcaccggagcgcagacgcagggttacgtacgcaccttcacgcgcgaccagctgggcggaagcgccagcggagcgagcgatctgagcgcctttacccggcttcagctcgataccatgaacagtgctacccaccgggatgttgcgcagaggcatgctgttgcctgccttgatcggcgcaccgataccggagatcagctggtcacctgcagcaacgcccttgggggcgatgatgtagcgacgctcgccgtctgcatacttcagcagagcgatgtgtgcagtgcggttcggatcgtattcgacgcgctcaacgatggcagggatgccatccttgttgcgacggaagtcgaccagacggtagtgctgcttgtgaccaccaccgatatgacgggtggtgatacgaccgttgttgttacggccgccagacttggatttcttttccagcagcggtgcgtagggagcgcctttgtgcagctcctgattcaccaccttgacgacaaagcgacgaccagcggaagtcggtttgcacttaacgattgccatgatgcacccctttactcagcgctggtggcgaaatcgagatcttggcccggctggagagcgatgtacgcttttttccagtcgttacgcttgcccagaccgcgagcggtgcgcttggtcttacccttgacgttcagggtagtgacgcgctgtaccttcacgctgaacaggctttctacggccttcttgatttccagcttggttgcatcggtggcaaccttgaaaacgaattggctcttgccgtccgcgagacccgtggctttctcggagatgtgcggaccaagcagcactttgaatacgcgttcctggttcatcccagcagctcctcgaacttcttcacggcggacacggtga

SEQ ID NO: 4733 - DNA, 1230 bp, Pseudomonas aeruginosa
tggcaggatcagcgattactcgatgatcttggcaaccacgccggcgccaacggtacggccgccttcgcggatcgcgaagcgcaggccatcttccatggcgatcggagcgatcagggtgacaaccatcttgatgttgtcgcccggcattaccatctctacgccttccggcagttcgcagttaccggtcacgtcggtggtacggaagtagaactgcggacggtagcccttgaagaacggggtgtgacgaccaccttcttccttggacagcacgtacacttcgcactcgaacttggtgtgcggcttgatggtgcccggcttggccagtacctggccacgctctacgtcttcacgcttggtgccacgcagcaggataccaacgttctcaccagcacgaccttcgtcgagcagcttgcggaacatttcaacgccggtgcaggtggtcttggtggtcgccttgatgccgacgatttccacttcttcctggaccttgatgatgccgcgctctacacgaccggttaccacggtaccgcggccggagatcgagaacacgtcttcgatcggcatcaggaacggctggtcgatggcacgaaccggctccggaatgtaggagtccagggtctctaccagcttctgcacggcgcttacgccgatgccgttgtcatccttgccttccagcgccatcagcgcggaaccgatgatgatcggagtgtcgtcgcccgggaagtcgtaggtgttcagcagatcgcgaacttccatctcgaccagttccagcagctcggcgtcgtcgaccatgtcggccttgttcaggaacacgacgatgtagggaacgcctacctggcgggacagcaggatgtgctcgcgggtctgcggcatggggccgtcggcagccgagcaaaccaggatcgcgccgtccatctgggcagcaccggtgatcatgttcttcacgtagtcggcgtgaccggggcagtcaacgtgggcgtagtgacgaacagcggaatcgtattcaacgtgcgaggtgttgatggtgataccgcgggccttttcttccggcgcgttgtcgatctgatcgaaagcacgagcggaaccaccccaggtatcggagcagaccttggtcagtgcagcggtcagagtggtcttgccatggtcaacgtgaccgatggtgccgacgttgacgtgcggtttgttacgttcgaatttttccttagccacgacagtaaacctcttacttaa

SEQ ID NO: 4734 - DNA, 1677 bp, Pseudomonas aeruginosa
agggctgaatcaaccttgttttttaaccagcgcttcgacgatgttcgacggagcttcggcgtatttggagaattccatggagtagctcgcgcgaccctgggacatggaacgcacgtcggtcgcataaccgaacatctcacccagcggaacctcggcacgaataaccttaccggaaaccgtgtcctccatcccctgaatcagaccacgacgacggttcaggtcgcccatcacgtcacccatgtagtcctcaggagtcactacctctaccttcatgatcggctcgagcaccttgccgccgcccttctgggccaactgcttggtcgccatggaagcagcgatcttgaacgccatctcgttggagtcgacgtcatggtaggaaccatcgaaaacggtagccttcaggccgatgagcggatagccggcaacgacgccgttcttcatctgctcttcgatacccttctggatcgccgggatgtattccttcggaaccacaccgcccacgacttcgttctcgaacaccaggccttcggtgatattgcccttctcgtccacgtccgcggccgagaaacggatccagcaatgaccgaactgaccgcgaccaccggactggcgaacgaacttgccttcgatctccacgttgtccttggtgatggtctcacggtaggcaacctgcggcttgccgatgttggcctcgacgccgaactcgcgcttcatgcggtcgacgatgatgtccaggtgcagctcgcccatgccggagatgatggtctgaccggactcttcgtcggtcttgacacggaacgacgggtcttcctgggccagcttgccgagggcgatacccatcttctcctggtcagccttggtcttcggctctacagcgaccgagattaccggctcggggaagtccatgcgctcgaggatgatcggcttctcgatcgagcacagggtgtcaccggtggtgacgtccttcatgccgatcagggcagcgatgtcgcctgcgcgcacttccttgatctcttcacgctggttggcgtgcatctgcaccatccgaccgacgcgctctttcttgcctttcaccgagttcaggacggagtcgccggaactcaggacgccggagtaaacgcgggcgaaggtcagggtaccgacgaacgggtcggtagcgatcttgaacgccagggacgagaacggttcgttgtcgtcggcatgacgctcgtcttcgacggtctcgtcgtccgggctgacgcccttgatcgcagggatctcggtcggagccgggaggtagtcgatgacggcatcgagaaccagcggaacgcccttgttcttgaacgaggaaccgcagacggccggaacgatctcgcaggccagggtgcgcagacgcaggccttccttgatctcggcttcggagagctcgccctcttcgaggtacttgttcatcagctcttcgttggcttcggccgcagcctcgaccatgctggaacgccactcttcggccaggtccttgagctccgcaggaatttcttcctcgcggtaggtcatgcccttgtcgtcatcgttccagtagatggccttcatcttgatcaggtcgacctgaccgacgaagttctcttcagcgccgatggcgagctggaccggaaccggggtatgacccaggcgcttcttgatctgctcgacgacgcgtag

SEQ ID NO: 4735 - DNA, 957 bp, Pseudomonas aeruginosa
gaagttcgcgccctggcggtccatcttgttgacgtagacgatgcgcggtacgccgtacttgttggcctgacgccatacggtttccgactgcggctctacgccggaggtgccacagaacaccacgacagcgccgtccagtacacgcagggaacgctccacctcgatggtgaagtctacgtggccgggagtgtcgatgacgtttacgcgatagttgtcgtactgaccgcgcgaacccttccagaaggtggtaacggcagcggaggtaatggtgataccgcgctcctgctcctgcaccatccagtcggtggtcgcagcgccgtcatgcacttcgcccagcttgtggttgacgccggtatagaacagaacccgctccgtggtggtggtcttgcccgcgtcaacgtgggcacagataccgatattacggtagcggttgatgggtgtagtacgggccacaataaggtcctcgggggttgggcagcgcgattagaaccggtagtgcgagaaggccttgttggcctctgccatacggtgcacgtcttcacgcttcttgactgctgcgcccttgccttcagcggcatccagcagctcgccagccaggcgcagagccatggacttctcgccacgcttgcgggcgaagtccaccagccaacgcatggccagggcattacgacgggacggacggacttcgaccggaacctggtaagtcgcaccacctacgcggcgggacttcacttcgaccagcggagcgatggcatcgagagctttttcgaaggtttccaggggatcggccttgccgcgttccttcaccttgtccagcgcaccgtaaacgatacgctcggcaacggctttcttgccgctttccatcacgtggttcatgaacttggccaggatctggcttccgtatttcggatcagccagcacttcacgcttggccgctacacgacgtcttggcattga

SEQ ID NO: 4736 - DNA, 447 bp, Pseudomonas aeruginosa
cccgggaccataacagtcaagttacgcccgaccttactcttatcgactcagataaatataaaaacgctattacttcggacgcttggcgccgtacttcgaacgaccctgcttacggtctttgacacccgaggtgtccagcgaaccgcgcacggtgtggtaacgcacacccggaaggtcctttacacgaccgccacggatcagcactacgctgtgctcttgcaggttgtgaccttcaccaccgatgtacgaggaaacctcgaaaccgttggtcagacgtacacggcataccttacgcagtgccgagttcggctttttcggcgtggtggtgtatacgcgggtgcatacgccacgacgttgcgggcagttctgcagcgcaggcacgtcgctcttgtcgaccatgcgcttgcgcggcttacgcaccagctggttgatagttgccatctatag

SEQ ID NO: 4737 - DNA, 4074 bp, Pseudomonas aeruginosa
cgtcacgtgttattcggtttccagttcgatgtcgatgccgagcgaacggatctctttgatcagaacgttgaaggactcgggcatgccggcctccatgcggtgatcgccgtccacgatgttcttgtacatcttggtccggccgttcacgtcgtccgacttgaccgtcagcatttcctgcagggtgtacgccgcgccataggcttccagcgcccacacctccatctcaccgaagcgctgaccaccgaactgtgccttaccacccagcggctgctgggtaaccaggctgtacgagccggtggaacgggcgtgcatcttgtcgtccaccaggtggttcagcttgagcatgtacatgtagccgacggtggtcggacgctcgaactggttgccggtacggccgtcgaacagacgcatctggccgctttccggcaggtcggccagcttcagcatggccttgatctcgcgttccttggcgccatcgaacaccggggtcgccatcggtacgccaccgcgcaggttcttggccagcgcgaggatctcgttgtcgcccagctcgtcgaggttttcctcgcgaccgccgatctcgttgtagatctcgtgcaggaacttacgcagttcggcgaccttgcgctgctcttcgagcatgcggttgatcttctcgcccagccccttggccgcgaggcccaggtgggtttcgaggatctgaccgacgttcatacgcgacggtacgcccagcgggttgaggacgatgtcgaccggggtgccgttggcatcgtgcggcatgtcttccaccggcatgatcaccgagaccacacccttgttaccgtgacggccggccatcttgtcgcccggctggatgcgacgcttgatcgccaggtagaccttgacgatcttcagcacgcccggagccaggtcgtcgccctgctgcagcttacgcttcttgtcctcgaacttgtcgtccaggagctggcgacgatcgctgatgtaggcctgggccttctccagctgttcgttcagggcgtcgtcggccatgcgcagcttgaaccactggccgcgctcgagaccgtcgaggtagtcgtcggtgatctccgtgcccttcttcagcgccgggccaccttcagccttggcaccgaccagggcggcacgcagacgctcaaaggtcgcgccttcgacgatgcggaactcttcgttcaggtccttgcggatctggtcgagttgcatcttctcgatggacagcgcgcgggaatcgcgctcgacgccgtcgcgggtgaagacctgaacgtcgatgacggtacccttggtgccggtcggcacacgcagggaggtgtccttcacgtcggacgccttctcaccgaagatcgcgcgcagcagcttctcttccggagtcagctgggtctcgcctttcggagtgaccttgccgaccaggatgtcgccggcctgcacttcggcgccgacgtagacgataccggcttcgtccagcttgttcagcgcggcctcgcccacgttcgggatgtccgcggtgatttcctctgggccgagcttggtgtcacgagcgacgcaggtcagttcctggatgtggatcgtggtgaaacgatcttcctggaccacgcgctcggacaggcagatggagtcttcgaagttgaagccgttccagggcatgaacgctacgcgcatgttctggcccagggccagttcgcccatgtcggtggacggaccgtcggccaggatgtcgccgcgcgcgaccacgtcacccttgctcaccagcggacgctggttgatgcaggtgttctggttggaacgggtgtacttggtcaggttgtagatgtcgacacccgcttcgccggtctcgacttcgtcatccgccacgcgaaccacgacacggctggcatcgaccgagtcgatcacaccgccacggcgagccacgacgcagacgccggagtcgcgcgccacgttgcgctccatgccggtacccaccagcggcttgtcggcacgcagggtcggcacggcctgacgctgcatgttcgagcccatgagtgcgcggttggcgtcatcgtgctcgaggaacggaatcagcgaggcagcgacggaaacgacctgcttcggcgacacgtccatcagggtcacgtcttccggcgccttcacggtgaattcgttcaggtgacgcacggccaccagctcgtccaccagttgacccttctcgttgagggtcgccgaagcctgggcgatgacgtggtcggcttcttcgatcgccgacaggaacacgatctcgtcggttaccaggctgtccttgaccacgcggtacgggctctcgaggaagccgtacttgttggtgcgggcgtaggtcgccagggagttgatcagaccgatgttcggaccttcaggggtttcgatcgggcacacgcggccgtagtgggtcgggtgtacgtcacgaacctcgaagcccgcacgctcacgggtcagaccgcccgggccgagcgcggagacgcggcgcttgtgggtgatctcggaaagcgggttgttctggtccatgaactgcgacagctggctcgaaccgaagaactccttgatcgcggcagccaccggcttggcgttgatcaggtcctgcggcatcaggccttcgctttcggccatggacaggcgttccttgaccgcgcgctcgacacgcaccaggcccacgcggaactggttctcggccatttcgccgacgcaacggacgcgacggttgcccaggtggtcgatgtcatcgacgatgcccttgccgttacggatgtcgacgagggtcttgagcacatcgatgatgtcttccttgctcaggacgcccggaccttcgatctcggtacgaccgatacggcggttgaacttcatccggcccacggccgacaggtcgtaacgctcggcgctgaagaacaggttgccgaacagggtctcggcagcttccttggtcggcggctcgcccggacgcatcatccggtagatctcgaccagggcttccagctggttgctggtgttgtcgatcttcagggtgtcggagatgaacggaccgcagtcgatgtcgttggtgtacagggtctcgatgcgcacgacctgggccttggccaccttggccaggaggtcgagggtcagctcggtgttgcactcggcgatgatctcgccggtagccggatgcacgatcgccttggcgatggtacggccgatcaggtagtcgaacggcacttccagctggctcacgccagccttttccagctggttgatgtggcgggcagtgatacgacgcccctgctccacgatcaccttgccgctgccatccttgatgtcgatgctcgcgacttcaccgcgcaggcgctgcgggaccagttccaggttcagggtctcgcccttgatgtggaagacgttggtcgcgtagaaggcgttgaggatctcttcggtgctatagccgagcgcgcgcagcagtaccgaggccggcagcttgcggcgacggtcgatacggacgaacacgcagtccttcggatcgaactcgaagtccagccaggaaccgcggtaaggaatgatccgcgcggagtacagcagcttgccggagctgtgggtcttgccacggtcgtggtcgaagaacacgcccggggaacggtgcaactgggagacgatgacacgttcggtaccgttgatgatgaaggtaccgttctcggtcatcagggggatttcccccatgtagacttcttgttccttgatgtccttgatcgccttgttcgacgactcgcggtcgaagatgatcaggcgaactttcacgcgcagcggtacggcgaaggtcacgccgcgcagcacgcactccttgacatcgaatgccggctcacccagacggtagccgacgtattccagggcagcattgccggaatagctgataatcgggaaaacggacttgaaggccgcgtgcagaccgatatcgcggaactgctccttggttgcgccagcctgcaggaattcgcgataggaatccagctggatggccagcaaatacggcacatccatgacgtccggcaacttgctaaagtccttgcggatacgttttttctcagtgtatga

SEQ ID NO: 4738 - DNA, 438 bp, Pseudomonas aeruginosa
acgcaaggtcgtcgcttacttgagctcgactttggcgcctgcttcttccagggctttcttggcggcttcggcttcttctttcgaagcgccttccttcaccacgcccggagcgccgtctacgacggccttggcttctttcagacccagaccggtcagttcgcgaacgaccttgatcacgttcactttcttgtcgccagcttcggccaggacgatggtgaactcggtctgctcttcggcagcggcagcagccgggccagcagcggcaacggtagcggcagcagcggtaacgccgaacttctcttccatcgccttgatcagttcgaccacttgcatgacggacatttcggatacggcgttgatgatgtcttcgttggtcagagccatgactctaattcctgtattgggggacggcctgcggccatcgtattaaacaaataa

SEQ ID NO: 4739 - DNA, 1047 bp, Pseudomonas aeruginosa
gcttgtggtttaaggcttgcgccacctacggtcttggatagcccccgccaggcagggaccccaatacctgtgcagcgggcagaacccgctgcacgatttcacttaggcttccagggaagccaggtcgatctgcaggcccggacccatggtggtgctcagggtcacgcgcttgacgtacacgcctttcgacgaggacggcttcaggcgcttcaggtcagccagcagcgcttcaacgttctgctgcagcttggccggctcgaaatcgaccttaccgacggagctgtggatgatgccgttcttgtcggtacggaaacgtacctgaccagccttggcattcttcacggcggtagcgacgtccggagtcacggtgccgactttcgggttcggcatcagaccacgcgggccgaggatctggcccagctggccgacgacacgcatggcatccggggaagcgatgacgacgtcgtagttcaggtcgccgcctttcatttcggcagccagttcgtccatgcccaccttgtcggcgccggcagccagagcggcttcggcagccggaccctgggtgaagacggcaacgcggacgctcttgccggtgccgttcggcaggacggtggcgccacgaacgacctggtcggatttacgcggatcgacgccgaggttcacggcaacgtccacggactccttgaacttgatggtggacagctcggccagcagcttggcggcctcttcgaagctgtactgcttgccggcaactactttctcggcaatcgccttctggcgcttggtcagcttagccattacacaccctccacgttcaggcccatgctgcgcgcggagccagcgatggtacgtacagcagcgtccagatcagcagcggtcaggtcagcctgcttggtcttggcgatctcttccagctgggcacgggtaacggtgccgactttctgggagttcggacgagcggagccgctggtgatgccagctgcttttttcagcaggacggcagccggggtgctcttggtttcgaaggtgaagctacggtcgctgtaa

SEQ ID NO: 4740 - DNA, 1356 bp, Pseudomonas aeruginosa
gctactggcctgaagcaaaatcaggccgaccattatgccggcctgagaggggaagatcaaccgatattattcgatgatcttggcaaccacgccagcaccaacggtacggccgccttcgcggatcgcgaagcgcaggccatcttccatggcgatcggagcgatcagggtgacaaccatcttgatgttgtcgcccggcattaccatctctacgccttccggcagctcgcagttaccggtcacgtcagtggtacggaagtagaactgcggacggtagcccttgaagaacggggtgtgacgaccaccttcttccttggacagcacgtacacttcgcactcgaacttggtgtgcggcttgatggtgcccggcttggccagaacctggccacgctctacgtcttcacgcttggtgccacgcagcaggataccaacgttctcaccagcacgaccttcgtcgagcagcttgcggaacatttcaacgccggtgcaggtggtcttggtggtcgccttgatgccgacgatttccacttcttcctggaccttgatgatgccgcgctctacacgaccggttaccacggtaccgcggccggagatcgagaacacgtcttcgatcggcatcaggaacggctggtcgatggcacgaaccggctccggaatgtaggagtccagggtctctaccagcttctgcacggcgcttacgccgatgccattgtcatccttgccttccagcgccatcagcgcggaaccgatgatgatcggagtgtcgtcgcccgggaagtcgtaggtattcagcagatcgcgaacttccatctcgaccagttccagcagctcggcgtcgtcgaccatgtcggccttgttcaggaacacgacgatgtagggaacgcccacctggcgggacagcaggatgtgctcgcgggtctgcggcatggggccgtcggcagccgagcaaaccaggatcgcgccgtccatctgagcagcaccggtgatcatgttcttcacatagtcggcgtgaccggggcagtcaacgtgggcgtagtgacgaacagcggaatcgtattcaacgtgcgaggtgttgatcgtgataccgcgggccttttcttccggcgcgttgtcgatctgatcgaaagcacgagcggaaccaccccaggtgtcggagcagaccttggtcagtgcagcggtcagagtggtcttgccatggtcaacgtgaccgatggtgccgacgttgacgtgcggcttgttccgttcaaatttttctttagccatggagaccatccccttcaaggaattgagcggatcacgctaccattagaacaagggcagatattttcatatctgcccctggataaatggagctcatga

SEQ ID NO: 4741 - DNA, 525 bp, Pseudomonas aeruginosa
gacgggcctgcgcactttcagccgaatcccgcgcggaaaacatccccaaagaaatgccattggccagcactccctcgccaatcaggtagctgtcgatattgcgcgcctgaagctccttcaactgacgaagcgcagcctcccgcgaggctagcggaggaagatagacccagtaatcgacgctcatctccccacgggcctcgacctccgcctcgatatctaggcccagcaggcgctgctgcaaccttcgggcatccgcctcctcaccgcctccgccaagatagagacaggccgactcggatgcgatcgactcttcggcagccggaggcacactcggcgccggcacctgcgatcccgagcgcgccctggaagcaaggttgctctcggccaacagcagaatgttcttctgcccatccttatagagttccagcggtgcgatttccttggcccgtagcggggattgctgctggtgccagacgtagtacaagacgttcagggccaggagaaacaggaagaaccagcgcatag

SEQ ID NO: 4742 - DNA, 516 bp, Pseudomonas aeruginosa
atcctctcactcaatcgggcaagccagtgccagccctacgaaaaccaggtccggcatgatccgggcgccagccagttcgtcgcgaaccagttcggcatccccacccgtcaggaatatttcacaatccggaccgagcagctcgcacgccatggcgtactgctcacgaacgaaccccctgagcatgagcagacaaccccgctcaaccgcctcggccgtggcctgccctggctggagactggcaagcgcccgccgggcctctgcatcgtcgtagcggatacgtcgggtatgggtgcgcaactggcttctcatcagggtcatgcccgggcatatgtagccccccagatgcactccatccgccgcgaccaggtcagaggtgaccgcggtccccagatcaatgaccaggcaggccttcttagccaggtgatgagccgcgacgagggccaaccagcggtcgagccccaggcgctggtagtcgagatagccgttgcgcactcccgccaactgcttgccggatga

SEQ ID NO: 4743 - DNA, 717 bp, Pseudomonas aeruginosa
gtgagaggatctatgcgctggttcttcctgtttctcctggccctgaacgtcttgtactacgtctggcaccagcagcaatccccgctacgggccaaggaaatcgcaccgctggaactctataaggatgggcagaagaacattctgctgttggccgagagcaaccttgcttccagggcgcgctcgggatcgcaggtgccggcgccgagtgtgcctccggctgccgaagagtcgatcgcatccgagtcggcctgtctctatcttggcggaggcggtgaggaggcggatgcccgaaggttgcagcagcgcctgctgggcctagatatcgaggcggaggtcgaggcccgtggggagatgagcgtcgattactgggtctatcttcctccgctagcctcgcgggaggctgcgcttcgtcagttgaaggagcttcaggcgcgcaatatcgacagctacctgattggcgagggagtgctggccaatggcatttctttggggatgttttccgcgcgggattcggctgaaagtgcgcaggcccgtctcaagacggcaggttacgaggcggagctgaaggaattgccccgcgggcagcgtgatttctgggtaagggtggcacccggcagccggcgtctggtggatgagcaactgctccaggagctggctcgggacttcaagggattgcagcatcaaataatgtcgtgcaaaggtgttgcatccccctga

SEQ ID NO: 4744 - DNA, 372 bp, Pseudomonas aeruginosa
cagatgaatgccaaggcagaagccaaagaatcacgttttgatctcttgaaatggctcttggttgccgttctggttgtggttgccgttgtgggcaatcagtacttttcggctcaaccaatcctgtatcgcgttctcggtattctcgttctggcggtgatcgctgctttcctggctctgcaaacggccaaggggcaggccttctttagtcttgctaaggaagcgcgcgtcgagattcgcaaggtcgtatggccgagtcgtcaagaaacaactcagaccacgctgatcgtggtcgcggtagtgctggtaatggcgctgctgctgtgggggctcgattccctgctgggttggttggtttccatgattgtaggttaa

SEQ ID NO: 4745 - DNA, 543 bp, Pseudomonas aeruginosa
gggtgcgccgtggctaagcgttggtacgttgtgcatgcatactcgggctacgagaagcatgtcatgcgctcgctgatcgagcgtgtcaagcttgctggcatggaagaagagttcggcgagattctggttcccaccgaagaagtggtggagatgcggaacggccagaagcgcaagagcgagcgcaaattcttccctggctatgtgctggttcagatggaaatgaacgaaggtacctggcacctggtgaaggataccccgcgtgtcatgggcttcatcggcgggactgccgacaagccggctccgatcaccgatcgtgaggctgatgcaatcctgcgtcgcgtggccgatagcggcgacaagcccaagccgaagaccctgttcgagccgggcgagaccgttcgtgtcatcgatggtcctttcgccgacttcaatggtgtcgtcgaagaagttaactacgagaagagccggatccaagtggccgtgctcatctttggccgctctaccccggtggagctggagttcagtcaggtcgaaaaggtctag

SEQ ID NO: 4746 - DNA, 615 bp, Pseudomonas aeruginosa
agtcatggctctgaccaacgaagacatcatcaacgccgtatccgaaatgtccgtcatgcaagtggtcgaactgatcaaggcgatggaagagaagttcggcgttaccgctgctgccgctaccgttgccgctgctggcccggctgctgccgctgccgaagagcagaccgagttcaccatcgtcctggccgaagctggcgacaagaaagtgaacgtgatcaaggtcgttcgcgaactgaccggtctgggtctgaaagaagccaaggccgtcgtagacggcgctccgggcgtggtgaaggaaggcgcttcgaaagaagaagccgaagccgccaagaaagccctggaagaagcaggcgccaaagtcgagctcaagtaagcgacgaccttgcgtctacagcccgagcgtcaagcgaaaggctgatggctggtggcttttgccaccggcctttttccgttctgggtggactcccccccggggcgttccacccaagacgtgaaagtgccccgagtgggcaatgcaggccaaggggtctgcaacatttccggctgctcccgtcggagacgccaaacaagcaggtgaccaagctggggaacgctgatggcttactcatacactga

SEQ ID NO: 4747 - DNA, 291 bp, Pseudomonas aeruginosa
catcgaccacctgggcaaccgtcgcgtccgttgcgtcggcgaaatggccgagaaccagttccgcgtgggcctggtgcgtgtcgagcgcgcggtcaaggaacgcctgtccatggccgaaagcgaaggcctgatgccgcaggacctgatcaacgccaagccggtggctgccgcgatcaaggagttcttcggttcgagccagctgtcgcagttcatggaccagaacaacccgctttccgagatcacccacaagcgccgcgtctccgcgctcggcccgggcggtctgacccgtga

SEQ ID NO: 4748 - DNA, 4212 bp, Pseudomonas aeruginosa
ggaggaaaggccttgaaagacttgcttaatctgttgaaaaaccagggtcaaatcgaagagttcgatgccatccgtattggcctggcttcgcccgagatgattcgttcctggtctttcggcgaagttaaaaagccggaaaccatcaactaccgtaccttcaagccggagcgcgacggcctgttctgcgccaagatcttcggcccggtgaaggactacgagtgcctgtgcggcaagtacaagcgcctcaagcaccgcggtgtgatctgcgagaagtgcggcgtggaagtcgccctggccaaggtgcgccgcgagcgcatgggccacatcgagctggcttcgccggttgcccacatctggttcctgaagtcgctgccgtcccgtatcggcctgctgctggacatgaccctgcgcgatatcgagcgcgtgctctatttcgagagctacgtggtgatcgatccgggcatgaccaccctggaaaagggccagctgctgaacgacgagcaatacttcgaggccctcgaagagttcggtgacgatttcgatgctcgcatgggcgccgaagccgttcacgaactgctcaacgccatcgatctggagcacgagatcggccgcctgcgcgaagagattccgcagaccaactcggaaaccaagatcaagaagctgtccaagcgcctgaagctgatggaagccttccagggctccggcaacaagcctgagtggatggtcctgaccgtcctgccggtgctgccgccggacctgcgtccgctggttccgctggatggcggtcgcttcgcgacttccgacctgaacgacctgtatcgtcgggtgatcaaccgtaacaaccgtctgaagcgcctgctcgacctggccgctccggacatcatcgtgcgcaacgaaaagcgcatgctgcaggaagccgtcgacgccctgctcgacaacggccgtcgcggtcgcgccatcaccggctcgaacaagcgtccgctgaagtcgctggccgacatgatcaagggcaagcaaggtcgcttccgtcagaacctgctcggcaagcgcgtggactactccggtcgttccgtgatcaccgtgggcccgaccctgcgcctgcaccagtgcggtctgccgaagaagatggccctggagctgttcaagccgttcatcttcggcaagctggaaggtcgtggtatggccaccaccatcaaggccgccaagaaaatggtcgagcgcgagctgcccgaggtctgggacgttctcgccgaagtcatccgcgagcatccggttctcctgaaccgtgcgccgaccctgcaccgtctgggcatccaggcgttcgagccggtcctcatcgaaggcaaggcgatccagctgcacccgctggtctgcgccgcgtacaacgccgacttcgacggtgaccagatggccgtccacgttccgctgaccctcgaggcccagctggaagcgcgcgcgctgatgatgtccaccaacaacatcctgtcgcccgccaacggcgagccgatcatcgttccgtcgcaggacgtggtaatgggtctgtactacatgacccgtgaagcgatcaacgcgaagggcgagggcatggccttcgccgacctgcaggaagtcgaccgcgcctaccgcagcggccaggcgtccctgcacgctcgcgtgaaagtgcgcatcaacgaaaagatcaagggtgaagacggccaactgaccgccaatacccgtatcgtcgacaccaccgtcggccgcgcgctgctgttccaggtcgttccggccggcctgccgttcgacgtggtcaaccagtcgatgaagaagaaggcgatctccaagctgatcaaccactgctatcgcgtggtgggtctgaaggacaccgtcatcttcgccgaccagctgatgtacaccggtttcgcctactcgaccatttccggcgtgtccatcggcgtcaacgacttcgtcatcccggacgagaaggcgcggatcatcaacgccgccaccgacgaagtgaaggagatcgagagccagtacgcctccggcctggtaacccagggcgagaagtacaacaaggtgatcgacctgtggtcgaaggccaacgacgaagtgtccaaggcgatgatggccaacctctcgaaagagaaggtcgtcgatcgcgagggcaaggaagtcgaccaggagtccttcaactccatgtacatgatggctgactcgggtgcgcggggctccgcggcccagatccgtcagctggcaggtatgcgcggcctgatggccaagccggacggctcgatcatcgagaccccgatcaccgcgaacttccgggaaggcctgaacgtactccagtacttcatctccacccacggtgctcgtaagggtctggcggataccgcgctgaagaccgcgaactccggttacctgacccgtcgtctggtcgacgtggcccaggatctggtagtgaccgagatcgattgcggtaccgagcacggcctgctgatgtcgccgcacatcgaaggcggcgacgtggtagaaccgctcggcgagcgcgtgctcggccgtgtgatcgcgcgcgacgtgttcaagccgggcagcgacgaggtcatcgtgccggccggcaccctgatcgacgagaagtgggtcgacttcctcgaagtgatgagcgtcgacgaagtggtggtgcgttccccgatcacctgcgaaacccgtcatggcatctgcgccatgtgctacggccgcgacctggcccgtggccatcgcgtcaacatcggcgaggcggtcggtgtcatcgctgcccagtccatcggtgagccgggcacccagctgaccatgcgtaccttccacatcggcggtgcggccagccggacctccgcggccgacaacgtccaggtgaagaacggcggcaccatccgcctgcacaacctgaagcatgtggttcgtgccgacggcgcgctggtcgcggtttcccgttccggcgaactggcggttgccgacgacttcggtcgcgagcgcgagcgctacaagctgccgtacggcgcggtgatctcggtcaaggaaggtgacaaggtcgacccgggcgctatcgtcgccaagtgggacccgcacacccacccgatcgtcaccgaggtggacggtaccgtggccttcgtgggcatggaagagggcatcaccgtcaagcgtcagaccgacgaactgaccggcctgaccaacatcgaagtgatggatccgaaggaccgtccggctgccggcaaggacatccgtccggccgtgaagctgatcgatgccgcgggcaaggacctgctgctgccgggtaccgacgtaccggcgcagtacttcctgccggccaacgccctggtcaacctgaccgacggcgccaaggtgagcatcggtgacgttgtcgcgcgtatcccgcaggaaacctcgaagacccgtgacatcaccggtggtctgccgcgcgttgccgacctgttcgaggctcgtcgtccgaaagagccttcgatcctggcggaaatcagcggcaccatctccttcggcaaagagaccaagggcaagcgccgcctggtcatcacgccgaacgatggcagcgatccgtacgaggagctgattccgaagtggcgtcacctgaacgtgttcgaaggcgaacaggtgaaccgcggcgaagtcatctccgacggtccgagcaacccgcacgacatcctgcgcctgctgggcgtgagctcgctggcgaagtacatcgtcaacgagatccaggacgtctaccgtctgcagggcgtgaagatcaacgacaagcacatcgagaccatcctgcgtcagatgctgcgcaaggtcgaagtcagcgagtccggcgactccagcttcatcaaaggcgaccaggtggaactcacccaggtgctggaagagaacgaacagctcggtaccgaggacaagttcccggccaagtacgagcgcgttctgctgggtatcaccaaggcttccctgtcgaccgagtcgttcatttccgcggcgtcgttccaggagaccacccgcgtcctcaccgaggcggcggtcaccggcaagcgcgacttcctgcgtggtctgaaagagaacgtggtcgtgggtcgcctgatcccggccggtaccggtctggcttaccacagcgagcgcaagcgtcagcgcgacctcggcaagccgcagcgtgtgagtgccagcgaggcggaagccgcactgaccgaagcgctgaactcgagcggtaactaa

SEQ ID NO: 4749 - DNA, 648 bp, Pseudomonas aeruginosa
tcgtgcgtccggcagccaaggctcgcggttaagggggaagctgagatgcaattgaatgtgaacggcgctcaggctatcgaagtctccgagcgtacctttggtggcgaattcaacgagaccctggtgcaccaggcagtcgtggcctacatggctggcggccgtcagggcagcaaggcgcagaagactcgctccgaagtctctggtggtggcaagaagccgtggcgtcagaagggcaccggtcgtgctcgtgctggcaccatccgtagccccatctggcgtgggggcggcaccactttcgccgctaaaccgcgtagccacgaacagaagctgaacaagaagatgtaccgcgcagcactgcgctccatccttgccgagctcgttcgtctggaccgtctggtcgtcgttgccgacttcgctgtcgatgcaccgaaaaccaagggcctggttgccaagctggacaccctgggtctgaaagacgtgctgatcgtgaccgatggtgtcgacgagaacctgtacctcgctgcgcgcaacctggcgcacgtcgatgtacgtgatgtccaaggttccgaccccgtcagcctgatcgcctacgacaaggtgctggtcaccgtgtccgccgtgaagaagttcgaggagctgctgggatga

SEQ ID NO: 4750 - DNA, 207 bp, Pseudomonas aeruginosa
gcggacggtgatgtgatgaaagcgaatgaacttcgtgaaaaatccgttgagcagctgaacgagcaactgctcggcctgctgcgcgaccagttcaatctgcgcatgcagaaagcaactggccagttggggcagtctcacctgctctcgcaggttaagcgcgacatcgctcgcgttaaaactgtgctcaatcagcaagcaggtaagtga

SEQ ID NO: 4751 - DNA, 390 bp, Pseudomonas aeruginosa
ccaccaccgctcgtacggatgacgaaggtcgcgccctgctgcgtgctttcaaattcccgttccgtaactgattggagtaggaacatggctaaagagagcatgaagaaccgcgagctgaagcgtcagctgacggtagccaagtacgccaagaagcgtgccgagctgaaagcgatcatcgctaatccgaactcctctgcggaagagcgttggaatgcccaggtcgccctgcagaagcaaccgcgtgacgccagcgccagccgcctgcgtaaccgttgccgcctgaccggtcgtccgcacggcttctaccgcaagttcggcctgagccgtaacaagctgcgcgaagccgccatgcgcggcgacgtaccgggtctggtgaaagccagctggtaa

SEQ ID NO: 4752 - DNA, 582 bp, Pseudomonas aeruginosa
tcgcagcgaacggtgtcgccagtcggcaccgttgatcgcgacatcgaatcaagcccctcatggggcttgattcgttttggcgtgatctctagaatacccggctcccctgagcctgggtttgtttcgcctggcgtttatgggcgaattgaagttgaaggcttattcttttgtatcaggagcgttaagcccatgagtatgcaggacccgttagcagacatgctaactcgcatccgtaatgcccagatggctgaaaagaccgtcgtaagcatgccgtcctcgaaactgaaagcggcggtagccaaagtcctgaaggacgaaggctatattgcggatttccagatcagctcggaagtaaaaccccagctgtccatcgaactgaagtacttcgaaggcaagcctgtcatcgaagaggtcaagcgcatcagccgtcctggcctgcgtcagtacaaatccgttgagcaactgccgaaagttcgtggcggcctcggtgtgtcgatcgtctccaccaacaaaggtgtgatgaccgatcgtgctgcccgtgctgctggtgttggcggcgaagtgctctgcactgtgttctaa

SEQ ID NO: 4753 - DNA, 354 bp, Pseudomonas aeruginosa
caaatgagcgtcaagaaagaaacccgtctgcgtcgcgctcgcaaggcacgcctgaagatgcgcgagctggaaaccgtacgcctctgcgtgtaccgctcttcccagcacatttacgcccaggtcattgcggccgacggcggcaaggtcctggccagcgcctcgaccctggacaaagacctgcgcgaaggtgccaccggcaacatcgatgcagccaagaaagttggtcaactggtcgccgagcgcgccaaagcggccggcgtcacccaggtggcgttcgatcgttctggcttcaagtaccacggccgtgtgaaagcgctggctgatgccgctcgtgaaggcggactggagttctaa

SEQ ID NO: 4754 - DNA, 504 bp, Pseudomonas aeruginosa
gttatggcaaacaacgagcaaaagcgcgacgaaggctacatcgagaagctggttcaggttaaccgcgtcgccaaaaccgtaaaaggtggccgtatcttcgctttcaccgcactgaccgtggtgggtgatggcaagggtcgcgttggtttcggtcgtggcaaggcgcgtgaagtgccggccgccatccagaaagcaatggaagccgctcgccgcaacatgatccaagtcgatctgaacggcaccaccctgcagtatccgaccaagtccgcccatggcgcctccaaggtgtacatgcagccggcttcggaaggtaccggcatcatcgccggcggcgccatgcgtgccgttctggaagtggctggtgtgcagaacgtcctggccaagtgctatggctccaccaatccggtgaacgtggtttacgccaccttcaagggcctgaagaacatgcaggctccggaagcagtagcggccaagcgtggcaagagcgtcgaggagattctctaa

SEQ ID NO: 4755 - DNA, 1017 bp, Pseudomonas aeruginosa
aaaataggtgcatccatgcagagttcggtaaatgagttcctgaccccccgccacatcgatgtgcaggtggtcagtcaaacccgcgccaagatcacgctcgagcctctcgagcgtggttttggtcacaccctgggcaacgcgctgcgtcgcatcctgttgtcctccatgcctggctgcgcagtggtcgaggccgagatcgacggcgtactccacgagtactcggcgatcgaaggtgtgcaggaagatgtaatcgagatcctgctgaacctgaaaggtctggccatcaagctgcacggtcgtgatgaagtgacgctgaccctggctaagaagggctcgggtgttgtgactgctgccgatattcagctggatcacgatgttgagatcatcaacggtgaccacgttatcgccaacctggcagacaacggcgcgctgaacatgaagctgaaggtagctcgtggccgtggctacgagcctgccgacgcacgtcagagcgatgaagacgaaagccgcagcatcggccgtctgcagctcgacgcatcgttcagcccggtccgtcgtgtctcctacgtggtggaaaacgcccgtgtcgagcagcgcaccaacctggacaaactggtcctggacctggaaaccaacggcaccctggatcccgaagaggctatccgtcgcgccgctaccatcctgcaacagcagctggcagcgttcgtggacctcaagggcgacagcgaacccgtcgttgaagagcaggaagacgagatcgatccgatcctcctgcgcccggtcgatgacctggaactgaccgtacgttcggccaactgcctgaaggcggaaaacatctactacatcggtgacctgatccagcgcaccgaagtggagctgttgaaaacgccgaacctgggcaagaagtccctgaccgaaatcaaggacgttctggcttcccgtggtctgtccctcggtatgcgcctcgataactggccgccggcaagtcttaagaaagacgacaaggccactgcctga

SEQ ID NO: 4756 - DNA, 1449 bp, Pseudomonas aeruginosa
atggaagagaagacccgcctgaccactgccgctggcgcaccggtggtcgataaccagaacgtgcagaccgccggtccgcgtggcccgatgttactgcaggacgtgtggttcctcgagaagctcgcccacttcgatcgcgaagtgatccccgagcgccgcatgcatgcgaaaggctccgcggcctacggcaccttcaccgtcacccatgacatcaccccctacacccgggcgaagatcttctcccaggtcggcaagaagaccgatatgttcctgcgcttctccaccgtcgccggtgagcgcggcgcggcggatgccgagcgcgatatccgcggcttctccatgcgtttctacaccgagcagggcaactgggacctggtcggcaacaacaccccggtgttctacctgcgtgacccgctcaaattccccgatctcaaccacgtggtaaagcgtgacccgcgcaccaacctgcgcaatgcgaccttcaagtgggactttttctctcacctccccgagtcgctgcatcagttgaccatcgacttcagcgaccgcggcctgccgaagagctatcggcacatccatggtttcggcagccataccttcagtttcatcaatgcgaacaacgagcgcttctgggtcaagttccacttcaagacccaacagggcatcgagaacctgaccaacgccgaggctgccgaagtgatcgcccaggaccgcgagagttcgcagcgcgacttgtacgagagcatcgagaaaggcgacttcccgcgctggaagatgtacgtgcagatcatgcccgagaaggaagcggccacctatcgctacaacccgttcgacctgaccaaggtctggccccacggcgactacccgttgatcgaagtgggcttcttcgagctgaaccgtaacccggacaactacttcgccgaggtcgagcaggccgctttcacgccggccaacgtggtgcccggtatcggtttctcgccggacaagatgctccagggccgtctgttctcctacggcgacgcccatcgctatcgcctgggcgtcaaccaccaccagatcccggtgaacgccgcgcgttgcccgcaccaggtctaccaccgcgacggcggcatgcgggtggacggcaacaacgcccatcagcgcgtcacctacgagccgaacagcttcaaccagtggcaggagcagcctgacttctccgagccgccgctgagcctggagggcgcggcggaccactggaaccaccgggtggacgacgactactacagccagcccgccgcgctgttccatctgttcaccgacgagcagaagcagcggctgttcgccaacatcgccgaagacatccgcgatgtaccggaacagatccagcgtcgccagatcggcctgttcctcaaggtcgacccggcctacggcaaaggcgtcgccgacgccctcggcctgaagctggactga

SEQ ID NO: 4757 - DNA, 3456 bp, Pseudomonas aeruginosa
attcctagttttctccagggagagccccccgatgcaaggccatccggaagtcatcgattacctcaacacgctgctgaccggcgagctggccgcgcgcgaccagtacttcatccactcgcgcatgtacgaggactggggcttcagcaagctctacgagcgcctcaaccacgagatggaggaggagacccagcacgccgacgccctgctgcgccgtatcctcctgctcgaaggtacgccgcgcatgcgtcccgacgatatccacccgggcaccacggtgccggagatgctcgaggccgacctcaagctcgagcgccatgtccgcgccgcgctggccaagggcatcgccctctgcgagcagcacaaggacttcgtcagccgcgacatcctcaaggcccagttggccgacaccgaggaagaccacgcctactggttggagcaacagcttggcctgatcgcgaggatgggcctggagaactacctgcaatcgcagatctgaccctaccccgcggatacgaaaaagcccctgcgcctcacggtcgcaggggctttttcatgagcgcccggcaatcaggcgcgatcgcgttccagcaacggcttgaggaagtggccggtgtgcgactggggcatctcggccacctgctccggcgtaccgttggcgatgatctggccacccttggagccgccctcggggccgaggtcgaccagccagtcggcggtcttgatcacgtccaggttgtgctcgatcaccaccacggtgttgccgtggtcgcgcaggcggtggagcacgtcgagcagttgctggatgtcggcgaaatgcaggccggtggtcggttcgtcgaggatgtacagggtcttgccggtatcgcgcttggacagctcgcgggacagcttgacccgttgcgcctcgccgcccgagagggtggtcgcgctctggcccagcttgatgtaggacaggccgacgtccatcagcgtctgcagcttgcgcgccagggcggggactgcgtcgaagaactcgcgggcttcctcgatggtcatctccagcacctcgtggatgctcttgcccttgtagcggatctccagggtctcgcggttgtagcgcttgcccttgcagacatcgcagggaacgtagatgtccggcaggaagtgcatctccaccttgatcacgccgtcgccctggcaggcctcgcaacggccgcccttgacgttgaacgagaagcggccgggaccgtagccgcgcgagcgggcctccggcacgccggagaacagttcgcggatcggcgtgaacaggccggtataggtcgccgggttggagcgcggggtacgaccgatcgggctctggtcgatgtcgaccaccttgtccaggtgctgcaggccgtcgaacgagtcatacggcgccacttccagggtagtcgcgccgttcagcgcggtggcggtgatcgggaacagggtgttgttgatcagcgtcgacttgccggagcccgagaccccggtgatgcaggtgaacaggccgaccgggatttccaggttgacgttctgcaggttgttgccgcgggcgcctttcagcttcagcagcttcttcttgtcgcgcggggtgcgcttggccggaaccgcgattttcttgcgcccggaaaggtacttgccggtcagcgagtcggggtggttcatcacctggtcgggcgtaccttccgccactacctggccgccgtgcacgccggcgcccggaccgatgtcgacgacgtagtcggcgagtcggatcgcgtcctcgtcgtgctcgaccacgatcaccgtgttgccgaggttgcgcaggtgggtgagggtgccgagcaggcgctcgttgtcgcgttggtgcaggccgatcgagggttcgtcgaggatgtacatcactcccaccaggccggcgccgatctggctggccaggcggatgcgctgggcttcgccgccggacagggtgtcggcgctgcggtcgagggtcaggtagtcgaggccgacgttgaccaggaattgcaggcggtcgcggatttccttgaggatcttcgccgcgatctcgccacggcggccggtcaggctgagtccggcggcatactcgcaggcttcgccgaccggcatcgcggtgatcgccggcagcgtccggtcgccgacccacacatgccgcgcctcgcggcgcaggcgggtaccgtggcaatccgggcagggctgggtgctgaggaacttggccagctcctcgcggaccgtggccgactcggtctcgcggtagcgccgctccaggttcggcaggatgccttcgaagggatgcgaacgcttgacgatgtcgccgcggtcgttgagatagcggaagtcgacgttttcccggccggagccgtagagcaccaccttctggtgctcggcgccgagttcgtcgaagggttcttccaggctgaagccgtaatgctgggccagcgaaccgagcatctggaagtaatagacgttgcgccggtcccagccgcggatcgcgccctcggccagggtcaactcgccgttgaccacccggcgcgcgtcgaagaattgcttcacgccgaggccgtcgcaggtcggacaggcgccggccgggttgttgaaggagaacagcttgggttccagctcgctgatagagtggccgcagaccgggcaggcgaagcgcgccgagaagatgatctcctcgacatcctcgtcctcgtccatcggtgctaccagggcgataccgtcggccagggacagggcggtctcgaacgactcggccaggcgttgctggaggtccgcgcgaaccttgaagcggtccaccaccacatcgatgctgtgcttcttctgcttatccagtttcggcacttcgtcgagttcgtagagcttgccgtcgacccgggcgcggacgaagccatgcgcgcgcatctcgtcgaacaccgccaggtgctcgcccttgcgctcgcggatcaccggcgccagcagcatcagcttgctgccttccggcagggccaggacctggtcgaccatctggctgacggtctgcgcctccagcgggatgtcgtggtccgggcagcgcggggtaccgacgcgggcataaagcaggcgcaggtagtcgtagatctcggtgatcgtacccacggtggagcgtgggttgtgggaagtggacttctgttcgatggaaatcgccggcgacagcccttcgatggtgtccacgtccggcttctccatcatcgacaggaactgccgggcgtaggccgagagggattccacgtagcgccgctggccttccgcatagagcgtgtcgaaagccagggaagacttgccggaaccggaaagaccggtgatcacgatcagtttgtcgcgtggcagtgtgaggtcgacgttcttcaggttgtgggtacgcgccccacgaatcaggatcttatccacagcggcctcgcatggcgggcgaaaaccgctgattatacggctggccgctag

SEQ ID NO: 4758 - DNA, 1551 bp, Pseudomonas aeruginosa
cgcgcggcaaagtggcgcgcctgtgccgcgagggggcggactggtagaatgcgcggcatttttccggcgcgggcattgccccggccgcccaggagcgggcggcggcgccatcggcaggggcatgaggccttgccctgcagcggtttcttccatgagggtgttatgcacgactcacatactgagcggatgagcggtaccgaaacgcgagcggccgtcgggctgtcactggtattcgccttccgcatgctcggcatgttcatggtcctgccggtgctggccacctacggccaggacctggccggcgcgaccccggcgctgatcggcctggccatcggcgcctatggcctgacccaggcgatcctgcagattcccttcgggaccatttccgaccgcatcggccggcgcccggtgatcgtcgtcgggctgctgatcttcgccgccggcgcggccctcgcggccaatgccgactccatctggggggtgatcgccggccgcgtcctgcagggcgccggggcgatctcggcggcggtgatggcgctgctctccgacctcacccgcgagcagcaccggaccaaggcgatggcgatgatcggcatgagcatcggcgtctccttcgccgtggccatggtgctcggcccggtgctgacccatctgttcggcctgcatgggctgttctggttcaccgccgggatggcgctggtcggcctgctgctgatcctgttcttcgtcccgcagccggaccacatgacccagcaccgcgaatccagcgtggcgcgccaggccctgctgccgaccctgaagcacggcgacctgctgcgcctggacgccggcatcctgatcctccacgccatcctcatggccagcttcgtcgccttgccgctggcactggtgcacgaggggggcctgcccaaggagcagcactggtgggtctacctgaccgcgctgctggtcggtttcttcggcatggtgccgttcatcatctacgccgagaagaagcgtcgcatgaagcgcgtgctgaccggcgcggtggcgaccctgctggcctgcgaactgttcttcctggtcttcggtcacagcctggccatgctggtggtcggcacggtggtgttcttcactgccttcaacctgctcgaagcctcgctgccgtcgctggtcagcaaggtctcgccggccggcggcaagggcacggcgatgggggtgtattccaccagccagttcctcggcgcggcgctgggcggcatcctcggcggctggatgttccagcacggcgggctgagcatggtgttcatcggatgcgcggtgctcgctgccctctggctggcgattgctgttaccatgcgcgaaccgccttatgtgaccagcattcgcctgccgctcgcgcccgccgcgctgcaggacgcggtgctggtccagcgattcagggcgttgcccggtgtggcagacgccgtggtggtggccgaggaggccgccgcctatgtcaaagtggatacccaacaagtggatcgcaccgccctcgagcgcctggcccaggccgcgccgggcggatgctga

SEQ ID NO: 4759 - DNA, 591 bp, Pseudomonas aeruginosa
cccggaaacccggtacatgcccaacggcaatgtggtgaccaacatcaccctcgccaccagcgagagctggaaggacaagcagaccggccagcaacaggagcgtaccgtatggcaccgcgtggtgttattcggcccgcctggcggagatcgccggcgagtacttgcgcaagggttcccaggtgtacgtcgaaggcagcctgcgcacccgcaagtggcagggccaggacggtcaggatcgctacaccaccgagatcgtggtcgacatcaacggcaacatgcagttgctcggcggccgcccttccggcgacgattcgcagcgcgccccgcgcgagcccatgcagcgcccgcagcaggccccgcagcagcagtcgcgtccggccccgcagcagcaaccggcgccgcaaccggcccaggaatacgacagcttcgacgacgacattccgttctaagcgacgcccttgcggcgcggcccgtccgcgccacgggcagaccttcgaagaccccctgccgccctcgggccgcagggggtcttcgttttcaggcgacgccgcgctgcaagggcacttcgtccaggccgcctatggcggatag

SEQ ID NO: 4760 - DNA, 861 bp, Pseudomonas aeruginosa
agcttcccgcatggcactgagcttaaggcaggtttcgcgatactcgtgggccggttccgaatcgcctaccagaccgcagccggcgaacaggtagccccggcccggcgtgagcagggccgagcgcagcgccaccaggaaatcgccgttgccttcgccgtcgagccagcccagcggcgcggcgtaccagccacggtccatcccttcgtgctggcggatgtagtccagcgccgcgctgcgtgggtagccgcccaccgcgggggtcggatgcagcgcctgcagcagccgcaggatgccgcctgcgtcggcgaggcgggcgcggatcggcgtgttcaggtgctggactcgcgccagtcgtttcaggccgggcgcatcggggatttccagcacctcgctgaagggttccagggccgtacggatcgcctccaccaccaactggtgttcgtgcctgtccttggcgctgtccagcagggcctgtccgagccgcgcatcttcctgggcatcgccgccgcgggcgatggtcccggccagggcatgggtgagtgcctcgccggcgcgaatgcggaccaggcgttccggggaggcgccgaggaagcaggcgttgccgcggcgacaggcgaacagctgggcgtcggcatgttgcagacgcaggtgttcgatgacctgccacggctcgatgtcgccgagaggccgggcctgggtgcgggccagcacgaccttgccgaagcgtccctggcggacactgcttaccgcgtcgctcaccttggcttcccattgcctgcgctcctgcgccgaagcgtcgccctgcgcgccagcggtcggccccgagggccggcgtctggccggctgcctcaggcgcagtag

SEQ ID NO: 4761 - DNA, 420 bp, Pseudomonas aeruginosa
cttcctcgtcgtgctcgccgaggaggacgtcgagggcgcaggccagggcgatgggctgcgcccgtcggtaggtctcgatcgcctggtagtcggcgcgcaggatcggcaggaacagcgcgcgcaggtcggcgtcctcgagtagctcgctggcgccaccctggcggcggacgtcctccagcagcgccgcctcgtcgccgcggtgcaacgcgccgccgcgttgccggtgcggtgccggatgggcggagacgaacaggtggcgcagcggcgcgccggcgctttccaggcgcagggcggtttcgtaggccagcgccgcgccgagactgtggccgaacagcgccaggggcgcgtcggcgaaatcgcgcagggcgagggcggcgccgtcggcgaggtcctccaagcgggtggccggcgcctcgttga

SEQ ID NO: 4762 - DNA, 891 bp, Pseudomonas aeruginosa
agcggtcctcgcgacccgggtactgcagggcaagcaggtcgatgtctggcggcaggcgttcgctccagctacggaagaagctggcgctgccgcctgcatgggggaagcaggccaggcgcaggcgcggcatcggcgtcaggcggaacggccggacccaggcggcgctcatgcgcgggcctccagctcgcggcgcaggcgctcgcgcaggtccttcttgctgatcttgccgatgccggtctgggggaaggccgggaccagctcgatgcggtccggcaccttgaacgcggccagcccgcaggcgtgcaggtattgcttcagcttcagcgccgagggcgccggctggcgcgggatgacgaaggcgcaggtgcgctcgccgagcaggctgtcgggcatcgccacgacggtggcgtcgtgcacctgcggatgggctatcagcaggttctccacctcttccgcggcgatcttctcgccgccgcggttgatctggtccttgtcgcggccctccaccaccaggtagccgtccttgtcgcggctgacccggtcgccggtgcggtagaagccgtccgcgctgaaggccttggcgttgtgttcgggcaggcggtagtagccgcggatggtgtagggaccgcgcacggtcagttcgccgacctcgccggggccgacctcgcggccctcggcgtcgaccacccgcacttcgtcgtccggcgacagcggccggccctgggtatgcagcacgcgttcgggcggatcgtccaggcgggtgtagcagatcagcccctcggccattcccagcacctgttgcaactggcagccgagcaccggttcgacgcgttgcgcggcactgctgccgagcctggagccgccgacctggagcagacgcaggctggatag

SEQ ID NO: 4763 - DNA, 2094 bp, Pseudomonas aeruginosa
atcggcgcggcggctttcctgggcatccagccagagcatcgccagcggcggtaccagggcggtgtgggtgacccgttcacgggcgatcagggcgaagcaatgctcgggatcggcgcgctggctgaccaccacgcggccgccggccagcagcgtgccgatcactccggggcagcagagagtgaagttgtgcgccatcggcaagccggtgaggtacaccgtgtgctcgtcgaagccgcagacctcggcgctggcgcggacgttgtagagatactcgcgatgacgccggggaatcagcttcggcgtgccggtggtgccgccggacaactggaagcaggcgatatcctcggcgcgggcggcgcagtcttccagcgcgtcggcctggtacagcggtgccagcgcttgcagcggcgcctcggcctcgccgtggatcagcgccatccggcaggcgccgctggcgagcagctcacgggccatcggccgtgggtcgaagccgtcgatccgttcggcgccgatgtaggccttggcctcggcgaagcggcagaaaccgctgatctcatgctggcgatgggcggggagggcgagcaccgggcgtacgccgagctggaacagggcgaagcaggtctcgacgaaggcgatgccgttgggcaggtgcagcactaccgtgtcgccatgtgcgaggccggcctggcgcagtccggctgccaggcggcggcagcgctggagcaggtcggcatagctgagccgctggtcgtcgtcgcagagcgcgatccgccgcggatggcgcgcggcgctggcggccagggcttcggcgaagttctggtcctgccagtggccggcgtcgagatagcggcggacgaaggcggcgggccagtcgggggcgtcgtcgacggccgatggggtgacgggcgaggaagtcatgcgatctccgtggatgcggtcgattgccattgctgggaaatgagatttattatcattggcgggcggcagggaccgcgcaagcccgcgcctttcgattgcggggctttttcattcgctgcaggggcggagtgcagggcgctttgtccatctccgctaaaaagtccccctgcccccacgtatccaggaaggcgtcgccgcgtcggcagcgcccgggctacaggaaaacctgatgaccatcaccatcattgctccgccacaggccgatgccgccgcgccggcaccgggcaaccggcccggcgtcgcgcacatcgatccgaacatgaagctggtgaccggaaccttctgttcggccagcgaggactggttcgaggaaccgctggagcgcggcctgcgcctgatcctcgtgcagagcggccagttgcgctgccggattcccggccagcccgagcacctcatcgaggggccgagcctgtgcaccatcgccaacgatggcgacttcacctcggcgcagatctacggcaccgacaagccgttgcgctacactatcgtccagctcggcgtcgaagccctggacagccgcctcggctggctgcccgagcaactgatacgccgccccggcggcgatccgcggatcatgagctgcccggcgccgcgggcgatgcaggcgttggcctcgcagatcgccacctgccagatgctcggtccgacccgcgatctctacctcggcggcaaggccctggagttggccgcgctcagcgcacagttcctttccggcgaggggcgccccgtcgaggagccgcgcatcacctgctcggaggtcgagcgcatccacgccgcccgcgacctgctggtcggcgccttgcaggagccgccgtcgctggacacgctggccagccgcgtgggcatgaacccgcgcaagctgaccgccggctttcgcaaggtgttcggcgccagcgtattcggctacctgcaggaataccgcctgcgcgaggcgcaccggatgctctgcgacgaagaggcgaacgtctccacggtggcctaccgggtgggctacagcccggcgcatttctccatcgctttccgcaagcgctacggcatctcccccagcgagatccgctgagtctccgcgacgacccccgacccggccacgggaggggtgtcgccgctgcgggatga

SEQ ID NO: 4764 - DNA, 2844 bp, Pseudomonas aeruginosa
agagcttccagcgcaacctccacggagccatcgaccacgccgcattccccgccctggaggtgctccgcgaggcgcgccggcaggggccagccacgctcggcgccggtggtgttcgccagcaacctgggcgaggagggcttcgtcccggcggccttccgcgacgctttcggcgatctccacgacatgctctcgcagaccccgcaggtctggctcgaccaccagctctaccgggtgggcgacggtatcctgctggcctgggacagcgtcgtcggcctgttccccgaaggcctgccggaaaccatgttcgaagcctacgtggggctgctccagcgtctctgcgacagcgcctgggagcagcccgccgatctgccgttgccctgggcgcagcaggcgcgccgggccctgctcaacggccagccggcatgcgccacggcgcgcaccctgcatcgcgacttcttccttcgcgccgccgaggcgccggatgccgacgcgctgctctatcgcgaccaacgtgtcacccgcggcgaactggccgagcgtgcgctgcgcatcgccggcggcctgcgcgaagccggggtgcgccctggcgacgcggtcgaggtcagcctgccgcgcggaccgcagcaggtcgcggcggtattcggcgtgctcgccgcaggcgcctgctacgtgccgctggacatcgaccagccgcccgcacggcggcgcctgatcgaagaggccgccggggtatgcctggcgatcaccgaggaggacgatccgcaggccttgccgccgcgcctggatgtccagcgcctgctgcgcggcccggcgctggccgcccccgtgccgctggcgccgcaggcgagtgcctatgtgatctacacctcgggctccaccggggtgcccaagggcgtcgaggtcagccacgcggcggcgatcaataccatcgacgcgctgctcgacctgctgcgggtgaacgcatcggatcgcttgctggcggtctccgcgctggacttcgatctgtcggtcttcgacctgttcggcggcctcggcgccggtgccagcctggtcctgccggcccaggaacaggcgcgcgatgccgctgcctgggcggaggctatccagcggcatgcggtgagcctgtggaactcggcgccggccttgctggagatggccctcagcctgccggcgagccaggccgactatcgcagtctgcgggcggtgctgctgtccggcgactgggtggccctggacctgcccggccgcctgcgcccacgttgtgccgaaggctgccgcctgcatgtgctgggtggcgctaccgaagcgggcatctggtcgaacctgcagagcgtcgatacggtgccgccgcactggcgttcgattccctacggccggccattgccgggacaggcctaccgggtggtcgacacccacgggcgcgacgtgccggacctggtggtcggcgagctgtggatcggcggcgccagcctggcccgcggctatcgcaacgatcccgaactcagcgcccggcgcttcgtccacgatgcccagggccgctggtatcgcaccggcgatcgcggtcgctactggggcgacggtaccctggaattcctcggtcgggtcgaccagcaggtgaaagtgcgcggccagcgcatcgagttgggcgaggtggaggccgcgctgtgcgcccaggctggcgtggatagcgcctgcgcggcggtgctcggcggtggcgtggcgagcctcggcgcggtgctggtaccgcgcctggcgccacgggccgaaggctccatggaactaccggccgcacagcccttcgccggcctggcagaggccgaggcggtactcacccgggaaatcctcggcgcgctgctggaggcgccgctggagctagacgacggtttgcgccggcgctggctggactggctagcggactccgccgccagcgcgctgccgtcgctcgacgaggcgttgcgccggctcggctggcaggccgcggggctgaccgcgatgggcaacgctctgcgcggcctgctcgccggcgaacaggcgccggccgcgctgctcctcgatccctggctggcgccgcaggcggtggccgcgcgcctgccggacggccgcgaggcccctggcgcgcctgctcgaagcgctgccgacgccggctgccggcgaacgcctgcgggtggcggtgctggatacccgcgccgggctctggctcgaccagggcatggcctcgctgttgcgcccggggctggaactgaccctcttcgaacgcagccgcgtcctcatcgacgccgccgccacccgcttgccggaacggatcgtggtgcaggcgctggacgacggcctgctacatgccgagcacctcggtcgctacgaccgggtgatcagcttcgccgcgctgcacgcctacgaggccagccgcgaaggcctggcgctggcggcggcgctgctgcgcccgcagggccgcctgttgctggtggacctgctatgcgagtcgccactggcgctgctcggtgcggccttgctcgacgaccggccgctgcgcctggcggagttgccgagcctgttggccgatctcgccgctgcgggactggcgccgcgttgcctgtggcgcagcgaacggctcgccctggtcgaggcgctggcgccgggactcgggctcgacgccgccgcgctccaggccggcctggagcaacgcctgccccaggcgatgcggcccgaacgcctgtggtgcctgccaagcctgccgttgaacggcaatggcaaggtcgatcgtcgccgcctggccgagagcatgacccgcgcactcggcgagtgtcgtcacgagccctcggcggaggagccgctggaagcccatga

SEQ ID NO: 4765 - DNA, 4563 bp, Pseudomonas aeruginosa
gcgtttcggcgtacgcctgggcatggccgacttctatcgccagccgaccctggccggtcttgcccgccacttgcaggcgcagaccgtcgaaatcgaggaaacccaactggaagagggcgtgctatgagcctcggcgaactgctggaaacctgccgcagccggcgcatcgaactctggagcgaggcgggccgcctgcgctatcgcgccccccagggcgccctcgacgccggcctcgccgagcgcctgcgggccgagcgcgaggccctgctggaacacctggaaggcggccctggctggcgcgccgaacccgacctggcccaccagcgcttcccattgaccccggtgcaggccgcctacgtgctgggccgccaggcggccttcgactacggcggtaacgcctgccagctgtacgccgagtacgactggccggtcgacaccgatccggcgcgcctggaggcggcctggaacgccatggtcgagcgccacccgatgctgcgcgcggtgatcgaggacaacgcctggcagcgcgtgctgcccgaggtgccctggcagcggctgaccgtgcatgcctgcgcggggctcgacgaggccgctttccaggcgcacctggagcgggtccgcgaacgcctcgaccacgcctgcgcggcgctcgaccagtggccggtcctgcgccccgagctgagtatcggccgggatgcctgcgtactgcactgctcggtggatttcaccctggtcgactacgccagcctgcaattgctgcttggcgaatggcgccgccgctatctcgatccgcaatggacggcggaaccgctggaggcgaccttccgcgactatgtcggcgtcgagcagcgccgacgccagtcgccagcctggcagcgcgaccgcgactggtggctggcgcgtctcgacgcgctaccggggcgtcccgacctgccgctgcgggtgcagccggacacccggtccacgcgcttccggcacttccacgcgcgcctcgacgaggccgcctggcaggcgctcggcgcgcgcgccggcgaacacggcctgagcgctgccggcgtggccttggcggccttcgccgagaccatcggtcgctggagccaggcaccggcgttctgtctcaacctgacggtactcaaccggccgccgctgcatccgcagctggcgcaggtgctcggtgacttcaccgcgctcagcctgctggcagtggacagccgccacggcgacagtttcgtcgagcgtgcccgacgcatcggcgagcagatgttcgacgacctcgaccacccgaccttcagcggcgtcgacctgctgcgcgaactggcgcgccggcgcggtcgcggcgccgacctgatgccggtggtgttcaccagtggcatcggcagcgtgcagcgcctgctcggcgatggcgaggcgccgcgcgcgccacgctacatgatcagccagaccccgcaggtctggctggactgccaggtcaccgaccagttcggcggcctggagatcggctgggacgtacgcctcgggttgttccccgagggccaggcggaagccatgttcgacgacttcgtcgggctgctccggcgcctggcgcagagcccgcgcgcctggaccgacggcgatgccacggaacccgtcgaggcgccgccgcaggcgttgcccggtagtgcccggagcatcgccgccggtttcgccgagcgtgccctgctgacccccgacgccacggcgatccacgatgccgccggcagctacagctaccgccaggtcgcccagcacgccaccgccctgcgccgcgtcctggaagcgcacggcgcgggccgtggccggcgggtcgcggtgatgctgccgaaaagcgccgcgcaattggtcgcggtgatcggcatcctccaggccggcgccgcctatgtgccggtggacatccgccagcctccgctgcggcgccaggcgatcctcgccagcgccgaagtggtcgcgctggtctgcctggaaagcgatgtcccggacgtcggctgcgcctgcgtggccatcgaccggctggccgccgacagcgcctggccgccaccgcccgcggcggaggtggcggcggacgacctcgcctacgtgatctacacctccggctccaccggcacgccaaagggcgtgatgctcagccatgcggcggtgagcaacacgctgctcgacatcaaccagcgctacggcgtcgacgccaacgaccgcgtcctcggcctcgccgagctgagcttcgacctctcggtctacgacttcttcggcgccaccgcggcgggggcccaggtggtcctcccggacccggcgcgcggcagcgatccatcgcactgggcggaactgctggaacgccacgccatcaccctgtggaactcggtgccggcccaaggccagatgctcatcgattacctggagagcgagccgcaacgtcacctgccgggaccgcgctgcgtgctctggtccggtgactggattccggtcagcctgccgacccgatggtggcggcgctggccggacagcgcgctgttcagcctgggcggcgccaccgaggcggcgatctggtcgatcgagcagccgatccgcccgcagcacaccgagctggccagcatcccttatggccgtgccctgcgcgggcagagcgtggaagtcctggatgcccgcgggcggcgctgcccgccgggcgtgcgcggcgagatccatatcggcggggtgggcctggcgctcggctacgccggcgatccgcagcgcaccgccgaacgcttcgtccgtcaccccgatggccgtcgcctgtatcgcaccggcgacctcggccgctatctggccgacggcagcatcgagttcctcggccgcgaggacgaccaggtgaagattcgcggccaccgcatcgaactggccgagctggacgccgcgctgtgcgctcatccgcaggtcaatctggcggccaccgtggtgctcggcgagacccacgagcgcagcctggccagcttcgtcaccctgcatgcgccggcggaggctggcgaggatccgcgtacggcgctcgacgcggtgcgccagcgggcggcccaggccttgcgccgcgactggggcagcgaggagggcatcgccgcggcggtggccgcactcgaccgtgcctgcctcgcctcgctggccgcctggctggccggcagcggtctgttcgccagtgcgacgccgctggacttcgccaccctgtgccagcgcctgggtatcgccgaggcgcgccagcgcctgctgcgccactggttgcgccagctggaggagggcggctacctgcgcgccgagggcgagggctggctgggctgcgccgagcgtcccgcgcagagtccggaggacgcctggacggcgttcgccggctgcgcgccggcggcgctctggccggccgagctggtcgcctacctgcgtgacagcgcgcaatccctcggcgagcaactggccgggcggatcagcccggcggcgctgatgttcccgcagggctcggcgcgcatcgccgaggccatgtacagccagggcctgcatgcccaggcgctgcacgaggccatggccgaggccatcgccgccatcgtcgagcgccagccgcaacggcgctggcgcctgctggagcttggcgccggcaccgccgccgccagccgcacggtgatcgcccggttggcgccgctggtgcagcgaggggcggaggtggactacctgttcaccgacgtttccagctacttcctcgccgccgcccgcgagcgattcgccgaccagccgtgggtacgcttcggccgcttagacatgaacggcgatattctcgaccagggcgtggcaccgcactcggtggatatcatgatcagctccggggcattgaacaacgcgctggacaccccggcgctgctggccggcctgcgcgagttgctgagcgccgacgcctggctggtgatccaggaactgacgcgcgagcacaacgagatcagcgtcagccagagcctgatgatggagaacccgcgcgacttccgcgacgagcgccgccaactgttcgtccacaccgggcaatggctggagtggctggcggcacagggtggcgacctggcttgtggggtggtgccgccgggcagcgctctcgacctgcttggctacgatgtcctgctggctcgctgcaagaccgaccgcgcccgcctggagccggccgagctgctggccttcgtcgaagcgcgggtgccgcgctacatgctcccggcgcagttgcgcgtgctcgaacgcctgccggtcaccggcaacggcaagatcgaccgcaaggccctgaccggctttgcccgccagccccaggcggaccttcggcatggcgtcgcgcaggcaccggccgacgaactggagaatgcgctgctggcactctggcgggaggtgctggacaacccgttgctgggcgtcgagcaagacttcttcggggctggcggcgactcgctgttgatcgcccagttgatcgcccgtttgcgcgaacgactggaaagcgcccgtcggcatccgttcgatcgcctgatacgctgggcgatcagccaccagacgcagcgcccctag

SEQ ID NO: 4766 - DNA, 762 bp, Pseudomonas aeruginosa
tttgaggttgcgtcaatgattcttgagctcgactgtggaaactcgctgatcaagtggcgggtcatcgagggcgcgtcacggtcggtcgccggtggccttgcggagtccgatgatgccctggtcgaacagttaacatcgcagcaagcgttgccagtgcgagcctgtcgcctggtgagcgttcgcagcgagcaggaaacctcgcaactggtcgcacggttggagcagctgttcccggtttcggcgctggttgcatcatccggcaagcagttggcgggagtgcgcaacggctatctcgactaccagcgcctggggctcgaccgctggttggccctcgtcgcggctcatcacctggctaagaaggcctgcctggtcattgatctggggaccgcggtcacctctgacctggtcgcggcggatggagtgcatctggggggctacatatgcccgggcatgaccctgatgagaagccagttgcgcacccatacccgacgtatccgctacgacgatgcagaggcccggcgggcgcttgccagtctccagccagggcaggccacggccgaggcggttgagcggggttgtctgctcatgctcagggggttcgttcgtgagcagtacgccatggcgtgcgagctgctcggtccggattgtgaaatattcctgacgggtggggatgccgaactggttcgcgacgaactggctggcgcccggatcatgccggacctggttttcgtagggctggcactggcttgcccgattgagtga

SEQ ID NO: 4767 - DNA, 1230 bp, Pseudomonas aeruginosa
cgtgatccgctcaattccttgaaggggatggtctccatggctaaagaaaaatttgaacggaacaagccgcacgtcaacgtcggcaccatcggtcacgttgaccatggcaagaccactctgaccgctgcactgaccaaggtctgctccgacacctggggtggttccgctcgtgctttcgatcagatcgacaacgcgccggaagaaaaggcccgcggtatcacgatcaacacctcgcacgttgaatacgattccgctgttcgtcactacgcccacgttgactgccccggtcacgccgactatgtgaagaacatgatcaccggtgctgctcagatggacggcgcgatcctggtttgctcggctgccgacggccccatgccgcagacccgcgagcacatcctgctgtcccgccaggtgggcgttccctacatcgtcgtgttcctgaacaaggccgacatggtcgacgacgccgagctgctggaactggtcgagatggaagttcgcgatctgctgaatacctacgacttcccgggcgacgacactccgatcatcatcggttccgcgctgatggcgctggaaggcaaggatgacaatggcatcggcgtaagcgccgtgcagaagctggtagagaccctggactcctacattccggagccggttcgtgccatcgaccagccgttcctgatgccgatcgaagacgtgttctcgatctccggccgcggtaccgtggtaaccggtcgtgtagagcgcggcatcatcaaggtccaggaagaagtggaaatcgtcggcatcaaggcgaccaccaagaccacctgcaccggcgttgaaatgttccgcaagctgctcgacgaaggtcgtgctggtgagaacgttggtatcctgctgcgtggcaccaagcgtgaagacgtagagcgtggccaggttctggccaagccgggcaccatcaagccgcacaccaagttcgagtgcgaagtgtacgtgctgtccaaggaagaaggtggtcgtcacaccccgttcttcaagggctaccgtccgcagttctacttccgtaccactgacgtgaccggtaactgcgagctgccggaaggcgtagagatggtaatgccgggcgacaacatcaagatggttgtcaccctgatcgctccgatcgccatggaagatggcctgcgcttcgcgatccgcgaaggcggccgtaccgttggtgctggcgtggttgccaagatcatcgaataa

SEQ ID NO: 4768 - DNA, 765 bp, Pseudomonas aeruginosa
tctggacgctgctgtacgtaccatcgctggctccgcgcgcagcatgggcctgaacgtggagggtgtgtaatggctaagctgaccaagcgccagaaggcgattgccgagaaagtagttgccggcaagcagtacagcttcgaagaggccgccaagctgctggccgagctgtccaccatcaagttcaaggagtccgtggacgttgccgtgaacctcggcgtcgatccgcgtaaatccgaccaggtcgttcgtggcgccaccgtcctgccgaacggcaccggcaagagcgtccgcgttgccgtcttcacccagggtccggctgccgaagccgctctggctgccggcgccgacaaggtgggcatggacgaactggctgccgaaatgaaaggcggcgacctgaactacgacgtcgtcatcgcttccccggatgccatgcgtgtcgtcggccagctgggccagatcctcggcccgcgtggtctgatgccgaacccgaaagtcggcaccgtgactccggacgtcgctaccgccgtgaagaatgccaaggctggtcaggtacgtttccgtaccgacaagaacggcatcatccacagctccgtcggtaaggtcgatttcgagccggccaagctgcagcagaacgttgaagcgctgctggctgacctgaagcgcctgaagccgtcctcgtcgaaaggcgtgtacgtcaagcgcgtgaccctgagcaccaccatgggtccgggcctgcagatcgacctggcttccctggaagcctaa

SEQ ID NO: 4769 - DNA, 606 bp, Pseudomonas aeruginosa
accacaagcctacgcagatggtgctcccgattcggttaccgaatcagacaccaaaacgacgtccggccccggctggacgaaacggtaacatccaggagtaaacccgtggcaattaaactcgaagacaagaaggccatcgtcgctgaagtcaacgaggctgccaaagctgccctgtccgctgtcgtggccgatgcccgtggcgtgaccgtaggcgccatgaccggactccgtaaagaggcccgcgaagctggtgtgtacgtgaaagtcgtacgtaacaccctgctcaagcgcgccgttgaaggcacccagttcgacgtgctcaacgacgtgttcaaaggcccgaccctgatcgctttctccaacgaacatccgggcgctgccgctcgtatcttccgtgagttcgccaagggtcaggacaagttcgagatcaaggcggctgccttcgagggtcagttcctcgcagccaatcagatcgacgtactggcaagcctgccgacctacgacgaagccgtatcgcagctgatgagcgtgattcagggcgctaccagcaagctggctcgtactctggcggccattcgcgaccagaaagaagctgctgccgcctaa

SEQ ID NO: 4770 - DNA, 411 bp, Pseudomonas aeruginosa
tacgatggccgcaggccgtcccccaatacaggaattagagtcatggctctgaccaacgaagacatcatcaacgccgtatccgaaatgtccgtcatgcaagtggtcgaactgatcaaggcgatggaagagaagttcggcgttaccgctgctgccgctaccgttgccgctgctggcccggctgctgccgctgccgaagagcagaccgagttcaccatcgtcctggccgaagctggcgacaagaaagtgaacgtgatcaaggtcgttcgcgaactgaccggtctgggtctgaaagaagccaaggccgtcgtagacggcgctccgggcgtggtgaaggaaggcgcttcgaaagaagaagccgaagccgccaagaaagccctggaagaagcaggcgccaaagtcgagctcaagtaa

SEQ ID NO: 4771 - DNA, 4092 bp, Pseudomonas aeruginosa
ccaagctggggaacgctgatggcttactcatacactgagaaaaaacgtatccgcaaggactttagcaagttgccggacgtcatggatgtgccgtatttgctggccatccagctggattcctatcgcgaattcctgcaggctggcgcaaccaaggagcagttccgcgatatcggtctgcacgcggccttcaagtccgttttcccgattatcagctattccggcaatgctgccctggaatacgtcggctaccgtctgggtgagccggcattcgatgtcaaggagtgcgtgctgcgcggcgtgaccttcgccgtaccgctgcgcgtgaaagttcgcctgatcatcttcgaccgcgagtcgtcgaacaaggcgatcaaggacatcaaggaacaagaagtctacatgggggaaatccccctgatgaccgagaacggtaccttcatcatcaacggtaccgaacgtgtcatcgtctcccagttgcaccgttccccgggcgtgttcttcgaccacgaccgtggcaagacccacagctccggcaagctgctgtactccgcgcggatcattccttaccgcggttcctggctggacttcgagttcgatccgaaggactgcgtgttcgtccgtatcgaccgtcgccgcaagctgccggcctcggtactgctgcgcgcgctcggctatagcaccgaagagatcctcaacgccttctacgcgaccaacgtcttccacatcaagggcgagaccctgaacctggaactggtcccgcagcgcctgcgcggtgaagtcgcgagcatcgacatcaaggatggcagcggcaaggtgatcgtggagcaggggcgtcgtatcactgcccgccacatcaaccagctggaaaaggctggcgtgagccagctggaagtgccgttcgactacctgatcggccgtaccatcgccaaggcgatcgtgcatccggctaccggcgagatcatcgccgagtgcaacaccgagctgaccctcgacctcctggccaaggtggccaaggcccaggtcgtgcgcatcgagaccctgtacaccaacgacatcgactgcggtccgttcatctccgacaccctgaagatcgacaacaccagcaaccagctggaagccctggtcgagatctaccggatgatgcgtccgggcgagccgccgaccaaggaagctgccgagaccctgttcggcaacctgttcttcagcgccgagcgttacgacctgtcggccgtgggccggatgaagttcaaccgccgtatcggtcgtaccgagatcgaaggtccgggcgtcctgagcaaggaagacatcatcgatgtgctcaagaccctcgtcgacatccgtaacggcaagggcatcgtcgatgacatcgaccacctgggcaaccgtcgcgtccgttgcgtcggcgaaatggccgagaaccagttccgcgtgggcctggtgcgtgtcgagcgcgcggtcaaggaacgcctgtccatggccgaaagcgaaggcctgatgccgcaggacctgatcaacgccaagccggtggctgccgcgatcaaggagttcttcggttcgagccagctgtcgcagttcatggaccagaacaacccgctttccgagatcacccacaagcgccgcgtctccgcgctcggcccgggcggtctgacccgtgagcgtgcgggcttcgaggttcgtgacgtacacccgacccactacggccgcgtgtgcccgatcgaaacccctgaaggtccgaacatcggtctgatcaactccctggcgacctacgcccgcaccaacaagtacggcttcctcgagagcccgtaccgcgtggtcaaggacagcctggtaaccgacgagatcgtgttcctgtcggcgatcgaagaagccgaccacgtcatcgcccaggcttcggcgaccctcaacgagaagggtcaactggtggacgagctggtggccgtgcgtcacctgaacgaattcaccgtgaaggcgccggaagacgtgaccctgatggacgtgtcgccgaagcaggtcgtttccgtcgctgcctcgctgattccgttcctcgagcacgatgacgccaaccgcgcactcatgggctcgaacatgcagcgtcaggccgtgccgaccctgcgtgccgacaagccgctggtgggtaccggcatggagcgcaacgtggcgcgcgactccggcgtctgcgtcgtggctcgccgtggcggtgtgatcgactcggtcgatgccagccgtgtcgtggttcgcgtggcggatgacgaagtcgagaccggcgaagcgggtgtcgacatctacaacctgaccaagtacacccgttccaaccagaacacctgcatcaaccagcgtccgctggtgagcaagggtgacgtggtcgcgcgcggcgacatcctggccgacggtccgtccaccgacatgggcgaactggccctgggccagaacatgcgcgtagcgttcatgccctggaacggcttcaacttcgaagactccatctgcctgtccgagcgcgtggtccaggaagatcgtttcaccacgatccacatccaggaactgacctgcgtcgctcgtgacaccaagctcggcccagaggaaatcaccgcggacatcccgaacgtgggcgaggccgcgctgaacaagctggacgaagccggtatcgtctacgtcggcgccgaagtgcaggccggcgacatcctggtcggcaaggtcactccgaaaggcgagacccagctgactccggaagagaagctgctgcgcgcgatcttcggtgagaaggcgtccgacgtgaaggacacctccctgcgtgtgccgaccggcaccaagggtaccgtcatcgacgttcaggtcttcacccgcgacggcgtcgagcgcgattcccgcgcgctgtccatcgagaagatgcaactcgaccagatccgcaaggacctgaacgaagagttccgcatcgtcgaaggcgcgacctttgagcgtctgcgtgccgccctggtcggtgccaaggctgaaggtggcccggcgctgaagaagggcacggagatcaccgacgactacctcgacggtctcgagcgcggccagtggttcaagctgcgcatggccgacgacgccctgaacgaacagctggagaaggcccaggcctacatcagcgatcgtcgccagctcctggacgacaagttcgaggacaagaagcgtaagctgcagcagggcgacgacctggctccgggcgtgctgaagatcgtcaaggtctacctggcgatcaagcgtcgcatccagccgggcgacaagatggccggccgtcacggtaacaagggtgtggtctcggtgatcatgccggtggaagacatgccgcacgatgccaacggcaccccggtcgacatcgtcctcaacccgctgggcgtaccgtcgcgtatgaacgtcggtcagatcctcgaaacccacctgggcctcgcggccaaggggctgggcgagaagatcaaccgcatgctcgaagagcagcgcaaggtcgccgaactgcgtaagttcctgcacgagatctacaacgagatcggcggtcgcgaggaaaacctcgacgagctgggcgacaacgagatcctcgcgctggccaagaacctgcgcggtggcgtaccgatggcgaccccggtgttcgatggcgccaaggaacgcgagatcaaggccatgctgaagctggccgacctgccggaaagcggccagatgcgtctgttcgacggccgtaccggcaaccagttcgagcgtccgaccaccgtcggctacatgtacatgctcaagctgaaccacctggtggacgacaagatgcacgcccgttccaccggctcgtacagcctggttacccagcagccgctgggtggtaaggcacagttcggtggtcagcgcttcggtgagatggaggtgtgggcgctggaagcctatggcgcggcgtacaccctgcaggaaatgctgacggtcaagtcggacgacgtgaacggccggaccaagatgtacaagaacatcgtggacggcgatcaccgcatggaggccggcatgcccgagtccttcaacgttctgatcaaagagatccgttcgctcggcatcgacatcgaactggaaaccgaataa

SEQ ID NO: 4772 - DNA, 372 bp, Pseudomonas aeruginosa
atggcaactatcaaccagctggtgcgtaagccgcgcaagcgcatggtcgacaagagcgacgtgcctgcgctgcagaactgcccgcaacgtcgtggcgtatgcacccgcgtatacaccaccacgccgaaaaagccgaactcggcactgcgtaaggtatgccgtgtacgtctgaccaacggtttcgaggtttcctcgtacatcggtggtgaaggtcacaacctgcaagagcacagcgtagtgctgatccgtggcggtcgtgtaaaggaccttccgggtgtgcgttaccacaccgtgcgcggttcgctggacacctcgggtgtcaaagaccgtaagcagggtcgttcgaagtacggcgccaagcgtccgaagtaa

SEQ ID NO: 4773 - DNA, 492 bp, Pseudomonas aeruginosa
agaccgtttgagggcttatcaatgccaagacgtcgtgtagcggccaagcgtgaagtgctggctgatccgaaatacggaagccagatcctggccaagttcatgaaccacgtgatggaaagcggcaagaaagccgttgccgagcgtatcgtttacggtgcgctggacaaggtgaaggaacgcggcaaggccgatcccctggaaaccttcgaaaaagctctcgatgccatcgctccgctggtcgaagtgaagtcccgccgcgtaggtggtgcgacttaccaggttccggtcgaagtccgtccgtcccgtcgtaatgccctggccatgcgttggctggtggacttcgcccgcaagcgtggcgagaagtccatggctctgcgcctggctggcgagctgctggatgccgctgaaggcaagggcgcagcagtcaagaagcgtgaagacgtgcaccgtatggcagaggccaacaaggccttctcgcactaccggttctaa

SEQ ID NO: 4774 - DNA, 2151 bp, Pseudomonas aeruginosa
tcgcgctgcccaacccccgaggaccttattgtggcccgtactacacccatcaaccgctaccgtaatatcggtatctgtgcccacgttgacgcgggcaagaccaccaccacggagcgggttctgttctataccggcgtcaaccacaagctgggcgaagtgcatgacggcgctgcgaccaccgactggatggtgcaggagcaggagcgcggtatcaccattacctccgctgccgttaccaccttctggaagggttcgcgcggtcagtacgacaactatcgcgtaaacgtcatcgacactcccggccacgtagacttcaccatcgaggtggagcgttccctgcgtgtactggacggcgctgtcgtggtgttctgtggcacctccggcgtagagccgcagtcggaaaccgtatggcgtcaggccaacaagtacggcgtaccgcgcatcgtctacgtcaacaagatggaccgccagggcgcgaacttcctacgcgtcgtcgagcagatcaagaagcgcctgggtcataccccggttccggtccagctcgccatcggcgctgaagagaacttcgtcggtcaggtcgacctgatcaagatgaaggccatctactggaacgatgacgacaagggcatgacctaccgcgaggaagaaattcctgcggagctcaaggacctggccgaagagtggcgttccagcatggtcgaggctgcggccgaagccaacgaagagctgatgaacaagtacctcgaagagggcgagctctccgaagccgagatcaaggaaggcctgcgtctgcgcaccctggcctgcgagatcgttccggccgtctgcggttcctcgttcaagaacaagggcgttccgctggttctcgatgccgtcatcgactacctcccggctccgaccgagatccctgcgatcaagggcgtcagcccggacgacgagaccgtcgaagacgagcgtcatgccgacgacaacgaaccgttctcgtccctggcgttcaagatcgctaccgacccgttcgtcggtaccctgaccttcgcccgcgtttactccggcgtcctgagttccggcgactccgtcctgaactcggtgaaaggcaagaaagagcgcgtcggtcggatggtgcagatgcacgccaaccagcgtgaagagatcaaggaagtgcgcgcaggcgacatcgctgccctgatcggcatgaaggacgtcaccaccggtgacaccctgtgctcgatcgagaagccgatcatcctcgagcgcatggacttccccgagccggtaatctcggtcgctgtagagccgaagaccaaggctgaccaggagaagatgggtatcgccctcggcaagctggcccaggaagacccgtcgttccgtgtcaagaccgacgaagagtccggtcagaccatcatctccggcatgggcgagctgcacctggacatcatcgtcgaccgcatgaagcgcgagttcggcgtcgaggccaacatcggcaagccgcaggttgcctaccgtgagaccatcaccaaggacaacgtggagatcgaaggcaagttcgttcgccagtccggtggtcgcggtcagttcggtcattgctggatccgtttctcggccgcggacgtggacgagaagggcaatatcaccgaaggcctggtgttcgagaacgaagtcgtgggcggtgtggttccgaaggaatacatcccggcgatccagaagggtatcgaagagcagatgaagaacggcgtcgttgccggctatccgctcatcggcctgaaggctaccgttttcgatggttcctaccatgacgtcgactccaacgagatggcgttcaagatcgctgcttccatggcgaccaagcagttggcccagaagggcggcggcaaggtgctcgagccgatcatgaaggtagaggtagtgactcctgaggactacatgggtgacgtgatgggcgacctgaaccgtcgtcgtggtctgattcaggggatggaggacacggtttccggtaaggttattcgtgccgaggttccgctgggtgagatgttcggttatgcgaccgacgtgcgttccatgtcccagggtcgcgcgagctactccatggaattctccaaatacgccgaagctccgtcgaacatcgtcgaagcgctggttaaaaaacaaggttga

SEQ ID NO: 4775 - DNA, 1224 bp, Pseudomonas aeruginosa
ttcagccctttaagtaagaggtttactgtcgtggctaaggaaaaattcgaacgtaacaaaccgcacgtcaacgtcggcaccatcggtcacgttgaccatggcaagaccactctgaccgctgcactgaccaaggtctgctccgatacctggggtggttccgctcgtgctttcgatcagatcgacaacgcgccggaagaaaaggcccgcggtatcaccatcaacacctcgcacgttgaatacgattccgctgttcgtcactacgcccacgttgactgccccggtcacgccgactacgtgaagaacatgatcaccggtgctgcccagatggacggcgcgatcctggtttgctcggctgccgacggccccatgccgcagacccgcgagcacatcctgctgtcccgccaggtaggcgttccctacatcgtcgtgttcctgaacaaggccgacatggtcgacgacgccgagctgctggaactggtcgagatggaagttcgcgatctgctgaacacctacgacttcccgggcgacgacactccgatcatcatcggttccgcgctgatggcgctggaaggcaaggatgacaacggcatcggcgtaagcgccgtgcagaagctggtagagaccctggactcctacattccggagccggttcgtgccatcgaccagccgttcctgatgccgatcgaagacgtgttctcgatctccggccgcggtaccgtggtaaccggtcgtgtagagcgcggcatcatcaaggtccaggaagaagtggaaatcgtcggcatcaaggcgaccaccaagaccacctgcaccggcgttgaaatgttccgcaagctgctcgacgaaggtcgtgctggtgagaacgttggtatcctgctgcgtggcaccaagcgtgaagacgtagagcgtggccaggtactggccaagccgggcaccatcaagccgcacaccaagttcgagtgcgaagtgtacgtgctgtccaaggaagaaggtggtcgtcacaccccgttcttcaagggctaccgtccgcagttctacttccgtaccaccgacgtgaccggtaactgcgaactgccggaaggcgtagagatggtaatgccgggcgacaacatcaagatggttgtcaccctgatcgctccgatcgccatggaagatggcctgcgcttcgcgatccgcgaaggcggccgtaccgttggcgccggcgtggttgccaagatcatcgagtaa

SEQ ID NO: 4776 - DNA, 318 bp, Pseudomonas aeruginosa
ggtcaaatgcaaaaccaacaaatccggattcggttgaaggcttttgaccatcgcctgatcgatcaatcaacccaggaaatcgtggaaaccgcgaaacgtactggtgctcaggtgcgtggtccaatccctctgccgacccgcaaggaacgtttcaccgtgctgatctctccgcacgtcaacaaagatgcgcgtgatcagtacgaaattcgtacacataagcgtgtactggacatcgtccagccgacggataaaaccgtcgatgcgctgatgaagctcgatcttgctgcaggcgttgaagtacagatcagcctcggctaa

SEQ ID NO: 4777 - DNA, 837 bp, Pseudomonas aeruginosa
gtaaaggggtgcatcatggcaatcgttaagtgcaaaccgacttccgctggtcgtcgctttgtcgtcaaggtggtgaatcaggagctgcacaaaggcgctccctacgcaccgctgctggaaaagaaatccaagtctggcggccgtaacaacaacggtcgtatcaccacccgtcatatcggtggtggtcacaagcagcactaccgtctggtcgacttccgtcgcaacaaggatggcatccctgccatcgttgagcgcgtcgaatacgatccgaaccgcactgcacacatcgctctgctgaagtatgcagacggcgagcgtcgctacatcatcgcccccaagggcgttgctgcaggtgaccagctgatctccggtatcggtgcgccgatcaaggcaggcaacagcatgcctctgcgcaacatcccggtgggtagcactgttcatggtatcgagctgaagccgggtaaaggcgctcagatcgctcgctccgctggcgcttccgcccagctggtcgcgcgtgaaggtgcgtacgtaaccctgcgtctgcgctccggtgaaatgcgtaaagtcctggctgagtgccgtgcgaccctgggcgaagtctcgaactccgagcacagcctgcgttcgctgggtaaagccggtgctacgcgctggcgtggtgttcgcccgaccgttcgcggcgtggcgatgaacccggtcgaccacccgcatggtggtggtgaaggccgtacctctgctggtcgtcatccggtatcgccgtggggtcttcagaccaagggtaagaagactcgctcgaacaagcgtaccgataacatgatcgtccgccgccgcaagtaa

SEQ ID NO: 4778 - DNA, 429 bp, Pseudomonas aeruginosa
gtaaggagtacgcaaatgctgcaacccaagcgtacgaagttccgcaaacaaatgaccggccacaaccgtggtctggctcatcgtggtagtaaggtcagcttcggtgagtacgcactgaaggccactagccgtggccgccttactgctcgtcagatcgagtccgcgcgtcgtgcgctgacccgtcacgtgaagcgtggcggcaagatctggatccgcgtattccctgacaagcctgtcaccaagaagcccctcgaagttcgtatgggtaaaggtaagggtggggtcgagtactgggtagcccagatccagccgggcaaggtcctgtacgagatcgagggtgtttccgaagagctggcgcgtgaggctttcgccctggctgctgcaaagctgcccctcgccacctcctttgttaagcggacggtgatgtga

SEQ ID NO: 4779 - DNA, 411 bp, Pseudomonas aeruginosa
acgcgcggtggaagtctaaggactaggggtcggagaaattatatgattcagactcaatccatgctcgatgtcgctgacaacagcggcgcgcgtcgtgtgatgtgcatcaaggtgctcggcggttcccaccgccgttacgccggcatcggcgacatcatcaaggtcaccgtcaaggaagcgattccgcgcggcaaagtgaagaagggccaggtcatgactgccgtggtcgttcgcaccaagcacggcgtgcgtcgtaccgacggttccatcatccgcttcgacggcaacgccgccgtcctgctgaacaacaagcaggagccgatcggcacccgtatctttgggccagtgactcgtgaactccgtaccgagaagttcatgaagatcgtctcgctcgcccccgaagtgctgtaa

SEQ ID NO: 4780 - DNA, 327 bp, Pseudomonas aeruginosa
ggagtagccgtcatgcaaaagattcgtcgtgacgacgaagtaatcgtcattgccggcaaggacaagggcaagcgtggcaaggtgctgaaggttctcgctgacgaccgtctggtcgtcggcggggtgaacctgatcaagcgccacaccaagcccaatccgatgctcggccaacagggcggtatcgtcgagaaggaggcgcctctgcacgtctccaacgtcgccatcttcaatactgaaaccagcaaggctgaccgcgttggcttcaaggtagaagacggtaagaaaattcgtgtcttcaagtcgacccagaaaccggttcaggcttga

SEQ ID NO: 4781 - DNA, 357 bp, Pseudomonas aeruginosa
atggcccgtattgcaggcgtcaacattccggataacaagcacactgttatctcgctgacctacatctatggtgttggtcgcactactgctcagagcatctgcgcagccaccggcgtaaacccggctgccaagatcaaggacctgagcgacgagcagatcgatcagctgcgtaacgaagtcgcgaagatcaccaccgaaggtgacctgcgtcgcgaaatcaacatgaacatcaagcgtctgatggacctcggttgctaccgcggtctgcgtcatcgtcgcggtctgccggttcgcggtcagcgtaccaagaccaacgcgcgtacccgcaagggcccgcgtaagccgatccgcaagtaa

SEQ ID NO: 4782 - DNA, 408 bp, Pseudomonas aeruginosa
tcgcgtaggaatctagtcatggcaaaacctgctgctcgtccccgtaagaaagtcaaaaagacagtggtcgatgggatcgcccacatccacgcgtctttcaacaacaccatcgtgaccatcaccgaccgtcagggcaacgcactgtcctgggcgacctccggtggttccggtttccgcggctcgcgtaagagcaccccgttcgctgcccaggtagcggccgagcgtgccggccaggctgccctggaatacggtctgaagaacctggacgtcaacgtcaagggcccgggcccgggccgcgagtccgccgttcgcgctctgaatgcttgcggctacaagatcgccagcatcaccgacgtaaccccgatcccgcataacggctgccgtccgccgaaaaagcgtcgcgtgtaa

SEQ ID NO: 4783 - DNA, 393 bp, Pseudomonas aeruginosa
accatgcgccatcgtaaaagtggtcgtcacctgagccgcaccagcgcgcaccgcaaggctatgttccagaacatggcggtgtcgctgttcgaacacgaactgatcaaaaccaccctgcccaaggccaaggaactgcgtcgcgttgccgagccgctgatcaccctggccaaggaagacagcgtcgccaaccgtcgcctggctttcgaccgtacccgttcgaaagctgccgttggcaagctgttcaacgacctgggcaagcgctacgccaaccgtccgggcggctacctgcgcatcctgaagtgcggtttccgcgctggcgacaacgcccccatggcgtacgtcgagctggttgatcgtcctgtcggcggtgaagtcgtagaagctgccgaataa

SEQ ID NO: 4784 - DNA, 606 bp, Pseudomonas aeruginosa
agctggactgatggcctgatgaggcccccggcccccttcctaggaagggggcttttttatctgcattggcttgacccggatcaggcggagccgggagcatatgcggctagattcctagttttctccagggagagccccccgatgcaaggccatccggaagtcatcgattacctcaacacgctgctgaccggcgagctggccgcgcgcgaccagtacttcatccactcgcgcatgtacgaggactggggcttcagcaagctctacgagcgcctcaaccacgagatggaggaggagacccagcacgccgacgccctgctgcgccgtatcctcctgctcgaaggtacgccgcgcatgcgtcccgacgatatccacccgggcaccacggtgccggagatgctcgaggccgacctcaagctcgagcgccatgtccgcgccgcgctggccaagggcatcgccctctgcgagcagcacaaggacttcgtcagccgcgacatcctcaaggcccagttggccgacaccgaggaagaccacgcctactggttggagcaacagcttggcctgatcgcgaggatgggcctggagaactacctgcaatcgcagatctga

SEQ ID NO: 4785 - DNA, 444 bp, Pseudomonas aeruginosa
gtcgccgggttggagcgcggggtacgaccgatcgggctctggtcgatgtcgaccaccttgtccaggtgctgcaggccgtcgaacgagtcatacggcgccacttccagggtagtcgcgccgttcagcgcggtggcggtgatcgggaacagggtgttgttgatcagcgtcgacttgccggagcccgagaccccggtgatgcaggtgaacaggccgaccgggatttccaggttgacgttctgcaggttgttgccgcgggcgcctttcagcttcagcagcttcttcttgtcgcgcggggtgcgcttggccggaaccgcgattttcttgcgcccggaaaggtacttgccggtcagcgagtcggggtggttcatcacctggtcgggcgtaccttccgccactacctggccgccgtgcacgccggcgcccggaccgatgtcgacgacgtag

SEQ ID NO: 4786 - DNA, 396 bp, Pseudomonas aeruginosa
acgttgcgccggtcccagccgcggatcgcgccctcggccagggtcaactcgccgttgaccacccggcgcgcgtcgaagaattgcttcacgccgaggccgtcgcaggtcggacaggcgccggccgggttgttgaaggagaacagcttgggttccagctcgctgatagagtggccgcagaccgggcaggcgaagcgcgccgagaagatgatctcctcgacatcctcgtcctcgtccatcggtgctaccagggcgataccgtcggccagggacagggcggtctcgaacgactcggccaggcgttgctggaggtccgcgcgaaccttgaagcggtccaccaccacatcgatgctgtgcttcttctgcttatccagtttcggcacttcgtcgagttcgtag

SEQ ID NO: 4787 - DNA, 744 bp, Pseudomonas aeruginosa
gagaacgtcatggcccgtggggttaacaaagtcattctggttggtaacgtcggtggtgacccggaaacccggtacatgcccaacggcaatgtggtgaccaacatcaccctcgccaccagcgagagctggaaggacaagcagaccggccagcaacaggagcgtaccgtatggcaccgcgtggtgttattcggcccgcctggcggagatcgccggcgagtacttgcgcaagggttcccaggtgtacgtcgaaggcagcctgcgcacccgcaagtggcagggccaggacggtcaggatcgctacaccaccgagatcgtggtcgacatcaacggcaacatgcagttgctcggcggccgcccttccggcgacgattcgcagcgcgccccgcgcgagcccatgcagcgcccgcagcaggccccgcagcagcagtcgcgtccggccccgcagcagcaaccggcgccgcaaccggcccaggaatacgacagcttcgacgacgacattccgttctaagcgacgcccttgcggcgcggcccgtccgcgccacgggcagaccttcgaagaccccctgccgccctcgggccgcagggggtcttcgttttcaggcgacgccgcgctgcaagggcacttcgtccaggccgcctatggcggatagagcttcccgcatggcactgagcttaaggcaggtttcgcgatactcgtgggccggttccgaatcgcctaccagaccgcagccggcgaacaggtag

SEQ ID NO: 4788 - DNA, 795 bp, Pseudomonas aeruginosa
ctcgctggcgccaccctggcggcggacgtcctccagcagcgccgcctcgtcgccgcggtgcaacgcgccgccgcgttgccggtgcggtgccggatgggcggagacgaacaggtggcgcagcggcgcgccggcgctttccaggcgcagggcggtttcgtaggccagcgccgcgccgagactgtggccgaacagcgccaggggcgcgtcggcgaaatcgcgcagggcgagggcggcgccgtcggcgaggtcctccaagcgggtggccggcgcctcgttgaagcggtcctcgcgacccgggtactgcagggcaagcaggtcgatgtctggcggcaggcgttcgctccagctacggaagaagctggcgctgccgcctgcatgggggaagcaggccaggcgcaggcgcggcatcggcgtcaggcggaacggccggacccaggcggcgctcatgcgcgggcctccagctcgcggcgcaggcgctcgcgcaggtccttcttgctgatcttgccgatgccggtctgggggaaggccgggaccagctcgatgcggtccggcaccttgaacgcggccagcccgcaggcgtgcaggtattgcttcagcttcagcgccgagggcgccggctggcgcgggatgacgaaggcgcaggtgcgctcgccgagcaggctgtcgggcatcgccacgacggtggcgtcgtgcacctgcggatgggctatcagcaggttctccacctcttccgcggcgatcttctcgccgccgcggttgatctggtccttgtcgcggccctccaccaccaggtag

SEQ ID NO: 4789 - DNA, 963 bp, Pseudomonas aeruginosa
aaagtccccctgcccccacgtatccaggaaggcgtcgccgcgtcggcagcgcccgggctacaggaaaacctgatgaccatcaccatcattgctccgccacaggccgatgccgccgcgccggcaccgggcaaccggcccggcgtcgcgcacatcgatccgaacatgaagctggtgaccggaaccttctgttcggccagcgaggactggttcgaggaaccgctggagcgcggcctgcgcctgatcctcgtgcagagcggccagttgcgctgccggattcccggccagcccgagcacctcatcgaggggccgagcctgtgcaccatcgccaacgatggcgacttcacctcggcgcagatctacggcaccgacaagccgttgcgctacactatcgtccagctcggcgtcgaagccctggacagccgcctcggctggctgcccgagcaactgatacgccgccccggcggcgatccgcggatcatgagctgcccggcgccgcgggcgatgcaggcgttggcctcgcagatcgccacctgccagatgctcggtccgacccgcgatctctacctcggcggcaaggccctggagttggccgcgctcagcgcacagttcctttccggcgaggggcgccccgtcgaggagccgcgcatcacctgctcggaggtcgagcgcatccacgccgcccgcgacctgctggtcggcgccttgcaggagccgccgtcgctggacacgctggccagccgcgtgggcatgaacccgcgcaagctgaccgccggctttcgcaaggtgttcggcgccagcgtattcggctacctgcaggaataccgcctgcgcgaggcgcaccggatgctctgcgacgaagaggcgaacgtctccacggtggcctaccgggtgggctacagcccggcgcatttctccatcgctttccgcaagcgctacggcatctcccccagcgagatccgctga

SEQ ID NO: 4790 - DNA, 1320 bp, Pseudomonas aeruginosa
atgcctggcggtggagcgcggccaggtgttcctgctcgggctggtgcgcatgccgggcggcgaggatcgcctctggctgagtctcgacctgcttgccgccgatgtcgaaagcctgcgcctgctgctggccgaactgggcgttgcctacctggcgccggagcgcctggcggagccgccggcgctgcatttcgccgactacctggcgcaccgtgcggcgcaacgcgccgaggccgcggcgcgggcccgcgactactggctggaacgcctgccgcgcttgccggacgcgccggccctgccgttggcctgcgcgccggaaagcatccgccagccgcgcacccggcgcctggcattccagctttccgccggcgagagccggcgcctggagcgtcttgccgcgcagcatggcgtgaccttgtccagcgtgttcggctgcgccttcgcgctggtcctggcgcgctggagcgaaagcgcggaatttctcctcaacgtgccgttgttcgatcggcatgccgacgacccgcgtatcggcgaggtgatcgccgacttcaccaccctgttgctgctggagtgccggatgcaggccggggtgtccttcgccgaggcggtgaagagcttccagcgcaacctccacggagccatcgaccacgccgcattccccgccctggaggtgctccgcgaggcgcgccggcaggggccagccacgctcggcgccggtggtgttcgccagcaacctgggcgaggagggcttcgtcccggcggccttccgcgacgctttcggcgatctccacgacatgctctcgcagaccccgcaggtctggctcgaccaccagctctaccgggtgggcgacggtatcctgctggcctgggacagcgtcgtcggcctgttccccgaaggcctgccggaaaccatgttcgaagcctacgtggggctgctccagcgtctctgcgacagcgcctgggagcagcccgccgatctgccgttgccctgggcgcagcaggcgcgccgggccctgctcaacggccagccggcatgcgccacggcgcgcaccctgcatcgcgacttcttccttcgcgccgccgaggcgccggatgccgacgcgctgctctatcgcgaccaacgtgtcacccgcggcgaactggccgagcgtgcgctgcgcatcgccggcggcctgcgcgaagccggggtgcgccctggcgacgcggtcgaggtcagcctgccgcgcggaccgcagcaggtcgcggcggtattcggcgtgctcgccgcaggcgcctgctacgtgccgctggacatcgaccagccgcccgcacggcggcgcctga

SEQ ID NO: 4791 - DNA, 1107 bp, Pseudomonas aeruginosa
ccgcgatgggcaacgctctgcgcggcctgctcgccggcgaacaggcgccggccgcgctgctcctcgatccctggctggcgccgcaggcggtggccgcgcgcctgccggacggccgcgaggcccctggcgcgcctgctcgaagcgctgccgacgccggctgccggcgaacgcctgcgggtggcggtgctggatacccgcgccgggctctggctcgaccagggcatggcctcgctgttgcgcccggggctggaactgaccctcttcgaacgcagccgcgtcctcatcgacgccgccgccacccgcttgccggaacggatcgtggtgcaggcgctggacgacggcctgctacatgccgagcacctcggtcgctacgaccgggtgatcagcttcgccgcgctgcacgcctacgaggccagccgcgaaggcctggcgctggcggcggcgctgctgcgcccgcagggccgcctgttgctggtggacctgctatgcgagtcgccactggcgctgctcggtgcggccttgctcgacgaccggccgctgcgcctggcggagttgccgagcctgttggccgatctcgccgctgcgggactggcgccgcgttgcctgtggcgcagcgaacggctcgccctggtcgaggcgctggcgccgggactcgggctcgacgccgccgcgctccaggccggcctggagcaacgcctgccccaggcgatgcggcccgaacgcctgtggtgcctgccaagcctgccgttgaacggcaatggcaaggtcgatcgtcgccgcctggccgagagcatgacccgcgcactcggcgagtgtcgtcacgagccctcggcggaggagccgctggaagcccatgagcaagcgctggccgagtgctgggaagcggttctcaaacgcccggtgcgtcgtcgcgaggcgagcttcttcagcctcggcggcgacagcctgctggcgacccgcctgctggccggcatacgtgagcgtttcggcgtacgcctgggcatggccgacttctatcgccagccgaccctggccggtcttgcccgccacttgcaggcgcagaccgtcgaaatcgaggaaacccaactggaagagggcgtgctatga

SEQ ID NO: 4792 - DNA, 630 bp, Pseudomonas aeruginosa
gcttcgacctctcggtctacgacttcttcggcgccaccgcggcgggggcccaggtggtcctcccggacccggcgcgcggcagcgatccatcgcactgggcggaactgctggaacgccacgccatcaccctgtggaactcggtgccggcccaaggccagatgctcatcgattacctggagagcgagccgcaacgtcacctgccgggaccgcgctgcgtgctctggtccggtgactggattccggtcagcctgccgacccgatggtggcggcgctggccggacagcgcgctgttcagcctgggcggcgccaccgaggcggcgatctggtcgatcgagcagccgatccgcccgcagcacaccgagctggccagcatcccttatggccgtgccctgcgcgggcagagcgtggaagtcctggatgcccgcgggcggcgctgcccgccgggcgtgcgcggcgagatccatatcggcggggtgggcctggcgctcggctacgccggcgatccgcagcgcaccgccgaacgcttcgtccgtcaccccgatggccgtcgcctgtatcgcaccggcgacctcggccgctatctggccgacggcagcatcgagttcctcggccgcgaggacgaccaggtga

SEQ ID NO: 4793 - DNA, 612 bp, Pseudomonas aeruginosa
agattcgcggccaccgcatcgaactggccgagctggacgccgcgctgtgcgctcatccgcaggtcaatctggcggccaccgtggtgctcggcgagacccacgagcgcagcctggccagcttcgtcaccctgcatgcgccggcggaggctggcgaggatccgcgtacggcgctcgacgcggtgcgccagcgggcggcccaggccttgcgccgcgactggggcagcgaggagggcatcgccgcggcggtggccgcactcgaccgtgcctgcctcgcctcgctggccgcctggctggccggcagcggtctgttcgccagtgcgacgccgctggacttcgccaccctgtgccagcgcctgggtatcgccgaggcgcgccagcgcctgctgcgccactggttgcgccagctggaggagggcggctacctgcgcgccgagggcgagggctggctgggctgcgccgagcgtcccgcgcagagtccggaggacgcctggacggcgttcgccggctgcgcgccggcggcgctctggccggccgagctggtcgcctacctgcgtgacagcgcgcaatccctcggcgagcaactggccgggcggatcagcccggcggcgctga

SEQ ID NO: 4794 - DNA, 951 bp, Pseudomonas aeruginosa
tgtggggcgtctatgcagaccttgctgaaactacttcaagacgggcgattccactccggtgaggagttgggggcagtactgggcatcagtcgcagtgcagtctggaaacgcttgcagcacctggaggctgaacatggcctgcagttccacaaggtgcgtggccggggttaccgcctggcgagtcccctcagtctcctggatccgcggaagatcgacagcctctggccggtcgagatcatgcccaccgtcgattcgaccaatagcgaggccatgcgtaggctcgcggctggagcctcgacgcctttcgttatcgtcgccgagcagcagactgccgggcgtggacgtcgcggccgagcctgggtcagtccctatggagagaacctctattattctctggccattactgtcagggggagcgctcgggagctcgaagggttgagcctggttgtcggtctcgcggtgctccgggccctggagtctttgggcgtccgggacgccgggttgaagtggccgaacgaccttctgcagggaggcaagaagatcgccggaattctcctggagctgagtggcgaccccgcggatctgtgtcatgtcgttatcggcatagggatcaacgtcaacatgaagaccgccactgatatcggccagccttggacctccctgcgcgaagcgctgggggaactggtggatcgttcgcggctgctttctgctctcaatcggcagttggccgattatctcgataggcattcgcgcgaaggctttgctgcaagtcgcgaggagtgggagtcctgcaatctctggcagggtgcccaggtcattctctcgactgctctgagttccatcgagggtcgtgtgctgggtgtcgatagccgaggagcgctgcgtctcgaggtggatggcgtggagcaggggttcagtggaggggagcttagtttgaggttgcgtcaatga

SEQ ID NO: 4795 - DNA, 435 bp, Pseudomonas aeruginosa
caaatggctaagaaaatccaggcttatatcaagctgcaagtaaaggccggtcaggccaacccgtcgccgccggtcggccctgccctgggtcagcacggcgtgaacatcatggaattctgcaaggcgttcaacgccaagacccaaggccaagagccgggcctgccgactcctgtgatcatcaccgtttacagcgaccgtagcttcaccttcgaaaccaagagcaccccggctgccgtcctgctgaaaaaagcagctggcatcaccagcggctccgctcgtccgaactcccagaaagtcggcaccgttacccgtgcccagctggaagagatcgccaagaccaagcaggctgacctgaccgctgctgatctggacgctgctgtacgtaccatcgctggctccgcgcgcagcatgggcctgaacgtggagggtgtgtaa

SEQ ID NO: 4796 - DNA, 432 bp, Pseudomonas aeruginosa
gggtctggcggataccgcgctgaagaccgcgaactccggttacctgacccgtcgtctggtcgacgtggcccaggatctggtagtgaccgagatcgattgcggtaccgagcacggcctgctgatgtcgccgcacatcgaaggcggcgacgtggtagaaccgctcggcgagcgcgtgctcggccgtgtgatcgcgcgcgacgtgttcaagccgggcagcgacgaggtcatcgtgccggccggcaccctgatcgacgagaagtgggtcgacttcctcgaagtgatgagcgtcgacgaagtggtggtgcgttccccgatcacctgcgaaacccgtcatggcatctgcgccatgtgctacggccgcgacctggcccgtggccatcgcgtcaacatcggcgaggcggtcggtgtcatcgctgcccagtccatcggtga

SEQ ID NO: 4797 - DNA, 798 bp, Pseudomonas aeruginosa
catcaccggtggtctgccgcgcgttgccgacctgttcgaggctcgtcgtccgaaagagccttcgatcctggcggaaatcagcggcaccatctccttcggcaaagagaccaagggcaagcgccgcctggtcatcacgccgaacgatggcagcgatccgtacgaggagctgattccgaagtggcgtcacctgaacgtgttcgaaggcgaacaggtgaaccgcggcgaagtcatctccgacggtccgagcaacccgcacgacatcctgcgcctgctgggcgtgagctcgctggcgaagtacatcgtcaacgagatccaggacgtctaccgtctgcagggcgtgaagatcaacgacaagcacatcgagaccatcctgcgtcagatgctgcgcaaggtcgaagtcagcgagtccggcgactccagcttcatcaaaggcgaccaggtggaactcacccaggtgctggaagagaacgaacagctcggtaccgaggacaagttcccggccaagtacgagcgcgttctgctgggtatcaccaaggcttccctgtcgaccgagtcgttcatttccgcggcgtcgttccaggagaccacccgcgtcctcaccgaggcggcggtcaccggcaagcgcgacttcctgcgtggtctgaaagagaacgtggtcgtgggtcgcctgatcccggccggtaccggtctggcttaccacagcgagcgcaagcgtcagcgcgacctcggcaagccgcagcgtgtgagtgccagcgaggcggaagccgcactgaccgaagcgctgaactcgagcggtaa

SEQ ID NO: 4798 - DNA, 513 bp, Pseudomonas aeruginosa
gtggtgcgacttaccaggttccggtcgaagtccgtccgtcccgtcgtaatgccctggccatgcgttggctggtggacttcgcccgcaagcgtggcgagaagtccatggctctgcgcctggctggcgagctgctggatgccgctgaaggcaagggcgcagcagtcaagaagcgtgaagacgtgcaccgtatggcagaggccaacaaggccttctcgcactaccggttctaatcgcgctgcccaacccccgaggaccttattgtggcccgtactacacccatcaaccgctaccgtaatatcggtatctgtgcccacgttgacgcgggcaagaccaccaccacggagcgggttctgttctataccggcgtcaaccacaagctgggcgaagtgcatgacggcgctgcgaccaccgactggatggtgcaggagcaggagcgcggtatcaccattacctccgctgccgttaccaccttctggaagggttcgcgcggtcagtacgacaactatcgcgtaa

SEQ ID NO: 4799 - DNA, 672 bp, Pseudomonas aeruginosa
cgggtgaaagccccgtacactcaagaggtttacaacatgacaattggtgttgtcggtcgtaaatgcggcatgacccgcattttcaccgaggaaggtgtctctattccggttacggtcatcgaggtcgagccgaatcgcgtcacccagttcaagactgaagaaaccgatggctaccgtgcagtgcaagtcaccgccggcgagcgtcgtgcttctcgcgttaccaaagcgcaagctggtcactttgccaaggcgaatgtcgccgccggtcgcggcgtgtgggaattccgtctgggcgaagagcagtatgccgctggtgaccagatcactgtcgatctgttccaggcaggccagatggtagacgttaccggcgagtccaagggtaagggcttcgcgggcaccatcaagcgctggaacttccgtggtcaggataacacccacggtaactccgtttcccaccgcgtcccgggttccatcggccagtgccagactcctggtcgagtgttcaagggcaagaaaatgtccggtcatctgggtgcggagcgggtaaccgttcaatccctggagatcgtgcgcgtcgatgctgaacgcaatctgctgctggtcaagggtgccgttcccggcgctaccggcggtgatgtgatcgtgcgtccggcagccaaggctcgcggttaa

SEQ ID NO: 4800 - DNA, 390 bp, Pseudomonas aeruginosa
tgtccaaggttccgaccccgtcagcctgatcgcctacgacaaggtgctggtcaccgtgtccgccgtgaagaagttcgaggagctgctgggatgaaccaggaacgcgtattcaaagtgctgcttggtccgcacatctccgagaaagccacgggtctcgcggacggcaagagccaattcgttttcaaggttgccaccgatgcaaccaagctggaaatcaagaaggccgtagaaagcctgttcagcgtgaaggtacagcgcgtcactaccctgaacgtcaagggtaagaccaagcgcaccgctcgcggtctgggcaagcgtaacgactggaaaaaagcgtacatcgctctccagccgggccaagatctcgatttcgccaccagcgctgagtaa

SEQ ID NO: 4801 - DNA, 288 bp, Pseudomonas aeruginosa
agggataccacagtgccacgttcactgaaaaaaggtccgtttatcgatcttcacctgttgaagaaggtcgaagtcgcggtggaaaagaacgaccgcaagccgatcaagacctggtcgcgtcgttcgatgattctgccgcatatggttggtctgaccatcgccgtgcacaacggccgtcaacacgtaccggttctcgtcaacgaggacatggtcggccacaaactgggcgagttcgccgctacccgcacctaccgcgggcatgctgcggacaagaaagccaagcgttaa

SEQ ID NO: 4802 - DNA, 345 bp, Pseudomonas aeruginosa
ggggtaaggaagatggaagtagccgctaagctgtcgggcgctcgtatctccgcccagaaagcccgcttggtcgccgaccagatccgcgggaagaaggtgggcgaagcgctcaacctcctggctttcagcagtaagaaagccgccgagatcatgaagaaagtgctggagtcggccgttgccaacgctgagcacaacgaaggcgccgatgtggatgacctgaaggtctccaccgtcttcgtcaacgaaggtcgttcgctcaagcgcatcatgccgcgtgccaaaggccgtgctgatcgcatcgtgaagcggtcttgccatatcacggtcaaggttgcggacaagtaa

SEQ ID NO: 4803 - DNA, 699 bp, Pseudomonas aeruginosa
cggagtcgacagatgggtcagaaagtacatcccaatggcattcgcctgggtatcgtcaaggagcacacctccgtttggtacgcagaccgcaagaactatgcggattacctgtttgccgacctgaaggtgcgtgagtacctccaagacaaactaaaaagcgcgtccgtaagccgtatcgatattcatcgtccggctcaaaccgcacgcatcaccatccacaccgctcgtcccggcatcgtgatcggcaagaaaggtgaagatgttgagaaactgcgccaggacctgaccaagcaaatgggtgtgcccgtgcacatcaacatcgaggaaatccgcaagccggaactcgatgccatgctggttgcgcagagcgtagcccagcagctggagcgtcgcgtaatgttccgtcgcgccatgaagcgcgccgtacagaacgccatgcgcattggtgccaagggcatcaagattcaggtcagcggtcgtctgggtggggctgaaatcgcccgtaccgaatggtatcgcgaaggtcgtgtgcccctgcacaccctgcgcgccgatatcgactatgccacctacgaagcgcacaccacttacggtgtgatcggtgtcaaggtttggatcttcaagggcgaggtcatcggtggccgccaggaagagctgaagccggtagcacccgctcctcgtaaaaaagctgctaggtaa

SEQ ID NO: 4804 - DNA, 273 bp, Pseudomonas aeruginosa
gtgatcatggctgaagctcagaaaaccgtccgtacgctgaccggccgcgtcgtcagcgacaaaatggacaagaccgtcaccgtactgatcgagcgtcgcgtcaagcacccgatctacggcaaatacgtcaagcgttcgaccaaactgcacgcacacgacgaatccaatcagtgccgcattggtgacctggtcaccattcgcgaaacccgtccgctggccaagaccaaggcctggaccctggttgatatcgttgaacgcgcggtggaagtctaa

SEQ ID NO: 4805 - DNA, 546 bp, Pseudomonas aeruginosa
atcaccatggcacgattgaaagaaatttatcggaaggaaatcgcgcccaagctgaaagaagagcttcagctggcgaacgtgatggaagttccgcgcgttaccaaaatcaccctgaacatgggtcttggcgaggcggtcggtgacaagaagatcatcgagaacgccgtagccgatctggaaaagatcactggtcagaagccggtcgtgacttacgctcgtaagtccatcgcaggcttcaagatccgtgaaggctggccgatcggcgtcaaggtcaccctgcgtagcgaccggatgtacgagttcctggatcgtctgctgtccatctccctgccgcgcgtgcgtgacttccgcggcctgaatgccaagtccttcgatggtcgcggcaactacagcatgggcgtgaaagagcagatcatcttcccggaaatcgattacgacaagatcgatgcgctgcgtggcctggacatcaccctgaccaccaccgctcgtacggatgacgaaggtcgcgccctgctgcgtgctttcaaattcccgttccgtaactga

SEQ ID NO: 4806 - DNA, 669 bp, Pseudomonas aeruginosa
gcaactgccgaaagttcgtggcggcctcggtgtgtcgatcgtctccaccaacaaaggtgtgatgaccgatcgtgctgcccgtgctgctggtgttggcggcgaagtgctctgcactgtgttctaaggggaatcagcatgtctcgcgttgctaagaaccccgtcaagctgcctgccggcgttgaaatcaaactggctggtcagcaactgtccatcaagggcgccaaaggtgctctggagctcaaggtccatccttcggtcgaagtgatccaggacagcggtgagctgcgttttgctgcgcgtaacggcgaccagcagactcgcgccatggctggtaccacccgtgctctggtgaacaacatggtagtcggcgtcagccagggcttcgagcgcaagctccagctggtcggcgttggttacaaagcgcaggccaagggccaagtgctgtccctgtccctcggcttctcccatccggttgattacgaactgccggccggcatcgtcgctgaaacccccagccagaccgatatcctgatcaagggtatcgacaagcagctggtcggtcaggttgctgccgaaattcgcgacttccgtccgccggagccttacaaaggcaagggcgtgcgttacgccgacgaagtcgtccgtcgtaaagaagccaagaagaagtag

SEQ ID NO: 4807 - DNA, 513 bp, Pseudomonas aeruginosa
agtgccggccgccatccagaaagcaatggaagccgctcgccgcaacatgatccaagtcgatctgaacggcaccaccctgcagtatccgaccaagtccgcccatggcgcctccaaggtgtacatgcagccggcttcggaaggtaccggcatcatcgccggcggcgccatgcgtgccgttctggaagtggctggtgtgcagaacgtcctggccaagtgctatggctccaccaatccggtgaacgtggtttacgccaccttcaagggcctgaagaacatgcaggctccggaagcagtagcggccaagcgtggcaagagcgtcgaggagattctctaaccatggcaactgtcaaagtcactctggtcaagagcctgaacggccgtctggccaatcacaaggcttgcgtcaagggtctcggcctgcgtcgcatcaatcataccgtcgaagttcaggacactcctgagaaccgcggcatgatcaacaaggcctactacctgctgcgtgtggagggttaa

SEQ ID NO: 4808 - DNA, 438 bp, Pseudomonas aeruginosa
tccatgcaactgaacgatctgcgttccgcgccgggtgcccgtcgcgaaaagcaccgtccgggccgtggcatcggtagcggtctgggcaagaccggtggccgtggtcacaaaggtctgacctcccgctccggtggcaaggtcgctccgggcttcgagggtggtcaacagcctctgcaccgtcgcctgccgaagttcggcttcgtttccctgaaggccatggatcgtgctgaagtacgcacctccgagctggccaaggtcgaaggcgacgtcgtcagcctgcagaccctgaaggatgccaacctgatcaaccagcacgtacagcgcgtcaaagtcatgctgtccggcgaagttggtcgtgcggtcaccctgaaaggtatcgccgccaccaagggtgcgcgtgcggctatcgaagcagctggcggtaaattcgaggactaa

SEQ ID NO: 4809 - DNA, 1329 bp, Pseudomonas aeruginosa
atggctaagcaaggtgctctctctgcgctaagcaacggcggtctgtccgagctctgggcacgtctgcgtttcctgttcctggcgatcatcgtctatcggatcggcgcgcacatcccagttccgggcatcaaccccgatcgcttggcggcactgttccggcagaacgaggggaccattcttagcctcttcaacatgttttccggcggcgcgctggagcgcatgagtatctttgcactggggatcatgccgtacatctcggcatcgatcatcatgcagctcatgaccgctatcagcccgcagctggagcagttgaagaaagagggtgagtctgggcgtcgcaagatcagccagtacacccgctacggtactgtagtcctggcactggtccaggccatcggcatgtccgttggcctgggcagccagggcgtagccttctccaacgacttcggcttctacttcgtggctgtcaccaccttcgtggctggtgccatgttcatgatgtggctgggcgagcagatcaccgagcgcggtgtcggcaacggcatctcgatgttgatcttcgctggtatcgttgcaggcctgccgcgcgccatcggtcagtctttcgagtctgcccgtcaaggtgacatcaacatcttcgccctgatcggcgtcggcctgctggccgtggcgatcatcgcgttcgtggtgttcatcgagcgtggccagcgtcgcatcgcggtgcattacgccaagcgccagcaaggccgcaaggtgtttgcagcgcagaccagccatctgccgttgaaggtgaacatggcgggtgtgattcccgcgattttcgccagcagtatcctgctgttcccggcgtccctgggctcctggttcggtcagtcggaaggcttgggttggttgcaggacgtcgcgcaagcgatcgctccggggcagccgctgaacatcttgctgttcactgcagggatcgttttcttctgcttcttctatacagcgctgatgttcaacccgaaggacgtggcggagaacctcaagaagtccggtgcatttattccgggcatccgtccgggcgaacagtccgctcgctacatcgatggcgtgctgacccgtttgaccatgttcggtgctctgtacatgacggctgtctgcctgctgccccagttcctggtggttgcggcgcacgtgccgttctatcttggcgggacctcgctgttgatcgtggtcgtggttgtcatggactttatggcccaggtgcaatctcacctcgtttctcaccagtatgaatccctgatgaagaaagccaacctgaagggctacggcagcggcatgctgcgctga

SEQ ID NO: 4810 - DNA, 624 bp, Pseudomonas aeruginosa
gaaatggctcgttacattggtcccaagtgcaaactgtctcgccgtgaaggcaccgacctgttcctgaagagcggcgcccgcgccctcgactcgaagtgcaaggctgaaaacgttcctggccagcatggccagcgtcgtggccgtctgtccgactacggtctgcagctgcgtgaaaagcagaaagtacgtcgcatctacggcgtgctggagcgtcagttccgcggttactaccaggaagcttcccgtcgcaagggttctaccggtgagaacctgctgcaactgctcgagtgccgcctggacaacgtcgtataccgcatgggcttcggttccactcgttcggaatcccgccagctggtatcccacaaggccatcaccgtcaacggtcagaccgtcaacatcccttcctaccaagtgaaggccggtgacgtcgtagctgttcgcgaaaaatcgaagaaccagctgcgtatcgctcaggctctggaactctgtggccagcgcggtcgcgtcgagtgggtcgaagtcgacctcgacaagaaggctggtaccttcaagagtgctccggctcgcagcgacctgtccgctgatatcaacgaaaacctgattgtcgagctctactccaagtaa

SEQ ID NO: 4811 - DNA, 216 bp, Pseudomonas aeruginosa
tcgtacccacggtggagcgtgggttgtgggaagtggacttctgttcgatggaaatcgccggcgacagcccttcgatggtgtccacgtccggcttctccatcatcgacaggaactgccgggcgtaggccgagagggattccacgtagcgccgctggccttccgcatagagcgtgtcgaaagccagggaagacttgccggaaccggaaagaccggtga

SEQ ID NO: 4812 - DNA, 1473 bp, Pseudomonas aeruginosa
gcggatgagcggtaccgaaacgcgagcggccgtcgggctgtcactggtattcgccttccgcatgctcggcatgttcatggtcctgccggtgctggccacctacggccaggacctggccggcgcgaccccggcgctgatcggcctggccatcggcgcctatggcctgacccaggcgatcctgcagattcccttcgggaccatttccgaccgcatcggccggcgcccggtgatcgtcgtcgggctgctgatcttcgccgccggcgcggccctcgcggccaatgccgactccatctggggggtgatcgccggccgcgtcctgcagggcgccggggcgatctcggcggcggtgatggcgctgctctccgacctcacccgcgagcagcaccggaccaaggcgatggcgatgatcggcatgagcatcggcgtctccttcgccgtggccatggtgctcggcccggtgctgacccatctgttcggcctgcatgggctgttctggttcaccgccgggatggcgctggtcggcctgctgctgatcctgttcttcgtcccgcagccggaccacatgacccagcaccgcgaatccagcgtggcgcgccaggccctgctgccgaccctgaagcacggcgacctgctgcgcctggacgccggcatcctgatcctccacgccatcctcatggccagcttcgtcgccttgccgctggcactggtgcacgaggggggcctgcccaaggagcagcactggtgggtctacctgaccgcgctgctggtcggtttcttcggcatggtgccgttcatcatctacgccgagaagaagcgtcgcatgaagcgcgtgctgaccggcgcggtggcgaccctgctggcctgcgaactgttcttcctggtcttcggtcacagcctggccatgctggtggtcggcacggtggtgttcttcactgccttcaacctgctcgaagcctcgctgccgtcgctggtcagcaaggtctcgccggccggcggcaagggcacggcgatgggggtgtattccaccagccagttcctcggcgcggcgctgggcggcatcctcggcggctggatgttccagcacggcgggctgagcatggtgttcatcggatgcgcggtgctcgctgccctctggctggcgattgctgttaccatgcgcgaaccgccttatgtgaccagcattcgcctgccgctcgcgcccgccgcgctgcaggacgcggtgctggtccagcgattcagggcgttgcccggtgtggcagacgccgtggtggtggccgaggaggccgccgcctatgtcaaagtggatacccaacaagtggatcgcaccgccctcgagcgcctggcccaggccgcgccgggcggatgctgaaccttaggagaacgtcatggcccgtggggttaacaaagtcattctggttggtaacgtcggtggtgacccggaaacccggtacatgcccaacggcaatgtggtga

SEQ ID NO: 4813 - DNA, 411 bp, Pseudomonas aeruginosa
ccaacatcaccctcgccaccagcgagagctggaaggacaagcagaccggccagcaacaggagcgtaccgtatggcaccgcgtggtgttattcggcccgcctggcggagatcgccggcgagtacttgcgcaagggttcccaggtgtacgtcgaaggcagcctgcgcacccgcaagtggcagggccaggacggtcaggatcgctacaccaccgagatcgtggtcgacatcaacggcaacatgcagttgctcggcggccgcccttccggcgacgattcgcagcgcgccccgcgcgagcccatgcagcgcccgcagcaggccccgcagcagcagtcgcgtccggccccgcagcagcaaccggcgccgcaaccggcccaggaatacgacagcttcgacgacgacattccgttctaa

SEQ ID NO: 4814 - DNA, 804 bp, Pseudomonas aeruginosa
tgccggcgagcatcaggctggcatcggcgaaggcttgccagtgttcctcgcgcgggccgcgcggatcgaagcggaatccgccgcacaggcgcggcgccagcgggccctcgaccacggcgtcggcgcagagcaattgccagttttcctcgatccgggcgaagcgctgttcgccgtggccttgcagctccagggcgcagccccaggcgaagaacgccagctcgggctgttcccagtacaggcagggcgtttgccggtcgtcccaggcaccgaatacctgcagcgggtccaatgggtcgatctcgaacgacgccgccaccaagaccggacgatcgagcgcctgcgcctggccgatggcgcgctcgaaggtgccgcgcaaggcgtgcaggcactggctcaggggcgccagccggctcatgcggcaccccgtgtctggcgccagtacttgatctgctcggcgatgtaccagtggatgatctgcgcgaacagtccctcgacgaagggcgcgtcgagtccgttttcctcggcccagcgggcgcgctcggggagcatcgcggcgacccgctcgggtgccggaatcgccgcctcgctggccttgaagcgcgacgccgccttgacgtagtccatgcggcggccgagggcctggacgatatccaggtcgatccggtcgatggcctcgcggatgtccgccaggccggtgcagtcttcgggagttttcatcatgcaacctctcgggaaagggcgtcgggatgtgcgaggcggcgcagcaggtgctcgatcaccgcgtcgcgcccctcgctcaggtag

SEQ ID NO: 4815 - DNA, 2922 bp, Pseudomonas aeruginosa
ggagcccccatggatctgccccccgattcccgtaccgccctgcgcgactggctgaccgagcagctcgccgacctgctcggtgaaccgcttgccgacgtgcgcgccctggcggacgacgacgacctgctgggctgcggcctcgactcgatccgcctgatgtacctgcaggaacgcctgcgcgcgcgtggctcgacgctggacttcgcccagttggcgcagcgcccctgcctgggggcctggctcgacctgctggcctgcgcggaccggctgtccgccccggcaacggtcgcgctgccgacggcgcaggatcgcgatcagccgttcgagctgtcttccgtgcagcaggcctactggctgggacgtggcgccggcgaggtgctgggcaacgtcagctgccatgccttcctggaattccgcgcgcgggatgtcgacccgcagcgcctggccgcggcggcggagtgcgtgcgtcaacgccacccgatgttgcgggcgcgcttcctcgacggtcgccagcagatccttccgacgccgccgctgtcctgcttcgacctgcaggactggcgcaccttgcaggtggacgaggccgagcgcgactggcaggcgctgcgcgactggcgcgcccatgaatgcctggcggtggagcgcggccaggtgttcctgctcgggctggtgcgcatgccgggcggcgaggatcgcctctggctgagtctcgacctgcttgccgccgatgtcgaaagcctgcgcctgctgctggccgaactgggcgttgcctacctggcgccggagcgcctggcggagccgccggcgctgcatttcgccgactacctggcgcaccgtgcggcgcaacgcgccgaggccgcggcgcgggcccgcgactactggctggaacgcctgccgcgcttgccggacgcgccggccctgccgttggcctgcgcgccggaaagcatccgccagccgcgcacccggcgcctggcattccagctttccgccggcgagagccggcgcctggagcgtcttgccgcgcagcatggcgtgaccttgtccagcgtgttcggctgcgccttcgcgctggtcctggcgcgctggagcgaaagcgcggaatttctcctcaacgtgccgttgttcgatcggcatgccgacgacccgcgtatcggcgaggtgatcgccgacttcaccaccctgttgctgctggagtgccggatgcaggccggggtgtccttcgccgaggcggtgaagagcttccagcgcaacctccacggagccatcgaccacgccgcattccccgccctggaggtgctccgcgaggcgcgccggcaggggccagccacgctcggcgccggtggtgttcgccagcaacctgggcgaggagggcttcgtcccggcggccttccgcgacgctttcggcgatctccacgacatgctctcgcagaccccgcaggtctggctcgaccaccagctctaccgggtgggcgacggtatcctgctggcctgggacagcgtcgtcggcctgttccccgaaggcctgccggaaaccatgttcgaagcctacgtggggctgctccagcgtctctgcgacagcgcctgggagcagcccgccgatctgccgttgccctgggcgcagcaggcgcgccgggccctgctcaacggccagccggcatgcgccacggcgcgcaccctgcatcgcgacttcttccttcgcgccgccgaggcgccggatgccgacgcgctgctctatcgcgaccaacgtgtcacccgcggcgaactggccgagcgtgcgctgcgcatcgccggcggcctgcgcgaagccggggtgcgccctggcgacgcggtcgaggtcagcctgccgcgcggaccgcagcaggtcgcggcggtattcggcgtgctcgccgcaggcgcctgctacgtgccgctggacatcgaccagccgcccgcacggcggcgcctgatcgaagaggccgccggggtatgcctggcgatcaccgaggaggacgatccgcaggccttgccgccgcgcctggatgtccagcgcctgctgcgcggcccggcgctggccgcccccgtgccgctggcgccgcaggcgagtgcctatgtgatctacacctcgggctccaccggggtgcccaagggcgtcgaggtcagccacgcggcggcgatcaataccatcgacgcgctgctcgacctgctgcgggtgaacgcatcggatcgcttgctggcggtctccgcgctggacttcgatctgtcggtcttcgacctgttcggcggcctcggcgccggtgccagcctggtcctgccggcccaggaacaggcgcgcgatgccgctgcctgggcggaggctatccagcggcatgcggtgagcctgtggaactcggcgccggccttgctggagatggccctcagcctgccggcgagccaggccgactatcgcagtctgcgggcggtgctgctgtccggcgactgggtggccctggacctgcccggccgcctgcgcccacgttgtgccgaaggctgccgcctgcatgtgctgggtggcgctaccgaagcgggcatctggtcgaacctgcagagcgtcgatacggtgccgccgcactggcgttcgattccctacggccggccattgccgggacaggcctaccgggtggtcgacacccacgggcgcgacgtgccggacctggtggtcggcgagctgtggatcggcggcgccagcctggcccgcggctatcgcaacgatcccgaactcagcgcccggcgcttcgtccacgatgcccagggccgctggtatcgcaccggcgatcgcggtcgctactggggcgacggtaccctggaattcctcggtcgggtcgaccagcaggtgaaagtgcgcggccagcgcatcgagttgggcgaggtggaggccgcgctgtgcgcccaggctggcgtggatag

SEQ ID NO: 4816 - DNA, 555 bp, Pseudomonas aeruginosa
cgcctgcgcggcggtgctcggcggtggcgtggcgagcctcggcgcggtgctggtaccgcgcctggcgccacgggccgaaggctccatggaactaccggccgcacagcccttcgccggcctggcagaggccgaggcggtactcacccgggaaatcctcggcgcgctgctggaggcgccgctggagctagacgacggtttgcgccggcgctggctggactggctagcggactccgccgccagcgcgctgccgtcgctcgacgaggcgttgcgccggctcggctggcaggccgcggggctgaccgcgatgggcaacgctctgcgcggcctgctcgccggcgaacaggcgccggccgcgctgctcctcgatccctggctggcgccgcaggcggtggccgcgcgcctgccggacggccgcgaggcccctggcgcgcctgctcgaagcgctgccgacgccggctgccggcgaacgcctgcgggtggcggtgctggatacccgcgccgggctctggctcgaccagggcatggcctcgctgttgcgcccggggctggaactga

SEQ ID NO: 4817 - DNA, 783 bp, Pseudomonas aeruginosa
cgcctgccagctgtacgccgagtacgactggccggtcgacaccgatccggcgcgcctggaggcggcctggaacgccatggtcgagcgccacccgatgctgcgcgcggtgatcgaggacaacgcctggcagcgcgtgctgcccgaggtgccctggcagcggctgaccgtgcatgcctgcgcggggctcgacgaggccgctttccaggcgcacctggagcgggtccgcgaacgcctcgaccacgcctgcgcggcgctcgaccagtggccggtcctgcgccccgagctgagtatcggccgggatgcctgcgtactgcactgctcggtggatttcaccctggtcgactacgccagcctgcaattgctgcttggcgaatggcgccgccgctatctcgatccgcaatggacggcggaaccgctggaggcgaccttccgcgactatgtcggcgtcgagcagcgccgacgccagtcgccagcctggcagcgcgaccgcgactggtggctggcgcgtctcgacgcgctaccggggcgtcccgacctgccgctgcgggtgcagccggacacccggtccacgcgcttccggcacttccacgcgcgcctcgacgaggccgcctggcaggcgctcggcgcgcgcgccggcgaacacggcctgagcgctgccggcgtggccttggcggccttcgccgagaccatcggtcgctggagccaggcaccggcgttctgtctcaacctgacggtactcaaccggccgccgctgcatccgcagctggcgcaggtgctcggtga

SEQ ID NO: 4818 - DNA, 480 bp, Pseudomonas aeruginosa
cttcaccgcgctcagcctgctggcagtggacagccgccacggcgacagtttcgtcgagcgtgcccgacgcatcggcgagcagatgttcgacgacctcgaccacccgaccttcagcggcgtcgacctgctgcgcgaactggcgcgccggcgcggtcgcggcgccgacctgatgccggtggtgttcaccagtggcatcggcagcgtgcagcgcctgctcggcgatggcgaggcgccgcgcgcgccacgctacatgatcagccagaccccgcaggtctggctggactgccaggtcaccgaccagttcggcggcctggagatcggctgggacgtacgcctcgggttgttccccgagggccaggcggaagccatgttcgacgacttcgtcgggctgctccggcgcctggcgcagagcccgcgcgcctggaccgacggcgatgccacggaacccgtcgaggcgccgccgcaggcgttgcccggtag

SEQ ID NO: 4819 - DNA, 804 bp, Pseudomonas aeruginosa
tgcccggagcatcgccgccggtttcgccgagcgtgccctgctgacccccgacgccacggcgatccacgatgccgccggcagctacagctaccgccaggtcgcccagcacgccaccgccctgcgccgcgtcctggaagcgcacggcgcgggccgtggccggcgggtcgcggtgatgctgccgaaaagcgccgcgcaattggtcgcggtgatcggcatcctccaggccggcgccgcctatgtgccggtggacatccgccagcctccgctgcggcgccaggcgatcctcgccagcgccgaagtggtcgcgctggtctgcctggaaagcgatgtcccggacgtcggctgcgcctgcgtggccatcgaccggctggccgccgacagcgcctggccgccaccgcccgcggcggaggtggcggcggacgacctcgcctacgtgatctacacctccggctccaccggcacgccaaagggcgtgatgctcagccatgcggcggtgagcaacacgctgctcgacatcaaccagcgctacggcgtcgacgccaacgaccgcgtcctcggcctcgccgagctgagcttcgacctctcggtctacgacttcttcggcgccaccgcggcgggggcccaggtggtcctcccggacccggcgcgcggcagcgatccatcgcactgggcggaactgctggaacgccacgccatcaccctgtggaactcggtgccggcccaaggccagatgctcatcgattacctggagagcgagccgcaacgtcacctgccgggaccgcgctgcgtgctctggtccggtga

SEQ ID NO: 4820 - DNA, 954 bp, Pseudomonas aeruginosa
ctggattccggtcagcctgccgacccgatggtggcggcgctggccggacagcgcgctgttcagcctgggcggcgccaccgaggcggcgatctggtcgatcgagcagccgatccgcccgcagcacaccgagctggccagcatcccttatggccgtgccctgcgcgggcagagcgtggaagtcctggatgcccgcgggcggcgctgcccgccgggcgtgcgcggcgagatccatatcggcggggtgggcctggcgctcggctacgccggcgatccgcagcgcaccgccgaacgcttcgtccgtcaccccgatggccgtcgcctgtatcgcaccggcgacctcggccgctatctggccgacggcagcatcgagttcctcggccgcgaggacgaccaggtgaagattcgcggccaccgcatcgaactggccgagctggacgccgcgctgtgcgctcatccgcaggtcaatctggcggccaccgtggtgctcggcgagacccacgagcgcagcctggccagcttcgtcaccctgcatgcgccggcggaggctggcgaggatccgcgtacggcgctcgacgcggtgcgccagcgggcggcccaggccttgcgccgcgactggggcagcgaggagggcatcgccgcggcggtggccgcactcgaccgtgcctgcctcgcctcgctggccgcctggctggccggcagcggtctgttcgccagtgcgacgccgctggacttcgccaccctgtgccagcgcctgggtatcgccgaggcgcgccagcgcctgctgcgccactggttgcgccagctggaggagggcggctacctgcgcgccgagggcgagggctggctgggctgcgccgagcgtcccgcgcagagtccggaggacgcctggacggcgttcgccggctgcgcgccggcggcgctctggccggccgagctggtcgcctacctgcgtga

SEQ ID NO: 4821 - DNA, 621 bp, Pseudomonas aeruginosa
atggcctcatctctggccggatccatcgcggctcggtgcacatatttatccacagattttctggataaaaaccgccggccgctgcgttatactcgccgccccattttcccctgcacatacacacaagagaccatggaacgctttttcgaaaacgccatgtacgcctcgcgctggctgctggctcccatctacatgggcctgtctctggcgctgctcgcgttgaccatcaagttcttccaggaaatattccacgtcatcccgaacatcttcgcgatggccgaggccgacctgatcctggtcctgctctcactgatcgacatggctctggttggcggcctgttggtcatggtgatgatctccggctacgagaacttcgtttcgcaactggacatcgacgaaggcaaggaaaagctcagctggctgggcaagatggattccggctcgctgaagaacaaggtggccgcctccatcgtggcgatctcttcgatccacctgttgcgcatcttcatggacgcgaagaatgtgccggacaacaagctgatgtggtacgtgatcatccacatgaccttcgtgctctcggcgttcgccatgggctacctggataagcagacccgtcactga

SEQ ID NO: 4822 - DNA, 717 bp, Pseudomonas aeruginosa
ggtgggcttgccttcggcgaggtcgtcgccgacgttcttgccgagggtcgcggcgtcgccgcggtagtcgagcaggtcgtccaccagctggaaggcgattcccaggtagtcgccgaagcggcgcagtgcctcggactgttcctcgccggcctggcacagcgcggcggcgctgtgggtcgaggcctcgaaaagcatcgcggtcttgccgcggatcacttccatgtaggtctcttcggtagtgctggcgtcgcgtaccttggacaattgcagcacttcgccctcggcgatcacccgggtggcctgggatatgatgcgcatgaccggcatggaacccagctcgaccatcatttcgaaggagcgggcataaaggaagtcgcctaccagcacgctcggcgcgttgccccacagggcattggcggtggagcggccgcggcgcaggccggaggcgtcgaccacgtcgtcgtgcagcagagtggaggtgtgcaggaattcgatggtggcggccagcaggcagaggtcgtcgcccttgtagcccagggtcttgccggcgagcaggaccagcagcgggcgcaggcgcttgccgccggcggagatgatgtagtcgccgatcttttccaccaggggaacgcgggaggtgagttggcgacggatgatcccgtcgacggcggtgaaatcttccgccaccacgcggtagaaggcctggggttgcatcagtga

SEQ ID NO: 4823 - DNA, 333 bp, Pseudomonas aeruginosa
gcaggtttaacggagatacacatgtacgcagtgattgttaccggtggcaagcagcacaaagtcaccgaaggcgaattcctcaaggtcgagaaactcgacgtcgctaccggcgaagcgatcgatttcgaccgcgtcctgctggttgccaatggcgaagacgtgaaaatcggcctgccggtcgtcgaaggtgcgaaggttaccgctgaagtggtttcccacggccgtcacgacaaggtccgcatcatcaagttccgccgtcgtaagcaccacatgaagcgtcagggccaccgccagtggttcactgaaatcaagatcaccggcattcaggcctaa

SEQ ID NO: 4824 - DNA, 183 bp, Pseudomonas aeruginosa
aggtgctggccgacgtcggcctgctgggactgccgaatgccggcaagagcactttcatccgcgcagtgtccgcggccaagccgaaggtggccgactatccgttcaccaccctggtgccgaacctcggcgtggtcagcgtcggtcgctacaagagcttcgtggtcgccgacattcccggcctga

SEQ ID NO: 4825 - DNA, 1629 bp, Pseudomonas aeruginosa
agagtcgaagcctgggcttctaaggttgagggtatgcgggacaaggtgacaggcgcgcggcgctgggtggtgaagatcggtagcgccctgctgacggccgatggccgtgggctggatcgcaatgccatggccgtttgggtcgagcagatggtggcgctgcattgcgccggcatcgagctggtgctggtgtcgtccggcgccgtcgccgccggtatgagccgcctgggctgggtgtcccgacctagcgcgatgcacgaactccaggccgccgcctcggtggggcaaatggggttggtgcaggcctgggagtccagcttcgccctgcatggcctgcagaccgcccaggtgttgctgacccatgacgacctctccgaccgcaagcgctacctgaacgcccgcagcaccctgcggaccctggtcgagctgggcgtggtcccggtgatcaacgagaacgacacggtggtcaccgacgagatccgcttcggcgacaacgacaccctggcggcactggtggccaacctggtcgaggccgacctgctggtgatccttaccgatcgcgacgggatgttcgacgccgatccgcgcaacaatcccgatgcccaactgatctacgaggcgcgtgccgatgatccgcagctcgatgcggtggccggcggcagtgccggcgccctggggcgcggcggaatgcagaccaagctgcgggcggcgcgcctggcggcgcgttccggcgggcatacggtgatcgtcggcgggcgtatcgagcgtgtcctcgaccgcctgcgcgccggcgaacgcctcggcaccctgttgacccctgatcgcagtcgcaaggcggcgcgcaagcaatggctggccggccacttgcagatgcgcggcaccctggtgctggacgatggggcggtgaaggcggtgagccaggatcacaagagcctgttgccggttggggtcaaggcggtccagggcagcttccgtcgcggcgagatggtggtctgtgtggaccagggcgggcgcgaaagtggcgcgcggcctggtcaactacagtgcgctggaggcgcagaagatcctcggtcagccgacggatgccatcgaggccttgctcggctacgtggatgggccggagctggtgcatcgcgacaatctggttctggtctgaggagagggcgaatgcgcaagctcgcggggttgctgggtggtctgctgctgttgccggcgcttgccggggcggaggagatcggcgaggtttccacggtgttcaagtgggtcgggccgaacgacaagattgtcgtcgaggctttcgacgatcccaaggtgcagggcgtgacctgctatctgtcgcgcgccaagaccggtggggtcaagggcggcctggggctggcggaggatcgcgccgaggcgtcgatcgcctgtcgccaggtggggccgatccagttcagtggcgaactcaaggatggcgaagaggtgttcaagcagcgcacttcgctggtgttcaaaagcatgcaggtggtgcgcttcttcgatcgcaagcgcaatgccttggtctatctggtctacagcgaccgggtgatcgagggcagtccgcagaacgcggtgacggcgattcccctcatgccctggccgaccgctcgctga

SEQ ID NO: 4826 - DNA, 723 bp, Pseudomonas aeruginosa
gtactcgcgcctgctcgactggggcctgcgcctgtgcttcctgctggtgctgccctgttccctggccctggcgatcctcgccgaacctctgaccgtctcgctgttccagtacggcaagttcaccacggtggacgcggcgatgacccagcgcgcgctggtggcctactccgtcggcctgctcggcatcatcctggtcaaggttcttgcgccgggcttctatgcccagcagaacatccgtacgccagtgaagatcgcgctcttcaccctggtttccacccagctgatgaacctggccttcatcggcccgcttcagcatgccggcctggccctgtccatcggcctggccgcctgcctgaatgccggcctgctctactggcaactgcgcaagcagcgtctgtacctgccgcaaccgggctgggcgaagttcctggtcaagctggtggtcgcggtgctggcgatgtcggcggtgctgctggccacgatgcactggctgccggcctgggagcagggcgccatgctggagcgattcctgcgcctcggcctgctggtggttgccggtctcctggcctatttcggtatgctcgcgctgctgggtttccgcctgcgcgacttttcccgccgggcggtgctgtgaagcgcgtccgggctggcggcgggatcatgccgttttgcctgttgtccggcgcccggtacgcgtataatcgaccactttctgagcaataa

SEQ ID NO: 4827 - DNA, 2844 bp, Pseudomonas aeruginosa
acaggccctgagatgaccgactacaaagcgacgctaaaccttccggaaaccgccttcccaatgaaagccggcctgccccagcgcgagccggaaaccctgaagttctggaacgacatcggtctgtaccagaagctgcgggccattggcggcgaccgtccgaagttcgtcctgcacgatggccctccgtacgccaacggcagcattcacatcggtcacgcggtcaacaagattctcaaggacatcattgtccgctccaagaccctggcgggctacgacgcgccctatgtgccgggctgggattgccacggcctgcccatcgagcacaaggtcgagaccacccacggcaagaatcttccggcggacaagacccgcgaactgtgccgcgaatacgcggccgagcagatcgaagggcagaaggccgacttcatccgcctgggcgtgctcggcgagtgggacaacccctacaagaccatgaatttcgccaacgaggcgaacgaaatccgcgccctcgcggaaatggtcaagcaggacttcgtgttcaagggcctgaagccggtcaactggtgcttcgactgtggttcggcgctggccgaggccgaggtcgagtacgccgacaagaagtcgccgaccatcgacgttggcttcccggtggcggatgccgacaagctggccgcggccttcggcctggcggccctggacaagccggcgcagatcgtcatctggaccaccacgccctggaccatcccggccaaccaggcgctgaacgtgcatccggagatcgactacgcgctggtcgatgccggcgatcgctacctggtgctggccgaggccctggtcgagtcctgcctggcgcgctaccagcgcgagggcaaggtggtcgccaccgccaagggcgaggcgctggagctgatcaacttccgccatccgttctacgagcgcctgtcgccggtgtacctggccgactacgtggccctcgatgccggcaccggtatcgtccactcgtcgccggcctacggcgaagacgacttctatacctgcaagcgctacgggatgagcaacgacgacatcctcagcccggtgcagagcaacggcgtctacgtcgactcgttgccgttcttcggcggccagttcatctggaaggccaaccccaacgtggtggccaagctggaagaggtcggcagcctgctggcccacgaaaccatcaatcacagctacatgcactgctggcggcacaagacgccgctgatctatcgcgccaccgcgcagtggttcgtcggcatggacaagcagcccaggcagggtgcttccctgcgcgagcgagcgctggaagccatcacccagaccgaattcgtcccgggctggggccaggcgcgtctgcacggaatgatcgccgggcgtcccgactggtgcatctcgcgccagcgcaactggggcgtaccgatcccgttcttcctgcacaaggccagtggcgaactgcatccacgcaccgtggagctgatggaagaggtcgcgcagcgagtcgagaaggaaggcatcgaagcctggttcaagctcgacgccgccgagctgctcggcgaggacgccgcgcagtacgagaaaatcaacgacaccctggacgtctggttcgactccggcaccacccattggcacgtgctgcgtggttcccaccggatcggccatgccagcggcccggtcgccgatctctacctggaaggttccgaccagcaccgcggctggttccactcctcgctgctgaccggctgcgcgatcgacaaccatgcgccgtaccgccagttgctgacccacggtttcaccgtcgacgagtccggccgcaagatgtccaagtcgctgggcaacaccgtggtgccgcagaccgtcatcgataccctgggcgccgacatcctgcgcctgtgggtggcttcgaccgattactcgggcgagatcgcggtatcccagcagattctccagcgtagcgccgatgcctaccggcggatccgcaataccacgcgcttcctgctgtccaacctgaacggtttcgatccggccacggatctgctgccgccccaggaaatgctggccctggatcgctgggcggtcgatcgcgccctgctcttgcagcgcgagatcgaagaggcgtaccgcgagtaccgcttctggaacgtctattccaaggtgcacaacttctgcgtacaggagctgggcgggttctatctggacatcatcaaggaccgccagtacaccaccggcgccaacagcgtcgcccggcgctcctgccagaccgcactgttccacatcgccgaggccctcgtgcgctggatcgccccgatcctggcgttcaccgccgaggaagtctggaagttcctgcccggcgagcgcgccgagtcggtaatgctcgccacctggtacgacggcctcagcgaactgccggccgacgtgacgctgaatcgccagtactgggaacaggtcatggcggtgaaggccgcggtcaacaaggagctggagaaccagcgcgcggccaaggccgtgggcggcaacctgcaggccgaggtcaccctgtatacggaagacgcgctgcaggcccaattggccaagctgggcaacgagctacgcttcgtcctgatcacctcgaccgcgaccctggcgccgctgtcggcggctccggccgacgcggtggacagcgaagtcgccggcctcaagctgaaagtggtcaagtcgacccacgccaagtgcggtcgttgctggcaccatcgcgaggacgtcggtcagcacgctgcgcatcctgacctgtgcggtcgctgcatcgagaacatcgaaggcagcggcgaggttcgccactatgcctga

SEQ ID NO: 4828 - DNA, 1107 bp, Pseudomonas aeruginosa
ccgtcgacttcaatcatccgctggccggcaagaccctggccttcgaagtcgagatcatcgacgtccagccggcctgaaccgtcggtcgctgcgcccttcccaagcggggagggcggtagcaaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctgaaggttttcgacgcgacctgcccgctggtgaccaaggtgcacatggaagtggtgcgctacagccgcgacggccacgaatgcgtgctgatcgggcatgaagggcaccccgaggtggaaggcaccatgggccagtacgatgccagcaacggtggtgccatctacctagtggaggacgaggccgacgtcgccgcgctggaggtgcgcaagcccgaagccctgcactacgtgacccagacgaccctgtcgatggacgacacctcgaaggtcatcgatgccctgcgcgccaagttcccgcagatccagggaccgcgcaagaacgacatctgctatgccacccagaaccgccaggatgccgtgaaggaactggccgaccagtgcgacatggtcctggtggtgggcagccccaacagttccaactccaaccgcctgcgcgaactcgccgagcggatgggcacgccggcctacctgatcgacggcgccgaggacatgcaacgcggctggttcgacggtgtgcgtcgcatcggaatcaccgcaggcgcttccgcgccggaagtgctggtgcgcggcgtgatcgcccagctacgcgagtggggggcgtcggaggagcaggaactggaggggcgggaggagaacattaccttctcgatgcccaaggaactgcgggtcaaggctttgtga

SEQ ID NO: 4829 - DNA, 1014 bp, Pseudomonas aeruginosa
ccacagcgcgtagccgattccaaaagccgcgctgagcatcgtctcctactcatgtccgatatgattcaacgcgcggccgaggtgccgttcgagctgggtggccagcgtctcgaccagatcgccgcccagctttttcccgaacactcccgctcccgtctggccggctggatcaaggacggacgcctgaccgtcgacggcgccgtgctgcgcccgcgcgacatcgtccacagcggcgcgcaactggtcctggaggccgagcaggaagcccagggcgagtggctcgcacaggacatcgagctggaaatcgtctacgaggacgagcacatcctggtgatcgacaagcccgccggcctggtggtccatccggctgccggccatcaggacggcaccctgctgaatgccttgctctaccatgtcccggacatcgccaatgtgccgcgcgccgggatcgtccaccgcctggacaaggacacgaccggcctgatggtagtggccaagacgctggaggcccacaccaagctggtggcgcaactgcaggcacggtcggtcagccgcatctacgaggcgatcgtgatcggcgtgatcacctccggcggcaccatcgatgcgccgatcggacggcatggcgtgcagcggcagaagatggcggtggtcgacgccggcaaggtggcggtcagccattaccgcgtgctggaacgcttccgtgcgcacacccatacccgggtcaagctggagaccgggcgtacccaccagatccgcgtgcacatgagccatatcggctatcccctggtcggcgatccggtctacggtgggcgcttcaggattcccccggtggccagccagaccctggtccagactcttcgcgagttcccccggcaggcgctgcacgcgcgcttcctcgaactggatcacccggccaccggcgtgcgcatgaagtgggagtcgccgctgccggaagacttcctctggctgctcagcctgttgcgccaggatcgcgaggcgttcgtcggatga

SEQ ID NO: 4830 - DNA, 789 bp, Pseudomonas aeruginosa
ccgcctggcccagcagaagggcgaccagttcatctccagcgagctggtattgctggccgcgatggacgagaacaccaggctcggcaagctgctgctcggccagggcgtgtcgcgcaaggcgctggagaatgccgtggccaacctgcgtggcggcgaagcggtgaacgacccgaacgtcgaggagtcgcgccaggcgctggacaagtacaccgtcgacatgaccaagcgcgccgaggaaggcaagctcgatccggtgatcggtcgcgacgacgaaatccgccggaccatccaggtcctgcagcggcggaccaagaacaacccggtgctgatcggcgaacccggcgtcggcaagaccgccatcgtcgagggcctggcccagcgcatcatcaacggcgaagtgccggacggcctcaaggacaagcgcctgctggccctggacatgggggcgctgatcgccggtgccaagttccgcggcgagttcgaggaacgcctgaaggcagtcctcaacgaactgggcaagcaggaaggccgggtcatcctgttcatcgacgaactgcacaccatggtcggtgccggcaaggcggaaggtgccatggacgccggcaacatgctcaagccggctctggcgcgcggcgagctgcactgcgtcggtgctactaccctcgacgagtatcgccagtacatcgagaaggatgccgcgctggagcgccgcttccagaaggtgctggtggacgaaccgagcgaggaagacacgatcgccatcctccgtggtctcaaggaacgctatga

SEQ ID NO: 4831 - DNA, 897 bp, Pseudomonas aeruginosa
agtgcaccacggggtgagcatcaccgacggcgcgatcatcgccgcggccaagctgtcgcaccgctacatcaccgatcggcaactgccggacaaggccatcgacctgatcgacgaggccgccagccgcatccgcatggagatcgactccaagccagaggaactggatcgtctcgaccgtcgcctgatccagctgaagatcgagcgcgaggcgctgaagaaggaagacgacgaagccaccaggaagcgcctggccaagctggaggaggatatcgtcaagctcgagcgcgaatacgccgacctcgaggatatctggaagtccgagaaggccgaggtgcagggctcggcgcagatccagcagaagatcgagcaggccaagcaggagatggaggcggcgcggcgcaagggcgacctcgagagcatggcgcgcatccagtaccagaccatcccggacctggaacgcagcctgcagatggtcgaccagcacggcaagaccgagaaccagttgctgcgcaacaaggtgaccgacgaggaaatcgccgaagtggtttccaagtggaccggtatcccggtgtcgaagatgctcgagggcgagcgcgagaagctgctgcgcatggagcaggagctgcatcggcgagtgatcggccaggacgaggcggtagtcgccgtgtccaacgccgtgcgccgttcgcgcgccggcctcgccgatccgaaccggccgagcggctcgttcctcttcctcggcccgaccggggtgggcaagaccgagttgtgcaaggcgctggccgagttcctcttcgataccgaggaggcgctggtgcggatcgatatgtccgagttcatggagaaacactcggtggcccgcctgatcggcgcgcctccgggctacgtcggctttga

SEQ ID NO: 4832 - DNA, 456 bp, Pseudomonas aeruginosa
tatcgggcggacgccgggagcgggcgtccttcgcatcgtcggggcctgccggccggacgatgccgggaatcgggccggcgctgtcgggaccgaggcggttggcggaaacctggaggcttccgctgcctgcgcaacctcgagaggttcgcgatgaacatgcaggatctcgccggccgggtccaggccggacatatcgacgccttgcacctggtgtcgctggagggcggcatctatgtcctggaggcgcagatgggcgaccgcgcctatccggtggaggacgatctcggccagccggtcagcctgcgctccgtggagcatgcgcgccaggtactgcgcgggctggacagggttccggtggagttggtgtgcgccgatgtcgatgacgagatgtgtggactcctggccgagtcggggtcgtttatcggcgggctgccgctgtcgatccgccagggttga

SEQ ID NO: 4833 - DNA, 657 bp, Pseudomonas aeruginosa
gctggccgccctttttcgaccccacagcggagcagcgccatgagcgaactcaacctgaccactgacgaagcccgtgtcagctacggcatcggccgtcaactgggcgaccaactgcgcgagaatccggttccgggcatgaccctggacgcagtcctggccggcctgtccgatgcgttcgcaggtatcgacagccgggtttccggcgaggcgctgtcggccagcttccaggtgatccgcgagcgcatgcaggccgaagcccaggccaaggccgaagccgccgctggcgaaggccgcgcctacctggccgagaacgccaagcgcgaaggcgtgaccgtgctgccctcgggcctgcagttcgaagtgctgagcactggcgagggcgccaagccttcccgcgaggataccgtgcgcacccactaccacggcaccctgatcgacggcaccgtattcgacagctcctaccagcgtggccagccggccgagttcccggtgggcggcgtgatcgccggctgggtcgaagcgctgcaactgatgaacgccggctccaagtggcgcctgcacgtaccgagcgaactggcctatggcggccaggcggtcggcagcattcccccgcacagcgtgctggtgttcgacgtcgaactgctggaaatcctctga

SEQ ID NO: 4834 - DNA, 1158 bp, Pseudomonas aeruginosa
cgtgctcgggttggccgaagcgaccgtggggttgccggccagcggcgggaacatgcccgggacgccgctgccgtccttgcggtggcagtcggagcagaactgcgcgtagccgaggccgccccgcgagctgtacaggtcgaccggtgctgccagcgggcgttcgctgtcgggcatgggcaggtcgtccttgccggccggcagggacttcaggtagctggcgatggccagcagatcgtcgtcgctgaagtgctgggtgctgtggtggatgacatcggtcatgctgccggacaccgtggcgaagcggttctgcccggtcttcagcaactgcacggtgtcctccaccgtccacaggttgcgcaggctcagggcttgccattgttcgacggtttcgccggcgaggtagagctgcccggaacgaccggcttcgctcatggctttttcctggaaggcgatgccgcgcggagtatggcaggcgccgcagtggccgagtccctgtaccaggtaggcgccgcggttgatcgccgggtccgcgtcgctggagggggtgaacggcgcgtcgtcgaggaacgcccagttccacagcgacaggccccagcgctggttgaacggccagctcatcgcgctcggcgtattcgcctgggtgacgggttgcacgccgtgcatcaggtaggcgtacagcgcacgcatgtcttcttcgctgatcttggcgtaggacgggtagggcatcgccggatagagattcactccctcggcggtcacccccttgcgcatggcgcggtcgaactcttcgaagctgtagcggccgatgccggtctcccggtcgggagtgatgttggtcgagtagatggtacccattggcgtcttcagctccaggccgccggccatcggcgcgccctgcgggccggtatggcaggcgatgcagtcgccgagctgggccacgtagcggcctttttcgatgagcgcagcgtccgtggtcggttcgctggcatggagcaggggaacgatggagcacagcgcgccgagcaagccgaggcgcgggaaagaagcaggcatttcctcatccttaggcgtaggcctggggcggtcccctcggccacggtccattctttttttcgttatgcggccgtcgacaggacgacggtcacgccgctgttgtaa

SEQ ID NO: 4835 - DNA, 240 bp, Pseudomonas aeruginosa
gccaggatcacaagagcctgttgccggttggggtcaaggcggtccagggcagcttccgtcgcggcgagatggtggtctgtgtggaccagggcgggcgcgaaagtggcgcgcggcctggtcaactacagtgcgctggaggcgcagaagatcctcggtcagccgacggatgccatcgaggccttgctcggctacgtggatgggccggagctggtgcatcgcgacaatctggttctggtctga

SEQ ID NO: 4836 - DNA, 1602 bp, Pseudomonas aeruginosa
accggcccggccggtcgcggtcttggacaggatcaatttcgacatgccggcagcccgacatccatgaatcttctcaaatcattggcggcggtgagttccatcaccatgctgtcgcgggtcctcggcttcgtccgcgataccatcctggcgcggatcttcggtgccggcctcgccaccgacgcctttttcgtcgccttcaagctgcccaacctgttgcggcggatcttcgccgagggggcgttttcccaggctttcgtgccgatcctggcagagtacaagaaccagcagggcgaggaggcgacgcggaccttcatcgcctacgtttccggcttgctcacgctggtgctggcgctggtcacggcgctcggcatcctcgccgcgccctgggttatctgggtcaccgctccgggcttcgccgataccccggaaaagttcgccctgaccaccgacctgctgcgggtgacctttccttatatattgctgatctcgctgtcgtccctggccggcgcgatcctcaacacctggaaccgcttctcggtgccagccttcgtgccgaccctgctgaacgtcgcaatgatcggcttcgcgctgttcctcacgccttatttcgatccgccggtcatggtgctgggctgggcggtgctggccggcggcctgttgcagctcctctatcagctgccgcacctgaggaagatcggcatgctcgtgctgccgcgcctgaacctcagggacagcggcgtctggcgggtgatgaagctgatgctgccggccatcctgggggtctcggtgagccagatctcgctgatcatcaacaccatcttcgcttcgttcctggcagccggttcggtgtcctggatgtactacgccgaccgcctgatggagctgccttccggcgtattgggcgtggcgctggggacgatcctcctgccgatgctggcgaagacctattcgaacaaggatcgccatgagtactcgcgcctgctcgactggggcctgcgcctgtgcttcctgctggtgctgccctgttccctggccctggcgatcctcgccgaacctctgaccgtctcgctgttccagtacggcaagttcaccacggtggacgcggcgatgacccagcgcgcgctggtggcctactccgtcggcctgctcggcatcatcctggtcaaggttcttgcgccgggcttctatgcccagcagaacatccgtacgccagtgaagatcgcgctcttcaccctggtttccacccagctgatgaacctggccttcatcggcccgcttcagcatgccggcctggccctgtccatcggcctggccgcctgcctgaatgccggcctgctctactggcaactgcgcaagcagcgtctgtacctgccgcaaccgggctgggcgaagttcctggtcaagctggtggtcgcggtgctggcgatgtcggcggtgctgctggccacgatgcactggctgccggcctgggagcagggcgccatgctggagcgattcctgcgcctcggcctgctggtggttgccggtctcctggcctatttcggtatgctcgcgctgctgggtttccgcctgcgcgacttttcccgccgggcggtgctgtga

SEQ ID NO: 4837 - DNA, 1035 bp, Pseudomonas aeruginosa
agcgcgtccgggctggcggcgggatcatgccgttttgcctgttgtccggcgcccggtacgcgtataatcgaccactttctgagcaataagcgtgctatgcagctgcttcgcggactacacaacctgcagcccctggccgggggctgcgtcgccaccatcggtaacttcgacggcgtccacctcgggcaccaggctatcctggcgcgtctgcgcgagcgctcgctggagctgggcgtacccagctgcgtggtgattttcgagccgcagccgcgcgagttcttctcccccgattcggcgccggtgcgcctgacccgcctgcgcgagaaactcgagttgctgcgtgggcagggcgtcgatgtggtgctctgcctggccttcaaccgccgcttgcgcgagctgtcggcagccgagttcgtccgccaggtcctggtcgatggactggcggtgcggcatcttgaagtgggcgacgatttccgtttcggctgcgaccgctccggtgacttcgccttcctggtgaacgccagtcgcgagcaggggttcaccgtcgaggcggccaccaccgtcgaactggacggtgtgcgggtgagcagcacgcgggtccgccaggccctggccgagggcgacctgcatctcgccgagcgccttctggggcgtcccttcagcctgagcggacgggtcctgcatggacagaaactcggccggcaactgggctcgcccacggccaacattcaactgaaacggcgcaaggcgccgttgaacggggtctacctggtcagtacgctggtcgatggccagcgttgccagggggtggcgaacatcggcacccgcccttcggtgaacggcgacggccgtccccatctggaagtgcacctgctcgatttcgccggcgatctatacggccggcatctgcaggtgaccttccaccagaagctgcgcgacgagcagcgttttgcctccctggaggcactcaaggcggcgattctcgcggatatcgccgccgcccgggcctactggctgggccaaccgcttgattga

SEQ ID NO: 4838 - DNA, 645 bp, Pseudomonas aeruginosa
aagtggtcaagtcgacccacgccaagtgcggtcgttgctggcaccatcgcgaggacgtcggtcagcacgctgcgcatcctgacctgtgcggtcgctgcatcgagaacatcgaaggcagcggcgaggttcgccactatgcctgacgtcgatcgtttcgggcgcttgccctggttgtggatcaccgtgctggtgttcgtcctcgaccaggtcagcaaggcgttcttccaggccgaactgagcatgtaccagcagatcgtggtgatccccgatctgttcagctggaccctggcctacaacaccggtgccgccttcagcttcctggccgacagctcgggctggcagcgctggctgttcgccctgatcgccatcgtcgtcagcgcgatcctggtggtctggctgaaacgcctgaagaaaggcgagacctggttggccatcgccctggcgctggtgctcggcggcgccctgggcaacctttacgaccgcatggtccttggccacgtggtggacttcatcctggtgcactggcagaaccgctggtacttcccggcgttcaacctggccgatagcgccatcaccgtcggcgccgtcatgctggcgctcgacatgttcagatcgaagaaatccggagaagccgcccatggctga

SEQ ID NO: 4839 - DNA, 441 bp, Pseudomonas aeruginosa
gcagcaggtgaccgtcgacttcaatcatccgctggccggcaagaccctggccttcgaagtcgagatcatcgacgtccagccggcctgaaccgtcggtcgctgcgcccttcccaagcggggagggcggtagcaaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctga

SEQ ID NO: 4840 - DNA, 1842 bp, Pseudomonas aeruginosa
gccgttgggtacgccggtcctgccggtgacttccagtttgcgggtgatggccccggtctccaggtcgatgatcagcagcgcggccttgtcgttcaggctggaataaccgtttccggtgaccacggcccacttgccgttgtgcagccgggcgaccgtgggtttggggaagctgtagccaaggtcgggctcctggtccacgccgatttcccagagcagcttgatgttggcgggatcggtcacgtcgagggcgaacaggcccttgccgccggcgcgcaggctgccgatcagcacggtatgccaggcgccaccgaagaaggcgtcggcgaccaccggcgagccgtcgacgtagaactggtgggcgccgccctggtagccgcgggcggtcaacttgtggagcttctcgaagaccgcgcttgggatgaaggcgaaggtctcgttaccgtcggtatcgaaaccgtgcagcatgccgtcgttggcgccgacgtatacccgcggggcacgggttttctgtgcttctgcgaacgtggagtagttgccgctgggctcgatcggctgggccaggtaggtcaggtactgggccttgccgaccgtcgccggcgaggagttgatgatatcgccgaggatcgagttgcgggtgcggaagttgtcgctgttctccttgctgcgatcgccgcgcaggaaggccacgcggtcctggcccttggtgtcggcgacatcgttgcggtccggatcgcggttcaactgccgctgctggtcggcgctgaggctgccccaggtgaactccttgaggcccgaggtaccggatccggccatcatgatcttgcggccagctccaccgttgggcatcgcgtcgaggatgctctgcgcgctccacagcttggtctgcacggtggccttgtcctgggtggtcaggctgtagcgggtcaggtcgccagcccagttcttgtcgctggcgaagctggtctggtaggcgaagcgggtcagcttgtcgccagtgtcgtcttcctgcagggacgagctgatggcggggcgggatgccggcaggtccttgcccgaaattcggttgaggatgtcctggaaggccgcgaccagttggtccggcgagtcggcgctgaagaactcgccccgggagttcactgcggcgtgccacaggtcatagacgttgttgctatggttattcgaagcgttcggccagctgaggcgcccggcggcgatttcgtcatagccgccggagtaggtggaaccctcccacttcgggctggtgaggctggtggtcaggcccaggcccagggtataggtcaccatgtgctgccaggtcgccggatcgttgcgcggattccagtactccgccgagggattggcctggtccgggtagggaatgtacggcttgatattgtcgtcgatatccggccgggcatcggtggcccagtaatggaaggcctggtcggccagggtattggacgcagcatccctgtaaggcgtctggctgctgtagctcttgccatcggggaggctacgactcgtgctgtcggcattgcctacgctggccgagtcgttgttccaaagaccatcggtcatcagaatgtgatagctgccacggcagctgtattccggcgaggtctgggtaccaggtcgataggcataggggccgttgacgccggtcttcttgagaaactcccctgctcgagtcatggcctgacgcagcggagtaccacctccgaccgacaggttctccagccagttgaagaagttcacccgatgttgcccggtgaagtctctcaggtagttgttgtaacagttactggagccactgccgatcaggcacgaggaactgttcagtag

SEQ ID NO: 4841 - DNA, 744 bp, Pseudomonas aeruginosa
gcagacggaggtgcgcggctggttgcgcgacggcgatcgagtgctcggcgtggcgacctcgcgtggcgagatccgtggcgacaaggtgctgctggcggcgggcgcctggagcggcgagttgttgaagccgcttggcctggaactgcccgtggtaccggtgaaagggcagatgatcctctacaagtgcgcggcggatttcctgccgcgcatggtgctggccaaggggcgctacgcgattccgcggcgcgacggccacatcctgatcggcagcaccttggaacattcgggcttcgacaagacgccgaccgacgaggcgctggaaagcctcagggcgtctgcggcagaactgttgccggaactggcggacatgcagccggtggcccactgggcagggttgcgcccgggctctcccgaaggcatcccctatatcggtccggtgcctggcttcgacgggctctggctgaataccgggcactaccgcaacgggctggtcctggcaccggcgtcgtgccgtctgctggcggatctcatgagcgggcgggaaccgatcatcgacccggtcccctacgccccggctggtcgcctctgaggagcgaaaaccaaaaggcctgtcttcggacaggccttttcactttcagtcgatgcccagctttttcaggcggtagcgcatcgagcggaacgtcaggcccaggcgctgggccgcggcggtgcggttccagcgggtctcctcgagcgcctgcatga

SEQ ID NO: 4842 - DNA, 2580 bp, Pseudomonas aeruginosa
aaggaaggacgacccatgcgaatagaccgtttgaccagcaagctgcaactggcgctctccgacgcccagtccctggccgttggccatgaccatccggccatcgagccggtgcacctgctttccgccctgctcgagcagcaaggcggttcgatcaagcccctgctgatgcaggtcggcttcgatatcgccgccctgcgcagcggcctcaacaaagaactcgacgcgctgccgaagatccagagcccgaccggcgacgtgaacctgtcccaggatctcgcacgcctgctcaaccaggctgaccgcctggcccagcagaagggcgaccagttcatctccagcgagctggtattgctggccgcgatggacgagaacaccaggctcggcaagctgctgctcggccagggcgtgtcgcgcaaggcgctggagaatgccgtggccaacctgcgtggcggcgaagcggtgaacgacccgaacgtcgaggagtcgcgccaggcgctggacaagtacaccgtcgacatgaccaagcgcgccgaggaaggcaagctcgatccggtgatcggtcgcgacgacgaaatccgccggaccatccaggtcctgcagcggcggaccaagaacaacccggtgctgatcggcgaacccggcgtcggcaagaccgccatcgtcgagggcctggcccagcgcatcatcaacggcgaagtgccggacggcctcaaggacaagcgcctgctggccctggacatgggggcgctgatcgccggtgccaagttccgcggcgagttcgaggaacgcctgaaggcagtcctcaacgaactgggcaagcaggaaggccgggtcatcctgttcatcgacgaactgcacaccatggtcggtgccggcaaggcggaaggtgccatggacgccggcaacatgctcaagccggctctggcgcgcggcgagctgcactgcgtcggtgctactaccctcgacgagtatcgccagtacatcgagaaggatgccgcgctggagcgccgcttccagaaggtgctggtggacgaaccgagcgaggaagacacgatcgccatcctccgtggtctcaaggaacgctatgaagtgcaccacggggtgagcatcaccgacggcgcgatcatcgccgcggccaagctgtcgcaccgctacatcaccgatcggcaactgccggacaaggccatcgacctgatcgacgaggccgccagccgcatccgcatggagatcgactccaagccagaggaactggatcgtctcgaccgtcgcctgatccagctgaagatcgagcgcgaggcgctgaagaaggaagacgacgaagccaccaggaagcgcctggccaagctggaggaggatatcgtcaagctcgagcgcgaatacgccgacctcgaggatatctggaagtccgagaaggccgaggtgcagggctcggcgcagatccagcagaagatcgagcaggccaagcaggagatggaggcggcgcggcgcaagggcgacctcgagagcatggcgcgcatccagtaccagaccatcccggacctggaacgcagcctgcagatggtcgaccagcacggcaagaccgagaaccagttgctgcgcaacaaggtgaccgacgaggaaatcgccgaagtggtttccaagtggaccggtatcccggtgtcgaagatgctcgagggcgagcgcgagaagctgctgcgcatggagcaggagctgcatcggcgagtgatcggccaggacgaggcggtagtcgccgtgtccaacgccgtgcgccgttcgcgcgccggcctcgccgatccgaaccggccgagcggctcgttcctcttcctcggcccgaccggggtgggcaagaccgagttgtgcaaggcgctggccgagttcctcttcgataccgaggaggcgctggtgcggatcgatatgtccgagttcatggagaaacactcggtggcccgcctgatcggcgcgcctccgggctacgtcggctttgaggaaggcggctacctgaccgaggcgatccgccgcaagccctactcggtggtgctgctggacgaggtggagaaggcccatccggatgtattcaacattctcctccaggtgctcgaggacggacgcctgaccgacagtcacgggcgtacggtggacttccgcaacaccgtggtggtgatgacctccaacctcggttcggcacagatccaggagctggccggcgaccgcgaggcgcaacgtgccgcagtgatggacgcggtcaatgcacacttccgtccggaattcatcaaccggatcgacgaagtggtggtattcgagccgctggctcgcgagcagatcgccggcatcgccgagatccagctcggtcgcctgcgcaagcgcctggccgagcgcgagctgagcctggaactgagccaggaggcgctggacaagctgatcgccgtcggcttcgacccggtctatggcgcacgcccgctgaagcgggccatccagcgctggatcgagaacccgctggcgcaactgatcctggccggcaaattcgcgccgggtgccagtatctcggcgaaggtggaaggagacgagatcgtcttcgcctga

SEQ ID NO: 4843 - DNA, 234 bp, Pseudomonas aeruginosa
tgtggatcaggcaggaatccctatcgcggcgaggggctgccggcgtgctcgggtgaggcgttgcggaaagaccgggacatgaggaaagtgactccgggaaggtcgtccgtgaccttcccggaaccggccggaggcgcctttgcctccgttcgtgcgatccgcctcccgggcagcggcgcacggatgacgcgtcctggcgtcatcgcaaaggctcagcgcagggcgcgggcgtag

SEQ ID NO: 4844 - DNA, 261 bp, Pseudomonas aeruginosa
ctcatggcacacaaaaaagctggcggttctacccgcaacggccgcgactcagaaagtaaacgccttggcgtgaaactgttcggcggccaggctgtaaaggctggcaacatcctggttcgtcagcgcggcaccaaattccacgccggttacggcgttggcctgggcaaggatcacaccctgttcgcgaaagtggacggcgtggtcaagtttgagaccaaaggcgcctttggtcgcaaatacgtgagcatcgttgctgcctaa

SEQ ID NO: 4845 - DNA, 1248 bp, Pseudomonas aeruginosa
cccgccctcgtggtgggaggcgtatccatgaaattcgtcgatgaagtatcaatccacgtgaaagccggtgacggcggcaatggcctcatgagctttcgtcgcgagaagttcatcgaaaagggcggtcccaacggcggcgacggtggcgacggcggttccatctacctggaagccgacgtcaacctgaacaccctggtcgactatcgctacacccgccgtttcgatgcccagcgcggcgagaacggcggcagcaaggactgcaccggggccaagggcgacgacctgatcctgccggtgccggtcggtaccaccgtgatcgacgccaatacccaggaaatcatcggcgacctgaccgagcccggtcagcggctgatggtcgctcagggcggctggcacggcctcggtaacacccgtttcaaatccagtaccaatcgggcgccgcgccagaccaccccgggcaagccgggcgaggcgcgtgacctcaagctggaactgaaggtgctggccgacgtcggcctgctgggactgccgaatgccggcaagagcactttcatccgcgcagtgtccgcggccaagccgaaggtggccgactatccgttcaccaccctggtgccgaacctcggcgtggtcagcgtcggtcgctacaagagcttcgtggtcgccgacattcccggcctgatcgaaggtgccgccgaaggcgccgggctgggcattcgcttcctcaagcatctggcgcggacccgcatccttctgcatctggtggacatggcgccgctggacgaaagcgatccggccgatgccgccgaggtcatcgttcgcgagctgggtcgcttcagtccggcgctgaccgagcgcgagcgctggctggtgctgaacaagatggaccagatcctcgatccggccgagcgcgaggcgcgcaagcaggcggtgatcgagcggttgggctgggaaggcccggtctatgtgatctccgccctggagcgcgatggcaccgaggcgctcagccaggacatcatgcgctatctcgacgagcgtaccctgcgcctggaagaagatccgcagtatgccgaggaactggccgaactcgaccggcgtatcgaggacgaggcgcgggcccgtctgcaggccctggacgatgcgcgcgcgctgcggcgttcgggtctgaagaacgccggtgcggtggatgacgatgatttcgatgatgaggaagacgacggcgacggtccggagatcttctacgttccctga

SEQ ID NO: 4846 - DNA, 834 bp, Pseudomonas aeruginosa
tcgcagtcgcaaggcggcgcgcaagcaatggctggccggccacttgcagatgcgcggcaccctggtgctggacgatggggcggtgaaggcggtgagccaggatcacaagagcctgttgccggttggggtcaaggcggtccagggcagcttccgtcgcggcgagatggtggtctgtgtggaccagggcgggcgcgaaagtggcgcgcggcctggtcaactacagtgcgctggaggcgcagaagatcctcggtcagccgacggatgccatcgaggccttgctcggctacgtggatgggccggagctggtgcatcgcgacaatctggttctggtctgaggagagggcgaatgcgcaagctcgcggggttgctgggtggtctgctgctgttgccggcgcttgccggggcggaggagatcggcgaggtttccacggtgttcaagtgggtcgggccgaacgacaagattgtcgtcgaggctttcgacgatcccaaggtgcagggcgtgacctgctatctgtcgcgcgccaagaccggtggggtcaagggcggcctggggctggcggaggatcgcgccgaggcgtcgatcgcctgtcgccaggtggggccgatccagttcagtggcgaactcaaggatggcgaagaggtgttcaagcagcgcacttcgctggtgttcaaaagcatgcaggtggtgcgcttcttcgatcgcaagcgcaatgccttggtctatctggtctacagcgaccgggtgatcgagggcagtccgcagaacgcggtgacggcgattcccctcatgccctggccgaccgctcgctgaggcgagcgagtcgtgggcaataa

SEQ ID NO: 4847 - DNA, 1962 bp, Pseudomonas aeruginosa
gatgaccgactacaaagcgacgctaaaccttccggaaaccgccttcccaatgaaagccggcctgccccagcgcgagccggaaaccctgaagttctggaacgacatcggtctgtaccagaagctgcgggccattggcggcgaccgtccgaagttcgtcctgcacgatggccctccgtacgccaacggcagcattcacatcggtcacgcggtcaacaagattctcaaggacatcattgtccgctccaagaccctggcgggctacgacgcgccctatgtgccgggctgggattgccacggcctgcccatcgagcacaaggtcgagaccacccacggcaagaatcttccggcggacaagacccgcgaactgtgccgcgaatacgcggccgagcagatcgaagggcagaaggccgacttcatccgcctgggcgtgctcggcgagtgggacaacccctacaagaccatgaatttcgccaacgaggcgaacgaaatccgcgccctcgcggaaatggtcaagcaggacttcgtgttcaagggcctgaagccggtcaactggtgcttcgactgtggttcggcgctggccgaggccgaggtcgagtacgccgacaagaagtcgccgaccatcgacgttggcttcccggtggcggatgccgacaagctggccgcggccttcggcctggcggccctggacaagccggcgcagatcgtcatctggaccaccacgccctggaccatcccggccaaccaggcgctgaacgtgcatccggagatcgactacgcgctggtcgatgccggcgatcgctacctggtgctggccgaggccctggtcgagtcctgcctggcgcgctaccagcgcgagggcaaggtggtcgccaccgccaagggcgaggcgctggagctgatcaacttccgccatccgttctacgagcgcctgtcgccggtgtacctggccgactacgtggccctcgatgccggcaccggtatcgtccactcgtcgccggcctacggcgaagacgacttctatacctgcaagcgctacgggatgagcaacgacgacatcctcagcccggtgcagagcaacggcgtctacgtcgactcgttgccgttcttcggcggccagttcatctggaaggccaaccccaacgtggtggccaagctggaagaggtcggcagcctgctggcccacgaaaccatcaatcacagctacatgcactgctggcggcacaagacgccgctgatctatcgcgccaccgcgcagtggttcgtcggcatggacaagcagcccaggcagggtgcttccctgcgcgagcgagcgctggaagccatcacccagaccgaattcgtcccgggctggggccaggcgcgtctgcacggaatgatcgccgggcgtcccgactggtgcatctcgcgccagcgcaactggggcgtaccgatcccgttcttcctgcacaaggccagtggcgaactgcatccacgcaccgtggagctgatggaagaggtcgcgcagcgagtcgagaaggaaggcatcgaagcctggttcaagctcgacgccgccgagctgctcggcgaggacgccgcgcagtacgagaaaatcaacgacaccctggacgtctggttcgactccggcaccacccattggcacgtgctgcgtggttcccaccggatcggccatgccagcggcccggtcgccgatctctacctggaaggttccgaccagcaccgcggctggttccactcctcgctgctgaccggctgcgcgatcgacaaccatgcgccgtaccgccagttgctgacccacggtttcaccgtcgacgagtccggccgcaagatgtccaagtcgctgggcaacaccgtggtgccgcagaccgtcatcgataccctgggcgccgacatcctgcgcctgtgggtggcttcgaccgattactcgggcgagatcgcggtatcccagcagattctccagcgtag

SEQ ID NO: 4848 - DNA, 810 bp, Pseudomonas aeruginosa
cgccgatgcctaccggcggatccgcaataccacgcgcttcctgctgtccaacctgaacggtttcgatccggccacggatctgctgccgccccaggaaatgctggccctggatcgctgggcggtcgatcgcgccctgctcttgcagcgcgagatcgaagaggcgtaccgcgagtaccgcttctggaacgtctattccaaggtgcacaacttctgcgtacaggagctgggcgggttctatctggacatcatcaaggaccgccagtacaccaccggcgccaacagcgtcgcccggcgctcctgccagaccgcactgttccacatcgccgaggccctcgtgcgctggatcgccccgatcctggcgttcaccgccgaggaagtctggaagttcctgcccggcgagcgcgccgagtcggtaatgctcgccacctggtacgacggcctcagcgaactgccggccgacgtgacgctgaatcgccagtactgggaacaggtcatggcggtgaaggccgcggtcaacaaggagctggagaaccagcgcgcggccaaggccgtgggcggcaacctgcaggccgaggtcaccctgtatacggaagacgcgctgcaggcccaattggccaagctgggcaacgagctacgcttcgtcctgatcacctcgaccgcgaccctggcgccgctgtcggcggctccggccgacgcggtggacagcgaagtcgccggcctcaagctgaaagtggtcaagtcgacccacgccaagtgcggtcgttgctggcaccatcgcgaggacgtcggtcagcacgctgcgcatcctga

SEQ ID NO: 4849 - DNA, 669 bp, Pseudomonas aeruginosa
agaaaggcgagacctggttggccatcgccctggcgctggtgctcggcggcgccctgggcaacctttacgaccgcatggtccttggccacgtggtggacttcatcctggtgcactggcagaaccgctggtacttcccggcgttcaacctggccgatagcgccatcaccgtcggcgccgtcatgctggcgctcgacatgttcagatcgaagaaatccggagaagccgcccatggctgagtcgacccgcattggccaggagagccgcgtcaccctgcatttcgccctcaagctggaggacggcaacgtcgtcgacagcaccttcgacaagcagcctgcctcgttcaaggtcggcgacggcaacctgctgccgggcttcgaacaggcgctgttcggcttgaaggctggcgacaagcgcaccctgagcattcttcccgaacagggcttcggccagccgaatccgcagaacgtgcagatcatgccgcgcgaccagttccaggacatggagctggccgagggcctgctggtgatcttcaacgacgcggccaagaccgaactgccgggcgtggtcaaggcgttcgatgagcagcaggtgaccgtcgacttcaatcatccgctggccggcaagaccctggccttcgaagtcgagatcatcgacgtccagccggcctga

SEQ ID NO: 4850 - DNA, 408 bp, Pseudomonas aeruginosa
caaggttcattcgtccaatcaccgcgtcgcccacgagaccgccatgcaaatcaaactcgccaatccccgcggcttctgcgccggcgtggatcgcgccatcgagatcgtcaaccgtgccctcgatgtcttcggcccgccgatctacgtgcgtcacgaggtggtgcacaacaagttcgtcgtggacaacctgcgccagcgcggcgccatcttcgtcgaggaactcgatcaggtgccggacaacgtcatcgtcatcttcagcgcccacggcgtttcccaggcggtccgcaaggaagccgaggggcgcggcctgaaggttttcgacgcgacctgcccgctggtgaccaaggtgcacatggaagtggtgcgctacagccgcgacggccacgaatgcgtgctgatcgggcatga

SEQ ID NO: 4851 - DNA, 594 bp, Pseudomonas aeruginosa
agggcaccccgaggtggaaggcaccatgggccagtacgatgccagcaacggtggtgccatctacctagtggaggacgaggccgacgtcgccgcgctggaggtgcgcaagcccgaagccctgcactacgtgacccagacgaccctgtcgatggacgacacctcgaaggtcatcgatgccctgcgcgccaagttcccgcagatccagggaccgcgcaagaacgacatctgctatgccacccagaaccgccaggatgccgtgaaggaactggccgaccagtgcgacatggtcctggtggtgggcagccccaacagttccaactccaaccgcctgcgcgaactcgccgagcggatgggcacgccggcctacctgatcgacggcgccgaggacatgcaacgcggctggttcgacggtgtgcgtcgcatcggaatcaccgcaggcgcttccgcgccggaagtgctggtgcgcggcgtgatcgcccagctacgcgagtggggggcgtcggaggagcaggaactggaggggcgggaggagaacattaccttctcgatgcccaaggaactgcgggtcaaggctttgtgaaccgtgcgcaatga

SEQ ID NO: 4852 - DNA, 1260 bp, Pseudomonas aeruginosa
gcgtcaacgctctctgcgacctttcgaccatggcaggcggtccttttgctcgtatcattccgcgacggtcgtatctcgccggattttccccgttgcctcaatcagctgcgggatgaggcgtatgaccgacttttctgcaacccctgtgtgatcgtggaggccctggtgtcggaaagagttgtggtagtgggcgctggcgtcatcggcctgttgaccgcccgggagctggcgctcgccggactgcgggtgaccctggtggagcggggcgagagtgggcgtgaggcatcctgggcgggaggcgggatcgtctcgccgctctatccgtggcgctacagcccggcggtgaccgccctggcgcactggtcgcaggacttctacccggccctggggcagcgtttgctcgacgagaccgggctcgatcccgaggtccataccgttggcctgtactggctggacctggacgaccagaccgaggcactgcagtgggcacgcaagcacacccggccgttgaaggaagtgccgatcgaggaggcctacgcggcggtgcccgggctgggcgccggcttccagcgggcggtctacatgtcgggcgtggccaatgtgcgcaatcctcgcctggcgcgctcattgcgggcatccctgcaacaattcgccaatctcgaactgcatgagcagacggaggtgcgcggctggttgcgcgacggcgatcgagtgctcggcgtggcgacctcgcgtggcgagatccgtggcgacaaggtgctgctggcggcgggcgcctggagcggcgagttgttgaagccgcttggcctggaactgcccgtggtaccggtgaaagggcagatgatcctctacaagtgcgcggcggatttcctgccgcgcatggtgctggccaaggggcgctacgcgattccgcggcgcgacggccacatcctgatcggcagcaccttggaacattcgggcttcgacaagacgccgaccgacgaggcgctggaaagcctcagggcgtctgcggcagaactgttgccggaactggcggacatgcagccggtggcccactgggcagggttgcgcccgggctctcccgaaggcatcccctatatcggtccggtgcctggcttcgacgggctctggctgaataccgggcactaccgcaacgggctggtcctggcaccggcgtcgtgccgtctgctggcggatctcatgagcgggcgggaaccgatcatcgacccggtcccctacgccccggctggtcgcctctga

SEQ ID NO: 4853 - DNA, 1467 bp, Pseudomonas aeruginosa
ggagcgaaaaccaaaaggcctgtcttcggacaggccttttcactttcagtcgatgcccagctttttcaggcggtagcgcatcgagcggaacgtcaggcccaggcgctgggccgcggcggtgcggttccagcgggtctcctcgagcgcctgcatgatcagcttgcgctcgatgtcttccaggtagtcctcgaggttgtctatttcgctcaggctcgcggcgccttcctggctggcacccggcgcatcggccaggcgcaggtcgtgaggctggatctggtcgtcttcgcacagggtgtaggcgcgctccagcatgttttccagctcgcggacgttgcccgggaagcggtagttcttcagcttctcctgtgcgtcgccggtcagcctggcggccggcaggccggtgtcgccggccaggcgcttgaggatgcgttcggcgagcagcgggatgtcctcgcggcgttcgcgcagcggcggtacgcgcagctcgatgacgttgaggcggtagtagaggtcctggcggaagcgcccggcgccgacttcggcggcgaggtccttgtgggtggcgcagaggatgcgcacgtcgacggcgacctcctgctggccgccgaccgcgcgcacggccttttcctggatcgcccggagcagtttgacctgcatggccatcggcaggtcggcgacttcgtcgaggaacagggtgccgccgctggcggcctggaacaggccctgcttgtcttcgatagcgccagtgaagctgcctttcttgtggccgaagaactcgctttccatcagttcggagggaatcgcgccgcagttcaccggcacgaacggccgctcgatacgtggcccctgctcgtggatcaggcgcgccaccagctccttgccgctaccggactcgccactgatgtagaccggcgcctggctgcgcgccagcttgccgatctggttgcgcagggcgcgcatcggcggcgactcgccgagcaggcggttgtccaccggcgcttcctcggcttccgggttgcgcaagcgcagggcggttgccaccagctcccgcaagcgaccgaggtcgaccggtttggtgaggaagtcgaaggcaccggccttgagcgcctggatcgcggtgtccaggctgccgtacgcggtgatcatggccaccggggtctgtggatggcgctgctggatgtactggaccagatcgaggccgctgccgtccggcaggcgcatgtcggtgaggcacaggtcgaacggctcgcgggccagcaactcgcgggcttccttgacgttgcgggcgctgcgggtgtccagcttcatgcggccgagagtgatttccagcagttcgcggatatccggttcatcgtcgacgatcagggctttttgtcggctcatgcgtgcggcttccgtcagctgagtttgcgcgggtgggcgaaggtgatgcggaagcagccgccgccttcctcgcgattgcggtag

SEQ ID NO: 4854 - DNA, 1590 bp, Pseudomonas aeruginosa
tcttccagttcgctggagatcagcaggaccagtaccaggccgatggtcaggcggtacaggtggtacagacggaggatgcgttgcccctgctcctcgctcagccgtagccgttcagcgcgcacggtcgccctggtcctggcgcaggtgcgcctggctgcaataccagcgttgttcgtgggcgagggcgttggcctgcggcacgtggacgccgcaatgggcgcagcggaccatcggcgatgcgctcggctcgtcctgcggacgttgctgctggcgcggagtgggacgggtaaagcgacgccagagccagaacgcgatggcgatcagggcgatccagaacaggaggcggaaaaggcccatggtgatctcggaggctggagaaagctgcagtttagccaagccgccggctcgatcccagccgggaaggtccaggctgtgcggcgtttggcgctgggagaggcatggcggcgggcaaaaagaagggaggcctgcgcctcccttcggtgtttcgtgcgatcagtcgaagagaccgaaggtcatgtagctccaccaggagcggccggagtcctcgtcgtcatcgctctccggcttctcgtcgtcggcgctgtgatcctggttttccggtttcagttcggcggggatctcccgctcggcatcctcgtactgcttgatcacgtccttggcggcttgggtttccatgtgcggcggcggctcgccgccctcgatcaggcccagggtggccttggccagccaggagcgggtgtcggcctcgctttcgcgggcgacgaactcgccatccttgaggctggcgttatccggatagttgagcttgagggtttccaggctggtgctggccaggtcgtcgagacccaggcgacggtaggcttcgaccatgatcgccaggccatcgccgacggccggggtttcctggaagttctctaccacgtagcgaccgcggttggcggcggcgacataggcctggcgcttcaggtagtagtggccgacgtgcacttcgtaggccgccagcaggttgcgcaggtacaccatgcgcgccttggcgtccggggcgtagcggctgttggggaagcggctggtgagctgggcgaactcgttgaaggagtcgcgggcggcgcccgggtcgcgcttggtcatgtccagcggcaggaagcgcgccagcaggccgcggtcctggtcgaaggaggacaggcccttgaggtagtaggcgtagtcgacgttggggtgctgcggatgcaggcggatgaagcgttcggcggcggcgcgggcggcttcgggctccatgttcttgtagttggcgtagatcagctcgagctgggcctgctcggcgtagcggccgaagggatagcgcgattcgagggctttcagcttggtgacggcgctgttgtagctcttgttgttgaggtcgtcctgcgcctgctggtacagctggctctcgctcaggttctcgtcgacagtctccttgttcgaggagcaggctgcggtgagggcgaggatggcgatcagcagcaggtgtttcacttgcatggcggcttgcgtccctgggacggtcggcttggcctcaaccgtctgttatga

SEQ ID NO: 4855 - DNA, 1704 bp, Pseudomonas aeruginosa
gcatcgtctcctactcatgtccgatatgattcaacgcgcggccgaggtgccgttcgagctgggtggccagcgtctcgaccagatcgccgcccagctttttcccgaacactcccgctcccgtctggccggctggatcaaggacggacgcctgaccgtcgacggcgccgtgctgcgcccgcgcgacatcgtccacagcggcgcgcaactggtcctggaggccgagcaggaagcccagggcgagtggctcgcacaggacatcgagctggaaatcgtctacgaggacgagcacatcctggtgatcgacaagcccgccggcctggtggtccatccggctgccggccatcaggacggcaccctgctgaatgccttgctctaccatgtcccggacatcgccaatgtgccgcgcgccgggatcgtccaccgcctggacaaggacacgaccggcctgatggtagtggccaagacgctggaggcccacaccaagctggtggcgcaactgcaggcacggtcggtcagccgcatctacgaggcgatcgtgatcggcgtgatcacctccggcggcaccatcgatgcgccgatcggacggcatggcgtgcagcggcagaagatggcggtggtcgacgccggcaaggtggcggtcagccattaccgcgtgctggaacgcttccgtgcgcacacccatacccgggtcaagctggagaccgggcgtacccaccagatccgcgtgcacatgagccatatcggctatcccctggtcggcgatccggtctacggtgggcgcttcaggattcccccggtggccagccagaccctggtccagactcttcgcgagttcccccggcaggcgctgcacgcgcgcttcctcgaactggatcacccggccaccggcgtgcgcatgaagtgggagtcgccgctgccggaagacttcctctggctgctcagcctgttgcgccaggatcgcgaggcgttcgtcggatgaacgcctggctgacccccggctggccggcgccggcccgtgtgcgggcctgcgtgaccacgcgcagtggcggggtcagccaggcacccttcgacagtctgaaccttggcgcccacgtcgacgacgatccgcgcgccgtggaagaaaaccgccgacgcctgaccgagcgcctggaatgccggccgagctggttggaccaggtgcacggagtgacggtggtggaggccgacccgagccgggtgctcagggccgacgccagctggagcgcgatgccgggcgtcgcctgtacgatcatgaccgccgactgcctgccggcgttgttctgcgaccgctcgggcacccgcgtggccgcggcccatgccggctggcgcgggctggcggcgggcgtgctggaggcgacggtggacagcctgggcgtgcccggcgacgaactgctggtgtggctggggccggcgatcggcccgcaggccttcgaggtcggcggcgaggtccgcgatgcattcgtcgctgcgcacgccgaggcgcgctcggctttcgtacctagcgccaatccgggccgcttcatggccgacatctaccgactcgcgcggatccgcctgggcgcccatggcgtcaccgccgtgcatggcggcggcttctgcaccttcagcgataccgcgcgcttctattcctaccgccgctcgtcgcgtaccggccgttttgccagcctggtctggctccaggactag

SEQ ID NO: 4856 - DNA, 1107 bp, Pseudomonas aeruginosa
  unsure (1016): Identity of nucleotide at the above locations are unknown.
cctgaactcacgcgagcggaacgccgcgccgttgtccgtcagcagtcgctgcacggtgatgcccaggcgggcgtaataggccacggcattgcgcaggaacaggaccgcctgcgccgtcttctcatcgggatgcatggcggtgaacgccaaccttgcgtgatcatcgatggccacgaacagcgtctcccagcctgcaccatcgaccgagtcgcgacggttgcctgtgacgcggtggctgggccgcacgatgcgcccgagcttcttggtgtcgatgtgcaacaggtccccgggcgcctcgtgctcgtagcgcacaacggcttcgacgggctccaggtcgctcaacctggacatgcccgctcgcgccagaacgttcgggtgcccaaggccaacagcgggcctttcgtgattcccgacgtaatggaagacgaacgcgtgctgttcctcagcgacatcctccccaccggctaccaggcggtgcgcaatgccggcgtccgccagggcagtatcgtggcgatctacggcgccggcccggtcggcctgatggccgccgcctgcgcgcggatgttgggcgccgagcggatcttcatcgtcgaccaccatccctaccggctggacttcgccgagcgcacctacggtgcgattcccatcgacttcgaccaggaggacgatcccgccgcggcgatcatcgagcgcaccgacgggcaccgcggcgtcgacgcggtgatcgacgcggtgggctttgaggccaagggcagcgtcaccgaaaccgtgctcaccgcgctcaagctcgaagccagcagcggcaaggcactacgccagtgcatcgcggctgtccggcggggtggcacggtgagcgtgccgggcgtgtatgccggcttcatccatggcttcctgttcggcgatgccttcgacaagggcttgaccttcaagatgggccagacccatgtacaggcactgctgccggccttgctcgaacacatcggcaacggcgacctgcatcccgaggcgatcatcanccaccgcctgcgtctggacgacgcaccggagggctacgccctgttcgacgaaaaacgcgaggattgccgcaaggtcctcctgcgcccatga

SEQ ID NO: 4857 - DNA, 951 bp, Pseudomonas aeruginosa
cctcttgacgcttcacagctagatagctccgagcactgcacgggggaacgcgcacgaatcactccggtttggttctggcggtgcgtattcgagacattctacgaaaccggcatccgtctgaatgcgctgctgtgcattcgtaagtgcgatgtggactggaaaagaaaaatgatcctgatccgggctgagacagagaaaacccaccgagagttttccgtccccatcaccgatgggatagccccccatatacggcggctactccaggaagccgagcaggtaggcatgagccaccacgaccagctattcaatgtgaatcgtttctcacgccactatgcacgcaaggaaatgaatgccgaccaagtcgaggcgatgtacagaaagttgaccgagaagaccggggtacgaatgacgccccatcgattcaggcacaccctggcttccgacttgatgaagcagcatgagcgcaatatccatgtcgccaaggatctactcaaccactccaacatccaaacaacaatgagctatatcgagacggatcacgatcagattcgggcagtgcttaacgagcgaagcctagctcagggcgccgtggcacagacccgaaaggtcgattacagtggatcgccgcagaaggcggctcattcaaggccggcgctgccacgcccaactcagagaggaagcagtccgtcgacacaggtacccacagcagaagtgacgagtacggggtctgatcaggagattcaggcttacaactcaccacccttctgtactcaaagaagagccgacgcggtacccccaccagcggacaactccgaacaggacttgctgttcgcgctgctggcccaacacctgttgcgacaggcaagcctgacgacaaccgagggcaactgcgctcctagatggggtaccgttgtcggaaagaaagcaagccccccgttggccgatcggtag

SEQ ID NO: 4858 - DNA, 819 bp, Pseudomonas aeruginosa
cccggaggcgcgccgatcaggcgggccaccgagtgtttctccatgaactcggacatatcgatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatatcctcgaggtcggcgtattcgcgctcgagcttgacgatatcctcctccagcttggccaggcgcttcctggtggcttcgtcgtcttccttcttcagcgcctcgcgctcgatcttcagctggatcaggcgacggtcgagacgatccagttcctctggcttggagtcgatctccatgcggatgcggctggcggcctcgtcgatcaggtcgatggccttgtccggcagttgccgatcggtgatgtag

SEQ ID NO: 4859 - DNA, 1116 bp, Pseudomonas aeruginosa
cgttccttgagaccacggaggatggcgatcgtgtcttcctcgctcggttcgtccaccagcaccttctggaagcggcgctccagcgcggcatccttctcgatgtactggcgatactcgtcgagggtagtagcaccgacgcagtgcagctcgccgcgcgccagagccggcttgagcatgttgccggcgtccatggcaccttccgccttgccggcaccgaccatggtgtgcagttcgtcgatgaacaggatgacccggccttcctgcttgcccagttcgttgaggactgccttcaggcgttcctcgaactcgccgcggaacttggcaccggcgatcagcgcccccatgtccagggccagcaggcgcttgtccttgaggccgtccggcacttcgccgttgatgatgcgctgggccaggccctcgacgatggcggtcttgccgacgccgggttcgccgatcagcaccgggttgttcttggtccgccgctgcaggacctggatggtccggcggatttcgtcgtcgcgaccgatcaccggatcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatgaactggtcgcccttctgctgggccaggcggtcagcctggttgagcaggcgtgcgagatcctgggacaggttcacgtcgccggtcgggctctggatcttcggcagcgcgtcgagttctttgttgaggccgctgcgcagggcggcgatatcgaagccgacctgcatcagcaggggcttgatcgaaccgccttgctgctcgagcagggcggaaagcaggtgcaccggctcgatggccggatggtcatggccaacggccagggactgggcgtcggagagcgccagttgcagcttgctggtcaaacggtctattcgcatgggtcgtccttccttctatagagcgggccggaacgatgggtgtccctga

SEQ ID NO: 4860 - DNA, 186 bp, Pseudomonas aeruginosa
agaaaagcccgccgagatgactcagtagataagggcgattttccgcggttcaagcgaccggaccgtgacatcggtcagttgccgccggataacctgcgcgggcctagtcctggagccagaccaggctggcaaaacggccggtacgcgacgagcggcggtaggaatagaagcgcgcggtatcgctga

SEQ ID NO: 4861 - DNA, 1041 bp, Pseudomonas aeruginosa
ccccgccactgcgcgtggtcacgcaggcccgcacacgggccggcgccggccagccgggggtcagccaggcgttcatccgacgaacgcctcgcgatcctggcgcaacaggctgagcagccagaggaagtcttccggcagcggcgactcccacttcatgcgcacgccggtggccgggtgatccagttcgaggaagcgcgcgtgcagcgcctgccgggggaactcgcgaagagtctggaccagggtctggctggccaccgggggaatcctgaagcgcccaccgtagaccggatcgccgaccaggggatagccgatatggctcatgtgcacgcggatctggtgggtacgcccggtctccagcttgacccgggtatgggtgtgcgcacggaagcgttccagcacgcggtaatggctgaccgccaccttgccggcgtcgaccaccgccatcttctgccgctgcacgccatgccgtccgatcggcgcatcgatggtgccgccggaggtgatcacgccgatcacgatcgcctcgtagatgcggctgaccgaccgtgcctgcagttgcgccaccagcttggtgtgggcctccagcgtcttggccactaccatcaggccggtcgtgtccttgtccaggcggtggacgatcccggcgcgcggcacattggcgatgtccgggacatggtagagcaaggcattcagcagggtgccgtcctgatggccggcagccggatggaccaccaggccggcgggcttgtcgatcaccaggatgtgctcgtcctcgtagacgatttccagctcgatgtcctgtgcgagccactcgccctgggcttcctgctcggcctccaggaccagttgcgcgccgctgtggacgatgtcgcgcgggcgcagcacggcgccgtcgacggtcaggcgtccgtccttgatccagccggccagacgggagcgggagtgttcgggaaaaagctgggcggcgatctggtcgagacgctggccacccagctcgaacggcacctcggccgcgcgttgaatcatatcggacatgagtag

SEQ ID NO: 4862 - DNA, 765 bp, Pseudomonas aeruginosa
ggccaagccgaccgtcccagggacgcaagccgccatgcaagtgaaacacctgctgctgatcgccatcctcgccctcaccgcagcctgctcctcgaacaaggagactgtcgacgagaacctgagcgagagccagctgtaccagcaggcgcaggacgacctcaacaacaagagctacaacagcgccgtcaccaagctgaaagccctcgaatcgcgctatcccttcggccgctacgccgagcaggcccagctcgagctgatctacgccaactacaagaacatggagcccgaagccgcccgcgccgccgccgaacgcttcatccgcctgcatccgcagcaccccaacgtcgactacgcctactacctcaagggcctgtcctccttcgaccaggaccgcggcctgctggcgcgcttcctgccgctggacatgaccaagcgcgacccgggcgccgcccgcgactccttcaacgagttcgcccagctcaccagccgcttccccaacagccgctacgccccggacgccaaggcgcgcatggtgtacctgcgcaacctgctggcggcctacgaagtgcacgtcggccactactacctgaagcgccaggcctatgtcgccgccgccaaccgcggtcgctacgtggtagagaacttccaggaaaccccggccgtcggcgatggcctggcgatcatggtcgaagcctaccgtcgcctgggtctcgacgacctggccagcaccagcctggaaaccctcaagctcaactatccggataa

SEQ ID NO: 4863 - DNA, 465 bp, Pseudomonas aeruginosa
accggatatccgcgaactgctggaaatcactctcggccgcatgaagctggacacccgcagcgcccgcaacgtcaaggaagcccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctgcgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggtag

SEQ ID NO: 4864 - DNA, 924 bp, Pseudomonas aeruginosa
cggcaaggagctggtggcgcgcctgatccacgagcaggggccacgtatcgagcggccgttcgtgccggtgaactgcggcgcgattccctccgaactgatggaaagcgagttcttcggccacaagaaaggcagcttcactggcgctatcgaagacaagcagggcctgttccaggccgccagcggcggcaccctgttcctcgacgaagtcgccgacctgccgatggccatgcaggtcaaactgctccgggcgatccaggaaaaggccgtgcgcgcggtcggcggccagcaggaggtcgccgtcgacgtgcgcatcctctgcgccacccacaaggacctcgccgccgaagtcggcgccgggcgcttccgccaggacctctactaccgcctcaacgtcatcgagctgcgcgtaccgccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctacaccctgtgcgaagacgaccagatccagcctcacgacctgcgcctggccgatgcgccgggtgccagccaggaaggcgccgcgagcctgagcgaaatagacaacctcgaggactacctggaagacatcgagcgcaagctgatcatgcaggcgctcgaggagacccgctggaaccgcaccgccgcggcccagcgcctgggcctgacgttccgctcgatgcgctaccgcctgaaaaagctgggcatcgactgaaagtgaaaaggcctgtccgaagacaggccttttggttttcgctcctcagaggcgaccagccggggcgtaggggaccgggtcgatga

SEQ ID NO: 4865 - DNA, 798 bp, Pseudomonas aeruginosa
ggctttccagcgcctcgtcggtcggcgtcttgtcgaagcccgaatgttccaaggtgctgccgatcaggatgtggccgtcgcgccgcggaatcgcgtagcgccccttggccagcaccatgcgcggcaggaaatccgccgcgcacttgtagaggatcatctgccctttcaccggtaccacgggcagttccaggccaagcggcttcaacaactcgccgctccaggcgcccgccgccagcagcaccttgtcgccacggatctcgccacgcgaggtcgccacgccgagcactcgatcgccgtcgcgcaaccagccgcgcacctccgtctgctcatgcagttcgagattggcgaattgttgcagggatgcccgcaatgagcgcgccaggcgaggattgcgcacattggccacgcccgacatgtagaccgcccgctggaagccggcgcccagcccgggcaccgccgcgtaggcctcctcgatcggcacttccttcaacggccgggtgtgcttgcgtgcccactgcagtgcctcggtctggtcgtccaggtccagccagtacaggccaacggtatggacctcgggatcgagcccggtctcgtcgagcaaacgctgccccagggccgggtagaagtcctgcgaccagtgcgccagggcggtcaccgccgggctgtagcgccacggatagagcggcgagacgatcccgcctcccgcccaggatgcctcacgcccactctcgccccgctccaccagggtcacccgcagtccggcgagcgccagctcccgggcggtcaacaggccgatga

SEQ ID NO: 4866 - DNA, 576 bp, Pseudomonas aeruginosa
ggcaacggggaaaatccggcgagatacgaccgtcgcggaatgatacgagcaaaaggaccgcctgccatggtcgaaaggtcgcagagagcgttgacgctcaccgagctgctgtttgcgctggttctgctgggaatactgggaagcctggcgctgcccgggatggcagcctggctggacggcaatcgcgagcgaagtgtgttgcacgagctgagcgcgagcatccagctgggcagaacccatgccgtcgcctaccagcgcccggtgacgctctgtccgtcgaccgatggccgtcactgcggcagcgactggggagagggctggctgcttgcggaagacggtggggaacggcttctcgtgggacgcgcgcttgcaaagaaggaaaggctccgctggaaccgttcgaaccgcctcaggttcctccccagcggccagctcaacattcacaacgggcggtttctgctctgcggaaggcataccgttgcctggcaactgatcctcaaccggcagggccggctccgtaccgcgagcgccagggagaaccgggagaaacgtgagctatgcagcacttccggatga

SEQ ID NO: 4867 - DNA, 525 bp, Pseudomonas aeruginosa
accccctggagcaaccgcatgtcatatcgttccaactcgaccggcttcaccctgatcgagttgctgatcatcgtcgtcctgctggccatcatggcgagcttcgccattccgaacttcaagcagctgacagaacgcaacgaactgcagagcgccgccgaggaactcaatgcgatgctgcagtacgctcgcagcgaagccgtgtcccagaggcgcgcgatcagcatccaggcgctgaaggacaaggactggggcaagggcctgagcataggtgtcctggcctccggctcgatcgccgcgcccctgcgcaaacacgacggcttccgtgccgccacgctgacagcgaaggaaaagagcgccgtggaacatctgaccttcacggccaacggtaccctcgtaccgccaacggaacgaaccttcgcaatctgccagaacggcaagaccgacgggggccgcgtgctgagcatcagccaggccggccggatccaactcgaaccttcctccaaggcgccccagtcatgctattga

SEQ ID NO: 4868 - DNA, 387 bp, Pseudomonas aeruginosa
agagcgactactacatctgccgcagctcgaagccgggcgactgcgacggcaagggctccatgctggaaatccgccttgcctggcgcggcaagcaaggcgcctgcgtcaacgccgccgacagcagcgccgacacctccctctgctactacaccctcagggtcgagccatgagcatgaacaaccgctcccgacggcaatcgggcctgtccatgatcgaactactggtggccctcgccatcagcagcttcctgattctcgggattacccagatctacctggacaacaagcgcaactacctgttccagcaaggccaggcaggcaaccaggaaaacggacgcttcgccatgatgttcctggaccagcaactggccaaggtgggtttccgtag

SEQ ID NO: 4869 - DNA, 645 bp, Pseudomonas aeruginosa
caaggaccgcctctaccagatcgccaagggcagccagacactcaggaatctcgtgccatgaacaacttccctgcacaacagcgcggcgccacgctggtcatcgccctggcgatcctggtgatcgtcaccctgctggcggtctcgagcatgcgcgaagtggtactggaaagccgcatcaccggcaacgtcatcgaacagactcgcttgcagaacgccgccgagtccggactccgcgaaggcgagcggcgcttcgtcaacaccctgcgtccgccggagcccggcaccggttgtacggccgacaacgtggcccgcccctgcctgctggacctcgccgcgctgaacctgaagctggcggacacccaccagaatccggtcggcgtgctgaagggcatcgccaatacctggatgagttaccgcggcagcgacatcagcagcgcgaccaccgcgggcacgctctacagcgtgcagtggaacaacctgcccattccctcgggcggccaggtcaacgaagcggaaagccccgaatacggcaacctgatgcgcggcatcggcaccttctactacgagaccaatagcgtcgcgcgcaaccagaccaacagcgaaaccgtcctgcagaccgttctcgcccgtctctataccaactga

SEQ ID NO: 4870 - DNA, 408 bp, Pseudomonas aeruginosa
accccggtccgaacacccgtggccgccagaactggcgccccatcgaaggaaagaactgatatgaaagtgctgcctatgctgctggccctggccgttcccggcctctgctgggccgaagatccccagaccttcgaaggcgctggcgtggtcttcgaagtccaggtcgagaagaacctggtggacatcgaccaccggctctaccgcctgcccaacagcaccgtcaggaacggcatgcccagcctgttccaggtcaagccgggctccgtggtgtcctactctggcaccgtcagccagccgtggtccaccatcaccgatatctacattcacaaacagatgagcgaacaggagctggccgagatgatcgagaaagaacagccccgccaggacggggaggagcagccccgatga

SEQ ID NO: 4871 - DNA, 417 bp, Pseudomonas aeruginosa
ctgggcgatcacgccgcgcaccagcacttccggcgcggaagcgcctgcggtgattccgatgcgacgcacaccgtcgaaccagccgcgttgcatgtcctcggcgccgtcgatcaggtaggccggcgtgcccatccgctcggcgagttcgcgcaggcggttggagttggaactgttggggctgcccaccaccaggaccatgtcgcactggtcggccagttccttcacggcatcctggcggttctgggtggcatagcagatgtcgttcttgcgcggtccctggatctgcgggaacttggcgcgcagggcatcgatgaccttcgaggtgtcgtccatcgacagggtcgtctgggtcacgtagtgcagggcttcgggcttgcgcacctccagcgcggcgacgtcggcctcgtcctccactag

SEQ ID NO: 4872 - DNA, 537 bp, Pseudomonas aeruginosa
gtagatggcaccaccgttgctggcatcgtactggcccatggtgccttccacctcggggtgcccttcatgcccgatcagcacgcattcgtggccgtcgcggctgtagcgcaccacttccatgtgcaccttggtcaccagcgggcaggtcgcgtcgaaaaccttcaggccgcgcccctcggcttccttgcggaccgcctgggaaacgccgtgggcgctgaagatgacgatgacgttgtccggcacctgatcgagttcctcgacgaagatggcgccgcgctggcgcaggttgtccacgacgaacttgttgtgcaccacctcgtgacgcacgtagatcggcgggccgaagacatcgagggcacggttgacgatctcgatggcgcgatccacgccggcgcagaagccgcggggattggcgagtttgatttgcatggcggtctcgtgggcgacgcggtgattggacgaatgaaccttgctaccgccctccccgcttgggaagggcgcagcgaccgacggttcaggccggctggacgtcgatga

SEQ ID NO: 4873 - DNA, 2571 bp, Pseudomonas aeruginosa
ctcgttgcccagcttggccaattgggcctgcagcgcgtcttccgtatacagggtgacctcggcctgcaggttgccgcccacggccttggccgcgcgctggttctccagctccttgttgaccgcggccttcaccgccatgacctgttcccagtactggcgattcagcgtcacgtcggccggcagttcgctgaggccgtcgtaccaggtggcgagcattaccgactcggcgcgctcgccgggcaggaacttccagacttcctcggcggtgaacgccaggatcggggcgatccagcgcacgagggcctcggcgatgtggaacagtgcggtctggcaggagcgccgggcgacgctgttggcgccggtggtgtactggcggtccttgatgatgtccagatagaacccgcccagctcctgtacgcagaagttgtgcaccttggaatagacgttccagaagcggtactcgcggtacgcctcttcgatctcgcgctgcaagagcagggcgcgatcgaccgcccagcgatccagggccagcatttcctggggcggcagcagatccgtggccggatcgaaaccgttcaggttggacagcaggaagcgcgtggtattgcggatccgccggtaggcatcggcgctacgctggagaatctgctgggataccgcgatctcgcccgagtaatcggtcgaagccacccacaggcgcaggatgtcggcgcccagggtatcgatgacggtctgcggcaccacggtgttgcccagcgacttggacatcttgcggccggactcgtcgacggtgaaaccgtgggtcagcaactggcggtacggcgcatggttgtcgatcgcgcagccggtcagcagcgaggagtggaaccagccgcggtgctggtcggaaccttccaggtagagatcggcgaccgggccgctggcatggccgatccggtgggaaccacgcagcacgtgccaatgggtggtgccggagtcgaaccagacgtccagggtgtcgttgattttctcgtactgcgcggcgtcctcgccgagcagctcggcggcgtcgagcttgaaccaggcttcgatgccttccttctcgactcgctgcgcgacctcttccatcagctccacggtgcgtggatgcagttcgccactggccttgtgcaggaagaacgggatcggtacgccccagttgcgctggcgcgagatgcaccagtcgggacgcccggcgatcattccgtgcagacgcgcctggccccagcccgggacgaattcggtctgggtgatggcttccagcgctcgctcgcgcagggaagcaccctgcctgggctgcttgtccatgccgacgaaccactgcgcggtggcgcgatagatcagcggcgtcttgtgccgccagcagtgcatgtagctgtgattgatggtttcgtgggccagcaggctgccgacctcttccagcttggccaccacgttggggttggccttccagatgaactggccgccgaagaacggcaacgagtcgacgtagacgccgttgctctgcaccgggctgaggatgtcgtcgttgctcatcccgtagcgcttgcaggtatagaagtcgtcttcgccgtaggccggcgacgagtggacgataccggtgccggcatcgagggccacgtagtcggccaggtacaccggcgacaggcgctcgtagaacggatggcggaagttgatcagctccagcgcctcgcccttggcggtggcgaccaccttgccctcgcgctggtagcgcgccaggcaggactcgaccagggcctcggccagcaccaggtagcgatcgccggcatcgaccagcgcgtagtcgatctccggatgcacgttcagcgcctggttggccgggatggtccagggcgtggtggtccagatgacgatctgcgccggcttgtccagggccgccaggccgaaggccgcggccagcttgtcggcatccgccaccgggaagccaacgtcgatggtcggcgacttcttgtcggcgtactcgacctcggcctcggccagcgccgaaccacagtcgaagcaccagttgaccggcttcaggcccttgaacacgaagtcctgcttgaccatttccgcgagggcgcggatttcgttcgcctcgttggcgaaattcatggtcttgtaggggttgtcccactcgccgagcacgcccaggcggatgaagtcggccttctgcccttcgatctgctcggccgcgtattcgcggcacagttcgcgggtcttgtccgccggaagattcttgccgtgggtggtctcgaccttgtgctcgatgggcaggccgtggcaatcccagcccggcacatagggcgcgtcgtagcccgccagggtcttggagcggacaatgatgtccttgagaatcttgttgaccgcgtgaccgatgtgaatgctgccgttggcgtacggagggccatcgtgcaggacgaacttcggacggtcgccgccaatggcccgcagcttctggtacagaccgatgtcgttccagaacttcagggtttccggctcgcgctggggcaggccggctttcattgggaaggcggtttccggaaggtttag

SEQ ID NO: 4874 - DNA, 795 bp, Pseudomonas aeruginosa
atgttggccgtgggcgagcccagttgccggccgagtttctgtccatgcaggacccgtccgctcaggctgaagggacgccccagaaggcgctcggcgagatgcaggtcgccctcggccagggcctggcggacccgcgtgctgctcacccgcacaccgtccagttcgacggtggtggccgcctcgacggtgaacccctgctcgcgactggcgttcaccaggaaggcgaagtcaccggagcggtcgcagccgaaacggaaatcgtcgcccacttcaagatgccgcaccgccagtccatcgaccaggacctggcggacgaactcggctgccgacagctcgcgcaagcggcggttgaaggccaggcagagcaccacatcgacgccctgcccacgcagcaactcgagtttctcgcgcaggcgggtcaggcgcaccggcgccgaatcgggggagaagaactcgcgcggctgcggctcgaaaatcaccacgcagctgggtacgcccagctccagcgagcgctcgcgcagacgcgccaggatagcctggtgcccgaggtggacgccgtcgaagttaccgatggtggcgacgcagcccccggccaggggctgcaggttgtgtagtccgcgaagcagctgcatagcacgcttattgctcagaaagtggtcgattatacgcgtaccgggcgccggacaacaggcaaaacggcatgatcccgccgccagcccggacgcgcttcacagcaccgcccggcgggaaaagtcgcgcaggcggaaacccagcagcgcgagcataccgaaatag

SEQ ID NO: 4875 - DNA, 354 bp, Pseudomonas aeruginosa
caacccctggaggcgacggcattattcgcggccttaatttgttcgctatttacccagtttttttcgaggagctcgacggtggccaacacaccttccgccaaaaaacgcgccaaacaggctgagaagcgtcgcagccacaacgccagcctgcgctccatggtgcgcacctacatcaagaacgtcgtgaaagccatcgacgccaaggacctggaaaaagcccaggccgccttcaccgccgctgtaccggtgatcgaccgcatggctgacaaaggcatcatccacaagaacaaggctgctcgtcacaagagccgtctgagcggccacatcaaggccctcagcaccgctgccgcctaa

SEQ ID NO: 4876 - DNA, 1308 bp, Pseudomonas aeruginosa
ttgaccaggccgcgcgccactttcgcgcccgccctggtccacacagaccaccatctcgccgcgacggaagctgccctggaccgccttgaccccaaccggcaacaggctcttgtgatcctggctcaccgccttcaccgccccatcgtccagcaccagggtgccgcgcatctgcaagtggccggccagccattgcttgcgcgccgccttgcgactgcgatcaggggtcaacagggtgccgaggcgttcgccggcgcgcaggcggtcgaggacacgctcgatacgcccgccgacgatcaccgtatgcccgccggaacgcgccgccaggcgcgccgcccgcagcttggtctgcattccgccgcgccccagggcgccggcactgccgccggccaccgcatcgagctgcggatcatcggcacgcgcctcgtagatcagttgggcatcgggattgttgcgcggatcggcgtcgaacatcccgtcgcgatcggtaaggatcaccagcaggtcggcctcgaccaggttggccaccagtgccgccagggtgtcgttgtcgccgaagcggatctcgtcggtgaccaccgtgtcgttctcgttgatcaccgggaccacgcccagctcgaccagggtccgcagggtgctgcgggcgttcaggtagcgcttgcggtcggagaggtcgtcatgggtcagcaacacctgggcggtctgcaggccatgcagggcgaagctggactcccaggcctgcaccaaccccatttgccccaccgaggcggcggcctggagttcgtgcatcgcgctaggtcgggacacccagcccaggcggctcataccggcggcgacggcgccggacgacaccagcaccagctcgatgccggcgcaatgcagcgccaccatctgctcgacccaaacggccatggcattgcgatccagcccacggccatcggccgtcagcagggcgctaccgatcttcaccacccagcgccgcgcgcctgtcaccttgtcccgcataccctcaaccttagaagcccaggcttcgactcttcagccccgccggcccgcccggcggggtatcacgccatcagggaacgtagaagatctccggaccgtcgccgtcgtcttcctcatcatcgaaatcatcgtcatccaccgcaccggcgttcttcagacccgaacgccgcagcgcgcgcgcatcgtccagggcctgcagacgggcccgcgcctcgtcctcgatacgccggtcgagttcggccagttcctcggcatactgcggatcttcttccaggcgcagggtacgctcgtcgagatagcgcatga

SEQ ID NO: 4877 - DNA, 1026 bp, Pseudomonas aeruginosa
cagtcccccccctgccacctagcatgccgcgcaatctttgtggagctattgtcactgatgcaaccccaggccttctaccgcgtggtggcggaagatttcaccgccgtcgacgggatcatccgtcgccaactcacctcccgcgttcccctggtggaaaagatcggcgactacatcatctccgccggcggcaagcgcctgcgcccgctgctggtcctgctcgccggcaagaccctgggctacaagggcgacgacctctgcctgctggccgccaccatcgaattcctgcacacctccactctgctgcacgacgacgtggtcgacgcctccggcctgcgccgcggccgctccaccgccaatgccctgtggggcaacgcgccgagcgtgctggtaggcgacttcctttatgcccgctccttcgaaatgatggtcgagctgggttccatgccggtcatgcgcatcatatcccaggccacccgggtgatcgccgagggcgaagtgctgcaattgtccaaggtacgcgacgccagcactaccgaagagacctacatggaagtgatccgcggcaagaccgcgatgcttttcgaggcctcgacccacagcgccgccgcgctgtgccaggccggcgaggaacagtccgaggcactgcgccgcttcggcgactacctgggaatcgccttccagctggtggacgacctgctcgactaccgcggcgacgccgcgaccctcggcaagaacgtcggcgacgacctcgccgaaggcaagcccaccctaccgctgatcgtcaccatgcgtgacggcaccgaggagcaggccgcgctggtacgcaaggccatccagcaaggcggcagccaggacctggagagcgtctgtgccgccgtcgaggctgccggcgccctggactataccgccaacctcgcccgcgactacgccgcccgcgccatcgcctgcctggatacgctgccggacaacgaataccgctccgccctggtcgaactcagcgaattcgctgtcgcccggacccactga

SEQ ID NO: 4878 - DNA, 423 bp, Pseudomonas aeruginosa
ggaacagcgccggcgagatgctcttcccaccgctgtggggcgacgagtcgttcaatatcggcgccggcatggcgcggaccttcaccgctgccgccttcgtcaagcacaacatgccggtcggcttccaggaacgcttcccgctcggccagggcggcctcagcgaccaggacgcagtggacgtcgcggagtacttttcgcaccagccgcgcccggacttcccggacaagatcaaggactggccgaaggacaagcgtccgctggatgcccgctactgatgccgcaatgaaaaacgccccgtcgatgcgtcgacggggcgtttcgctccttcctggggccgatgcgcctcagaggatttccagcagttcgacgtcgaacaccagcacgctgtgcgggggaatgctgccgaccgcctggccgccatag

SEQ ID NO: 4879 - DNA, 651 bp, Pseudomonas aeruginosa
atgccgccctccagcgacaccaggtgcaaggcgtcgatatgtccggcctggacccggccggcgagatcctgcatgttcatcgcgaacctctcgaggttgcgcaggcagcggaagcctccaggtttccgccaaccgcctcggtcccgacagcgccggcccgattcccggcatcgtccggccggcaggccccgacgatgcgaaggacgcccgctcccggcgtccgcccgatatcacaggaaagtcttgcccaggcggcaggcaacgcaagccggaaacaccgccgcccgtccgttttacaacggccgggcggcgcgagcgaaacactggagagggtcgtcagtgacgggtctgcttatccaggtagcccatggcgaacgccgagagcacgaaggtcatgtggatgatcacgtaccacatcagcttgttgtccggcacattcttcgcgtccatgaagatgcgcaacaggtggatcgaagagatcgccacgatggaggcggccaccttgttcttcagcgagccggaatccatcttgcccagccagctgagcttttccttgccttcgtcgatgtccagttgcgaaacgaagttctcgtagccggagatcatcaccatgaccaacaggccgccaaccagagccatgtcgatcagtga

SEQ ID NO: 4880 - DNA, 588 bp, Pseudomonas aeruginosa
  unsure (383): Identity of nucleotide at the above locations are unknown.
ggttgtacgttaatcccagaaaaacccgagaacccgggaaaccggaacgggaagaaaattcagagattggaggaactagtggaggaagacccgaaagggccccacaagggggtgggtcgttttggaagaaccgggacccggaaaacccttgagaaactgggtcagcggtacccgcaacatgggcgagcagaccggcgaaaccccggaaagcgtcccccccgaggaagaagcgccagtgcggatgcggcgaggagcgacggcgcgccgagtgaccccccgcgccgcgatggctcatgggcgcaggaggaccttgcggcaatcctcgcgtttttcgtcgaacagggcgtagccctccggtgcgtcgtccagacgcaggcggtggntgatgatcgcctcgggatgcaggtcgccgttgccgatgtgttcgagcaaggccggcagcagtgcctgtacatgggtctggcccatcttgaaggtcaagcccttgtcgaaggcatcgccgaacaggaagccatggatgaagccggcatacacgcccggcacgctcaccgtgccaccccgccggacagccgcgatgcactggcgtag

SEQ ID NO: 4881 - DNA, 1077 bp, Pseudomonas aeruginosa
tgccttgccgctgctggcttcgagcttgagcgcggtgagcacggtttcggtgacgctgcccttggcctcaaagcccaccgcgtcgatcaccgcgtcgacgccgcggtgcccgtcggtgcgctcgatgatcgccgcggcgggatcgtcctcctggtcgaagtcgatgggaatcgcaccgtaggtgcgctcggcgaagtccagccggtagggatggtggtcgacgatgaagatccgctcggcgcccaacatccgcgcgcaggcggcggccatcaggccgaccgggccggcgccgtagatcgccacgatactgccctggcggacgccggcattgcgcaccgcctggtagccggtggggaggatgtcgctgaggaacagcacgcgttcgtcttccattacgtcgggaatcacgaaaggcccgctgttggccttgggcacccgaacgttctggcgcgagcgggcatgtccaggttgagcgacctggagcccgtcgaagccgttgtgcgctacgagcacgaggcgcccggggacctgttgcacatcgacaccaagaagctcgggcgcatcgtgcggcccagccaccgcgtcacaggcaaccgtcgcgactcggtcgatggtgcaggctgggagacgctgttcgtggccatcgatgatcacgcaaggttggcgttcaccgccatgcatcccgatgagaagacggcgcaggcggtcctgttcctgcgcaatgccgtggcctattacgcccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccagtcagcgttgcgcgagtgggcctacggctggacctaccagaactcagcccatcgaaccgatgccctggcaagctggcaacaccactacaactggcatcgcccgcacagcggcatcggcggcatcgcgcctatgtccagactcaactcgtcaagaaataacctcttgacgcttcacagctag

SEQ ID NO: 4882 - DNA, 357 bp, Pseudomonas aeruginosa
aaaagccccgccgaagcggggctttccctgtccgtccacgaagaggtcaggcgaagacgatctcgtctccttccaccttcgccgagatactggcacccggcgcgaatttgccggccaggatcagttgcgccagcgggttctcgatccagcgctggatggcccgcttcagcgggcgtgcgccatagaccgggtcgaagccgacggcgatcagcttgtccagcgcctcctggctcagttccaggctcagctcgcgctcggccaggcgcttgcgcaggcgaccgagctggatctcggcgatgccggcgatctgctcgcgagccagcggctcgaataccaccacttcgtcgatccggttga

SEQ ID NO: 4883 - DNA, 564 bp, Pseudomonas aeruginosa
actcggacatatcgatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatatcctcgaggtcggcgtattcgcgctcgagcttga

SEQ ID NO: 4884 - DNA, 354 bp, Pseudomonas aeruginosa
tgcgctgggccaggccctcgacgatggcggtcttgccgacgccgggttcgccgatcagcaccgggttgttcttggtccgccgctgcaggacctggatggtccggcggatttcgtcgtcgcgaccgatcaccggatcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatga

SEQ ID NO: 4885 - DNA, 906 bp, Pseudomonas aeruginosa
ataagggcgattttccgcggttcaagcgaccggaccgtgacatcggtcagttgccgccggataacctgcgcgggcctagtcctggagccagaccaggctggcaaaacggccggtacgcgacgagcggcggtaggaatagaagcgcgcggtatcgctgaaggtgcagaagccgccgccatgcacggcggtgacgccatgggcgcccaggcggatccgcgcgagtcggtagatgtcggccatgaagcggcccggattggcgctaggtacgaaagccgagcgcgcctcggcgtgcgcagcgacgaatgcatcgcggacctcgccgccgacctcgaaggcctgcgggccgatcgccggccccagccacaccagcagttcgtcgccgggcacgcccaggctgtccaccgtcgcctccagcacgcccgccgccagcccgcgccagccggcatgggccgcggccacgcgggtgcccgagcggtcgcagaacaacgccggcaggcagtcggcggtcatgatcgtacaggcgacgcccggcatcgcgctccagctggcgtcggccctgagcacccggctcgggtcggcctccaccaccgtcactccgtgcacctggtccaaccagctcggccggcattccaggcgctcggtcaggcgtcggcggttttcttccacggcgcgcggatcgtcgtcgacgtgggcgccaaggttcagactgtcgaagggtgcctggctgaccccgccactgcgcgtggtcacgcaggcccgcacacgggccggcgccggccagccgggggtcagccaggcgttcatccgacgaacgcctcgcgatcctggcgcaacaggctgagcagccagaggaagtcttccggcagcggcgactcccacttcatgcgcacgccggtggccgggtga

SEQ ID NO: 4886 - DNA, 1071 bp, Pseudomonas aeruginosa
cagacggttgaggccaagccgaccgtcccagggacgcaagccgccatgcaagtgaaacacctgctgctgatcgccatcctcgccctcaccgcagcctgctcctcgaacaaggagactgtcgacgagaacctgagcgagagccagctgtaccagcaggcgcaggacgacctcaacaacaagagctacaacagcgccgtcaccaagctgaaagccctcgaatcgcgctatcccttcggccgctacgccgagcaggcccagctcgagctgatctacgccaactacaagaacatggagcccgaagccgcccgcgccgccgccgaacgcttcatccgcctgcatccgcagcaccccaacgtcgactacgcctactacctcaagggcctgtcctccttcgaccaggaccgcggcctgctggcgcgcttcctgccgctggacatgaccaagcgcgacccgggcgccgcccgcgactccttcaacgagttcgcccagctcaccagccgcttccccaacagccgctacgccccggacgccaaggcgcgcatggtgtacctgcgcaacctgctggcggcctacgaagtgcacgtcggccactactacctgaagcgccaggcctatgtcgccgccgccaaccgcggtcgctacgtggtagagaacttccaggaaaccccggccgtcggcgatggcctggcgatcatggtcgaagcctaccgtcgcctgggtctcgacgacctggccagcaccagcctggaaaccctcaagctcaactatccggataacgccagcctcaaggatggcgagttcgtcgcccgcgaaagcgaggccgacacccgctcctggctggccaaggccaccctgggcctgatcgagggcggcgagccgccgccgcacatggaaacccaagccgccaaggacgtgatcaagcagtacgaggatgccgagcgggagatccccgccgaactgaaaccggaaaaccaggatcacagcgccgacgacgagaagccggagagcgatgacgacgaggactccggccgctcctggtggagctacatgaccttcggtctcttcgactga

SEQ ID NO: 4887 - DNA, 402 bp, Pseudomonas aeruginosa
tcgcacgaaacaccgaagggaggcgcaggcctcccttctttttgcccgccgccatgcctctcccagcgccaaacgccgcacagcctggaccttcccggctgggatcgagccggcggcttggctaaactgcagctttctccagcctccgagatcaccatgggccttttccgcctcctgttctggatcgccctgatcgccatcgcgttctggctctggcgtcgctttacccgtcccactccgcgccagcagcaacgtccgcaggacgagccgagcgcatcgccgatggtccgctgcgcccattgcggcgtccacgtgccgcaggccaacgccctcgcccacgaacaacgctggtattgcagccaggcgcacctgcgccaggaccagggcgaccgtgcgcgctga

SEQ ID NO: 4888 - DNA, 1986 bp, Pseudomonas aeruginosa
gatccgcaacccgctgggcgcgatcagccacgccgcccaactgctgcaggagtcagaggaactggatgccccggaccgacgcctgacgcagatcatccaggaccagtcgaagcggatgaacctggtcatcgagaacgtcctgcagctctcccgtcgccgccaggccgaaccgcagcagctcgacctgaaggagtggcttcagcggttcgtcgacgaataccccggcaggctgcgcaacgacagccaactgcacctgcagctcggtgccgtcgacatccagacccgcatggacccacaccagttgaaccaggtgctgagcaacctggtgcagaacggtcttcgctacagcgcccaggcgcacgggcgcggccaggtctggctgagcctcgcgcgcgacccggagagcgacctgccggtgctggaagtcatcgacgacggtcccggcgtaccggcggacaaattgaacaacctgttcgaacccttctttactacagaaagcaaaggcaccggcctgggcctctatctctcccgcgaactctgcgagagcaaccaggcacggatcgactaccgcaatcgcgaggaaggcggcggctgcttccgcatcaccttcgcccacccgcgcaaactcagctgacggaagccgcacgcatgagccgacaaaaagccctgatcgtcgacgatgaaccggatatccgcgaactgctggaaatcactctcggccgcatgaagctggacacccgcagcgcccgcaacgtcaaggaagcccgcgagttgctggcccgcgagccgttcgacctgtgcctcaccgacatgcgcctgccggacggcagcggcctcgatctggtccagtacatccagcagcgccatccacagaccccggtggccatgatcaccgcgtacggcagcctggacaccgcgatccaggcgctcaaggccggtgccttcgacttcctcaccaaaccggtcgacctcggtcgcttgcgggagctggtggcaaccgccctgcgcttgcgcaacccggaagccgaggaagcgccggtggacaaccgcctgctcggcgagtcgccgccgatgcgcgccctgcgcaaccagatcggcaagctggcgcgcagccaggcgccggtctacatcagtggcgagtccggtagcggcaaggagctggtggcgcgcctgatccacgagcaggggccacgtatcgagcggccgttcgtgccggtgaactgcggcgcgattccctccgaactgatggaaagcgagttcttcggccacaagaaaggcagcttcactggcgctatcgaagacaagcagggcctgttccaggccgccagcggcggcaccctgttcctcgacgaagtcgccgacctgccgatggccatgcaggtcaaactgctccgggcgatccaggaaaaggccgtgcgcgcggtcggcggccagcaggaggtcgccgtcgacgtgcgcatcctctgcgccacccacaaggacctcgccgccgaagtcggcgccgggcgcttccgccaggacctctactaccgcctcaacgtcatcgagctgcgcgtaccgccgctgcgcgaacgccgcgaggacatcccgctgctcgccgaacgcatcctcaagcgcctggccggcgacaccggcctgccggccgccaggctgaccggcgacgcacaggagaagctgaagaactaccgcttcccgggcaacgtccgcgagctggaaaacatgctggagcgcgcctacaccctgtgcgaagacgaccagatccagcctcacgacctgcgcctggccgatgcgccgggtgccagccaggaaggcgccgcgagcctgagcgaaatagacaacctcgaggactacctggaagacatcgagcgcaagctgatcatgcaggcgctcgaggagacccgctggaaccgcaccgccgcggcccagcgcctgggcctgacgttccgctcgatgcgctaccgcctgaaaaagctgggcatcgactga

SEQ ID NO: 4889 - DNA, 1434 bp, Pseudomonas aeruginosa
gcatcagccaggccggccggatccaactcgaaccttcctccaaggcgccccagtcatgctattgaaatcgcgacacaggtcgctgcaccaatccggcttcagcatgatcgaagtgctggtcgccctgctgctgatcagcatcggcgtgctgggcatgatcgccatgcagggcaagaccatccagtacaccgccgactcggtcgagcgcaacaaggcagccatgctcggcagcaacctgctggaaagcatgcgggcgagcccgaaggcgctgtacgacgtcaaggaccagatggccacgcaatccgacttcttcaaggccaaggggtcggcgttccccaccgcgccgtcctcctgcacgccattgcccgacgcgatcaaggaccgcctgggatgctgggcggaacaggtgaagaacgaactgccaggcgctggcgacctgctgaagagcgactactacatctgccgcagctcgaagccgggcgactgcgacggcaagggctccatgctggaaatccgccttgcctggcgcggcaagcaaggcgcctgcgtcaacgccgccgacagcagcgccgacacctccctctgctactacaccctcagggtcgagccatgagcatgaacaaccgctcccgacggcaatcgggcctgtccatgatcgaactactggtggccctcgccatcagcagcttcctgattctcgggattacccagatctacctggacaacaagcgcaactacctgttccagcaaggccaggcaggcaaccaggaaaacggacgcttcgccatgatgttcctggaccagcaactggccaaggtgggtttccgtaggcgtgcggacgaccccaacgagtttgccttcccggcgcagcagaaaaccgcctattgcgaggcattcaaagccggctcgaccctggtgcccgccgtggtcaaggccggccagagcggattctgctaccgctatcaaccggcgccaggcgaagcctacgactgcgaaggcaactcgatcaccacccctagcgatcccttcgctaccgcccaggccatcaccgcacgcgttctgttcgttcccgcgaccgccgatgtccccggcagcctcgcctgctccgcgcagacaatcaaggaaaaaggccaggagatcgtaagcggcctggtcgacttcaagctcgagtacggcgtcggcccgaccatggccggcaaacgcgaggtggaaagcttcgtcgaacaggccaacatcgccgaccgtccggtgcgtgccctgcgctactccgcgctgatggccagcgacaagaacctgcgccagggcgacagcaagaccctggacgattggatcacgctctacccctcgtccaagaccagcctgcaaggcaatgacaaggaccgcctctaccagatcgccaagggcagccagacactcaggaatctcgtgccatga

SEQ ID NO: 4890 - DNA, 963 bp, Pseudomonas aeruginosa
cgagaccttcgccttcatcccaagcgcggtcttcgagaagctccacaagttgaccgcccgcggctaccagggcggcgcccaccagttctacgtcgacggctcgccggtggtcgccgacgccttcttcggtggcgcctggcataccgtgctgatcggcagcctgcgcgccggcggcaagggcctgttcgccctcgacgtgaccgatcccgccaacatcaagctgctctgggaaatcggcgtggaccaggagcccgaccttggctacagcttccccaaacccacggtcgcccggctgcacaacggcaagtgggccgtggtcaccggaaacggttattccagcctgaacgacaaggccgcgctgctgatcatcgacctggagaccggggccatcacccgcaaactggaagtcaccggcaggaccggcgtacccaacggcctatccagccctcgcctggcagacaacaacagcgacggcgtagccgactacgcctacgccggcgacctgcaaggcaacctctggcgcttcgacctgatcgccggcaaggtcaaccaggacgatccgttcagccgagccaacgacggcccggcggtggcctcgagcttcagggtgtctttcggtggccagccgctctattcggcagtcgactccgccggcgcggcgcaagcgatcaccgccgcgccctcgctggttcgccatccgacacgcaagggctacatcgtgatcttcggtaccggcaagtatttcgagaacgccgacgcccgggccgataccagccgcgcccagacgctctacggcatctgggaccagcaaaccaagggcgaagccgcgggcagcacaccccgactgacgcgcggcaacctgcagcagcagacactggacctccaggccgactcgaccttcgcctcgaccgctcgcaccattcgcatcgccagtcagaacccggtcaactggctgaacaatga

SEQ ID NO: 4891 - DNA, 555 bp, Pseudomonas aeruginosa
ccgacgtcctcgcgatggtgccagcaacgaccgcacttggcgtgggtcgacttgaccactttcagcttgaggccggcgacttcgctgtccaccgcgtcggccggagccgccgacagcggcgccagggtcgcggtcgaggtgatcaggacgaagcgtagctcgttgcccagcttggccaattgggcctgcagcgcgtcttccgtatacagggtgacctcggcctgcaggttgccgcccacggccttggccgcgcgctggttctccagctccttgttgaccgcggccttcaccgccatgacctgttcccagtactggcgattcagcgtcacgtcggccggcagttcgctgaggccgtcgtaccaggtggcgagcattaccgactcggcgcgctcgccgggcaggaacttccagacttcctcggcggtgaacgccaggatcggggcgatccagcgcacgagggcctcggcgatgtggaacagtgcggtctggcaggagcgccgggcgacgctgttggcgccggtggtgtactggcggtccttgatgatgtccagatag

SEQ ID NO: 4892 - DNA, 1620 bp, Pseudomonas aeruginosa
cgcttgcggtcggagaggtcgtcatgggtcagcaacacctgggcggtctgcaggccatgcagggcgaagctggactcccaggcctgcaccaaccccatttgccccaccgaggcggcggcctggagttcgtgcatcgcgctaggtcgggacacccagcccaggcggctcataccggcggcgacggcgccggacgacaccagcaccagctcgatgccggcgcaatgcagcgccaccatctgctcgacccaaacggccatggcattgcgatccagcccacggccatcggccgtcagcagggcgctaccgatcttcaccacccagcgccgcgcgcctgtcaccttgtcccgcataccctcaaccttagaagcccaggcttcgactcttcagccccgccggcccgcccggcggggtatcacgccatcagggaacgtagaagatctccggaccgtcgccgtcgtcttcctcatcatcgaaatcatcgtcatccaccgcaccggcgttcttcagacccgaacgccgcagcgcgcgcgcatcgtccagggcctgcagacgggcccgcgcctcgtcctcgatacgccggtcgagttcggccagttcctcggcatactgcggatcttcttccaggcgcagggtacgctcgtcgagatagcgcatgatgtcctggctgagcgcctcggtgccatcgcgctccagggcggagatcacatagaccgggccttcccagcccaaccgctcgatcaccgcctgcttgcgcgcctcgcgctcggccggatcgaggatctggtccatcttgttcagcaccagccagcgctcgcgctcggtcagcgccggactgaagcgacccagctcgcgaacgatgacctcggcggcatcggccggatcgctttcgtccagcggcgccatgtccaccagatgcagaaggatgcgggtccgcgccagatgcttgaggaagcgaatgcccagcccggcgccttcggcggcaccttcgatcaggccgggaatgtcggcgaccacgaagctcttgtagcgaccgacgctgaccacgccgaggttcggcaccagggtggtgaacggatagtcggccaccttcggcttggccgcggacactgcgcggatgaaagtgctcttgccggcattcggcagtcccagcaggccgacgtcggccagcaccttcagttccagcttgaggtcacgcgcctcgcccggcttgcccggggtggtctggcgcggcgcccgattggtactggatttgaaacgggtgttaccgaggccgtgccagccgccctgagcgaccatcagccgctgaccgggctcggtcaggtcgccgatgatttcctgggtattggcgtcgatcacggtggtaccgaccggcaccggcaggatcaggtcgtcgcccttggccccggtgcagtccttgctgccgccgttctcgccgcgctgggcatcgaaacggcgggtgtagcgatagtcgaccagggtgttcaggttgacgtcggcttccaggtagatggaaccgccgtcgccaccgtcgccgccgttgggaccgcccttttcgatgaacttctcgcgacgaaagctcatgaggccattgccgccgtcaccggctttcacgtggattga

SEQ ID NO: 4893 - DNA, 1554 bp, Pseudomonas aeruginosa
ggaaatgcctgcttctttcccgcgcctcggcttgctcggcgcgctgtgctccatcgttcccctgctccatgccagcgaaccgaccacggacgctgcgctcatcgaaaaaggccgctacgtggcccagctcggcgactgcatcgcctgccataccggcccgcagggcgcgccgatggccggcggcctggagctgaagacgccaatgggtaccatctactcgaccaacatcactcccgaccgggagaccggcatcggccgctacagcttcgaagagttcgaccgcgccatgcgcaagggggtgaccgccgagggagtgaatctctatccggcgatgccctacccgtcctacgccaagatcagcgaagaagacatgcgtgcgctgtacgcctacctgatgcacggcgtgcaacccgtcacccaggcgaatacgccgagcgcgatgagctggccgttcaaccagcgctggggcctgtcgctgtggaactgggcgttcctcgacgacgcgccgttcaccccctccagcgacgcggacccggcgatcaaccgcggcgcctacctggtacagggactcggccactgcggcgcctgccatactccgcgcggcatcgccttccaggaaaaagccatgagcgaagccggtcgttccgggcagctctacctcgccggcgaaaccgtcgaacaatggcaagccctgagcctgcgcaacctgtggacggtggaggacaccgtgcagttgctgaagaccgggcagaaccgcttcgccacggtgtccggcagcatgaccgatgtcatccaccacagcacccagcacttcagcgacgacgatctgctggccatcgccagctacctgaagtccctgccggccggcaaggacgacctgcccatgcccgacagcgaacgcccgctggcagcaccggtcgacctgtacagctcgcggggcggcctcggctacgcgcagttctgctccgactgccaccgcaaggacggcagcggcgtcccgggcatgttcccgccgctggccggcaaccccacggtcgcttcggccaacccgagcacgctactgcatatcaccctgaccggctggaaaaccgcggaaaccgcaacccactcgcgggtctacaccatgcccggcttcgcccagctggaggaccgcgaaatcgccgagatcctcagcttcgtccgcagcagttggggcaaccagggttcgtcgatcgatgccggccaggtgaagaaactgcgccagcggatcgaggccggcaacggcccggccacgaccttcgtctctccacgcctggcggacatgctcgcggcgccgaacgccgaacaggtggtacgcggcatgcgcctgcacctggagacccgcgagctgctgccggcgaacgtcggcaaccagttgaactgcaccagttgccacctgaacgccggaaccgtagccgacggctcgcccttcgtcggcgtctcggcgttcttccccagctacgcgccacgggcgggcaagatcatcggcctggaggaacgcatcaacggctgcttccggcgctcgatgaacggtaa

SEQ ID NO: 4894 - DNA, 489 bp, Pseudomonas aeruginosa
gcctctgccgccggactctgccgacatgcaggcgatggtggcctacttcgactggatgaagaacaacacccggccgcaggacaaggtcgccggccgcggcgtcggcaaggtcgacccggcgctgaagcccgacccggagaacggccgcaaggtctacgcccgacaatgcgcggtgtgtcatggcgagaatggcgaggggctgaggaacagcgccggcgagatgctcttcccaccgctgtggggcgacgagtcgttcaatatcggcgccggcatggcgcggaccttcaccgctgccgccttcgtcaagcacaacatgccggtcggcttccaggaacgcttcccgctcggccagggcggcctcagcgaccaggacgcagtggacgtcgcggagtacttttcgcaccagccgcgcccggacttcccggacaagatcaaggactggccgaaggacaagcgtccgctggatgcccgctactgatgccgcaatga

SEQ ID NO: 4895 - DNA, 408 bp, Pseudomonas aeruginosa
ccggctggccgagatcgtcctccaccggataggcgcggtcgcccatctgcgcctccaggacatagatgccgccctccagcgacaccaggtgcaaggcgtcgatatgtccggcctggacccggccggcgagatcctgcatgttcatcgcgaacctctcgaggttgcgcaggcagcggaagcctccaggtttccgccaaccgcctcggtcccgacagcgccggcccgattcccggcatcgtccggccggcaggccccgacgatgcgaaggacgcccgctcccggcgtccgcccgatatcacaggaaagtcttgcccaggcggcaggcaacgcaagccggaaacaccgccgcccgtccgttttacaacggccgggcggcgcgagcgaaacactggagagggtcgtcagtga

SEQ ID NO: 4896 - DNA, 420 bp, Pseudomonas aeruginosa
  unsure (34): Identity of nucleotide at the above locations are unknown.
ccctccggtgcgtcgtccagacgcaggcggtggntgatgatcgcctcgggatgcaggtcgccgttgccgatgtgttcgagcaaggccggcagcagtgcctgtacatgggtctggcccatcttgaaggtcaagcccttgtcgaaggcatcgccgaacaggaagccatggatgaagccggcatacacgcccggcacgctcaccgtgccaccccgccggacagccgcgatgcactggcgtagtgccttgccgctgctggcttcgagcttgagcgcggtgagcacggtttcggtgacgctgcccttggcctcaaagcccaccgcgtcgatcaccgcgtcgacgccgcggtgcccgtcggtgcgctcgatgatcgccgcggcgggatcgtcctcctggtcgaagtcgatgggaatcgcaccgtag

SEQ ID NO: 4897 - DNA, 2970 bp, Pseudomonas aeruginosa
agagattcgaactcccgacatcctgctcccaaagcaggcgcgctaccggactgcgctataccccgattggaagttggctccgcgacctggactcgaaccagggacccaatgattaacagtcatttgctctaccgactgagctatcgcggaacgtctttcttccaaccctggacgcttccggtgttgctggattcgcgtctcagaggcgcgccattttacggatgcgcgcgggcatgtcaaccctctgatccaaaaagtttttcttctttttccacgagcggcaaaacggcccttccactgcatgcggcagcgctctcgctcctaccggacgcccatgaaaaagccccgccgaagcggggctttccctgtccgtccacgaagaggtcaggcgaagacgatctcgtctccttccaccttcgccgagatactggcacccggcgcgaatttgccggccaggatcagttgcgccagcgggttctcgatccagcgctggatggcccgcttcagcgggcgtgcgccatagaccgggtcgaagccgacggcgatcagcttgtccagcgcctcctggctcagttccaggctcagctcgcgctcggccaggcgcttgcgcaggcgaccgagctggatctcggcgatgccggcgatctgctcgcgagccagcggctcgaataccaccacttcgtcgatccggttgatgaattccggacggaagtgtgcattgaccgcgtccatcactgcggcacgttgcgcctcgcggtcgccggccagctcctggatctgtgccgaaccgaggttggaggtcatcaccaccacggtgttgcggaagtccaccgtacgcccgtgactgtcggtcaggcgtccgtcctcgagcacctggaggagaatgttgaatacatccggatgggccttctccacctcgtccagcagcaccaccgagtagggcttgcggcggatcgcctcggtcaggtagccgccttcctcaaagccgacgtagcccggaggcgcgccgatcaggcgggccaccgagtgtttctccatgaactcggacatatcgatccgcaccagcgcctcctcggtatcgaagaggaactcggccagcgccttgcacaactcggtcttgcccaccccggtcgggccgaggaagaggaacgagccgctcggccggttcggatcggcgaggccggcgcgcgaacggcgcacggcgttggacacggcgactaccgcctcgtcctggccgatcactcgccgatgcagctcctgctccatgcgcagcagcttctcgcgctcgccctcgagcatcttcgacaccgggataccggtccacttggaaaccacttcggcgatttcctcgtcggtcaccttgttgcgcagcaactggttctcggtcttgccgtgctggtcgaccatctgcaggctgcgttccaggtccgggatggtctggtactggatgcgcgccatgctctcgaggtcgcccttgcgccgcgccgcctccatctcctgcttggcctgctcgatcttctgctggatctgcgccgagccctgcacctcggccttctcggacttccagatatcctcgaggtcggcgtattcgcgctcgagcttgacgatatcctcctccagcttggccaggcgcttcctggtggcttcgtcgtcttccttcttcagcgcctcgcgctcgatcttcagctggatcaggcgacggtcgagacgatccagttcctctggcttggagtcgatctccatgcggatgcggctggcggcctcgtcgatcaggtcgatggccttgtccggcagttgccgatcggtgatgtagcggtgcgacagcttggccgcggcgatgatcgcgccgtcggtgatgctcaccccgtggtgcacttcatagcgttccttgagaccacggaggatggcgatcgtgtcttcctcgctcggttcgtccaccagcaccttctggaagcggcgctccagcgcggcatccttctcgatgtactggcgatactcgtcgagggtagtagcaccgacgcagtgcagctcgccgcgcgccagagccggcttgagcatgttgccggcgtccatggcaccttccgccttgccggcaccgaccatggtgtgcagttcgtcgatgaacaggatgacccggccttcctgcttgcccagttcgttgaggactgccttcaggcgttcctcgaactcgccgcggaacttggcaccggcgatcagcgcccccatgtccagggccagcaggcgcttgtccttgaggccgtccggcacttcgccgttgatgatgcgctgggccaggccctcgacgatggcggtcttgccgacgccgggttcgccgatcagcaccgggttgttcttggtccgccgctgcaggacctggatggtccggcggatttcgtcgtcgcgaccgatcaccggatcgagcttgccttcctcggcgcgcttggtcatgtcgacggtgtacttgtccagcgcctggcgcgactcctcgacgttcgggtcgttcaccgcttcgccgccacgcaggttggccacggcattctccagcgccttgcgcgacacgccctggccgagcagcagcttgccgagcctggtgttctcgtccatcgcggccagcaataccagctcgctggagatgaactggtcgcccttctgctgggccaggcggtcagcctggttgagcaggcgtgcgagatcctgggacaggttcacgtcgccggtcgggctctggatcttcggcagcgcgtcgagttctttgttgaggccgctgcgcagggcggcgatatcgaagccgacctgcatcagcaggggcttgatcgaaccgccttgctgctcgagcagggcggaaagcaggtgcaccggctcgatggccggatggtcatggccaacggccagggactgggcgtcggagagcgccagttgcagcttgctggtcaaacggtctattcgcatgggtcgtccttccttctatag

SEQ ID NO: 4898 - DNA, 612 bp, Pseudomonas aeruginosa
atgtcggccatgaagcggcccggattggcgctaggtacgaaagccgagcgcgcctcggcgtgcgcagcgacgaatgcatcgcggacctcgccgccgacctcgaaggcctgcgggccgatcgccggccccagccacaccagcagttcgtcgccgggcacgcccaggctgtccaccgtcgcctccagcacgcccgccgccagcccgcgccagccggcatgggccgcggccacgcgggtgcccgagcggtcgcagaacaacgccggcaggcagtcggcggtcatgatcgtacaggcgacgcccggcatcgcgctccagctggcgtcggccctgagcacccggctcgggtcggcctccaccaccgtcactccgtgcacctggtccaaccagctcggccggcattccaggcgctcggtcaggcgtcggcggttttcttccacggcgcgcggatcgtcgtcgacgtgggcgccaaggttcagactgtcgaagggtgcctggctgaccccgccactgcgcgtggtcacgcaggcccgcacacgggccggcgccggccagccgggggtcagccaggcgttcatccgacgaacgcctcgcgatcctggcgcaacaggctga

SEQ ID NO: 4899 - DNA, 1791 bp, Pseudomonas aeruginosa
tcgccatcgcgttctggctctggcgtcgctttacccgtcccactccgcgccagcagcaacgtccgcaggacgagccgagcgcatcgccgatggtccgctgcgcccattgcggcgtccacgtgccgcaggccaacgccctcgcccacgaacaacgctggtattgcagccaggcgcacctgcgccaggaccagggcgaccgtgcgcgctgaacggctacggctgagcgaggagcaggggcaacgcatcctccgtctgtaccacctgtaccgcctgaccatcggcctggtactggtcctgctgatctccagcgaactggaagatcaggtcctcaagctcgtccaccctgaactgttccatgtcggcagttggtgctacctggtcttcaacatcctggtcgcgctgttcctgccgccgtcacggcaattgctgccgatcttcatcctcgcgctcaccgacgtgctgatgctttgcggcctgttctacgcaggtggcggcgtacccagcggcatcggcagcctgctggtggtggcggtggccattgccaacatcctgctgcgcgggcgcatcggcctggtcatcgcggcggcggccagcctcggcctgctctacctgaccttcttcctcagcctgagcagtccggacgccaccaaccactacgtccaggccggcggcctcggcaccctgtgcttcgccgccgcgctggtgatccaggccctggtgcggcgccaggagcagaccgaaacgctggccgaagaacgcgccgagacggtcgccaacctggaggaactcaacgcattgatcctgcagcgcatgcgcaccggcatccttgtggtcgatagccgtcaggccatcctcctcgccaaccaggccgccctcggcctgctcaggcaggacgacgtgcagggcgccagcctcggccgccacagcccgatgctgatgcactgcatgaagcaatggcgcctgaatcccagcctccgtccgccgacgctcaaggtggtgccggatggcccgacggtgcaacccagctttatcagcctcaaccgcgaagacgaccagcacgtgctgatcttcctcgaagacatttcgcagatcgcccagcaggcgcagcagatgaagctggccggtctcggccgcctgaccgccggcatcgcccatgagatccgcaacccgctgggcgcgatcagccacgccgcccaactgctgcaggagtcagaggaactggatgccccggaccgacgcctgacgcagatcatccaggaccagtcgaagcggatgaacctggtcatcgagaacgtcctgcagctctcccgtcgccgccaggccgaaccgcagcagctcgacctgaaggagtggcttcagcggttcgtcgacgaataccccggcaggctgcgcaacgacagccaactgcacctgcagctcggtgccgtcgacatccagacccgcatggacccacaccagttgaaccaggtgctgagcaacctggtgcagaacggtcttcgctacagcgcccaggcgcacgggcgcggccaggtctggctgagcctcgcgcgcgacccggagagcgacctgccggtgctggaagtcatcgacgacggtcccggcgtaccggcggacaaattgaacaacctgttcgaacccttctttactacagaaagcaaaggcaccggcctgggcctctatctctcccgcgaactctgcgagagcaaccaggcacggatcgactaccgcaatcgcgaggaaggcggcggctgcttccgcatcaccttcgcccacccgcgcaaactcagctga

SEQ ID NO: 4900 - DNA, 408 bp, Pseudomonas aeruginosa
tggaaagcgagttcttcggccacaagaaaggcagcttcactggcgctatcgaagacaagcagggcctgttccaggccgccagcggcggcaccctgttcctcgacgaagtcgccgacctgccgatggccatgcaggtcaaactgctccgggcgatccaggaaaaggccgtgcgcgcggtcggcggccagcaggaggtcgccgtcgacgtgcgcatcctctgcgccacccacaaggacctcgccgccgaagtcggcgccgggcgcttccgccaggacctctactaccgcctcaacgtcatcgagctgcgcgtaccgccgctgcgcgaacgccgcgaggacatcccgctgctcgccgaacgcatcctcaagcgcctggccggcgacaccggcctgccggccgccaggctga

SEQ ID NO: 4901 - DNA, 1182 bp, Pseudomonas aeruginosa
gctatgcagcacttccggatgatcatggaccagttgtcctgccccacgggccgaccgtcaacgaccgcaagacgctcccaggcccgtttggcatgctttccaggcgtagaccccctggagcaaccgcatgtcatatcgttccaactcgaccggcttcaccctgatcgagttgctgatcatcgtcgtcctgctggccatcatggcgagcttcgccattccgaacttcaagcagctgacagaacgcaacgaactgcagagcgccgccgaggaactcaatgcgatgctgcagtacgctcgcagcgaagccgtgtcccagaggcgcgcgatcagcatccaggcgctgaaggacaaggactggggcaagggcctgagcataggtgtcctggcctccggctcgatcgccgcgcccctgcgcaaacacgacggcttccgtgccgccacgctgacagcgaaggaaaagagcgccgtggaacatctgaccttcacggccaacggtaccctcgtaccgccaacggaacgaaccttcgcaatctgccagaacggcaagaccgacgggggccgcgtgctgagcatcagccaggccggccggatccaactcgaaccttcctccaaggcgccccagtcatgctattgaaatcgcgacacaggtcgctgcaccaatccggcttcagcatgatcgaagtgctggtcgccctgctgctgatcagcatcggcgtgctgggcatgatcgccatgcagggcaagaccatccagtacaccgccgactcggtcgagcgcaacaaggcagccatgctcggcagcaacctgctggaaagcatgcgggcgagcccgaaggcgctgtacgacgtcaaggaccagatggccacgcaatccgacttcttcaaggccaaggggtcggcgttccccaccgcgccgtcctcctgcacgccattgcccgacgcgatcaaggaccgcctgggatgctgggcggaacaggtgaagaacgaactgccaggcgctggcgacctgctgaagagcgactactacatctgccgcagctcgaagccgggcgactgcgacggcaagggctccatgctggaaatccgccttgcctggcgcggcaagcaaggcgcctgcgtcaacgccgccgacagcagcgccgacacctccctctgctactacaccctcagggtcgagccatga

SEQ ID NO: 4902 - DNA, 672 bp, Pseudomonas aeruginosa
tggccagcgacaagaacctgcgccagggcgacagcaagaccctggacgattggatcacgctctacccctcgtccaagaccagcctgcaaggcaatgacaaggaccgcctctaccagatcgccaagggcagccagacactcaggaatctcgtgccatgaacaacttccctgcacaacagcgcggcgccacgctggtcatcgccctggcgatcctggtgatcgtcaccctgctggcggtctcgagcatgcgcgaagtggtactggaaagccgcatcaccggcaacgtcatcgaacagactcgcttgcagaacgccgccgagtccggactccgcgaaggcgagcggcgcttcgtcaacaccctgcgtccgccggagcccggcaccggttgtacggccgacaacgtggcccgcccctgcctgctggacctcgccgcgctgaacctgaagctggcggacacccaccagaatccggtcggcgtgctgaagggcatcgccaatacctggatgagttaccgcggcagcgacatcagcagcgcgaccaccgcgggcacgctctacagcgtgcagtggaacaacctgcccattccctcgggcggccaggtcaacgaagcggaaagccccgaatacggcaacctgatgcgcggcatcggcaccttctactacgagaccaatag

SEQ ID NO: 4903 - DNA, 3573 bp, Pseudomonas aeruginosa
cgtcgcgcgcaaccagaccaacagcgaaaccgtcctgcagaccgttctcgcccgtctctataccaactgatcgagcctcgcatgaaatcggtactccaccagatcggcaagacctcgctggcagccgcgctcagcggcgccgtcctgctctccgcccagaccacccacgccgccgccctgtcggtcagccagcagccgctgatgctgatccagggcgtcgccccgaacatgctggtgactctcgacgactcgggcagtatggcttatgcctatgcaccggatagcctggtcaacagccgcaacaacgtctatttcgcgtcgaacagctacaacccgatgtacttcgacccgaatacccagtacaagctgccgaaaaaggtgaccctttccaatggccagatccaggtgcaggactattccaagcccagcttcaccgcggcatggcgcaacggtttcactcaggaaggccgggtaaacctttcccgtgactacaggccaacggtgcagtaccagggcggatcgggagcaggcaccgagtccagcatcgactggtacggggctcctgccttctactaccaatacagcgggggccgcggttgcagcctcaccacttcgagttgctacacccgtgtggaaatcagcggcgcggcccagcagcagaacttcgccaactggtactccttctatcgtacccgcgccctggccacccagaccgccgctaacctggcgttctacagcctgcctgaaaacgcccggatcagttggcaactactgaacagttcctcgtgcctgatcggcagtggctccagtaactgttacaacaactacctgagagacttcaccgggcaacatcgggtgaacttcttcaactggctggagaacctgtcggtcggaggtggtactccgctgcgtcaggccatgactcgagcaggggagtttctcaagaagaccggcgtcaacggcccctatgcctatcgacctggtacccagacctcgccggaatacagctgccgtggcagctatcacattctgatgaccgatggtctttggaacaacgactcggccagcgtaggcaatgccgacagcacgagtcgtagcctccccgatggcaagagctacagcagccagacgccttacagggatgctgcgtccaataccctggccgaccaggccttccattactgggccaccgatgcccggccggatatcgacgacaatatcaagccgtacattccctacccggaccaggccaatccctcggcggagtactggaatccgcgcaacgatccggcgacctggcagcacatggtgacctataccctgggcctgggcctgaccaccagcctcaccagcccgaagtgggagggttccacctactccggcggctatgacgaaatcgccgccgggcgcctcagctggccgaacgcttcgaataaccatagcaacaacgtctatgacctgtggcacgccgcagtgaactcccggggcgagttcttcagcgccgactcgccggaccaactggtcgcggccttccaggacatcctcaaccgaatttcgggcaaggacctgccggcatcccgccccgccatcagctcgtccctgcaggaagacgacactggcgacaagctgacccgcttcgcctaccagaccagcttcgccagcgacaagaactgggctggcgacctgacccgctacagcctgaccacccaggacaaggccaccgtgcagaccaagctgtggagcgcgcagagcatcctcgacgcgatgcccaacggtggagctggccgcaagatcatgatggccggatccggtacctcgggcctcaaggagttcacctggggcagcctcagcgccgaccagcagcggcagttgaaccgcgatccggaccgcaacgatgtcgccgacaccaagggccaggaccgcgtggccttcctgcgcggcgatcgcagcaaggagaacagcgacaacttccgcacccgcaactcgatcctcggcgatatcatcaactcctcgccggcgacggtcggcaaggcccagtacctgacctacctggcccagccgatcgagcccagcggcaactactccacgttcgcagaagcacagaaaacccgtgccccgcgggtatacgtcggcgccaacgacggcatgctgcacggtttcgataccgacggtaacgagaccttcgccttcatcccaagcgcggtcttcgagaagctccacaagttgaccgcccgcggctaccagggcggcgcccaccagttctacgtcgacggctcgccggtggtcgccgacgccttcttcggtggcgcctggcataccgtgctgatcggcagcctgcgcgccggcggcaagggcctgttcgccctcgacgtgaccgatcccgccaacatcaagctgctctgggaaatcggcgtggaccaggagcccgaccttggctacagcttccccaaacccacggtcgcccggctgcacaacggcaagtgggccgtggtcaccggaaacggttattccagcctgaacgacaaggccgcgctgctgatcatcgacctggagaccggggccatcacccgcaaactggaagtcaccggcaggaccggcgtacccaacggcctatccagccctcgcctggcagacaacaacagcgacggcgtagccgactacgcctacgccggcgacctgcaaggcaacctctggcgcttcgacctgatcgccggcaaggtcaaccaggacgatccgttcagccgagccaacgacggcccggcggtggcctcgagcttcagggtgtctttcggtggccagccgctctattcggcagtcgactccgccggcgcggcgcaagcgatcaccgccgcgccctcgctggttcgccatccgacacgcaagggctacatcgtgatcttcggtaccggcaagtatttcgagaacgccgacgcccgggccgataccagccgcgcccagacgctctacggcatctgggaccagcaaaccaagggcgaagccgcgggcagcacaccccgactgacgcgcggcaacctgcagcagcagacactggacctccaggccgactcgaccttcgcctcgaccgctcgcaccattcgcatcgccagtcagaacccggtcaactggctgaacaatgacggcagcaccaagcagtccggctggtatctggacttcatggtcaacggcaccctgaagggcgagatgctgatcgaggacatgatcgccatcggccaggtggtgctgctgcaaaccatcaccccgaacgatgacccctgtgccgacggcgccagcaactggacctatggcctcgatccctataccggcggtcgcaccagcttcaccgtgttcgacctggcacgccagggcgtcgtggactcgaaatccgactacagctacaacaagcagaacgtcgcggtatccggtaccgagcagaaaggcctgggaggcttgacgctgagcaccaacgaacagggcaatccggaagtctgctcctcgggcgaatgcctgaccgtgaaccccggtccgaacacccgtggccgccagaactggcgccccatcgaaggaaagaactga

SEQ ID NO: 4904 - DNA, 771 bp, Pseudomonas aeruginosa
tatgaaagtgctgcctatgctgctggccctggccgttcccggcctctgctgggccgaagatccccagaccttcgaaggcgctggcgtggtcttcgaagtccaggtcgagaagaacctggtggacatcgaccaccggctctaccgcctgcccaacagcaccgtcaggaacggcatgcccagcctgttccaggtcaagccgggctccgtggtgtcctactctggcaccgtcagccagccgtggtccaccatcaccgatatctacattcacaaacagatgagcgaacaggagctggccgagatgatcgagaaagaacagccccgccaggacggggaggagcagccccgatgaggacaagacagaagggcttcacgttgctggaaatggtggtggtagtggcggtgatcggcatcctcctcggcatcgccattcccagttaccagaactacgtgatccgctccaaccgcaccgagggccaggccctgctctcggacgcggccgcgcgccaggaacgctactactcgcagaaccccggggtcggctacaccaaggacgtggccaagctgggcatgagttcggccaactcgccgaacaacctgtacaacctcaccatagcgacgcccaccagcaccacctataccctgaccgccacgccgatcaactcgcagacccgcgacaagacctgcggcaagctgaccctcaatcagctcggcgaacgcggcgcagccggcaagaccggcaacaacagcaccgtcaacgactgctggcgctga

SEQ ID NO: 4905 - DNA, 321 bp, Pseudomonas aeruginosa
ccttcgaggtgtcgtccatcgacagggtcgtctgggtcacgtagtgcagggcttcgggcttgcgcacctccagcgcggcgacgtcggcctcgtcctccactaggtagatggcaccaccgttgctggcatcgtactggcccatggtgccttccacctcggggtgcccttcatgcccgatcagcacgcattcgtggccgtcgcggctgtagcgcaccacttccatgtgcaccttggtcaccagcgggcaggtcgcgtcgaaaaccttcaggccgcgcccctcggcttccttgcggaccgcctgggaaacgccgtgggcgctga

SEQ ID NO: 4906 - DNA, 1008 bp, Pseudomonas aeruginosa
ttgaagtcgacggtcacctgctgctcatcgaacgccttgaccacgcccggcagttcggtcttggccgcgtcgttgaagatcaccagcaggccctcggccagctccatgtcctggaactggtcgcgcggcatgatctgcacgttctgcggattcggctggccgaagccctgttcgggaagaatgctcagggtgcgcttgtcgccagccttcaagccgaacagcgcctgttcgaagcccggcagcaggttgccgtcgccgaccttgaacgaggcaggctgcttgtcgaaggtgctgtcgacgacgttgccgtcctccagcttgagggcgaaatgcagggtgacgcggctctcctggccaatgcgggtcgactcagccatgggcggcttctccggatttcttcgatctgaacatgtcgagcgccagcatgacggcgccgacggtgatggcgctatcggccaggttgaacgccgggaagtaccagcggttctgccagtgcaccaggatgaagtccaccacgtggccaaggaccatgcggtcgtaaaggttgcccagggcgccgccgagcaccagcgccagggcgatggccaaccaggtctcgcctttcttcaggcgtttcagccagaccaccaggatcgcgctgacgacgatggcgatcagggcgaacagccagcgctgccagcccgagctgtcggccaggaagctgaaggcggcaccggtgttgtaggccagggtccagctgaacagatcggggatcaccacgatctgctggtacatgctcagttcggcctggaagaacgccttgctgacctggtcgaggacgaacaccagcacggtgatccacaaccagggcaagcgcccgaaacgatcgacgtcaggcatagtggcgaacctcgccgctgccttcgatgttctcgatgcagcgaccgcacaggtcaggatgcgcagcgtgctgaccgacgtcctcgcgatggtgccagcaacgaccgcacttggcgtgggtcgacttga

SEQ ID NO: 4907 - DNA, 1548 bp, Pseudomonas aeruginosa
tcccgccgccagcccggacgcgcttcacagcaccgcccggcgggaaaagtcgcgcaggcggaaacccagcagcgcgagcataccgaaataggccaggagaccggcaaccaccagcaggccgaggcgcaggaatcgctccagcatggcgccctgctcccaggccggcagccagtgcatcgtggccagcagcaccgccgacatcgccagcaccgcgaccaccagcttgaccaggaacttcgcccagcccggttgcggcaggtacagacgctgcttgcgcagttgccagtagagcaggccggcattcaggcaggcggccaggccgatggacagggccaggccggcatgctgaagcgggccgatgaaggccaggttcatcagctgggtggaaaccagggtgaagagcgcgatcttcactggcgtacggatgttctgctgggcatagaagcccggcgcaagaaccttgaccaggatgatgccgagcaggccgacggagtaggccaccagcgcgcgctgggtcatcgccgcgtccaccgtggtgaacttgccgtactggaacagcgagacggtcagaggttcggcgaggatcgccagggccagggaacagggcagcaccagcaggaagcacaggcgcaggccccagtcgagcaggcgcgagtactcatggcgatccttgttcgaataggtcttcgccagcatcggcaggaggatcgtccccagcgccacgcccaatacgccggaaggcagctccatcaggcggtcggcgtagtacatccaggacaccgaaccggctgccaggaacgaagcgaagatggtgttgatgatcagcgagatctggctcaccgagacccccaggatggccggcagcatcagcttcatcacccgccagacgccgctgtccctgaggttcaggcgcggcagcacgagcatgccgatcttcctcaggtgcggcagctgatagaggagctgcaacaggccgccggccagcaccgcccagcccagcaccatgaccggcggatcgaaataaggcgtgaggaacagcgcgaagccgatcattgcgacgttcagcagggtcggcacgaaggctggcaccgagaagcggttccaggtgttgaggatcgcgccggccagggacgacagcgagatcagcaatatataaggaaaggtcacccgcagcaggtcggtggtcagggcgaacttttccggggtatcggcgaagcccggagcggtgacccagataacccagggcgcggcgaggatgccgagcgccgtgaccagcgccagcaccagcgtgagcaagccggaaacgtaggcgatgaaggtccgcgtcgcctcctcgccctgctggttcttgtactctgccaggatcggcacgaaagcctgggaaaacgccccctcggcgaagatccgccgcaacaggttgggcagcttgaaggcgacgaaaaaggcgtcggtggcgaggccggcaccgaagatccgcgccaggatggtatcgcggacgaagccgaggacccgcgacagcatggtgatggaactcaccgccgccaatga

SEQ ID NO: 4908 - DNA, 993 bp, Pseudomonas aeruginosa
caatcactgcgtacatgtgtatctccgttaaacctgctcacccgacgctttatagaagtaggaatcggccggcatggctgcatggggtcggatcggacgcccgtgcaattgcgtaaggcagggtatgccaaggaagttcagggcccgcgattgtacggaaaggtccaggccgaggcaagtgccacgggcctttccttgacagtcccccccctgccacctagcatgccgcgcaatctttgtggagctattgtcactgatgcaaccccaggccttctaccgcgtggtggcggaagatttcaccgccgtcgacgggatcatccgtcgccaactcacctcccgcgttcccctggtggaaaagatcggcgactacatcatctccgccggcggcaagcgcctgcgcccgctgctggtcctgctcgccggcaagaccctgggctacaagggcgacgacctctgcctgctggccgccaccatcgaattcctgcacacctccactctgctgcacgacgacgtggtcgacgcctccggcctgcgccgcggccgctccaccgccaatgccctgtggggcaacgcgccgagcgtgctggtaggcgacttcctttatgcccgctccttcgaaatgatggtcgagctgggttccatgccggtcatgcgcatcatatcccaggccacccgggtgatcgccgagggcgaagtgctgcaattgtccaaggtacgcgacgccagcactaccgaagagacctacatggaagtgatccgcggcaagaccgcgatgcttttcgaggcctcgacccacagcgccgccgcgctgtgccaggccggcgaggaacagtccgaggcactgcgccgcttcggcgactacctgggaatcgccttccagctggtggacgacctgctcgactaccgcggcgacgccgcgaccctcggcaagaacgtcggcgacgacctcgccgaaggcaagcccaccctaccgctgatcgtcaccatgcgtga

SEQ ID NO: 4909 - DNA, 267 bp, Pseudomonas aeruginosa
gaattattctcatctcacagtcttgtcacggagatgagcgccatgacttatttgatcgatgcctggcttgatcggccacacccctacctgcggatcctgcaccgggaaaccggggaaatctgcgcagtcctggaagaagacgcgctggacgaactgcgtgaccagggcggcctggacctgcacgagttgaactcgagcgaaccgctgatcctcaaggagctggtacgcaacctgttcctcttctgctacgcccgcgccctgcgctga

SEQ ID NO: 4910 - DNA, 2139 bp, Pseudomonas aeruginosa
aagccgttacaacagcggcgtgaccgtcgtcctgtcgacggccgcataacgaaaaaaagaatggaccgtggccgaggggaccgccccaggcctacgcctaaggatgaggaaatgcctgcttctttcccgcgcctcggcttgctcggcgcgctgtgctccatcgttcccctgctccatgccagcgaaccgaccacggacgctgcgctcatcgaaaaaggccgctacgtggcccagctcggcgactgcatcgcctgccataccggcccgcagggcgcgccgatggccggcggcctggagctgaagacgccaatgggtaccatctactcgaccaacatcactcccgaccgggagaccggcatcggccgctacagcttcgaagagttcgaccgcgccatgcgcaagggggtgaccgccgagggagtgaatctctatccggcgatgccctacccgtcctacgccaagatcagcgaagaagacatgcgtgcgctgtacgcctacctgatgcacggcgtgcaacccgtcacccaggcgaatacgccgagcgcgatgagctggccgttcaaccagcgctggggcctgtcgctgtggaactgggcgttcctcgacgacgcgccgttcaccccctccagcgacgcggacccggcgatcaaccgcggcgcctacctggtacagggactcggccactgcggcgcctgccatactccgcgcggcatcgccttccaggaaaaagccatgagcgaagccggtcgttccgggcagctctacctcgccggcgaaaccgtcgaacaatggcaagccctgagcctgcgcaacctgtggacggtggaggacaccgtgcagttgctgaagaccgggcagaaccgcttcgccacggtgtccggcagcatgaccgatgtcatccaccacagcacccagcacttcagcgacgacgatctgctggccatcgccagctacctgaagtccctgccggccggcaaggacgacctgcccatgcccgacagcgaacgcccgctggcagcaccggtcgacctgtacagctcgcggggcggcctcggctacgcgcagttctgctccgactgccaccgcaaggacggcagcggcgtcccgggcatgttcccgccgctggccggcaaccccacggtcgcttcggccaacccgagcacgctactgcatatcaccctgaccggctggaaaaccgcggaaaccgcaacccactcgcgggtctacaccatgcccggcttcgcccagctggaggaccgcgaaatcgccgagatcctcagcttcgtccgcagcagttggggcaaccagggttcgtcgatcgatgccggccaggtgaagaaactgcgccagcggatcgaggccggcaacggcccggccacgaccttcgtctctccacgcctggcggacatgctcgcggcgccgaacgccgaacaggtggtacgcggcatgcgcctgcacctggagacccgcgagctgctgccggcgaacgtcggcaaccagttgaactgcaccagttgccacctgaacgccggaaccgtagccgacggctcgcccttcgtcggcgtctcggcgttcttccccagctacgcgccacgggcgggcaagatcatcggcctggaggaacgcatcaacggctgcttccggcgctcgatgaacggtaagcctctgccgccggactctgccgacatgcaggcgatggtggcctacttcgactggatgaagaacaacacccggccgcaggacaaggtcgccggccgcggcgtcggcaaggtcgacccggcgctgaagcccgacccggagaacggccgcaaggtctacgcccgacaatgcgcggtgtgtcatggcgagaatggcgaggggctgaggaacagcgccggcgagatgctcttcccaccgctgtggggcgacgagtcgttcaatatcggcgccggcatggcgcggaccttcaccgctgccgccttcgtcaagcacaacatgccggtcggcttccaggaacgcttcccgctcggccagggcggcctcagcgaccaggacgcagtggacgtcgcggagtacttttcgcaccagccgcgcccggacttcccggacaagatcaaggactggccgaaggacaagcgtccgctggatgcccgctactga

SEQ ID NO: 4911 - DNA, 1401 bp, Pseudomonas aeruginosa
tgccgcaatgaaaaacgccccgtcgatgcgtcgacggggcgtttcgctccttcctggggccgatgcgcctcagaggatttccagcagttcgacgtcgaacaccagcacgctgtgcgggggaatgctgccgaccgcctggccgccataggccagttcgctcggtacgtgcaggcgccacttggagccggcgttcatcagttgcagcgcttcgacccagccggcgatcacgccgcccaccgggaactcggccggctggccacgctggtaggagctgtcgaatacggtgccgtcgatcagggtgccgtggtagtgggtgcgcacggtatcctcgcgggaaggcttggcgccctcgccagtgctcagcacttcgaactgcaggcccgagggcagcacggtcacgccttcgcgcttggcgttctcggccaggtaggcgcggccttcgccagcggcggcttcggccttggcctgggcttcggcctgcatgcgctcgcggatcacctggaagctggccgacagcgcctcgccggaaacccggctgtcgatacctgcgaacgcatcggacaggccggccaggactgcgtccagggtcatgcccggaaccggattctcgcgcagttggtcgcccagttgacggccgatgccgtagctgacacgggcttcgtcagtggtcaggttgagttcgctcatggcgctgctccgctgtggggtcgaaaaagggcggccagcctagcacagaaggcccttcccccctaccggcgcagccgcttgtgctcaaccctggcggatcgacagcggcagcccgccgataaacgaccccgactcggccaggagtccacacatctcgtcatcgacatcggcgcacaccaactccaccggaaccctgtccagcccgcgcagtacctggcgcgcatgctccacggagcgcaggctgaccggctggccgagatcgtcctccaccggataggcgcggtcgcccatctgcgcctccaggacatagatgccgccctccagcgacaccaggtgcaaggcgtcgatatgtccggcctggacccggccggcgagatcctgcatgttcatcgcgaacctctcgaggttgcgcaggcagcggaagcctccaggtttccgccaaccgcctcggtcccgacagcgccggcccgattcccggcatcgtccggccggcaggccccgacgatgcgaaggacgcccgctcccggcgtccgcccgatatcacaggaaagtcttgcccaggcggcaggcaacgcaagccggaaacaccgccgcccgtccgttttacaacggccgggcggcgcgagcgaaacactggagagggtcgtcagtgacgggtctgcttatccaggtagcccatggcgaacgccgagagcacgaaggtcatgtggatga

SEQ ID NO: 4912 - DNA, 810 bp, Pseudomonas aeruginosa
cggcaccttcaacgtcagcgtcagcatccgcccggccctgcacagcggccaccagttgcaactggtgctggacggcaaaccctacggcacgcccagcagcggcacccgcttcaccctgcacgagatcgaccgcggcgaccacagcctcgcggtacaggtactcaacggcgaacgggtgctgcaatccagcccgccggtgaccttcaccgtgcagcgcgtgcacctcgggaagaagcgatgatcccgcgcattctcggcgccctcctgctgtgcctggcctgcgccgcgcaagcgggggtctacacctacatcgacgccgagggcaaccgcgtctacaccgaccagccgcccagcgggcgcaaggcccaacgcgtcgaactggcgccgggcaacagcgtggcgccgccgggcatacgctatcgtccgcccgccgcgccgctggaggtgaagccgccggcctaccagctactgcgcatcctcttccccgaaccggacgcaaccctgcgcgccaacagcggcgacgtcatcgtcaccgtcaccagcgagccggcgctgctgcccggccatcgctatcgcctgctgctcgacggcaagcctgccggagtgccgggacgcagcccggtgttcccgttgaagaacctcgatcgcggcacccaccaggtcgcagtggaaatcatcgatggcgacggcatgaccgtcgaaagcaccccgagccagcccttccacctgcatcgagtgagcatcgccgggcaacccctgccggaggtcgatacgccgctggtcagcgcgatagagccaagcgagcgctag

SEQ ID NO: 4913 - DNA, 1164 bp, Pseudomonas aeruginosa
ccagcgcctcggcagaaaaaacgcgccttttcggcgcctggtttgctttttgcattttcctgcccaaccttggaacagctgcccgccatgccgaccgataccctgcaccgactgttgctcgacaacctgaccaccgcggtgatcctgctcaacggcgaactgcgcctggagtacatgaacccggcggcggagatgctcctggccgtgagcggccagcgcagccacgggcaattcatcagcgagctgttcaccgaatcgccggaagccttgaactcgctgcgccaggcggtggaacaggcacatccgttcaccaagcgcgaagcgaccctgacctcgatcaccggcgtcagcatcacggtcgactatgcggtgacgcccatcctcaaccgcaacgagacgctgctgctgctcgaggtccatccgcgcgaccggctgatgcggatcacccgcgaagaagcgcagttgtccaagcaggagaccaccaagctgctggtgcgcgggctcgcccacgagatcaagaacccgctcggcggcatccgcggcgcagcgcaactgctatcccgcgagctgccggaagagtcgctgaaggactacaccaacgtcatcatcgaagaagccgaccggttgcggaacctggtggaccgcatgctcggctcgaacaaactgccgaacctggcgccgaccaacatccatgaagtgctggagcgggtcagcagcctggtggaagcggagagccagggcagcatcaccctggtccgcgactacgacccgagcatccccgacctgctgctcgaccgcgagcaaatgatccaggccgtgctcaacatggtacgcaacgccatgcaggcgatcgccgggcagaacgacctgcgcctcggtcgcatcaccctgcgcagccgtaccctgcgccagttcaccatcggccacacgcgtcaccgcctggtgtgcaaggtggagatcatcgacaacggcccgggcattccggccgagctccaggaaaccatcttctaccccatggtcagcggccgtccggacggtaccggactcggcctggccatcgcccagaacatcatcagccagcaccaggggctgattgaatgcgagagccaccccggccataccgtgttcagtctgttcctgcccctggaacaaggagtgcattga

SEQ ID NO: 4914 - DNA, 312 bp, Pseudomonas aeruginosa
gccagagcagcgcgctggccaggcaggcccagaggaggatcaccaccgaaaaatcgaagaccatcgccggcaggtcgcgccagcttggaaagcgctcctcgagttcggcacgcgccagctggaactggttgccccataacgcgaccgggctgttcgcgccctggaactgcttctccaggctggtcagggtatcgccgatcagccccagcaccccaccctcgctttccttgcctttcttggtcacgtcgcgcagctgtttcagctttttcagcaggtcggcgcgctgcctgtcgttctccagggtctggatga

SEQ ID NO: 4915 - DNA, 786 bp, Pseudomonas aeruginosa
gaaaccgaaacagccgcatcatacaagccggacacccgccgtttcgaacggggccgccggccggcggcgcaagcacagacactctggcgcaacgagggttcgccccgccagtgccggctgagacgaacgcagccgcgcggcggggcacagcgaccgccaacgtgccccagcgcacaccttcgaatacccgcatgccgcacaatgcacggcttgccagcgcgccgatgcggtgcaacgcttggcaggttcacccggagaccgtccatgcgcctgatcaccagctgcctgctcctggccgccgccctgccggccatggcgcagatttaccaatacaccgacgccaacggcaacaaggtattcaccaaccagccgccagacggggtgcaggcgcagaccgtcgaactgcagccgaccaataccgtaggaatcgacacgccggaaaagtcctccgcgggcaatgccccggccgccgatagcgaggccgccgcctacgagatccttgccctcagcgacctccccacggaagaggcgctgcgcgccaataacggcaccttcaacgtcagcgtcagcatccgcccggccctgcacagcggccaccagttgcaactggtgctggacggcaaaccctacggcacgcccagcagcggcacccgcttcaccctgcacgagatcgaccgcggcgaccacagcctcgcggtacaggtactcaacggcgaacgggtgctgcaatccagcccgccggtgaccttcaccgtgcagcgcgtgcacctcgggaagaagcgatga

SEQ ID NO: 4916 - DNA, 1041 bp, Pseudomonas aeruginosa
gaagggcgccttcaccggggccgccgcccagcgccgcggacgcttcgagcaggccgatggcggcaccctgttcctcgacgagatcggcgacatgccggccgacacccagacccgcctgctgcgcgtcctggccgacggcgagttttaccgggtcggcgggcacacgccggtgaaggtcgacgtgcggatcatcgccgccacccaccagaacctggaaagcctggtgcgcgacggcaagttccgcgaggacctgttccatcgcctgaacgtgatccgcatccacatcccacggctggccgaccgccgcgaggacatcccggcgctggcccggcacttcctcagccgcgccgcccaggagctggcggtggaacccaagctgctgaaggcggaaaccgaggagtacctgaagaacctcggctggccgggcaacgtccgccaactggagaacacctgtcgctggatcaccgtgatggcctccggccgcgaggtgcacatcgacgacctgccgccggagctgctgacccagccgcaggacagcgcgccggcggcgaactgggaacaggcccttcgccagtgggccgaccaggcgctgggccgcggccagtcgaacctgctggacagcgccgtgccggccttcgaacggatcatgatagaaaccgccctcaagcacaccgccggccgccgccgcgatgccgccgtgctgctcggctggggccgcaataccctgacccgcaagatcaaggagctggggatgaacgtcgatggagccgacgacgaaggcgacgactgaagcgccactgctcccatgagcgacccaacggggccttcgggccccgtttttcatggtccgtcgcgcgcccgtaccaagcgagacgccgccccagcctcggcagggcgcccgcccggaaccaccggtcaaatcgtaacgtagggcgaataaccgcatcgcggttatccgccgattgtgcagggccgcggcggataacgcctatggcgttattcgtatatggactcctcccggtttgccagtgtttgtcttga

SEQ ID NO: 4917 - DNA, 1548 bp, Pseudomonas aeruginosa
cagcgccaccgcgtcgtcgatcggcatgctcgccggcaccggccagcggaacatcgcgtagccgaactggcgcgagtagttctggatgctctcgatctcgctgcacgggatggtatgcaccacgccgtacaggtcgcgcaggcgcacggtacggatagtcaggccctcgaccgtgccaaggtggccgccgacgtcgacgtagtcgtcgatcgacagcgagtcctcgatgatgatgaacaggccggtgatcaggtccgccaccagcgactgcgcgccgaagccgatggccaggccgatcacgccggcaccggccagcaacggggtgacgttcatgcccatgttggccagggcgacgatcagggcgatcaccgcgatggtggcgaacagcacgttgcggatcagcggcagcatggtcagcgcgcgggtgttcggccggctcttgccgcccaggccgaggctgtgctggatcgcggtatcggtgaggatccagatcagccaggcgaccagcagggtggtgccgaagctgactaccttcatgctgatctgctcgccctcgccttccgcatagcgaatcagcgacatgccccagacgcgcaaggcgacctcgatgaagaacagcaccacgaagatgtgcagcagggtgtagccgaagctctgcaactgctcgatgtacggcgcgctgcggcgcgggccggcgccgacccgactggaacggcggcggatcagcccgatcacggtcatcgccaccaccgccagcaccgcgcagaccagcgcccggcgcaacgccgaactgctgtcgccggcggaaacgaaggtggcgaacagggaaatccccaccagcaccagcaccggcacgaaccacagcgagccgaccagttgcaccaggtcgtgcaggctacggcgcttgaggcggcgctccagcggctggttgcggatcaggtgggcgatcggccggcggaaacgcatcacgaacaaggcggtgaacagcgcggcgctggcgttggccagggtactcaggcagatcgaggtgtgctcgccgaggccggcgatcagccgcggatcgtgggcgacctcgcccagcgcggcgaggctgccgatcagccacaacgggcggaacgcctggcgccgcaggatatccagggcgcgctggcggtgcgggccgctgagcagcgagagggaaatcacgcacagcgcggagaacagcgtgccgcagaccagcacataggccatgaccatcgccagggtcttgctcagggagtccggcagcaccaccgacaggtacagggtgatgaggaaggccaccagccaggggcccagcttgcgcagggagaacagcagcaggtcgcgggtcttcggatgctgcggcaactccgccgacaggccgaagcgctcgcgcatgcgccggctgagccagagcagcgcgctggccaggcaggcccagaggaggatcaccaccgaaaaatcgaagaccatcgccggcaggtcgcgccagcttggaaagcgctcctcgagttcggcacgcgccagctggaactggttgccccataa

SEQ ID NO: 4918 - DNA, 1488 bp, Pseudomonas aeruginosa
ccttcaccgtgcagcgcgtgcacctcgggaagaagcgatgatcccgcgcattctcggcgccctcctgctgtgcctggcctgcgccgcgcaagcgggggtctacacctacatcgacgccgagggcaaccgcgtctacaccgaccagccgcccagcgggcgcaaggcccaacgcgtcgaactggcgccgggcaacagcgtggcgccgccgggcatacgctatcgtccgcccgccgcgccgctggaggtgaagccgccggcctaccagctactgcgcatcctcttccccgaaccggacgcaaccctgcgcgccaacagcggcgacgtcatcgtcaccgtcaccagcgagccggcgctgctgcccggccatcgctatcgcctgctgctcgacggcaagcctgccggagtgccgggacgcagcccggtgttcccgttgaagaacctcgatcgcggcacccaccaggtcgcagtggaaatcatcgatggcgacggcatgaccgtcgaaagcaccccgagccagcccttccacctgcatcgagtgagcatcgccgggcaacccctgccggaggtcgatacgccgctggtcagcgcgatagagccaagcgagcgctagccgaacttcccctgcccactccgccgtgggcgggattttccggtttttttcccgaatctcctggcgaaaacgccgccggccacgccaacgcaccagattggtgcgattacccgcaccactttctatactgtccccatttcgggtcaccgctcgtcgccgaaaaccttcccggcgcacctctagccagcgcctcggcagaaaaaacgcgccttttcggcgcctggtttgctttttgcattttcctgcccaaccttggaacagctgcccgccatgccgaccgataccctgcaccgactgttgctcgacaacctgaccaccgcggtgatcctgctcaacggcgaactgcgcctggagtacatgaacccggcggcggagatgctcctggccgtgagcggccagcgcagccacgggcaattcatcagcgagctgttcaccgaatcgccggaagccttgaactcgctgcgccaggcggtggaacaggcacatccgttcaccaagcgcgaagcgaccctgacctcgatcaccggcgtcagcatcacggtcgactatgcggtgacgcccatcctcaaccgcaacgagacgctgctgctgctcgaggtccatccgcgcgaccggctgatgcggatcacccgcgaagaagcgcagttgtccaagcaggagaccaccaagctgctggtgcgcgggctcgcccacgagatcaagaacccgctcggcggcatccgcggcgcagcgcaactgctatcccgcgagctgccggaagagtcgctgaaggactacaccaacgtcatcatcgaagaagccgaccggttgcggaacctggtggaccgcatgctcggctcgaacaaactgccgaacctggcgccgaccaacatccatga

SEQ ID NO: 4919 - DNA, 402 bp, Pseudomonas aeruginosa
agtgctggagcgggtcagcagcctggtggaagcggagagccagggcagcatcaccctggtccgcgactacgacccgagcatccccgacctgctgctcgaccgcgagcaaatgatccaggccgtgctcaacatggtacgcaacgccatgcaggcgatcgccgggcagaacgacctgcgcctcggtcgcatcaccctgcgcagccgtaccctgcgccagttcaccatcggccacacgcgtcaccgcctggtgtgcaaggtggagatcatcgacaacggcccgggcattccggccgagctccaggaaaccatcttctaccccatggtcagcggccgtccggacggtaccggactcggcctggccatcgcccagaacatcatcagccagcaccaggggctgattga

SEQ ID NO: 4920 - DNA, 1500 bp, Pseudomonas aeruginosa
atgcgagagccaccccggccataccgtgttcagtctgttcctgcccctggaacaaggagtgcattgaccatgagccgatcagagaccgtctggatcgtcgacgacgaccgctccatccgctgggtactggaaaaggccctgcaacaggaaggcatgaccacggtgagcttcgacagcgccgacagcgtcatcggccgcctcggccggcagcagccggacgtgatcatctccgatatccgcatgcccggcgccagcggcctcgacctgctggcgcagatccgcgaactgcatccgcgcctgccggtgatcatcatgaccgcgcattccgacctcgacagcgcggttgcctcctaccagggcggcgccttcgaatacctgcccaagccgttcgacgtcgacgaggcggtctccctggtcaagcgcgccaaccagcacgcccaggagcagcagggcctggagctgccggcgaaccaggcgcgcacgccggagatcatcggcgaggcgccggcgatgcaggaggtattccgcgccatcggccgcctcagccattccaacatcaccgtgctgatcaacggcgaatcgggtaccggcaaggagctggtcgcccatgccctgcatcgccacagcccgcgcgcagcctcgccattcatcgcgctgaacatggcggcgatccccaaggacctgatggaatccgagctgttcggccatgagaagggcgccttcaccggggccgccgcccagcgccgcggacgcttcgagcaggccgatggcggcaccctgttcctcgacgagatcggcgacatgccggccgacacccagacccgcctgctgcgcgtcctggccgacggcgagttttaccgggtcggcgggcacacgccggtgaaggtcgacgtgcggatcatcgccgccacccaccagaacctggaaagcctggtgcgcgacggcaagttccgcgaggacctgttccatcgcctgaacgtgatccgcatccacatcccacggctggccgaccgccgcgaggacatcccggcgctggcccggcacttcctcagccgcgccgcccaggagctggcggtggaacccaagctgctgaaggcggaaaccgaggagtacctgaagaacctcggctggccgggcaacgtccgccaactggagaacacctgtcgctggatcaccgtgatggcctccggccgcgaggtgcacatcgacgacctgccgccggagctgctgacccagccgcaggacagcgcgccggcggcgaactgggaacaggcccttcgccagtgggccgaccaggcgctgggccgcggccagtcgaacctgctggacagcgccgtgccggccttcgaacggatcatgatagaaaccgccctcaagcacaccgccggccgccgccgcgatgccgccgtgctgctcggctggggccgcaataccctgacccgcaagatcaaggagctggggatgaacgtcgatggagccgacgacgaaggcgacgactga

SEQ ID NO: 4921 - DNA, 1353 bp, Pseudomonas aeruginosa
atctgcgccatggccggcagggcggcggccaggagcaggcagctggtgatcaggcgcatggacggtctccgggtgaacctgccaagcgttgcaccgcatcggcgcgctggcaagccgtgcattgtgcggcatgcgggtattcgaaggtgtgcgctggggcacgttggcggtcgctgtgccccgccgcgcggctgcgttcgtctcagccggcactggcggggcgaaccctcgttgcgccagagtgtctgtgcttgcgccgccggccggcggccccgttcgaaacggcgggtgtccggcttgtatgatgcggctgtttcggtttctcaccttggggactgcctttctcgtgccgatcatcgcccgcttcacccttcgctcccgcgtcctggcggccctgctgctgtgcctctgcgccgccctgttctactcgccgccgggtgccgcggcgctgccgaacccgttggcggggagttcttccggtggcgagaaggtcagcgatgcgcagttggaacaatcgctgaaccaggtcatccagaccctggagaacgacaggcagcgcgccgacctgctgaaaaagctgaaacagctgcgcgacgtgaccaagaaaggcaaggaaagcgagggtggggtgctggggctgatcggcgataccctgaccagcctggagaagcagttccagggcgcgaacagcccggtcgcgttatggggcaaccagttccagctggcgcgtgccgaactcgaggagcgctttccaagctggcgcgacctgccggcgatggtcttcgatttttcggtggtgatcctcctctgggcctgcctggccagcgcgctgctctggctcagccggcgcatgcgcgagcgcttcggcctgtcggcggagttgccgcagcatccgaagacccgcgacctgctgctgttctccctgcgcaagctgggcccctggctggtggccttcctcatcaccctgtacctgtcggtggtgctgccggactccctgagcaagaccctggcgatggtcatggcctatgtgctggtctgcggcacgctgttctccgcgctgtgcgtgatttccctctcgctgctcagcggcccgcaccgccagcgcgccctggatatcctgcggcgccaggcgttccgcccgttgtggctgatcggcagcctcgccgcgctgggcgaggtcgcccacgatccgcggctgatcgccggcctcggcgagcacacctcgatctgcctgagtaccctggccaacgccagcgccgcgctgttcaccgccttgttcgtgatgcgtttccgccggccgatcgcccacctgatccgcaaccagccgctggagcgccgcctcaagcgccgtag

SEQ ID NO: 4922 - DNA, 1620 bp, Pseudomonas aeruginosa
gcgttatccgccgcggccctgcacaatcggcggataaccgcgatgcggttattcgccctacgttacgatttgaccggtggttccgggcgggcgccctgccgaggctggggcggcgtctcgcttggtacgggcgcgcgacggaccatgaaaaacggggcccgaaggccccgttgggtcgctcatgggagcagtggcgcttcagtcgtcgccttcgtcgtcggctccatcgacgttcatccccagctccttgatcttgcgggtcagggtattgcggccccagccgagcagcacggcggcatcgcggcggcggccggcggtgtgcttgagggcggtttctatcatgatccgttcgaaggccggcacggcgctgtccagcaggttcgactggccgcggcccagcgcctggtcggcccactggcgaagggcctgttcccagttcgccgccggcgcgctgtcctgcggctgggtcagcagctccggcggcaggtcgtcgatgtgcacctcgcggccggaggccatcacggtgatccagcgacaggtgttctccagttggcggacgttgcccggccagccgaggttcttcaggtactcctcggtttccgccttcagcagcttgggttccaccgccagctcctgggcggcgcggctgaggaagtgccgggccagcgccgggatgtcctcgcggcggtcggccagccgtgggatgtggatgcggatcacgttcaggcgatggaacaggtcctcgcggaacttgccgtcgcgcaccaggctttccaggttctggtgggtggcggcgatgatccgcacgtcgaccttcaccggcgtgtgcccgccgacccggtaaaactcgccgtcggccaggacgcgcagcaggcgggtctgggtgtcggccggcatgtcgccgatctcgtcgaggaacagggtgccgccatcggcctgctcgaagcgtccgcggcgctgggcggcggccccggtgaaggcgcccttctcatggccgaacagctcggattccatcaggtccttggggatcgccgccatgttcagcgcgatgaatggcgaggctgcgcgcgggctgtggcgatgcagggcatgggcgaccagctccttgccggtacccgattcgccgttgatcagcacggtgatgttggaatggctgaggcggccgatggcgcggaatacctcctgcatcgccggcgcctcgccgatgatctccggcgtgcgcgcctggttcgccggcagctccaggccctgctgctcctgggcgtgctggttggcgcgcttgaccagggagaccgcctcgtcgacgtcgaacggcttgggcaggtattcgaaggcgccgccctggtaggaggcaaccgcgctgtcgaggtcggaatgcgcggtcatgatgatcaccggcaggcgcggatgcagttcgcggatctgcgccagcaggtcgaggccgctggcgccgggcatgcggatatcggagatgatcacgtccggctgctgccggccgaggcggccgatgacgctgtcggcgctgtcgaagctcaccgtggtcatgccttcctgttgcagggccttttccagtacccagcggatggagcggtcgtcgtcgacgatccagacggtctctga

SEQ ID NO: 4923 - DNA, 2172 bp, Pseudomonas aeruginosa
acctgccaagcgttgcaccgcatcggcgcgctggcaagccgtgcattgtgcggcatgcgggtattcgaaggtgtgcgctggggcacgttggcggtcgctgtgccccgccgcgcggctgcgttcgtctcagccggcactggcggggcgaaccctcgttgcgccagagtgtctgtgcttgcgccgccggccggcggccccgttcgaaacggcgggtgtccggcttgtatgatgcggctgtttcggtttctcaccttggggactgcctttctcgtgccgatcatcgcccgcttcacccttcgctcccgcgtcctggcggccctgctgctgtgcctctgcgccgccctgttctactcgccgccgggtgccgcggcgctgccgaacccgttggcggggagttcttccggtggcgagaaggtcagcgatgcgcagttggaacaatcgctgaaccaggtcatccagaccctggagaacgacaggcagcgcgccgacctgctgaaaaagctgaaacagctgcgcgacgtgaccaagaaaggcaaggaaagcgagggtggggtgctggggctgatcggcgataccctgaccagcctggagaagcagttccagggcgcgaacagcccggtcgcgttatggggcaaccagttccagctggcgcgtgccgaactcgaggagcgctttccaagctggcgcgacctgccggcgatggtcttcgatttttcggtggtgatcctcctctgggcctgcctggccagcgcgctgctctggctcagccggcgcatgcgcgagcgcttcggcctgtcggcggagttgccgcagcatccgaagacccgcgacctgctgctgttctccctgcgcaagctgggcccctggctggtggccttcctcatcaccctgtacctgtcggtggtgctgccggactccctgagcaagaccctggcgatggtcatggcctatgtgctggtctgcggcacgctgttctccgcgctgtgcgtgatttccctctcgctgctcagcggcccgcaccgccagcgcgccctggatatcctgcggcgccaggcgttccgcccgttgtggctgatcggcagcctcgccgcgctgggcgaggtcgcccacgatccgcggctgatcgccggcctcggcgagcacacctcgatctgcctgagtaccctggccaacgccagcgccgcgctgttcaccgccttgttcgtgatgcgtttccgccggccgatcgcccacctgatccgcaaccagccgctggagcgccgcctcaagcgccgtagcctgcacgacctggtgcaactggtcggctcgctgtggttcgtgccggtgctggtgctggtggggatttccctgttcgccaccttcgtttccgccggcgacagcagttcggcgttgcgccgggcgctggtctgcgcggtgctggcggtggtggcgatgaccgtgatcgggctgatccgccgccgttccagtcgggtcggcgccggcccgcgccgcagcgcgccgtacatcgagcagttgcagagcttcggctacaccctgctgcacatcttcgtggtgctgttcttcatcgaggtcgccttgcgcgtctggggcatgtcgctgattcgctatgcggaaggcgagggcgagcagatcagcatgaaggtagtcagcttcggcaccaccctgctggtcgcctggctgatctggatcctcaccgataccgcgatccagcacagcctcggcctgggcggcaagagccggccgaacacccgcgcgctgaccatgctgccgctgatccgcaacgtgctgttcgccaccatcgcggtgatcgccctgatcgtcgccctggccaacatgggcatgaacgtcaccccgttgctggccggtgccggcgtgatcggcctggccatcggcttcggcgcgcagtcgctggtggcggacctgatcaccggcctgttcatcatcatcgaggactcgctgtcgatcgacgactacgtcgacgtcggcggccaccttggcacggtcgagggcctgactatccgtaccgtgcgcctgcgcgacctgtacggcgtggtgcataccatcccgtgcagcgagatcgagagcatccagaactactcgcgccagttcggctacgcgatgttccgctggccggtgccggcgagcatgccgatcgacgacgcggtggcgctg

SEQ ID NO: 4924 - DNA, 687 bp, Pseudomonas aeruginosa
  unsure (41): Identity of nucleotide at the above locations are unknown.
aggagcgaagagcagcaggccgtgcgttcggtgcatcgggngcgcagtcgtctggtgcgggcccgcacggcgttgtgcaatgaggtgcgtggcttgctgggcgagttcgggctgatcgcgacgcgacgtgggcgagcggcgacgatggcattgctcgaaacggtcacggataccgaaccggcgcccttgccggccccgatgggcgagctgttgcgtgaattgaaagatgaattgcagacgctggaggcgcgcatcgctcgactggagcgacagattcaggctcacgtacgtggcgatgcccgcatccagcgcctgctggcggtggaaggcatcggcccgatcagcgccagcgcggtggcggcatccgccggtgatgcacggcaattccgcacgggccgccagtttgcggcctggctgggcctagtgccacggcagcactccacgggcgggcagcagcgcttgggcaacatcagcaagcgcggcgatacctacttgcggaccttgctcatccatggcgcccgtgcagtcgtgcgctgttgcgccaacaagaccgatgcccgcagccgctggctgcaaggtctgctgcaacggcgtcctgccaatgtcgtcgccgttgccctggccaacaagaatgcccggatcctttgggccttactcagccgggagacatgctaccggcccggttga

SEQ ID NO: 4925 - DNA, 504 bp, Pseudomonas aeruginosa
aactcgccgtcggccaggacgcgcagcaggcgggtctgggtgtcggccggcatgtcgccgatctcgtcgaggaacagggtgccgccatcggcctgctcgaagcgtccgcggcgctgggcggcggccccggtgaaggcgcccttctcatggccgaacagctcggattccatcaggtccttggggatcgccgccatgttcagcgcgatgaatggcgaggctgcgcgcgggctgtggcgatgcagggcatgggcgaccagctccttgccggtacccgattcgccgttgatcagcacggtgatgttggaatggctgaggcggccgatggcgcggaatacctcctgcatcgccggcgcctcgccgatgatctccggcgtgcgcgcctggttcgccggcagctccaggccctgctgctcctgggcgtgctggttggcgcgcttgaccagggagaccgcctcgtcgacgtcgaacggcttgggcaggtattcgaaggcgccgccctggtag

SEQ ID NO: 4926 - DNA, 915 bp, Pseudomonas aeruginosa
gcacaagagccaggagataccatcatgcgttacgcccatcccggtagcgaaggcgccatcgtttccttcaaggcccgctacggcaactacatcggcggcgagttcgtgcctccggtcaagggccagtacttcaccaacacctcgccggtgaacggccagccgatcgccgagttcccccgttccaccgccgaggacatcgacaaggccctcgacgccgcccacgccgccgccgacgcctggggccgcacctcggtgcaggagcgctcgaacatcctgctgaagatcgccgaccgcatcgagcagaacctggaactgctcgccgtcaccgagacctgggacaacggcaaggccgtgcgcgagaccctcaacgccgacatccccctggccgccgaccacttccgctacttcgccggctgcatccgcgcccaggaaggctccgccgccgagatcaacgacagcaccgtggcctaccacatccatgagccgctgggcgtggttgggcagatcatcccgtggaacttcccgctgctgatggccgcctggaagctggccccggcgctggccgccggcaactgcgtggtgctcaagccggccgagcagaccccgctgggcatctgcgtgctgctggaactcatcggcgacctgctgccgccgggcgtgctcaatgtcgtccagggcttcggcagggaggccggcgaggccctggccaccagcaagcgcatcgccaagatcgccttcaccggttccaccccggtcggctcgcacatcctcaagtgcgcggcggagaacatcattccctccaccgtcgagctgggcggcaagagcccgaacatctatttcgaagacatcatgcaggccgagccggcgttcatcgcgaaggccgccgagggcgccatggtcttcacaacggggagg

SEQ ID NO: 4927 - DNA, 2211 bp, Pseudomonas aeruginosa
cggcagcgccgccagggcctggcggatatccgcgggcaggtcgcgcaggccgacccggccgtcctcgcagagtgccaccagggtccgcagcaccgtgcgcatctgccggacgttgcccggccagcggtaggccagcaggccctggcgaacctcgccgtcgagctggatgcgctggcccctggcctcctcggccagcaggtagtccagcagctcctcgcggtcgctgcgctcgcgcagcggcggcaggctcacgaccatgccattgaggcggtagtagagatcctcgcggaagcgtccatcggcaaccagcccggccaggtcgcggtgggtagcgctgatcaggcgcacgtcgacatcctccggctcgccgcccagcggtactacccggcgctcttccagcacccgcagcaggcgggtctgcaaggccagcggcatgtcgccgatctcgtcgaggaacagggtgccgccgtcggcctgctgcaacttgccgcgcatgccctccttgcgcgcgccggtgaagctgccgccgcgataaccgaacagttcgctctcgatcagggtttccgggatcgccgcgcagttcagcgcgacgaacgcctgttccgcgcgcgggccggccaggtgcacggccttggcgaaggcctccttgccggaaccggtctcgccgttgagcagcagcggcacgtcgcgcgcgtagaccttcagcgcccggcggaaatcggcggccagctcggcgtcgcccaggcacaggccgggcgcggcaggcgccggcttcgctgccgtgggcaccgccagggcctggggtatcgcccgcggcgcgccgcgcagcatggcgtacagggtccgtccctcgcgggtgcgcagcggccagctggcgctgggttgcggcgaggcgcgaccgagcaggtcgtcgagacggcaatcgaagaaggtctccaccggctggccgagcaggcgctggcgcggacaaccgagcaggttcagcgcgctctggttcaccgcgcggatccgcccgtcttcctcgaaggccagcagtccttcgctgaacaggccgacatagtcgccctggacatggaagcgcagcagccaggagccctcgaagcgacggaggaaatagcagccctcgatgatcttcgccgacaggttgaccagcgccatggtgtggaactggctctgccgcgagacttcctggcgcgccgaagacacgtcgagcaccgccatcagctcgccctgcggatcgaacaccgggctcgccgagcaggtcaggccggtatggcggctacggaagtgctcttcctgctggatggtcagggcctgccgctcgaccacgcaggtgccgatgccgttggtgccttcgcagggctcgctccagtcggcaccgagccagaggccggcgtgttcgaaggtctggcgctgggcgtcggcgttgacgcaattgaggatcaccccgcgggcatcggtgagcagtaccgcgtggtcgttgccggaaagctgctggtagaggctgtgcatctcgccatcggcgatctccagcacctgttgcaggcgctcgcggcgttcgagcatgcgcgcgtgctccagcaccatcggcgccatcggctggccgggatcgagatggtgctgttccaggcagcgcagccaggagcgggcgatggacggatcggtcgcagggccgcccggcgggatcttgccctgggcgacggtcagcacttgccgcgcgtggcggctcatggaactggcaggcattgttatggttctccgcgagggacgggccgtctcttgcctgggcgcggtggatcggtccgcgagtctccggacggctatcggtgcagcatccaacaggccggggcgcaatgcaacgacggactgaccgatgagtcatgcgctgcgccaaaaacggtacagagtgtcactcacgagcgtcccgcccgcgtgacagggagcgttcgcaagctcccctgcgaaacctccaggacgctctactccgggcatttcgccactctggcccggcccttgctccaggcttacgacaagcgcgacagcgcgtcctcccctaataagcacaagagccaggagataccatcatgcgttacgcccatcccggtagcgaaggcgccatcgtttccttcaaggcccgctacggcaactacatcggcggcgagttcgtgcctccggtcaagggccagtacttcaccaacacctcgccggtga

SEQ ID NO: 4928 - DNA, 252 bp, Pseudomonas aeruginosa
agatcgccgaccgcatcgagcagaacctggaactgctcgccgtcaccgagacctgggacaacggcaaggccgtgcgcgagaccctcaacgccgacatccccctggccgccgaccacttccgctacttcgccggctgcatccgcgcccaggaaggctccgccgccgagatcaacgacagcaccgtggcctaccacatccatgagccgctgggcgtggttgggcagatcatcccgtggaacttcccgctgctga

SEQ ID NO: 4929 - DNA, 435 bp, Pseudomonas aeruginosa
cgaaggcgccatcgtttccttcaaggcccgctacggcaactacatcggcggcgagttcgtgcctccggtcaagggccagtacttcaccaacacctcgccggtgaacggccagccgatcgccgagttcccccgttccaccgccgaggacatcgacaaggccctcgacgccgcccacgccgccgccgacgcctggggccgcacctcggtgcaggagcgctcgaacatcctgctgaagatcgccgaccgcatcgagcagaacctggaactgctcgccgtcaccgagacctgggacaacggcaaggccgtgcgcgagaccctcaacgccgacatccccctggccgccgaccacttccgctacttcgccggctgcatccgcgcccaggaaggctccgccgccgagatcaacgacagcaccgtggcctaccacatccatga

SEQ ID NO: 4930 - DNA, 432 bp, Pseudomonas aeruginosa
gccgctgggcgtggttgggcagatcatcccgtggaacttcccgctgctgatggccgcctggaagctggccccggcgctggccgccggcaactgcgtggtgctcaagccggccgagcagaccccgctgggcatctgcgtgctgctggaactcatcggcgacctgctgccgccgggcgtgctcaatgtcgtccagggcttcggcagggaggccggcgaggccctggccaccagcaagcgcatcgccaagatcgccttcaccggttccaccccggtcggctcgcacatcctcaagtgcgcggcggagaacatcattccctccaccgtcgagctgggcggcaagagcccgaacatctatttcgaagacatcatgcaggccgagccggcgttcatcgcgaaggccgccgagggcgccatggtcttcacaacggggag

SEQ ID NO: 4931 - DNA, 951 bp, Pseudomonas aeruginosa
cctccccgttgtgaagaccatggcgccctcggcggccttcgcgatgaacgccggctcggcctgcatgatgtcttcgaaatagatgttcgggctcttgccgcccagctcgacggtggagggaatgatgttctccgccgcgcacttgaggatgtgcgagccgaccggggtggaaccggtgaaggcgatcttggcgatgcgcttgctggtggccagggcctcgccggcctccctgccgaagccctggacgacattgagcacgcccggcggcagcaggtcgccgatgagttccagcagcacgcagatgcccagcggggtctgctcggccggcttgagcaccacgcagttgccggcggccagcgccggggccagcttccaggcggccatcagcagcgggaagttccacgggatgatctgcccaaccacgcccagcggctcatggatgtggtaggccacggtgctgtcgttgatctcggcggcggagccttcctgggcgcggatgcagccggcgaagtagcggaagtggtcggcggccagggggatgtcggcgttgagggtctcgcgcacggccttgccgttgtcccaggtctcggtgacggcgagcagttccaggttctgctcgatgcggtcggcgatcttcagcaggatgttcgagcgctcctgcaccgaggtgcggccccaggcgtcggcggcggcgtgggcggcgtcgagggccttgtcgatgtcctcggcggtggaacgggggaactcggcgatcggctggccgttcaccggcgaggtgttggtgaagtactggcccttgaccggaggcacgaactcgccgccgatgtagttgccgtagcgggccttgaaggaaacgatggcgccttcgctaccgggatgggcgtaacgcatgatggtatctcctggctcttgtgcttattaggggaggacgcgctgtcgcgcttgtcgtaa

SEQ ID NO: 4932 - DNA, 1278 bp, Pseudomonas aeruginosa
ccgccataccggcctgacctgctcggcgagcccggtgttcgatccgcagggcgagctgatggcggtgctcgacgtgtcttcggcgcgccaggaagtctcgcggcagagccagttccacaccatggcgctggtcaacctgtcggcgaagatcatcgagggctgctatttcctccgtcgcttcgagggctcctggctgctgcgcttccatgtccagggcgactatgtcggcctgttcagcgaaggactgctggccttcgaggaagacgggcggatccgcgcggtgaaccagagcgcgctgaacctgctcggttgtccgcgccagcgcctgctcggccagccggtggagaccttcttcgattgccgtctcgacgacctgctcggtcgcgcctcgccgcaacccagcgccagctggccgctgcgcacccgcgagggacggaccctgtacgccatgctgcgcggcgcgccgcgggcgataccccaggccctggcggtgcccacggcagcgaagccggcgcctgccgcgcccggcctgtgcctgggcgacgccgagctggccgccgatttccgccgggcgctgaaggtctacgcgcgcgacgtgccgctgctgctcaacggcgagaccggttccggcaaggaggccttcgccaaggccgtgcacctggccggcccgcgcgcggaacaggcgttcgtcgcgctgaactgcgcggcgatcccggaaaccctgatcgagagcgaactgttcggttatcgcggcggcagcttcaccggcgcgcgcaaggagggcatgcgcggcaagttgcagcaggccgacggcggcaccctgttcctcgacgagatcggcgacatgccgctggccttgcagacccgcctgctgcgggtgctggaagagcgccgggtagtaccgctgggcggcgagccggaggatgtcgacgtgcgcctgatcagcgctacccaccgcgacctggccgggctggttgccgatggacgcttccgcgaggatctctactaccgcctcaatggcatggtcgtgagcctgccgccgctgcgcgagcgcagcgaccgcgaggagctgctggactacctgctggccgaggaggccaggggccagcgcatccagctcgacggcgaggttcgccagggcctgctggcctaccgctggccgggcaacgtccggcagatgcgcacggtgctgcggaccctggtggcactctgcgaggacggccgggtcggcctgcgcgacctgcccgcggatatccgccaggccctggcggcgctgcc

SEQ ID NO: 4933 - DNA, 1878 bp, Pseudomonas aeruginosa
ctcatcggtcagtccgtcgttgcattgcgccccggcctgttggatgctgcaccgatagccgtccggagactcgcggaccgatccaccgcgcccaggcaagagacggcccgtccctcgcggagaaccataacaatgcctgccagttccatgagccgccacgcgcggcaagtgctgaccgtcgcccagggcaagatcccgccgggcggccctgcgaccgatccgtccatcgcccgctcctggctgcgctgcctggaacagcaccatctcgatcccggccagccgatggcgccgatggtgctggagcacgcgcgcatgctcgaacgccgcgagcgcctgcaacaggtgctggagatcgccgatggcgagatgcacagcctctaccagcagctttccggcaacgaccacgcggtactgctcaccgatgcccgcggggtgatcctcaattgcgtcaacgccgacgcccagcgccagaccttcgaacacgccggcctctggctcggtgccgactggagcgagccctgcgaaggcaccaacggcatcggcacctgcgtggtcgagcggcaggccctgaccatccagcaggaagagcacttccgtagccgccataccggcctgacctgctcggcgagcccggtgttcgatccgcagggcgagctgatggcggtgctcgacgtgtcttcggcgcgccaggaagtctcgcggcagagccagttccacaccatggcgctggtcaacctgtcggcgaagatcatcgagggctgctatttcctccgtcgcttcgagggctcctggctgctgcgcttccatgtccagggcgactatgtcggcctgttcagcgaaggactgctggccttcgaggaagacgggcggatccgcgcggtgaaccagagcgcgctgaacctgctcggttgtccgcgccagcgcctgctcggccagccggtggagaccttcttcgattgccgtctcgacgacctgctcggtcgcgcctcgccgcaacccagcgccagctggccgctgcgcacccgcgagggacggaccctgtacgccatgctgcgcggcgcgccgcgggcgataccccaggccctggcggtgcccacggcagcgaagccggcgcctgccgcgcccggcctgtgcctgggcgacgccgagctggccgccgatttccgccgggcgctgaaggtctacgcgcgcgacgtgccgctgctgctcaacggcgagaccggttccggcaaggaggccttcgccaaggccgtgcacctggccggcccgcgcgcggaacaggcgttcgtcgcgctgaactgcgcggcgatcccggaaaccctgatcgagagcgaactgttcggttatcgcggcggcagcttcaccggcgcgcgcaaggagggcatgcgcggcaagttgcagcaggccgacggcggcaccctgttcctcgacgagatcggcgacatgccgctggccttgcagacccgcctgctgcgggtgctggaagagcgccgggtagtaccgctgggcggcgagccggaggatgtcgacgtgcgcctgatcagcgctacccaccgcgacctggccgggctggttgccgatggacgcttccgcgaggatctctactaccgcctcaatggcatggtcgtgagcctgccgccgctgcgcgagcgcagcgaccgcgaggagctgctggactacctgctggccgaggaggccaggggccagcgcatccagctcgacggcgaggttcgccagggcctgctggcctaccgctggccgggcaacgtccggcagatgcgcacggtgctgcggaccctggtggcactctgcgaggacggccgggtcggcctgcgcgacctgcccgcggatatccgccaggccctggcggcgctgccg

SEQ ID NO: 4934 - DNA, 1665 bp, Pseudomonas aeruginosa
ggtctcacccgcggcgtagagcccggcgagcaacaggcaggacttcacctgggcgctggccatcggcatgtcgtaatgcataccggtgaggcgctggccgccgcgaatggtcatcggcggacggccttccggccccgtctcgattaccgcgcccatctcgcgcagcggcttggctacgcgattcatcggccgcttggaaagggaagcgtcgccggtcagggtgctgtcgaacggctgggccgccagcagaccgctgagcagacgcatggaagtaccggagttacccaggtagatcggcccaggcggcgccttgaggccgtgcaggccaacgccatggacggtgacgcggccgttctgcggcccctcgatcaccactcccatgtcgcggaacgcctggatggttgccagtgcgtcctcgccctcgaggaagccctccacttcggtggtgccttcggccagggagccgagcatgatcgagcgatgggaaatcgacttgtcgcccggtacccggatggttccggacaggctgccgcccggctgggccagataaatcaggtcgttgttgtgcatggcgtccacataggcccgacgggccaggattttgctgaaatgctcacgggctacccgggcgcgcgtgaaaacgcccaacaactggtgcccgtccccagtgtcgacggcctcgcgcagcgcgtcgaggtcgtcacgaaaaacatccagtgtacgcagcaccgcctcgcgattggcgagaaagatgtcgtgccacatcaccgggtcgctgccggcgatccgcgtgaaatcacggaaaccgccggcggcatagcggaagatctccaggttctcgctgcgcttggccagggagtcgaccagggtgaaggccagcaggtgaggcaggtggctggtggccgccagaacctcgtcgtgatgctcgacctccatgtgctcgacgtccgcgcccagcgcgcgccacaggctgtcgaccagcgccagcgcgtcggcatcggtctccgcggagggcgtgagaatcaccttgtgccggcggaacagggtcgccttcgccgcggtcactccgctctgctcggaacccgcgatcggatgccccggtaccaggtaccgcggcatcccgccgaacgcgacacgcgcggcacgcacgatattgcccttggcgctgccaacgtcggtcaatacagccttgcccaggtcgagcttcgccaggtcggccagcacccgctccatcgccaggatcggcaccgccaactggatcacgtcggcgccgacgcaggcgcggccaagatcctcctcgcaacggtcgaccacgccgagctccaccgccaggcggcaagactcggcatcccgatccacgccgaccacttcccggaacaaccctttgctccgcaaccccttggcgaaggagccgccgatcaggcccagccccaccaccaccaggcggcccagcttaggggtcgactgttgcagcggcgtgacctcagtcatgcgccagcaccttgcccagcgcctggaggaaacgatcgttctcttccggcagcccgatggagacgcgcaggaaggtcggcatcccgtagccagccaccggacgcacgatcacaccttcgcgcagcagcgcctggtagaccggaccggcatcgcgagccagatccacggcgatga

SEQ ID NO: 4935 - DNA, 1356 bp, Pseudomonas aeruginosa
cgatcgccgcagggtcgatgcccagctcgcgggccagttcgtccaccggcttgccagggacgtagggcgacagcttttgcacccccggctgggccagggcaaggaaatcggacatggatagttcagcctcgacgcgggacggggcattcatcgatgacccgtctcttcggaatgacagcgcgctcagagcaccgctttcggataggagcccaggaccttcagggcgacggcttcctggccgatcttctccaggacgtccttgatcagcggttctttatggtggccgacgaaatcgatgaagaacacgtaggtccatttgccgctgcgcgacggacgggtttcgatgcgggtcaggtcgataccgttgttgtggaacggtaccagcagctcgtgcagggcccccggcttgttgcgcatggaaacgatgatcgaggtcttgtcgtcgccggtcggcggcacctcctgattgccgatgatcaggaagcgcgtggagttgtccgggcggtcctcgatcttctcgtgcagcttgctcaggtcgtacaggctggccgccatgtcgccggcgatcgccgccgaattccactcgctcttcacccgcttggccgcgtcggcgttgctcgacaccgccacccgctcgacgctcgggtagtgcgagtccagccacttgcgacattgcgcgagggattgggcatgggaatagatccgggtgatgttgtcggtcttggtggtttcgccgaccagcaggtgatggtggatacgcagctcgacttcgccgcagatcaccatgtcgtgctcgaggaagctgtcgagggtatggttgaccgccccctcggtggagttttccacaggcaccacgccgaagttcaccgcgccggcggcgacctcgcggaacacctcgtcgatcgccgccatcggcgtgctgatcaccgcattgccgaaatgcttgagtgccgcggcctgggtaaaggtgccctcgggtccgagataggccactttcagcggctgctcgagcgccaggcaggacgacatgatctcgcggaacagccgcgcgacctcttcgttgtccagcggccccttgttcaattgcatgatgtgcttgagcacccaggcttcgcgctcgggacggtagaacaccggcgcctcgccctcgcccagggtctgggtcttgactcgcgccacgtcctgggcgcaacgggcacgctcgctgatcagctcgagcaacttctcgtcgaggctgtcgatgcgcaggcgcaaggccttgagctggtcctggtccgccatcagccgtgctccttctcgaactccgccatgtatgcgaccagcgcctcgaccgcgtccaggccaagggcgttgtag

SEQ ID NO: 4936 - DNA, 933 bp, Pseudomonas aeruginosa
tcatcactacggtggctcatttccatgaccgaaaggcccttgccccgccagtcgagaagctcggcctgggcacgttgcagaactgcgtcgggaagcgccgcgggaccggcgcagaaattgaaggctcgcttgctcacatccactctcgctataggtagggcggatagccgtgagttatccgccgacgtcatcggccgggcgggcgcaggcgcccgccccgagccttactcttcgttgccttccgcttccgccgcgggctcggactcggactcggccgactcgcccagagattcggcagcttcctccccttcgggcaggtcctcgtcatctccgcccgacggctcctggacacgctccagaccgaccagtacctcgtcgctggcgagcttgatcagggttacgccctgggtattgcggccggacagggagacttcgtcgacacgcgtccgcaccagggtgccctggtcggaaatcagcatgatctcctcgccttcctggacctgtaccgcggcgatcagcgcgccgttgcgctcgttggtgaccatggcgatcaccccctggccgccacggccgcgacgcgggaacttgctcagcggggtacgcttgccgaagccgcgctcggaggcggtgaggatctgcgccccggactccggaatcagcatggagatcagctgctgccccttgcccaggcgcatgccgcgtacgccgcgggcgttgcggcccatgatgcgcaccacgctctcggcgaagcggatcaccttgccggcgctggagaacagcatgacttccttggcgccatcggtgatcgcggcggcgatcagggtgtcgccctcttccagcttgagcgcgatcaggccgctgctgcgcggacggctgaactgcaccagcggggtcttcttcacggtaccgaaggcggtggccatgaagatgtag

SEQ ID NO: 4937 - DNA, 939 bp, Pseudomonas aeruginosa
cagcggggtccgcgcccaggtggcgatcccggtactggacttcccgatccccggcgcccgcgacagcgccgaggcgatccgccagggcatggcgctgttcgacgacctcaagcaccacccgcgcatccgcatcgccttcggcccgcacgctccttatacggtgagcgacgacaagctggagcagatcctggtgctcaccgaggaactcgacgccagcatccagatgcacgtccacgagaccgccttcgaggtggagcaggccacggagcgcaacggcgagcgcccgctggcccgcctgcaccgcctcggcctgctcggcccacgcttccaggcggtgcacatgacccaggtggacgacgacgacctggcgatgctggtggaaaccaacagctcggtgatccactgcccggaatccaacctcaagctggccagcggcttctgcccggtggaaaaactctggcaggccggggtcaacgtagccatcggcaccgacggcgcggcgagcaacaacgatctcgacctgctcggcgagacccgcaccgcggcgctgctggccaaggccgtgtacggccaggccaccgccctcgacgcccaccgcgcgctgcgcatggccaccctgaacggcgcccgcgcgcttggcctggagcgcctgatcggctccctggaagccggcaaggccgccgacctggtggccttcgatctgtccggcctggcccagcaaccggtctacgacccggtttcgcaacttatctatgccagcggccgcgactgcgtgcggcacgtctgggtcggcggcaggcaactcctcgacgacggccgcctgcttcgtcacgacgaacagcgcctgatcgccagggcccgcgaatggggggcgaagatcgccgccagcgacaggtcctgaaccgcggcgggccggcccgctgcgacaaactgacatag

SEQ ID NO: 4938 - DNA, 1488 bp, Pseudomonas aeruginosa
gaaggcgaaccgccgccggccccatccctccgccaaagctggcaacatgaaggattggattccgccgccgcggcccttcccccaaaggcttcactcttcaacgggaacgattatgagcaacgtcgaccacgccgagatcgccaaattcgaggcactggcccatcgctggtgggaccgcgagagcgagttcaagccgctccacgacatcaacccgctgcgcgtcaactggatcgacgagcgcgccggcctggccggcaagaaggtgctcgacatcggttgcggcggcggcatcctcagcgaagccatggcccagcgcggcgccaacgtcaccggcatcgacatgggcgaagcgccgctcgcggtggcgcgcctgcaccagctggaatccggcgtcgccgtcgactaccggcagatcaccgccgagcagatggccgaggaaatgcccgggcagttcgacgtggtcacctgcctggagatgctcgaacacgtgccggacccggcctcggtgatccgcgcctgccaccgcctggtcaagccgggcggacaggttttcctctcgaccatcaaccgcaatcccaaggcctacctgttcgcggtgatcggcgcggaatacatcctccagttgctgccgcgcgggacccacgatttccgcaagttcatccgtccgtcggaactcggcgcctggtcgcgcgaggccggtctcgaggtcaaggacatcatcggcctgacctacaacccgctgaccaagcactacaagctggccaacgacgtcgacgtcaactacatggtccagacccagcgggaggcgtgaagcgcatgcggctcaaagcggtactgttcgacatggatggcaccttgctcgacacggcgccggacttcatcgccatcacccaggccatgcgtgccgcccacggcctgccgccggtggacgagcaacgggtgcgcgacgtggtctccggcggcgcgcgcgcgatggttgccgcggccttcggcctgtcgctggacagcccggaactggaacccctgcgccaggagttcctcgaccgctaccaggagcattgcgcggttctcagccggccctacgacggcatccccgaactgctcgcggcgatcgagaaagccgggttgatctggggcgtggtgaccaacaagccggtgcgcttcgccgaaccgatcatgcagcgcctgggctacgccgagcgttccagggtgctggtctgcccggaccacgtgacccgcagcaagcccgatcccgagccgctgctactggcctgtagccagctcggcatcgatccgtcgagggtgctgttcatcggcgacgacctgcgcgacatcgaatccggccgcgacgccgggaccaagaccgcggcggtgcgctacggctacatccaccccgaagacaaccccgcgcactggggcgccgacgtgatcgtcgaccacccgcgcgaactcatcgacgttctcgaccgcgcgctctgcgactgctga

SEQ ID NO: 4939 - DNA, 1749 bp, Pseudomonas aeruginosa
tccgcagcgccgccgacagacaacgacccgccgccaggcgggtcatgcattcaaaggattcgacatgttccagtactccgcccgccccgacctgctgaaagaccgcgtgatcctggtcaccggcgccggccgcggcatcggcgccgccgccgccaagaccttcgccgcccacggcgccaccgtgctgctgctgggcaagaccgaggagtacctgaacgaggtctacgacgccatcgaggccgccggccatccgcaggccgccgtgatcccgttcaacctggagaccgcccagccgcaccagttcgaggaactggcggcaaccctggagaacgagttcggccgcatcgacggcctgctgcacaacgcttcgatcctcggtccgcgctcgccgatgcagcagatttccggggagaacttcatgcgcgtgatgcaggtgaacgtcaatgccatgttcatgctgaccaccgccatgctgccgctgatgaagctctccagcgacgcctcgatcatcttcacctcgagcagcgtgggccggaagggccgcgcctactggggcgcctattcggtatcgaagttcgccaccgagggcctgatgcagacccttgccgacgaactcgacggtaccagcgcgatccgcgccaacagcgtcaaccccggcgccacccgcaccagcatgcgcgccctcgcctaccctggggaaaacccgctgaacaaccccaccggcgaggagatcatgccggtctacctgtacctcatggggccggacagcgccggcgtcaacggccaggccttcgacgcccagtgattccccggcagcctcgccgcccggcgaggctgccctgtccttccctcttcccgtccggaacttcccattctttttgcatatttttcccactgagtgggaaagtggtttcattttccgggaaatcgccttcaccctgtgggtcaaggagttcccatgtcgaagcattcccccaccgatcgcctgctgcagatcctcattgccctcggccaggcgcccgaagccctgtctgcctaggagctgtcgctgaccctggagcagccgctgagcagcacctaccggcacctgaagaccctgttgcgctggggcctggccgaagaacaggccggccagggccgctacctgcccggcccggcctgcctgcaactggcgaagaaattcgatcgcgaggcctcgctgatcggtctcgccaaaccggaactcaagcgcctggccgacctgagccaggagagcgtggcgctgatggtggccagcaaccagcaggcgatctgcctggaactgttcgacagtccgcagccactgcgctgctgctaccagaaagggctggcgcagccgctgttgcatggcgcctcggccaaagccctgctggcgcacctggaggacgaacggcgcgaggagctgtacctcgcccaggaactctccgccgagcgtatcgacaagctggagcaggaactccggctgatccgcgaacagggctacgccgtcagccagggcgagatcgacgaaggcgtctggggcatcagcgtaccgctgctggacagccgccagcgcctgcacggcgccctcagcctgatggcccccgccttgcgcgcccagtcgcgcagcgaacgcttgcggcaatggaccctcgacgccgccgcgcgactttccgcgcggctggactgaccgacaggagtttcgatgtaccccgcccccgacatgagcctctggcaaggccggatcgatag

SEQ ID NO: 4940 - DNA, 1224 bp, Pseudomonas aeruginosa
agccacgccatgccgacattgcacctggacgccctgtccaccaccgccctcgccctgctcctgctcgccctcggcagccaattgaagaagcgcagccgctggctgacacgtctgtgcgtaccgtcgccggtgatcgccggcttcggcttcgcctccctggtctggctgctcagggatcgcggctggctcgacatcggcctcgacaccagcctgcagacgcccctgatggtggcgttcttcaccaccgtcggcctcggtggcagcctcggcctgctgcgcaagggcggcaagaccctgctggtctacctgtcggcctgctgggcgctggcgatactgcagaacctgatcggcgtaggcagcgccggactgctcggcctcgacccgttgctcgggatcatggccggcgcggtgtcgctggaaggcggcttcggcgcggcggcggccttcggcccggttgcggaagggctcggcgcccagggcgcgaccaccgtggcgctggcctcggccaccttcggcatggtcgctggcgggctgctcggcagcccggtggcgcgctggctgatcgaacgcaaccgcctgccggtgcaggcggaaagcgacaatcggctggaagccctcgggcagcaggagcgacgccagcatgcggcggccacgctggacggcaatctcctgctgcgcctgctgacctgcgtgctgctggtgatggtgctcggcttctggctcggcgacgcgctcgaggaacgcctgggcctggtgctgcccagttatgtcggggcgatgttcatcgccatcgtcctgcgcaacctcgacgaccggctcggctggctgcgcattccggaccacgccgtcggtaccctgggcgacgtctgcctgggcatcttcctgaccatggcgatgatgagcctgaagttctgggagctggagaacctcggcctgccgctgctcggcgtactgttcatccaggtcgcggtgctgttgctgctgacgatcttcgtcctgttccgcctgctcggccgcaactacgacgccgcggtgctctgcgccggcttcctcggccacggcctgggcgccacgcccaacgcggtggccaacatgggcgcggtctgcgagcactatcgggtgttctcgcacaaggccttcatcatcgtgcccctgtgcggcgcggtactgatcgatctcgtcgccatcccggcgatcacctggttcatcaacgccttcagttga

SEQ ID NO: 4941 - DNA, 1131 bp, Pseudomonas aeruginosa
cggagcgccagctttccgacgagcgcctcggccactcgccagcaaaacgccattattccgtcgaaatctctccgaaattcctacagaatgtggaaaccattcctaggaaaacctgtctgtgcctctgatttctccgttcttcagttggctggcacgaaactcgccttagccctactgtcgccgtctttcgcgccagaggttccgcgcatggctcctcccaagcagtccaataccatcgatttcgacgccgccaagcagaagcgcggcccccagcccggcggcaacgccagcgggccgcgcgccagcaacctgacggagttgcgccagcaactgaccctacagttgcagagcagcctggaggcggagcggattctcggcctgttcttcgaggaagtccgccaactgatcccgctggatgcccttggctaccgccatccgggctccgacctgcgcctggagttcggcagcagcgccaagcattcggtgagctatcgcctgagccatgacagcgactacctcggcgaactgatcttccgtcgccgccagcgcctcggcgaagacgaacaacggcaactggagagcctgctcggcaccctgctgttcccgctgcgcaacgccctgctctatcgcgccgcgatccagaccgccctgcgcgacgccctgaccggcaccggcaaccgcatcgccatggaccaggcgctcggccgcgaactggaactggcccggcgcaacctgcaaccgctctcggtgctgatgctcgatatcgaccacttcaagcgggtcaacgaccactacggtcacgccgtcggcgacgaagccctcaaggccgtggcggaaaccatcaaggaccacctgcgcaatgtcgacatggtgttccgcttcggcggcgaggaattcctcgtcctgctgtccagcacgccgctgcaggctgcctgcatggtcggcgaacgcctgcgccaggcggtggaggaactggactaccggcacgccggcgaaccgctgaagctgtcgatcagcctcggttgcgccgacctgcggcccggcgaaggcagcgacgacctgctgcgacgggtcgacgaggcgctctacgaagccaagcgcgacggccgcaaccgcctgcgctgcgcctga

SEQ ID NO: 4942 - DNA, 543 bp, Pseudomonas aeruginosa
cctcgcgggacgactccaggtcatgaccgatgggcttctccagcaccacccgggtgcgctcggcgagaccggcggcggcgaggttctcgcagatgccgccgaacaccgaggccggcgtggcgaagtaggcgaccagcggcagttcgtcatccaccgcctcgcgcaagccgacataggcctgcgggtcgaggaagtccatgctcaggtagtcgaggcgttcgcggaaacgctgccagaccacgtcgtcccactccttcgccggcactgccaggcgcaggcgctgctccagcgtcgccaggtgttcggcgggagcgccttcgtcacgggccagggccaggacgcgggtatcgcggtgcagcaggttctcacgatcgagttggtagagcgccgggaacagcttgcgcaaggcgagatcgcccagcgcaccgaacagcgctaacgtgcaaggcagaacgcggacatcaggcatttgttgttaccaaccaaatattgagtgatattgagccatccactgcgcaattaagacaaatatgtagtaattaa

SEQ ID NO: 4943 - DNA, 1908 bp, Pseudomonas aeruginosa
cggcctgacgttaggataggcgccgccgccggcccttccccgccgggccgacagaacacgaggaacccggatgaaaaacctgctggagcagatccagagccgcctggacgaactgaacaaggcggagcgcaaagtcgccgaggtcatcctgcagaacccgcagcaggccacccgtttcagcatcgccgccctggcccaggcggcagcggtcagcgaaccgacggtgaaccgcttctgtcgctccttcggcatgagcggctatccggaactgaagatccagctggcccagagcctggccagcggcgctgccttcgtgacccaggcggtagccgaggacgacgggccggaagcctatacgcggaagatcttcagcaacaccatcgcctccctcgacagcgcccacaagctgctcgacccacgcgtcatcgaccgcgccgtggacctgttgatccaggcccggcagatccacttcttcggtcttggcgcctcggcctcggtagcgctcgacgcgcagcacaagttcttccgcttcaacctggcggtgagcgcccaggccgacgtgctgatgcaacggatgatcgcctcggtggcgcataccggcgacctgttcgtggtgatttcctataccggacgcacccgcgagctggtggaggtggcgcacctggcgcgggagaacggcgcctcggtgctcggcctgaccgccgccggctcgccgctggccagggccagcaccctgtgcctggacatcccgttgccggaagacaccgacatctacatgccgatgacttcgcggatcgtccagctcaccgtgctcgacgtactggccaccggagtgaccctgcgccgcggcgtggacttccagccgcacctgcggcggatcaaggaaagcctggtgccgacccgctatcccctcgacgaggacaactgaccgcccacctattgcaggccggcggcgagactcaggcgcatgcgttcgccgggcgccaggatcagcccgcccgggcggtagccagcggcgccgatacagaggaagcgttccgcttcgcccggctcgacctgctccaccgggcggctgccggggtgccagatcacgctgccggcgctgacgttcttgtcgatccgcaagcggcggttccagccgccgtcctccagcaccagcgatccgggatggtagagcacctgcttgaccgcgccgcgcggtatccaggttcccggaatccgcgaagcgccgcgctggccgcgagccgactccagctccatgccgtgcaccaccacccggctcagcgcgccgacccgccagtagggctgcagggcgaagctgaacaggcaatcgtcgtcttcctcatggtagctgcacagctccagctccaggcgctggccaaggcgcgcatcgaggcgcacgtgccagtcctccaggtccagttgccagctcaccaccaccttgctttcgtcggcgtaggcatccagcaggcgccattcgcgttgccgcgcccagccctgctgcggccattcgctgccgttcggatggctgccgaaccacggccagcagaccgggatgccgccgcgcaccggcgcgctgctgagggccggccattcgctggcgcaccacagcaacgggcgttcgccctgcggctggaaatgcaggagctgcgccccttgccgactgaatacggcctggcacagcggatggtcgatcaacagcagatcgcgacgttggaagcgtacccagtcgaacggtcgcttggcccgcatggaatgaaagaaacgctgcagcggatgctcaagcatgtccgattgtcctaccctctccccttcccggaaagcccgggcgtgcatccgtgtagttttactacatttcgcacgcaagccccaaatgatcggcacaggaaaagcgtagtcggtttgtaa

SEQ ID NO: 4944 - DNA, 522 bp, Pseudomonas aeruginosa
ttgcactcccgaatgggaatgcccagttgggttgttctgcgatggcgccaggcaagtcgggaggcaaccctcgccgcacctgcaaaacgccacaacataaggtctggaatattagcaaccaggccctgtatcgtcaattcccgcgccgaaacctcagacgtcccaaccctgccgctcgcagtgccggatgatcgtctcgaccaccgcctcgatgctcatttcggtggagtccagcaggatcgcgtcatcggccggtttcagcggcgcgaccgcgcgctggctgtcgcgctcgtcgcgctcgcggatttcttccagcaaggcagactggtcgacatccgcgcccttcgccttcaactgcaggtagcgtcgacgcgcacgctcctccgccgaggcggtgaggaagatcttcagaggcgcatcgggaaacaccacggtgcccatgtcgcggccgtcggccaccaaccccggcgcttcgaggaacgcccgctggcgctgcagcaacgcatcgcgcacggccggtaa

SEQ ID NO: 4945 - DNA, 996 bp, Pseudomonas aeruginosa
ggcgccggcaccgacctgctcggtacggatcacatcggtcacttcctcgccttcgagaatgatgcgctgcccatggctgccatcggcagcgacgaactgcacatcgaggtgcgcagccagaaccttcagcgcttcttcattggtcaggtcgacaccatggttgaccgcggcgaacgccaacagccgataaagcgccccggaatccagcaggttccagcccaggcgccgggcgagcagcccggcgaccgtgcccttgccggcgccactggggccatcgatggcgagcatcggtacagcgccgttcatcaattgttctccacggcgacccggataccggtctgggcacacagggcgaggaagttggggaaggaggtggcgacgttggcgcagtcgtggatgcggatcggcccgctggcacgcagcgaagcgacgctgaaggacatggcgatacggtggtcgccgtgcgcccagacttcgccgccaccgaacgcaccaccctcgatgacgatgccatccggggtcggctcggccttcacgcccagggccttcaggccgtcggccatgacctggatacggtccgactccttgacccgcagctcttcggcgccacgcaggacggtgcgcccctcggcgcaggcggcagccacgaagagtaccgggaactcgtcgatggccagtggcaccaggtcctcgggaatgtcgatgcccttgagccgcgcggagcgcacgcggatgtcggcgaccggctcgccgccgacctcgcgctggttttccaggctcaggtcaccacccatcaggcgcaggatctcgatgacgccgacgcgcgtcgggttgatgccgacgtgctgcaggaccagttccgaaccctcggcgatactggcggcaaccaggaagaaggctgccgaggatatgtcggccgggacctcgatatgggtggcgctcaacttgtgcccggattcgaccttggcggtgctgccctcgaccaccaccggatag

SEQ ID NO: 4946 - DNA, 822 bp, Pseudomonas aeruginosa
tgctcgacctccatgtgctcgacgtccgcgcccagcgcgcgccacaggctgtcgaccagcgccagcgcgtcggcatcggtctccgcggagggcgtgagaatcaccttgtgccggcggaacagggtcgccttcgccgcggtcactccgctctgctcggaacccgcgatcggatgccccggtaccaggtaccgcggcatcccgccgaacgcgacacgcgcggcacgcacgatattgcccttggcgctgccaacgtcggtcaatacagccttgcccaggtcgagcttcgccaggtcggccagcacccgctccatcgccaggatcggcaccgccaactggatcacgtcggcgccgacgcaggcgcggccaagatcctcctcgcaacggtcgaccacgccgagctccaccgccaggcggcaagactcggcatcccgatccacgccgaccacttcccggaacaaccctttgctccgcaaccccttggcgaaggagccgccgatcaggcccagccccaccaccaccaggcggcccagcttaggggtcgactgttgcagcggcgtgacctcagtcatgcgccagcaccttgcccagcgcctggaggaaacgatcgttctcttccggcagcccgatggagacgcgcaggaaggtcggcatcccgtagccagccaccggacgcacgatcacaccttcgcgcagcagcgcctggtagaccggaccggcatcgcgagccagatccacggcgatgaagttgcccttcgagggaatccaggacaggcccaacacgtggaagccatcctccagctgcgccatgccggaatcgtttag

SEQ ID NO: 4947 - DNA, 855 bp, Pseudomonas aeruginosa
gcggcgactctgcgccaggtagtcatggtcatccagcgccgcgcaggcagccgccagggccaggctattgacattgaacggctggcgcacgcggttgagcacatcggccaccgccttgctcgaaagcgcgtagccgacccgcagcgaagccaggccataggccttggagaaggtccgcgagaccagcaggttggggtgccgcgccaggtagtccaggccatcgggcagctcgtcgccctcggcgtattcgatataggcctcgtccagcaccaccagcacctccgccggcacctgggcgaggaaccgctccagggcgtccgcaccgaaccaggtcccggtcgggttgttcgggttggcgacgaacaccacgcgagtttgcccatcgatggcggcgagcatcgcttccaggtcatgcccccaggcgcgcgccttgaccgcccgcccctcggcgcccacggcctgggtggcgatcgggtagacggcgaaggcatgttcgctgaacacggcgttcagaccaggcgcgaggtaggcacgggcgaccaggtcgagaatgtcgttggagccgttgcccagggtcacctgcgccgcatccaccgcgcaacgctcggccagcttgcgcttgagttcgaaaccgttgccgtcaggataacgggtcagttccgccagttcggcgcggatagcctccagcgcctttgggctcgcacccagcgggttctcgttgctggcgagcttgacgatcgccgcagggtcgatgcccagctcgcgggccagttcgtccaccggcttgccagggacgtagggcgacagcttttgcacccccggctgggccagggcaaggaaatcggacatggatag

SEQ ID NO: 4948 - DNA, 528 bp, Pseudomonas aeruginosa
ccgtcggagcttaccacagcccacgccccagcccaaggcaaaggccctggcggggacgacctccagtcgcctcgttcaatgcaggcgcttgcggctcatcagggcggccatgcgctcggcgtcgggacgctcgacgacgccacgctcggtcacgatggcatcgataaggtccgccggggtcacgtcgaataccggattgtaggcatcgacctcggccgctacccgtcgcccgccgatttccagcagctcgcgaccgtcgcgctcttcgatcgggatgtcctcgccgctctccaggttcatgtcgatggtcgaactcggcgccaccaccatgaagcgcacgccgtggtgcatggcgttgaccgccaactggtaggtcccgatcttgttggcgacatcgccattggcggtgatgcggtcggcgccgacgatgacccaggtgatgttctcggtcttcatcaggtgcgcggcggccgaatccacgttcaggctgaccgggatgccttcgttggccagctcccaggcggttag

SEQ ID NO: 4949 - DNA, 642 bp, Pseudomonas aeruginosa
tcgcgagccctggagccagggccgggtttcgtcggcgtagatgcgattgaccaggccttccaggtgcgcggcgcggatcacccccagcgcggtgccgaacccgccggtcgccagggcgccggtattgcagtgggtgaggatgttctgcgggctgccctgctgcttgcggatcagctccatgcccaactgggccatggtcaggttggcctcgcggtcgctttcatggatggagatcgcctcggcttccagcaccgccagcggctggtcgccctatttcattcgctccagacggtcgcgcatgcggttcagcgcccagaacaggttgaccgccgtgggtcgcgagtcggccagcaggcggaagtcctcctccagcgcggcgcgccagtcgccgccctgcgccaagcgcgcgcgggcgccaaggacgatgccgtaggcggcgctgatgccgatggccggcgcgccgcgcacgaccatatcgcgaatggccttggccacctcggccgccgactcgtgttcgagccagacctcctcctggggcagcaggcgctgatccagcaaccgcagcgtaccgtcccgccactcgatcgccttgacccgctcggccgccagcagtcgctctcgcatgcacacacctctcgctga

SEQ ID NO: 4950 - DNA, 1317 bp, Pseudomonas aeruginosa
ccccttcgacctcctcctgctgccgacctggatcgtccccgtggagcccgccggggtggtgctgcgcgaccacgcgctgggcatccgcgacggccagatagccctggtcgcgccgcgcgagcaggccatgcgccatggcgccacggaaatccgcgaattgccgggcatgctgctcgcccccggtctggtcaacgcccacggccattcggcgatgagtctgttccgcggtctcgccgacgacctgccgctgatgacctggctgcaggaccacatctggccggccgaaggccaatgggtcagcgaggattcatccgcgacggcacggagctggccatcgccgaacaggtaaagggcggcatcacctgtttctccgacatgtacttctatccacaggccatctgcggcgtggtccatgacagcggggtccgcgcccaggtggcgatcccggtactggacttcccgatccccggcgcccgcgacagcgccgaggcgatccgccagggcatggcgctgttcgacgacctcaagcaccacccgcgcatccgcatcgccttcggcccgcacgctccttatacggtgagcgacgacaagctggagcagatcctggtgctcaccgaggaactcgacgccagcatccagatgcacgtccacgagaccgccttcgaggtggagcaggccacggagcgcaacggcgagcgcccgctggcccgcctgcaccgcctcggcctgctcggcccacgcttccaggcggtgcacatgacccaggtggacgacgacgacctggcgatgctggtggaaaccaacagctcggtgatccactgcccggaatccaacctcaagctggccagcggcttctgcccggtggaaaaactctggcaggccggggtcaacgtagccatcggcaccgacggcgcggcgagcaacaacgatctcgacctgctcggcgagacccgcaccgcggcgctgctggccaaggccgtgtacggccaggccaccgccctcgacgcccaccgcgcgctgcgcatggccaccctgaacggcgcccgcgcgcttggcctggagcgcctgatcggctccctggaagccggcaaggccgccgacctggtggccttcgatctgtccggcctggcccagcaaccggtctacgacccggtttcgcaacttatctatgccagcggccgcgactgcgtgcggcacgtctgggtcggcggcaggcaactcctcgacgacggccgcctgcttcgtcacgacgaacagcgcctgatcgccagggcccgcgaatggggggcgaagatcgccgccagcgacaggtcctga

SEQ ID NO: 4951 - DNA, 816 bp, Pseudomonas aeruginosa
cataggaaggcgaaccgccgccggccccatccctccgccaaagctggcaacatgaaggattggattccgccgccgcggcccttcccccaaaggcttcactcttcaacgggaacgattatgagcaacgtcgaccacgccgagatcgccaaattcgaggcactggcccatcgctggtgggaccgcgagagcgagttcaagccgctccacgacatcaacccgctgcgcgtcaactggatcgacgagcgcgccggcctggccggcaagaaggtgctcgacatcggttgcggcggcggcatcctcagcgaagccatggcccagcgcggcgccaacgtcaccggcatcgacatgggcgaagcgccgctcgcggtggcgcgcctgcaccagctggaatccggcgtcgccgtcgactaccggcagatcaccgccgagcagatggccgaggaaatgcccgggcagttcgacgtggtcacctgcctggagatgctcgaacacgtgccggacccggcctcggtgatccgcgcctgccaccgcctggtcaagccgggcggacaggttttcctctcgaccatcaaccgcaatcccaaggcctacctgttcgcggtgatcggcgcggaatacatcctccagttgctgccgcgcgggacccacgatttccgcaagttcatccgtccgtcggaactcggcgcctggtcgcgcgaggccggtctcgaggtcaaggacatcatcggcctgacctacaacccgctgaccaagcactacaagctggccaacgacgtcgacgtcaactacatggtccagacccagcgggaggcgtga

SEQ ID NO: 4952 - DNA, 864 bp, Pseudomonas aeruginosa
tcgtcgaccacccgcgcgaactcatcgacgttctcgaccgcgcgctctgcgactgctgatccgcagcgccgccgacagacaacgacccgccgccaggcgggtcatgcattcaaaggattcgacatgttccagtactccgcccgccccgacctgctgaaagaccgcgtgatcctggtcaccggcgccggccgcggcatcggcgccgccgccgccaagaccttcgccgcccacggcgccaccgtgctgctgctgggcaagaccgaggagtacctgaacgaggtctacgacgccatcgaggccgccggccatccgcaggccgccgtgatcccgttcaacctggagaccgcccagccgcaccagttcgaggaactggcggcaaccctggagaacgagttcggccgcatcgacggcctgctgcacaacgcttcgatcctcggtccgcgctcgccgatgcagcagatttccggggagaacttcatgcgcgtgatgcaggtgaacgtcaatgccatgttcatgctgaccaccgccatgctgccgctgatgaagctctccagcgacgcctcgatcatcttcacctcgagcagcgtgggccggaagggccgcgcctactggggcgcctattcggtatcgaagttcgccaccgagggcctgatgcagacccttgccgacgaactcgacggtaccagcgcgatccgcgccaacagcgtcaaccccggcgccacccgcaccagcatgcgcgccctcgcctaccctggggaaaacccgctgaacaaccccaccggcgaggagatcatgccggtctacctgtacctcatggggccggacagcgccggcgtcaacggccaggccttcgacgcccagtga

SEQ ID NO: 4953 - DNA, 648 bp, Pseudomonas aeruginosa
gagctgtcgctgaccctggagcagccgctgagcagcacctaccggcacctgaagaccctgttgcgctggggcctggccgaagaacaggccggccagggccgctacctgcccggcccggcctgcctgcaactggcgaagaaattcgatcgcgaggcctcgctgatcggtctcgccaaaccggaactcaagcgcctggccgacctgagccaggagagcgtggcgctgatggtggccagcaaccagcaggcgatctgcctggaactgttcgacagtccgcagccactgcgctgctgctaccagaaagggctggcgcagccgctgttgcatggcgcctcggccaaagccctgctggcgcacctggaggacgaacggcgcgaggagctgtacctcgcccaggaactctccgccgagcgtatcgacaagctggagcaggaactccggctgatccgcgaacagggctacgccgtcagccagggcgagatcgacgaaggcgtctggggcatcagcgtaccgctgctggacagccgccagcgcctgcacggcgccctcagcctgatggcccccgccttgcgcgcccagtcgcgcagcgaacgcttgcggcaatggaccctcgacgccgccgcgcgactttccgcgcggctggactga

SEQ ID NO: 4954 - DNA, 951 bp, Pseudomonas aeruginosa
ccgacaggagtttcgatgtaccccgcccccgacatgagcctctggcaaggccggatcgatagccaggaaggcgccgacgcgcggcgctggcaccaatggatgcgtccctacgcagacgacgccgaagcggccagcgtgctgctcgggttcgccagcgacgaaggcgtgcgccgcaaccagggtcgccagggcgcgcgccacggaccgccagccttgcgtcgcgcgctggccaacctggcctggcacggcgagcaagcgatctacgacgccggcgacatcgtcgccggcgacgatctggaagccgcccaggaacgctacgcgcaacgcgtcgccgacctgctcgcgcgcggccaccgggtggtcggcctgggcggcggccacgaaatcgcctacgccagcttcgccggcctcgcccgccacttgagtcggcatgagcgcctgccgcgcatcggtatcctcaatttcgacgcgcatttcgacctgcgccacgccgaacgggccagctccggcacgccgttccgccagatcgccgaactctgccaggccagcgactggccgttcgcttactgctgcctgggcatcagccgcctgagcaacaccgcggcgctgttcgaccaggcccagcgcctgggtgtgcgctacctgctggaccgccagttgcagccgtggaacctggaacgcagcgaagccttcctcgacagcttcctgcaatccgtcgaccacctctacctgaccgtttgcctcgacgtgctcccggccgcccaggcgcccggcgtcagcgcgccctcggcgcacggcgtggagatgccggtggtggagcacctggtccgccgcgccaaggccagcggcaagctgcgcctggccgacatcgccgaactcaacccgcaactcgatagcgaccagcgcaccgcccggatcgccgcgcgcctggtcgacagcctggtcaactga

SEQ ID NO: 4955 - DNA, 1071 bp, Pseudomonas aeruginosa
tccggacggcataaaaaaacccggccgaagccgggcatgcccaggcgggcagtctcagtgtctgcggtgctcggcgaagcgctccagggcttcgcggctgaggcgctcgacctgggcccagtcgccgcggtcgaccacggccttgggcagcatccaggtgccgccgacgcacatcacgttgggtaccgccaggtagtcggcgagattgttcaggctgacgcctccggtggggcagaagcggatatcggggaatggtcccgagaacgccttcagcgccgccgggccgccgctgacttcggcgggaaacagcttgaagcggcggtagccatggcggtaggcgagcatgatctcggaagcgctggccacgccgggcaacagcgggacttcgctgtccagggcgaagcgcagcaactcgtcggtgcaacccggggtgaccacgaagctcgccccggccttttccgcggcggcgaaggtctgcgggtcgagcacggtgccggcgccgatacgcaggtgcgggcgctcctcgctgaggcgccggatggcggtcagcccgtgcgtcgtgcgcagggtgatctccagggcggtcaggccgccggcggcgagggcatcggccatcggcaggatgtccgcctcgcggtcgatggtgatcaccgggaggatgcgcgcctcccggcacagcgtgtcgatgcgggcggtcttctgttcaaggttgtgcatggctacagctccgccactcaggggtaccaatggatcgtcagctgcgcgcggaggaaggcgcgaaccggcatccgccgttcgtcctcgaccgccagcgcggcgttcagggtggccagcttggactggccctggatcgccagcagctgcaccttcgccgccgccagcacggcgcgcggcagggtcaggcgctggtgcggcacgctcggcgcccacatcggcaggcaacggcgcgtcccctggggatccatcgccaggtccaggccagggctgttcgggaacagcgaggcggtatggccgtcgtcgcccatgccgaggaccagcacgtcgatcggcaatggcagctcgtgcaggtga

SEQ ID NO: 4956 - DNA, 1758 bp, Pseudomonas aeruginosa
aggccgatgaagcgcgccttcgccgcctcgccacggagcaggtggcggcgaaccaggccggcgttgctatcggcatgcgactccggcacccagcgctcgtcggccaggctgactgtgatccgcgaccagtccagcggctcctcgctcaaggcttcgaggaaggccaccggactgcgcccaccggacaccaccaacagcgcctggccctgctcggccagcgccgagcgcaaccggccggcgacctcggcggccaggccgcgggcctgctcggcggcgctgccccagacctgcaggccgacgccggccggcagcttcaactcagaaatcgccataccaactcctcccatcgcgggccaccagggccaccgaggccaccggcccccaactcccagccggatacggcttgggcgcttcgctcaggcgttcccagccagcgatcagctggtcgcaccacttccaggcgaactccacctcgtccttgcgcacgaacaggtactggttgccctgggtgacctccagcagcagacgctcgtaggcatcgggaatccgcgccgcgtggtaggtctcggaaaaactcagttgcagcgggccggtacgcaattgcatgcccttgcccaggccctggtccttggtcatcacttgcagggagataccttcgtccggctgcaggcggatgatcagccggttgctgatcagcgaacgctgctcgggagcgaagatgtagtgcggcggctccttgaagtggatgacgatctgcgacagcttctgcggcatgcgcttgccggtgcgcaggtagaacggcacgcccgaccagcgccagttgcggatgtccacgcgcagggcgacgaaggtttccgcgtcgctgtcgcgattcgcatgttcctcctccaggtagcccggcactgccttgccgtcgctgaaaccggcggtgtactgcccacgcaccacgcgcgaagccagttgttctgcgggaatcggctcgagggcgcggaggaccttgaccttctcgtcgcgaatgctgtccgccgaaaggtcgctgggcggatccatggcgatcaggcagagcagttgcagcaggtggttctgcaccatgtcgcgcagttgcccggcctggtcgaagtagccccagcggccttcgatgccgaccttctcggccacggtgatctccacgtgggagatgtggttctggttccactgggtctcgaagaggctgttggcgaagcgcagggcgatcaggttctgcaccgtctccttgcccaggtaatggtcgatccggtagatgcggctttccgggaagaaccgggcgactgcctcgttgacctcgcgggacgactccaggtcatgaccgatgggcttctccagcaccacccgggtgcgctcggcgagaccggcggcggcgaggttctcgcagatgccgccgaacaccgaggccggcgtggcgaagtaggcgaccagcggcagttcgtcatccaccgcctcgcgcaagccgacataggcctgcgggtcgaggaagtccatgctcaggtagtcgaggcgttcgcggaaacgctgccagaccacgtcgtcccactccttcgccggcactgccaggcgcaggcgctgctccagcgtcgccaggtgttcggcgggagcgccttcgtcacgggccagggccaggacgcgggtatcgcggtgcagcaggttctcacgatcgagttggtagagcgccgggaacagcttgcgcaaggcgagatcgcccagcgcaccgaacagcgctaa

SEQ ID NO: 4957 - DNA, 909 bp, Pseudomonas aeruginosa
gcgccgccgccggcccttccccgccgggccgacagaacacgaggaacccggatgaaaaacctgctggagcagatccagagccgcctggacgaactgaacaaggcggagcgcaaagtcgccgaggtcatcctgcagaacccgcagcaggccacccgtttcagcatcgccgccctggcccaggcggcagcggtcagcgaaccgacggtgaaccgcttctgtcgctccttcggcatgagcggctatccggaactgaagatccagctggcccagagcctggccagcggcgctgccttcgtgacccaggcggtagccgaggacgacgggccggaagcctatacgcggaagatcttcagcaacaccatcgcctccctcgacagcgcccacaagctgctcgacccacgcgtcatcgaccgcgccgtggacctgttgatccaggcccggcagatccacttcttcggtcttggcgcctcggcctcggtagcgctcgacgcgcagcacaagttcttccgcttcaacctggcggtgagcgcccaggccgacgtgctgatgcaacggatgatcgcctcggtggcgcataccggcgacctgttcgtggtgatttcctataccggacgcacccgcgagctggtggaggtggcgcacctggcgcgggagaacggcgcctcggtgctcggcctgaccgccgccggctcgccgctggccagggccagcaccctgtgcctggacatcccgttgccggaagacaccgacatctacatgccgatgacttcgcggatcgtccagctcaccgtgctcgacgtactggccaccggagtgaccctgcgccgcggcgtggacttccagccgcacctgcggcggatcaaggaaagcctggtgccgacccgctatcccctcgacgaggacaactga

SEQ ID NO: 4958 - DNA, 300 bp, Pseudomonas aeruginosa
gcatccagcaggcgccattcgcgttgccgcgcccagccctgctgcggccattcgctgccgttcggatggctgccgaaccacggccagcagaccgggatgccgccgcgcaccggcgcgctgctgagggccggccattcgctggcgcaccacagcaacgggcgttcgccctgcggctggaaatgcaggagctgcgccccttgccgactgaatacggcctggcacagcggatggtcgatcaacagcagatcgcgacgttggaagcgtacccagtcgaacggtcgcttggcccgcatggaatga

SEQ ID NO: 4959 - DNA, 1254 bp, Pseudomonas aeruginosa
tcggtttgtaacaggcagccgggaagagcggtcgccggaaaaaaacggcccgcccgaaacgctcgggcgggtccaggcacaacaccggagcaggcaacgcgacgatcagaacaccgtctggatcttgatccccgccaccagcgcgttgtcgacctcgtcgaccccgcccggctgcttgatgtattgcaggttcggccgcaccgtcagccagtcggtcacatgcaccccgtagtacagctcggcgttgtactcggtgtcctgcagcggctggtacagcgggttgtcgtagtcgtcgatgccgttcacctggttcaccaggcgctggcgcttcttcacatcgtcgttgacatggatgcgcgcgatgcccaggccgatgtcgtccttcggccgcgcgtcgaacggccccttgtagaccaccccgagctgctggtagttgtccaccacgttggtcgccttgtcgtggaccgtcaggttggcgaacaggctcaacccgcgcgaggcatcgccgttgtgcgaagtgacctgctgctgcgccaccacccaccagccatgcttgctgccgcgcgacttgaagtcgttgccggtcagcccctgcggctggccgtcgacgtcgtcgtagacgtcatcggccttcgccgtgctgtagtagtagcccagccggtactcgcccggcagttgctcggcgccgaccttcggctgccagatcagctccaccggcagcaacgcgcccttggtcccgctgccgctcatcttgaagccgttgccggtctccaggttcgacgggttctgctcgtaggcgccgacctgcacgtaccagtccggcgcgaagttgtacttcacccgcaacgcccactggctgaccggccagttgtaccagatgctccccgcccagttgcccacctgcgagccgcagaaggccaggttctggaaatcgcaggggaagctgttgaagtcctcgccctcgccgaaacggccgaatttcacgtccagcgcgccgtcgaagtactgctgcttgagccacagctgggtcagccgccaggtctgcccgcggccccaaaactcctgcaccgaactgaattgtcccggacgccggtctcccaatccgtccttggaaaaggtcttgccgttgcgctccgtgacagtgaactggaaatccgtgtccttccacccgaaagatattctctcaagtccctgtttcccccccacagggcaaactggtcccgtggtataccttccggtttcggtttctccctc

SEQ ID NO: 4960 - DNA, 363 bp, Pseudomonas aeruginosa
cgtcgacgcgcacgctcctccgccgaggcggtgaggaagatcttcagaggcgcatcgggaaacaccacggtgcccatgtcgcggccgtcggccaccaaccccggcgcttcgaggaacgcccgctggcgctgcagcaacgcatcgcgcacggccggtaaggcggcgacctgtgaggcgccggcaccgacctgctcggtacggatcacatcggtcacttcctcgccttcgagaatgatgcgctgcccatggctgccatcggcagcgacgaactgcacatcgaggtgcgcagccagaaccttcagcgcttcttcattggtcaggtcgacaccatggttgaccgcggcgaacgccaacagccgataa

SEQ ID NO: 4961 - DNA, 438 bp, Pseudomonas aeruginosa
gaatcaccttgtgccggcggaacagggtcgccttcgccgcggtcactccgctctgctcggaacccgcgatcggatgccccggtaccaggtaccgcggcatcccgccgaacgcgacacgcgcggcacgcacgatattgcccttggcgctgccaacgtcggtcaatacagccttgcccaggtcgagcttcgccaggtcggccagcacccgctccatcgccaggatcggcaccgccaactggatcacgtcggcgccgacgcaggcgcggccaagatcctcctcgcaacggtcgaccacgccgagctccaccgccaggcggcaagactcggcatcccgatccacgccgaccacttcccggaacaaccctttgctccgcaaccccttggcgaaggagccgccgatcaggcccagccccaccaccaccaggcggcccagcttag

SEQ ID NO: 4962 - DNA, 234 bp, Pseudomonas aeruginosa
tcaggaagcgcgtggagttgtccgggcggtcctcgatcttctcgtgcagcttgctcaggtcgtacaggctggccgccatgtcgccggcgatcgccgccgaattccactcgctcttcacccgcttggccgcgtcggcgttgctcgacaccgccacccgctcgacgctcgggtagtgcgagtccagccacttgcgacattgcgcgagggattgggcatgggaatagatccgggtga

SEQ ID NO: 4963 - DNA, 1125 bp, Pseudomonas aeruginosa
gctggtcctggtccgccatcagccgtgctccttctcgaactccgccatgtatgcgaccagcgcctcgaccgcgtccaggccaagggcgttgtagatggaagcgcgcatgccgccgaccgagcggtggcctttcaggttgagcagcccgcgcgcctcggcgccttccaggaacggcttgtcgagacgctcgtcggccaggcggaacggcacgttcatccaggagcgggcgctcggctggatcgggttggtgtagaagtcgctggcatcgatggtcttgtacagcaggtccttcttggcgcggttgcgctgctccatcgcggtcaccccgccctgctccttcagccattcgaagaccaggccggacaggtaccaggagtaggtcgccggggtgttgtacatggaaccgttgtccgcggcgatcttgtagttgagcatggtcgggcagacgctgcgggcgcggccgagcaggtcttcgcgaacgatcaccaccaccaggccggacgggccgatgttcttctgcgccccggcatagatcaggccgaagcgggacacgtcgagcgggcgcgagaggatatcggaggacatgtcggtgaccagcggcacgtcgccggtctcgggaatccagtcgaactcgaggccgccgatggtctcgttggaggcgtagtgcacataggccgcgtccttggtcagcgtccactcgttctgacccggaatggcgaagtagtcgtactccttggcgctggccgcgacattcacggtgccatagcgacgagcctcctcgatggccttcttcgaccagataccggtatcgatatagtcggcgacgccatcttcgggcagcaggttcagcggaatctcggcgaactgctggctggcgccgccctgcaggaacagcaccttgtagtccgagggaatgtcgagcaggtcgcgcaggtcctgctcggccttgctggcgatggccacgtagtcatcactacggtggctcatttccatgaccgaaaggcccttgccccgccagtcgagaagctcggcctgggcacgttgcagaactgcgtcgggaagcgccgcgggaccggcgcagaaattgaaggctcgcttgctcacatccactctcgctataggtag

SEQ ID NO: 4964 - DNA, 2886 bp, Pseudomonas aeruginosa
gttatccgccgacgtcatcggccgggcgggcgcaggcgcccgccccgagccttactcttcgttgccttccgcttccgccgcgggctcggactcggactcggccgactcgcccagagattcggcagcttcctccccttcgggcaggtcctcgtcatctccgcccgacggctcctggacacgctccagaccgaccagtacctcgtcgctggcgagcttgatcagggttacgccctgggtattgcggccggacagggagacttcgtcgacacgcgtccgcaccagggtgccctggtcggaaatcagcatgatctcctcgccttcctggacctgtaccgcggcgatcagcgcgccgttgcgctcgttggtgaccatggcgatcaccccctggccgccacggccgcgacgcgggaacttgctcagcggggtacgcttgccgaagccgcgctcggaggcggtgaggatctgcgccccggactccggaatcagcatggagatcagctgctgccccttgcccaggcgcatgccgcgtacgccgcgggcgttgcggcccatgatgcgcaccacgctctcggcgaagcggatcaccttgccggcgctggagaacagcatgacttccttggcgccatcggtgatcgcggcggcgatcagggtgtcgccctcttccagcttgagcgcgatcaggccgctgctgcgcggacggctgaactgcaccagcggggtcttcttcacggtaccgaaggcggtggccatgaagatgtaggcgccggtctgctcggccaccagctcggcggtctcgccctcgacttcctcgacctcggcggcctcgaccacctcgccctcgagcaccgcgccttcggcttcgtcgaggtcgtcatcggcgccaccgttctgctgcagcgcctccaggtcgatctgcaacatcgcggtgatccgctcgccctcatccagcggcagcaggttcaccagcggccggccacgcgcggtacgcgaggcttccggaatctcgaaggtacgcagccagtagaccttgcccttgctggagaacagcaggagggtcgcatggctgttggccaccagcaggtgttcgatgtagtcctcgtccttcatcccggtggcggacttgcctttgccgccgcgacgctgcgcctggtaggcggccagcggctgggacttggcgtagccgccgtgggagatggtcaccacgcggtcttcctcggtgatcaggtcggcgatggtcaggtcgacctgggaagccacgatctcggtgcggcgagcatcgccgaattcggccttgaccgcttccagctcctcacggatcacctccatcaggcgcgccgggttggtcaggatgcggatcaactcgccgatcaggttgaggatttcctggtattcggagagcagcttctcgtgctccaggccggtcaggcgatgcaggcgcagctcgaggatcgcctgggcctgttccggcgacaggtagtacttgccgtcgcgcaggccgtactgcggatccaggtcttccgggcgacaggcgtcggcgccggcacgctcgaccatcgcttccaccgcgctggactcccaggcagtggcgatcaggcgttccttggcctcggccggggtcggcgaactcttgatcagctcgatcaccgggtcgatgttcgacagggcgaccgcctggccttccaggatgtgcccgcgctcgcgggccttgcgcagctcgtagacggtacgccgggtcaccacttcgcggcggtggcggacgaacacctcgagcatgtccttcaggttcagcgtgcgcggctggccgtcgaccagggccaccacgttgatgccgaacacgctctgcagctgggtctgggcatagaggttgttgaggaccacctcgcccacctcgccgcgacgcagctcgatgaccacgcgcatgccgtccttgtcggactcgtcgcgcagctcggaaataccctcgatcttcttctctttcaccagctcggcgatcttctcgatcaaccgcgccttgttcaactggtacggcagctcggtgatgatgatctgctcgcgaccgccgcccttctccatctcctcgacgacggcgcgggcacggatgtagatgcgcccgcgaccggtgcggtaggcctcgatgatcccggcgcggccgttgatgatgccggcggtggggaagtccggaccggggatgtactgcatcagctcatcgacggtcaggtcggggttgtccatcagcgccaggcagccgtcgatcacttcgccgaggttgtgcggcgggatgttggtcgccatacccacggcgataccgctggaaccgttgaccagcaggttgggaatcttggtcggcatgaccgccgggatctgctcggtgccatcgtagttgggcacccagtcgacggtttccttttccaggtccgccagcagttcgtgggccagcttggccatgcgcacttcggtgtatcgcatggctgcggcgttgtcgccgtccaccgaaccgaagttgccctggccgtctaccagcatgtagcgcagcgagaacggctgcgccatgcgcacgatggtgtcgtagaccgcggtgtcgccgtgcgggtggtacttaccgatcacgtcgccgaccacacgggcggatttcttgtagggcttgttccagtcgttgcccagctcgctcatggcataaagcacacggcggtgcaccggcttcaggccgtcacgtgcatccggcagggcccgcccgacgatcacgctcatcgcgtagtcgagataggactgtttcagctcgtcttcgatattgaccgggagaatttctttggccagttcgcccatgagaagcctggttcctttttctggtggaacttcgccgcctcgatcctgaggcaaacgaagtag

SEQ ID NO: 4965 - DNA, 432 bp, Pseudomonas aeruginosa
cgagccccagccgcggacgctcgggtatacttccggcttcccgctctgcgcccaggatgcgccgccatgcccaacgtccgtaaccccttcgacctcctcctgctgccgacctggatcgtccccgtggagcccgccggggtggtgctgcgcgaccacgcgctgggcatccgcgacggccagatagccctggtcgcgccgcgcgagcaggccatgcgccatggcgccacggaaatccgcgaattgccgggcatgctgctcgcccccggtctggtcaacgcccacggccattcggcgatgagtctgttccgcggtctcgccgacgacctgccgctgatgacctggctgcaggaccacatctggccggccgaaggccaatgggtcagcgaggattcatccgcgacggcacggagctggccatcgccgaacaggtaa

SEQ ID NO: 4966 - DNA, 393 bp, Pseudomonas aeruginosa
gcaacgtcgaccacgccgagatcgccaaattcgaggcactggcccatcgctggtgggaccgcgagagcgagttcaagccgctccacgacatcaacccgctgcgcgtcaactggatcgacgagcgcgccggcctggccggcaagaaggtgctcgacatcggttgcggcggcggcatcctcagcgaagccatggcccagcgcggcgccaacgtcaccggcatcgacatgggcgaagcgccgctcgcggtggcgcgcctgcaccagctggaatccggcgtcgccgtcgactaccggcagatcaccgccgagcagatggccgaggaaatgcccgggcagttcgacgtggtcacctgcctggagatgctcgaacacgtgccggacccggcctcggtga

SEQ ID NO: 4967 - DNA, 387 bp, Pseudomonas aeruginosa
gcctctggcaaggccggatcgatagccaggaaggcgccgacgcgcggcgctggcaccaatggatgcgtccctacgcagacgacgccgaagcggccagcgtgctgctcgggttcgccagcgacgaaggcgtgcgccgcaaccagggtcgccagggcgcgcgccacggaccgccagccttgcgtcgcgcgctggccaacctggcctggcacggcgagcaagcgatctacgacgccggcgacatcgtcgccggcgacgatctggaagccgcccaggaacgctacgcgcaacgcgtcgccgacctgctcgcgcgcggccaccgggtggtcggcctgggcggcggccacgaaatcgcctacgccagcttcgccggcctcgcccgccacttga

SEQ ID NO: 4968 - DNA, 1620 bp, Pseudomonas aeruginosa
ccgtttgcctcgacgtgctcccggccgcccaggcgcccggcgtcagcgcgccctcggcgcacggcgtggagatgccggtggtggagcacctggtccgccgcgccaaggccagcggcaagctgcgcctggccgacatcgccgaactcaacccgcaactcgatagcgaccagcgcaccgcccggatcgccgcgcgcctggtcgacagcctggtcaactgatcgccctttcgcccacacaacaacaatagagccacgccatgccgacattgcacctggacgccctgtccaccaccgccctcgccctgctcctgctcgccctcggcagccaattgaagaagcgcagccgctggctgacacgtctgtgcgtaccgtcgccggtgatcgccggcttcggcttcgcctccctggtctggctgctcagggatcgcggctggctcgacatcggcctcgacaccagcctgcagacgcccctgatggtggcgttcttcaccaccgtcggcctcggtggcagcctcggcctgctgcgcaagggcggcaagaccctgctggtctacctgtcggcctgctgggcgctggcgatactgcagaacctgatcggcgtaggcagcgccggactgctcggcctcgacccgttgctcgggatcatggccggcgcggtgtcgctggaaggcggcttcggcgcggcggcggccttcggcccggttgcggaagggctcggcgcccagggcgcgaccaccgtggcgctggcctcggccaccttcggcatggtcgctggcgggctgctcggcagcccggtggcgcgctggctgatcgaacgcaaccgcctgccggtgcaggcggaaagcgacaatcggctggaagccctcgggcagcaggagcgacgccagcatgcggcggccacgctggacggcaatctcctgctgcgcctgctgacctgcgtgctgctggtgatggtgctcggcttctggctcggcgacgcgctcgaggaacgcctgggcctggtgctgcccagttatgtcggggcgatgttcatcgccatcgtcctgcgcaacctcgacgaccggctcggctggctgcgcattccggaccacgccgtcggtaccctgggcgacgtctgcctgggcatcttcctgaccatggcgatgatgagcctgaagttctgggagctggagaacctcggcctgccgctgctcggcgtactgttcatccaggtcgcggtgctgttgctgctgacgatcttcgtcctgttccgcctgctcggccgcaactacgacgccgcggtgctctgcgccggcttcctcggccacggcctgggcgccacgcccaacgcggtggccaacatgggcgcggtctgcgagcactatcgggtgttctcgcacaaggccttcatcatcgtgcccctgtgcggcgcggtactgatcgatctcgtcgccatcccggcgatcacctggttcatcaacgccttcagttgaaccatggcggcgctccgctagcggagcgccagctttccgacgagcgcctcggccactcgccagcaaaacgccattattccgtcgaaatctctccgaaattcctacagaatgtggaaaccattcctaggaaaacctgtctgtgcctctga

SEQ ID NO: 4969 - DNA, 765 bp, Pseudomonas aeruginosa
cagcgactacctcggcgaactgatcttccgtcgccgccagcgcctcggcgaagacgaacaacggcaactggagagcctgctcggcaccctgctgttcccgctgcgcaacgccctgctctatcgcgccgcgatccagaccgccctgcgcgacgccctgaccggcaccggcaaccgcatcgccatggaccaggcgctcggccgcgaactggaactggcccggcgcaacctgcaaccgctctcggtgctgatgctcgatatcgaccacttcaagcgggtcaacgaccactacggtcacgccgtcggcgacgaagccctcaaggccgtggcggaaaccatcaaggaccacctgcgcaatgtcgacatggtgttccgcttcggcggcgaggaattcctcgtcctgctgtccagcacgccgctgcaggctgcctgcatggtcggcgaacgcctgcgccaggcggtggaggaactggactaccggcacgccggcgaaccgctgaagctgtcgatcagcctcggttgcgccgacctgcggcccggcgaaggcagcgacgacctgctgcgacgggtcgacgaggcgctctacgaagccaagcgcgacggccgcaaccgcctgcgctgcgcctgaggcttgccgactcgcacaccccgaagcgcggagcgggcgcatcgggcgacggcagtagcaacggctctcaccggcgcagttacggtttccgccaaggtcctgccgcttatggctgcgccggctcgtccggggcgccatag

SEQ ID NO: 4970 - DNA, 2007 bp, Pseudomonas aeruginosa
gcgcgccccttgtcgatcacctcgccctccagcggcggacggaagttgtcctcggggccggccgtcgcctcgccaaggcttgcacagctctgcgccggcatcgccgcatcctcggccagcccggcgacgctccatagcatgcagagcgcgatagccaggatcctgtgcatttcaccacctccttgtgtgcgggcgaccattagacaccgattcccaggcatgaaaaaggccccgaaggggcctttccagggcgctttccgctcagcggcggaagcccggacgcataccgtcgccggccggtttcggccgccgcttgacctgcggcttgcgggccgccggcttgtcgcccggcgcgctggccggacgctcgtcgcgcggcttgctcgggcgcggcttgcggttgctctcgcggggccgctcggcaaccggagtgccctgctcgcgccccttgcgctcggcgctcggctgcggaccgcgcgcgggacgcgaagccggcgcgcgacgagcggcattctcgccgtcctcgcgccttggcgcacgcttgcgcccggcttccggacgctcgctgcgcgccagcggacgggcctgcttgcgctgctggcgttcggccttctcgcgcgccttggtggtcatgcccggcagcgccaccggcttgaggccgacttcctcgctgaggatgtcgatttcgcgctggtccatttcgcggtagcggcccatggtcagctcggaggtcaggaacaccgggccgaaacgcactcgcttcaggcggctgaccaccaatccctgggattcccacaaccggcgcacctcgcggttgcggccctccatcactacgcagtggtaccagtggttgaagccttcgccgcccggcgcctgctggatatcgctgaacttggccgggccgtcctcgagcatcacgccgttgagcaggcgctcgatcatctcttcggtgacctcgccgcgcacccgtaccgcgtattcacggtccatctcataggaaggatgcatcaggcggttggccagttcgccatcggtggtgaacagcagcaggccggtggtattgatgtccaggcgaccgacattgatccagcgaccggtgcgcaggcgcggcaggcggtcgaagatggtcgggcggccttccggatcgtcgcgggtgcagacctcgccttccggcttgttgtagatcagcacgcgacggacactctcggcggcctcttcgcggcggatcaggtggccatcgacggtgatcgcatcgtggctgtcgacccgctggccgaggctggccacgccgccattgacgttgacccgaccttcggcgatccacacttctacgtcgcgccgggaaccgacgccgagacgggcgaggactttctgcagtttttccccgaccggtacgtggggattctctggggtatcgttcatctgggcacctcccggtgtggctggcaacgaatcgaagggcgcgcatcatacgcgcttcgtcaggacaaagcaccgtccccgggcggaaacccggacaatcccgctagactaggccgggttcacccaccccgccacccggaggccccggtgcacgacatccctcccttcagcggcgccaagctggcgctgttctatggcgaccacctggtcgtctacaaacgcgacgaaaaacccggcattcccttccccggctactgggactttcccggcggcggccgtgagggcctggagacgcctgccgaatgcgccctgcgcgaactcgaggaagagttctccatccgcctggaagaacctcgtatcgaatggcagcgacagtatccgagcaccagcggcagcgcgcccttcgcctacttcctggtggcgcgcctggaggaccgcgagttcgaggccatccgcttcggcgacgaaggacaatactggcgattgatggaggtggacgcctacctcgcgcatgccatggccgtaccctacctgcagagccggctcggcgactatctgcgggaacgccggcgcatcggcgaataa

SEQ ID NO: 4971 - DNA, 792 bp, Pseudomonas aeruginosa
gcgagcatgatctcggaagcgctggccacgccgggcaacagcgggacttcgctgtccagggcgaagcgcagcaactcgtcggtgcaacccggggtgaccacgaagctcgccccggccttttccgcggcggcgaaggtctgcgggtcgagcacggtgccggcgccgatacgcaggtgcgggcgctcctcgctgaggcgccggatggcggtcagcccgtgcgtcgtgcgcagggtgatctccagggcggtcaggccgccggcggcgagggcatcggccatcggcaggatgtccgcctcgcggtcgatggtgatcaccgggaggatgcgcgcctcccggcacagcgtgtcgatgcgggcggtcttctgttcaaggttgtgcatggctacagctccgccactcaggggtaccaatggatcgtcagctgcgcgcggaggaaggcgcgaaccggcatccgccgttcgtcctcgaccgccagcgcggcgttcagggtggccagcttggactggccctggatcgccagcagctgcaccttcgccgccgccagcacggcgcgcggcagggtcaggcgctggtgcggcacgctcggcgcccacatcggcaggcaacggcgcgtcccctggggatccatcgccaggtccaggccagggctgttcgggaacagcgaggcggtatggccgtcgtcgcccatgccgaggaccagcacgtcgatcggcaatggcagctcgtgcaggtgatggtcggccagctcggccgcttcctccaggctcgccgccggctggtagaggccgatga

SEQ ID NO: 4972 - DNA, 1164 bp, Pseudomonas aeruginosa
cggtgcggccgaacctgcaatacatcaagcagccgggcggggtcgacgaggtcgacaacgcgctggtggcggggatcaagatccagacggtgttctgatcgtcgcgttgcctgctccggtgttgtgcctggacccgcccgagcgtttcgggcgggccgtttttttccggcgaccgctcttcccggctgcctgttacaaaccgactacgcttttcctgtgccgatcatttggggcttgcgtgcgaaatgtagtaaaactacacggatgcacgcccgggctttccgggaaggggagagggtaggacaatcggacatgcttgagcatccgctgcagcgtttctttcattccatgcgggccaagcgaccgttcgactgggtacgcttccaacgtcgcgatctgctgttgatcgaccatccgctgtgccaggccgtattcagtcggcaaggggcgcagctcctgcatttccagccgcagggcgaacgcccgttgctgtggtgcgccagcgaatggccggccctcagcagcgcgccggtgcgcggcggcatcccggtctgctggccgtggttcggcagccatccgaacggcagcgaatggccgcagcagggctgggcgcggcaacgcgaatggcgcctgctggatgcctacgccgacgaaagcaaggtggtggtgagctggcaactggacctggaggactggcacgtgcgcctcgatgcgcgccttggccagcgcctggagctggagctgtgcagctaccatgaggaagacgacgattgcctgttcagcttcgccctgcagccctactggcgggtcggcgcgctgagccgggtggtggtgcacggcatggagctggagtcggctcgcggccagcgcggcgcttcgcggattccgggaacctggataccgcgcggcgcggtcaagcaggtgctctaccatcccggatcgctggtgctggaggacggcggctggaaccgccgcttgcggatcgacaagaacgtcagcgccggcagcgtgatctggcaccccggcagccgcccggtggagcaggtcgagccgggcgaagcggaacgcttcctctgtatcggcgccgctggctaccgcccgggcgggctgatcctggcgcccggcgaacgcatgcgcctgagtctcgccgccggcctgcaatag

SEQ ID NO: 4973 - DNA, 363 bp, Pseudomonas aeruginosa
tcgccatggatccgcccagcgacctttcggcggacagcattcgcgacgagaaggtcaaggtcctccgcgccctcgagccgattcccgcagaacaactggcttcgcgcgtggtgcgtgggcagtacaccgccggtttcagcgacggcaaggcagtgccgggctacctggaggaggaacatgcgaatcgcgacagcgacgcggaaaccttcgtcgccctgcgcgtggacatccgcaactggcgctggtcgggcgtgccgttctacctgcgcaccggcaagcgcatgccgcagaagctgtcgcagatcgtcatccacttcaaggagccgccgcactacatcttcgctcccgagcagcgttcgctga

SEQ ID NO: 4974 - DNA, 801 bp, Pseudomonas aeruginosa
gcgaagcgcccaagccgtatccggctgggagttgggggccggtggcctcggtggccctggtggcccgcgatgggaggagttggtatggcgatttctgagttgaagctgccggccggcgtcggcctgcaggtctggggcagcgccgccgagcaggcccgcggcctggccgccgaggtcgccggccggttgcgctcggcgctggccgagcagggccaggcgctgttggtggtgtccggtgggcgcagtccggtggccttcctcgaagccttgagcgaggagccgctggactggtcgcggatcacagtcagcctggccgacgagcgctgggtgccggagtcgcatgccgatagcaacgccggcctggttcgccgccacctgctccgtggcgaggcggcgaaggcgcgcttcatcggcctctaccagccggcggcgagcctggaggaagcggccgagctggccgaccatcacctgcacgagctgccattgccgatcgacgtgctggtcctcggcatgggcgacgacggccataccgcctcgctgttcccgaacagccctggcctggacctggcgatggatccccaggggacgcgccgttgcctgccgatgtgggcgccgagcgtgccgcaccagcgcctgaccctgccgcgcgccgtgctggcggcggcgaaggtgcagctgctggcgatccagggccagtccaagctggccaccctgaacgccgcgctggcggtcgaggacgaacggcggatgccggttcgcgccttcctccgcgcgcagctgacgatccattggtacccctga

SEQ ID NO: 4975 - DNA, 276 bp, Pseudomonas aeruginosa
ccgccatccggcgcctcagcgaggagcgcccgcacctgcgtatcggcgccggcaccgtgctcgacccgcagaccttcgccgccgcggaaaaggccggggcgagcttcgtggtcaccccgggttgcaccgacgagttgctgcgcttcgccctggacagcgaagtcccgctgttgcccggcgtggccagcgcttccgagatcatgctcgcctaccgccatggctaccgccgcttcaagctgtttcccgccgaagtcagcggcggcccggcggcgctga

SEQ ID NO: 4976 - DNA, 780 bp, Pseudomonas aeruginosa
atacgcggtacgggtgcgcggcgaggtcaccgaagagatgatcgagcgcctgctcaacggcgtgatgctcgaggacggcccggccaagttcagcgatatccagcaggcgccgggcggcgaaggcttcaaccactggtaccactgcgtagtgatggagggccgcaaccgcgaggtgcgccggttgtgggaatcccagggattggtggtcagccgcctgaagcgagtgcgtttcggcccggtgttcctgacctccgagctgaccatgggccgctaccgcgaaatggaccagcgcgaaatcgacatcctcagcgaggaagtcggcctcaagccggtggcgctgccgggcatgaccaccaaggcgcgcgagaaggccgaacgccagcagcgcaagcaggcccgtccgctggcgcgcagcgagcgtccggaagccgggcgcaagcgtgcgccaaggcgcgaggacggcgagaatgccgctcgtcgcgcgccggcttcgcgtcccgcgcgcggtccgcagccgagcgccgagcgcaaggggcgcgagcagggcactccggttgccgagcggccccgcgagagcaaccgcaagccgcgcccgagcaagccgcgcgacgagcgtccggccagcgcgccgggcgacaagccggcggcccgcaagccgcaggtcaagcggcggccgaaaccggccggcgacggtatgcgtccgggcttccgccgctgagcggaaagcgccctggaaaggccccttcggggcctttttcatgcctgggaatcggtgtctaa

SEQ ID NO: 4977 - DNA, 1011 bp, Pseudomonas aeruginosa
acgtcatgtacgtggctcgagacggcaaggaaaccagcggctggctgctggagaagcgcgtccgcttgcgccaggcctatggcgccccggacgagccggcgcagccataagcggcaggaccttggcggaaaccgtaactgcgccggtgagagccgttgctactgccgtcgcccgatgcgcccgctccgcgcttcggggtgtgcgagtcggcaagcctcaggcgcagcgcaggcggttgcggccgtcgcgcttggcttcgtagagcgcctcgtcgacccgtcgcagcaggtcgtcgctgccttcgccgggccgcaggtcggcgcaaccgaggctgatcgacagcttcagcggttcgccggcgtgccggtagtccagttcctccaccgcctggcgcaggcgttcgccgaccatgcaggcagcctgcagcggcgtgctggacagcaggacgaggaattcctcgccgccgaagcggaacaccatgtcgacattgcgcaggtggtccttgatggtttccgccacggccttgagggcttcgtcgccgacggcgtgaccgtagtggtcgttgacccgcttgaagtggtcgatatcgagcatcagcaccgagagcggttgcaggttgcgccgggccagttccagttcgcggccgagcgcctggtccatggcgatgcggttgccggtgccggtcagggcgtcgcgcagggcggtctggatcgcggcgcgatagagcagggcgttgcgcagcgggaacagcagggtgccgagcaggctctccagttgccgttgttcgtcttcgccgaggcgctggcggcgacggaagatcagttcgccgaggtagtcgctgtcatggctcaggcgatagctcaccgaatgcttggcgctgctgccgaactccaggcgcaggtcggagcccggatggcggtagccaagggcatccagcgggatcagttggcggacttcctcgaagaacaggccgagaatccgctccgcctccaggctgctctgcaactgtag

SEQ ID NO: 4978 - DNA, 1602 bp, Pseudomonas aeruginosa
gaatggtttccacattctgtaggaatttcggagagatttcgacggaataatggcgttttgctggcgagtggccgaggcgctcgtcggaaagctggcgctccgctagcggagcgccgccatggttcaactgaaggcgttgatgaaccaggtgatcgccgggatggcgacgagatcgatcagtaccgcgccgcacaggggcacgatgatgaaggccttgtgcgagaacacccgatagtgctcgcagaccgcgcccatgttggccaccgcgttgggcgtggcgcccaggccgtggccgaggaagccggcgcagagcaccgcggcgtcgtagttgcggccgagcaggcggaacaggacgaagatcgtcagcagcaacagcaccgcgacctggatgaacagtacgccgagcagcggcaggccgaggttctccagctcccagaacttcaggctcatcatcgccatggtcaggaagatgcccaggcagacgtcgcccagggtaccgacggcgtggtccggaatgcgcagccagccgagccggtcgtcgaggttgcgcaggacgatggcgatgaacatcgccccgacataactgggcagcaccaggcccaggcgttcctcgagcgcgtcgccgagccagaagccgagcaccatcaccagcagcacgcaggtcagcaggcgcagcaggagattgccgtccagcgtggccgccgcatgctggcgtcgctcctgctgcccgagggcttccagccgattgtcgctttccgcctgcaccggcaggcggttgcgttcgatcagccagcgcgccaccgggctgccgagcagcccgccagcgaccatgccgaaggtggccgaggccagcgccacggtggtcgcgccctgggcgccgagcccttccgcaaccgggccgaaggccgccgccgcgccgaagccgccttccagcgacaccgcgccggccatgatcccgagcaacgggtcgaggccgagcagtccggcgctgcctacgccgatcaggttctgcagtatcgccagcgcccagcaggccgacaggtagaccagcagggtcttgccgcccttgcgcagcaggccgaggctgccaccgaggccgacggtggtgaagaacgccaccatcaggggcgtctgcaggctggtgtcgaggccgatgtcgagccagccgcgatccctgagcagccagaccagggaggcgaagccgaagccggcgatcaccggcgacggtacgcacagacgtgtcagccagcggctgcgcttcttcaattggctgccgagggcgagcaggagcagggcgagggcggtggtggacagggcgtccaggtgcaatgtcggcatggcgtggctctattgttgttgtgtgggcgaaagggcgatcagttgaccaggctgtcgaccaggcgcgcggcgatccgggcggtgcgctggtcgctatcgagttgcgggttgagttcggcgatgtcggccaggcgcagcttgccgctggccttggcgcggcggaccaggtgctccaccaccggcatctccacgccgtgcgccgagggcgcgctgacgccgggcgcctgggcggccgggagcacgtcgaggcaaacggtcaggtag

SEQ ID NO: 4979 - DNA, 573 bp, Pseudomonas aeruginosa
accggttgctgggccaggccggacagatcgaaggccaccaggtcggcggccttgccggcttccagggagccgatcaggcgctccaggccaagcgcgcgggcgccgttcagggtggccatgcgcagcgcgcggtgggcgtcgagggcggtggcctggccgtacacggccttggccagcagcgccgcggtgcgggtctcgccgagcaggtcgagatcgttgttgctcgccgcgccgtcggtgccgatggctacgttgaccccggcctgccagagtttttccaccgggcagaagccgctggccagcttgaggttggattccgggcagtggatcaccgagctgttggtttccaccagcatcgccaggtcgtcgtcgtccacctgggtcatgtgcaccgcctggaagcgtgggccgagcaggccgaggcggtgcaggcgggccagcgggcgctcgccgttgcgctccgtggcctgctccacctcgaaggcggtctcgtggacgtgcatctggatgctggcgtcgagttcctcggtgagcaccaggatctgctccagcttgtcgtcgctcaccgtataa

SEQ ID NO: 4980 - DNA, 894 bp, Pseudomonas aeruginosa
gctgatgcagtacatccccggtccggacttccccaccgccggcatcatcaacggccgcgccgggatcatcgaggcctaccgcaccggtcgcgggcgcatctacatccgtgcccgcgccgtcgtcgaggagatggagaagggcggcggtcgcgagcagatcatcatcaccgagctgccgtaccagttgaacaaggcgcggttgatcgagaagatcgccgagctggtgaaagagaagaagatcgagggtatttccgagctgcgcgacgagtccgacaaggacggcatgcgcgtggtcatcgagctgcgtcgcggcgaggtgggcgaggtggtcctcaacaacctctatgcccagacccagctgcagagcgtgttcggcatcaacgtggtggccctggtcgacggccagccgcgcacgctgaacctgaaggacatgctcgaggtgttcgtccgccaccgccgcgaagtggtgacccggcgtaccgtctacgagctgcgcaaggcccgcgagcgcgggcacatcctggaaggccaggcggtcgccctgtcgaacatcgacccggtgatcgagctgatcaagagttcgccgaccccggccgaggccaaggaacgcctgatcgccactgcctgggagtccagcgcggtggaagcgatggtcgagcgtgccggcgccgacgcctgtcgcccggaagacctggatccgcagtacggcctgcgcgacggcaagtactacctgtcgccggaacaggcccaggcgatcctcgagctgcgcctgcatcgcctgaccggcctggagcacgagaagctgctctccgaataccaggaaatcctcaacctgatcggcgagttgatccgcatcctgaccaacccggcgcgcctgatggaggtgatccgtga

SEQ ID NO: 4981 - DNA, 720 bp, Pseudomonas aeruginosa
cgacctcgacgaagccgaaggcgcggtgctcgagggcgaggtggtcgaggccgccgaggtcgaggaagtcgagggcgagaccgccgagctggtggccgagcagaccggcgcctacatcttcatggccaccgccttcggtaccgtgaagaagaccccgctggtgcagttcagccgtccgcgcagcagcggcctgatcgcgctcaagctggaagagggcgacaccctgatcgccgccgcgatcaccgatggcgccaaggaagtcatgctgttctccagcgccggcaaggtgatccgcttcgccgagagcgtggtgcgcatcatgggccgcaacgcccgcggcgtacgcggcatgcgcctgggcaaggggcagcagctgatctccatgctgattccggagtccggggcgcagatcctcaccgcctccgagcgcggcttcggcaagcgtaccccgctgagcaagttcccgcgtcgcggccgtggcggccagggggtgatcgccatggtcaccaacgagcgcaacggcgcgctgatcgccgcggtacaggtccaggaaggcgaggagatcatgctgatttccgaccagggcaccctggtgcggacgcgtgtcgacgaagtctccctgtccggccgcaatacccagggcgtaaccctgatcaagctcgccagcgacgaggtactggtcggtctggagcgtgtccaggagccgtcgggcggagatga

SEQ ID NO: 4982 - DNA, 2046 bp, Pseudomonas aeruginosa
ctacgtggccatcgccagcaaggccgagcaggacctgcgcgacctgctcgacattccctcggactacaaggtgctgttcctgcagggcggcgccagccagcagttcgccgagattccgctgaacctgctgcccgaagatggcgtcgccgactatatcgataccggtatctggtcgaagaaggccatcgaggaggctcgtcgctatggcaccgtgaatgtcgcggccagcgccaaggagtacgactacttcgccattccgggtcagaacgagtggacgctgaccaaggacgcggcctatgtgcactacgcctccaacgagaccatcggcggcctcgagttcgactggattcccgagaccggcgacgtgccgctggtcaccgacatgtcctccgatatcctctcgcgcccgctcgacgtgtcccgcttcggcctgatctatgccggggcgcagaagaacatcggcccgtccggcctggtggtggtgatcgttcgcgaagacctgctcggccgcgcccgcagcgtctgcccgaccatgctcaactacaagatcgccgcggacaacggttccatgtacaacaccccggcgacctactcctggtacctgtccggcctggtcttcgaatggctgaaggagcagggcggggtgaccgcgatggagcagcgcaaccgcgccaagaaggacctgctgtacaagaccatcgatgccagcgacttctacaccaacccgatccagccgagcgcccgctcctggatgaacgtgccgttccgcctggccgacgagcgtctcgacaagccgttcctggaaggcgccgaggcgcgcgggctgctcaacctgaaaggccaccgctcggtcggcggcatgcgcgcttccatctacaacgcccttggcctggacgcggtcgaggcgctggtcgcatacatggcggagttcgagaaggagcacggctgatggcggaccaggaccagctcaaggccttgcgcctgcgcatcgacagcctcgacgagaagttgctcgagctgatcagcgagcgtgcccgttgcgcccaggacgtggcgcgagtcaagacccagaccctgggcgagggcgaggcgccggtgttctaccgtcccgagcgcgaagcctgggtgctcaagcacatcatgcaattgaacaaggggccgctggacaacgaagaggtcgcgcggctgttccgcgagatcatgtcgtcctgcctggcgctcgagcagccgctgaaagtggcctatctcggacccgagggcacctttacccaggccgcggcactcaagcatttcggcaatgcggtgatcagcacgccgatggcggcgatcgacgaggtgttccgcgaggtcgccgccggcgcggtgaacttcggcgtggtgcctgtggaaaactccaccgagggggcggtcaaccataccctcgacagcttcctcgagcacgacatggtgatctgcggcgaagtcgagctgcgtatccaccatcacctgctggtcggcgaaaccaccaagaccgacaacatcacccggatctattcccatgcccaatccctcgcgcaatgtcgcaagtggctggactcgcactacccgagcgtcgagcgggtggcggtgtcgagcaacgccgacgcggccaagcgggtgaagagcgagtggaattcggcggcgatcgccggcgacatggcggccagcctgtacgacctgagcaagctgcacgagaagatcgaggaccgcccggacaactccacgcgcttcctgatcatcggcaatcaggaggtgccgccgaccggcgacgacaagacctcgatcatcgtttccatgcgcaacaagccgggggccctgcacgagctgctggtaccgttccacaacaacggtatcgacctgacccgcatcgaaacccgtccgtcgcgcagcggcaaatggacctacgtgttcttcatcgatttcgtcggccaccataaagaaccgctgatcaaggacgtcctggagaagatcggccaggaagccgtcgccctgaaggtcctgggctcctatccgaaagcggtgctctga

SEQ ID NO: 4983 - DNA, 2349 bp, Pseudomonas aeruginosa
tcgtgcgtccggtggctggctacgggatgccgaccttcctgcgcgtctccatcgggctgccggaagagaacgatcgtttcctccaggcgctgggcaaggtgctggcgcatgactgaggtcacgccgctgcaacagtcgacccctaagctgggccgcctggtggtggtggggctgggcctgatcggcggctccttcgccaaggggttgcggagcaaagggttgttccgggaagtggtcggcgtggatcgggatgccgagtcttgccgcctggcggtggagctcggcgtggtcgaccgttgcgaggaggatcttggccgcgcctgcgtcggcgccgacgtgatccagttggcggtgccgatcctggcgatggagcgggtgctggccgacctggcgaagctcgacctgggcaaggctgtattgaccgacgttggcagcgccaagggcaatatcgtgcgtgccgcgcgtgtcgcgttcggcgggatgccgcggtacctggtaccggggcatccgatcgcgggttccgagcagagcggagtgaccgcggcgaaggcgaccctgttccgccggcacaaggtgattctcacgccctccgcggagaccgatgccgacgcgctggcgctggtcgacagcctgtggcgcgcgctgggcgcggacgtcgagcacatggaggtcgagcatcacgacgaggttctggcggccaccagccacctgcctcacctgctggccttcaccctggtcgactccctggccaagcgcagcgagaacctggagatcttccgctatgccgccggcggtttccgtgatttcacgcggatcgccggcagcgacccggtgatgtggcacgacatctttctcgccaatcgcgaggcggtgctgcgtacactggatgtttttcgtgacgacctcgacgcgctgcgcgaggccgtcgacactggggacgggcaccagttgttgggcgttttcacgcgcgcccgggtagcccgtgagcatttcagcaaaatcctggcccgtcgggcctatgtggacgccatgcacaacaacgacctgatttatctggcccagccgggcggcagcctgtccggaaccatccgggtaccgggcgacaagtcgatttcccatcgctcgatcatgctcggctccctggccgaaggcaccaccgaagtggagggcttcctcgagggcgaggacgcactggcaaccatccaggcgttccgcgacatgggagtggtgatcgaggggccgcagaacggccgcgtcaccgtccatggcgttggcctgcacggcctcaaggcgccgcctgggccgatctacctgggtaactccggtacttccatgcgtctgctcagcggtctgctggcggcccagccgttcgacagcaccctgaccggcgacgcttccctttccaagcggccgatgaatcgcgtagccaagccgctgcgcgagatgggcgcggtaatcgagacggggccggaaggccgtccgccgatgaccattcgcggcggccagcgcctcaccggtatgcattacgacatgccgatggccagcgcccaggtgaagtcctgcctgttgctcgccgggctctacgccgcgggtgagacctcagtcaccgagccggcgccgacccgcgaccacaccgagcgcatgctgcgcggcttcggctatccggtggtggtcgagggcagcaccgccaaggtcgaatccgggcacaagttgagcgccacccatatcgaggtcccggccgacatatcctcggcagccttcttcctggttgccgccagtatcgccgagggttcggaactggtcctgcagcacgtcggcatcaacccgacgcgcgtcggcgtcatcgagatcctgcgcctgatgggtggtgacctgagcctggaaaaccagcgcgaggtcggcggcgagccggtcgccgacatccgcgtgcgctccgcgcggctcaagggcatcgacattcccgaggacctggtgccactggccatcgacgagttcccggtactcttcgtggctgccgcctgcgccgaggggcgcaccgtcctgcgtggcgccgaagagctgcgggtcaaggagtcggaccgtatccaggtcatggccgacggcctgaaggccctgggcgtgaaggccgagccgaccccggatggcatcgtcatcgagggtggtgcgttcggtggcggcgaagtctgggcgcacggcgaccaccgtatcgccatgtccttcagcgtcgcttcgctgcgtgccagcgggccgatccgcatccacgactgcgccaacgtcgccacctccttccccaacttcctcgccctgtgtgcccagaccggtatccgggtcgccgtggagaacaattga

SEQ ID NO: 4984 - DNA, 1215 bp, Pseudomonas aeruginosa
acagaagaccgcccgcatcgacacgctgtgccgggaggcgcgcatcctcccggtgatcaccatcgaccgcgaggcggacatcctgccgatggccgatgccctcgccgccggcggcctgaccgccctggagatcaccctgcgcacgacgcacgggctgaccgccatccggcgcctcagcgaggagcgcccgcacctgcgtatcggcgccggcaccgtgctcgacccgcagaccttcgccgccgcggaaaaggccggggcgagcttcgtggtcaccccgggttgcaccgacgagttgctgcgcttcgccctggacagcgaagtcccgctgttgcccggcgtggccagcgcttccgagatcatgctcgcctaccgccatggctaccgccgcttcaagctgtttcccgccgaagtcagcggcggcccggcggcgctgaaggcgttctcgggaccattccccgatatccgcttctgccccaccggaggcgtcagcctgaacaatctcgccgactacctggcggtacccaacgtgatgtgcgtcggcggcacctggatgctgcccaaggccgtggtcgaccgcggcgactgggcccaggtcgagcgcctcagccgcgaagccctggagcgcttcgccgagcaccgcagacactgagactgcccgcctgggcatgcccggcttcggccgggtttttttatgccgtccggattatccggggcatggaacggctaacgtcatcggcgttattcgccgatgcgccggcgttcccgcagatagtcgccgagccggctctgcaggtagggtacggccatggcatgcgcgaggtaggcgtccacctccatcaatcgccagtattgtccttcgtcgccgaagcggatggcctcgaactcgcggtcctccaggcgcgccaccaggaagtaggcgaagggcgcgctgccgctggtgctcggatactgtcgctgccattcgatacgaggttcttccaggcggatggagaactcttcctcgagttcgcgcagggcgcattcggcaggcgtctccaggccctcacggccgccgccgggaaagtcccagtagccggggaagggaatgccgggtttttcgtcgcgtttgtagacgaccaggtggtcgccatagaacagcgccagcttggcgccgctgaagggagggatgtcgtgcaccggggcctccgggtggcggggtgggtgaacccggcctag

SEQ ID NO: 4985 - DNA, 1206 bp, Pseudomonas aeruginosa
tgcgcgcccttcgattcgttgccagccacaccgggaggtgcccagatgaacgataccccagagaatccccacgtaccggtcggggaaaaactgcagaaagtcctcgcccgtctcggcgtcggttcccggcgcgacgtagaagtgtggatcgccgaaggtcgggtcaacgtcaatggcggcgtggccagcctcggccagcgggtcgacagccacgatgcgatcaccgtcgatggccacctgatccgccgcgaagaggccgccgagagtgtccgtcgcgtgctgatctacaacaagccggaaggcgaggtctgcacccgcgacgatccggaaggccgcccgaccatcttcgaccgcctgccgcgcctgcgcaccggtcgctggatcaatgtcggtcgcctggacatcaataccaccggcctgctgctgttcaccaccgatggcgaactggccaaccgcctgatgcatccttcctatgagatggaccgtgaatacgcggtacgggtgcgcggcgaggtcaccgaagagatgatcgagcgcctgctcaacggcgtgatgctcgaggacggcccggccaagttcagcgatatccagcaggcgccgggcggcgaaggcttcaaccactggtaccactgcgtagtgatggagggccgcaaccgcgaggtgcgccggttgtgggaatcccagggattggtggtcagccgcctgaagcgagtgcgtttcggcccggtgttcctgacctccgagctgaccatgggccgctaccgcgaaatggaccagcgcgaaatcgacatcctcagcgaggaagtcggcctcaagccggtggcgctgccgggcatgaccaccaaggcgcgcgagaaggccgaacgccagcagcgcaagcaggcccgtccgctggcgcgcagcgagcgtccggaagccgggcgcaagcgtgcgccaaggcgcgaggacggcgagaatgccgctcgtcgcgcgccggcttcgcgtcccgcgcgcggtccgcagccgagcgccgagcgcaaggggcgcgagcagggcactccggttgccgagcggccccgcgagagcaaccgcaagccgcgcccgagcaagccgcgcgacgagcgtccggccagcgcgccgggcgacaagccggcggcccgcaagccgcaggtcaagcggcggccgaaaccggccggcgacggtatgcgtccgggcttccgccgctga

SEQ ID NO: 4986 - DNA, 462 bp, Pseudomonas aeruginosa
ctgggcagcaccaggcccaggcgttcctcgagcgcgtcgccgagccagaagccgagcaccatcaccagcagcacgcaggtcagcaggcgcagcaggagattgccgtccagcgtggccgccgcatgctggcgtcgctcctgctgcccgagggcttccagccgattgtcgctttccgcctgcaccggcaggcggttgcgttcgatcagccagcgcgccaccgggctgccgagcagcccgccagcgaccatgccgaaggtggccgaggccagcgccacggtggtcgcgccctgggcgccgagcccttccgcaaccgggccgaaggccgccgccgcgccgaagccgccttccagcgacaccgcgccggccatgatcccgagcaacgggtcgaggccgagcagtccggcgctgcctacgccgatcaggttctgcagtatcgccagcgcccagcaggccgacaggtag

SEQ ID NO: 4987 - DNA, 558 bp, Pseudomonas aeruginosa
ggataccgatgcgcggcaggcgctcatgccgactcaagtggcgggcgaggccggcgaagctggcgtaggcgatttcgtggccgccgcccaggccgaccacccggtggccgcgcgcgagcaggtcggcgacgcgttgcgcgtagcgttcctgggcggcttccagatcgtcgccggcgacgatgtcgccggcgtcgtagatcgcttgctcgccgtgccaggccaggttggccagcgcgcgacgcaaggctggcggtccgtggcgcgcgccctggcgaccctggttgcggcgcacgccttcgtcgctggcgaacccgagcagcacgctggccgcttcggcgtcgtctgcgtagggacgcatccattggtgccagcgccgcgcgtcggcgccttcctggctatcgatccggccttgccagaggctcatgtcgggggcggggtacatcgaaactcctgtcggtcagtccagccgcgcggaaagtcgcgcggcggcgtcgagggtccattgccgcaagcgttcgctgcgcgactgggcgcgcaaggcgggggccatcaggctga

SEQ ID NO: 4988 - DNA, 2862 bp, Pseudomonas aeruginosa
gttggcgctgctcgggcatgcgccgacctacttcgtttgcctcaggatcgaggcggcgaagttccaccagaaaaaggaaccaggcttctcatgggcgaactggccaaagaaattctcccggtcaatatcgaagacgagctgaaacagtcctatctcgactacgcgatgagcgtgatcgtcgggcgggccctgccggatgcacgtgacggcctgaagccggtgcaccgccgtgtgctttatgccatgagcgagctgggcaacgactggaacaagccctacaagaaatccgcccgtgtggtcggcgacgtgatcggtaagtaccacccgcacggcgacaccgcggtctacgacaccatcgtgcgcatggcgcagccgttctcgctgcgctacatgctggtagacggccagggcaacttcggttcggtggacggcgacaacgccgcagccatgcgatacaccgaagtgcgcatggccaagctggcccacgaactgctggcggacctggaaaaggaaaccgtcgactgggtgcccaactacgatggcaccgagcagatcccggcggtcatgccgaccaagattcccaacctgctggtcaacggttccagcggtatcgccgtgggtatggcgaccaacatcccgccgcacaacctcggcgaagtgatcgacggctgcctggcgctgatggacaaccccgacctgaccgtcgatgagctgatgcagtacatccccggtccggacttccccaccgccggcatcatcaacggccgcgccgggatcatcgaggcctaccgcaccggtcgcgggcgcatctacatccgtgcccgcgccgtcgtcgaggagatggagaagggcggcggtcgcgagcagatcatcatcaccgagctgccgtaccagttgaacaaggcgcggttgatcgagaagatcgccgagctggtgaaagagaagaagatcgagggtatttccgagctgcgcgacgagtccgacaaggacggcatgcgcgtggtcatcgagctgcgtcgcggcgaggtgggcgaggtggtcctcaacaacctctatgcccagacccagctgcagagcgtgttcggcatcaacgtggtggccctggtcgacggccagccgcgcacgctgaacctgaaggacatgctcgaggtgttcgtccgccaccgccgcgaagtggtgacccggcgtaccgtctacgagctgcgcaaggcccgcgagcgcgggcacatcctggaaggccaggcggtcgccctgtcgaacatcgacccggtgatcgagctgatcaagagttcgccgaccccggccgaggccaaggaacgcctgatcgccactgcctgggagtccagcgcggtggaagcgatggtcgagcgtgccggcgccgacgcctgtcgcccggaagacctggatccgcagtacggcctgcgcgacggcaagtactacctgtcgccggaacaggcccaggcgatcctcgagctgcgcctgcatcgcctgaccggcctggagcacgagaagctgctctccgaataccaggaaatcctcaacctgatcggcgagttgatccgcatcctgaccaacccggcgcgcctgatggaggtgatccgtgaggagctggaagcggtcaaggccgaattcggcgatgctcgccgcaccgagatcgtggcttcccaggtcgacctgaccatcgccgacctgatcaccgaggaagaccgcgtggtgaccatctcccacggcggctacgccaagtcccagccgctggccgcctaccaggcgcagcgtcgcggcggcaaaggcaagtccgccaccgggatgaaggacgaggactacatcgaacacctgctggtggccaacagccatgcgaccctcctgctgttctccagcaagggcaaggtctactggctgcgtaccttcgagattccggaagcctcgcgtaccgcgcgtggccggccgctggtgaacctgctgccgctggatgagggcgagcggatcaccgcgatgttgcagatcgacctggaggcgctgcagcagaacggtggcgccgatgacgacctcgacgaagccgaaggcgcggtgctcgagggcgaggtggtcgaggccgccgaggtcgaggaagtcgagggcgagaccgccgagctggtggccgagcagaccggcgcctacatcttcatggccaccgccttcggtaccgtgaagaagaccccgctggtgcagttcagccgtccgcgcagcagcggcctgatcgcgctcaagctggaagagggcgacaccctgatcgccgccgcgatcaccgatggcgccaaggaagtcatgctgttctccagcgccggcaaggtgatccgcttcgccgagagcgtggtgcgcatcatgggccgcaacgcccgcggcgtacgcggcatgcgcctgggcaaggggcagcagctgatctccatgctgattccggagtccggggcgcagatcctcaccgcctccgagcgcggcttcggcaagcgtaccccgctgagcaagttcccgcgtcgcggccgtggcggccagggggtgatcgccatggtcaccaacgagcgcaacggcgcgctgatcgccgcggtacaggtccaggaaggcgaggagatcatgctgatttccgaccagggcaccctggtgcggacgcgtgtcgacgaagtctccctgtccggccgcaatacccagggcgtaaccctgatcaagctcgccagcgacgaggtactggtcggtctggagcgtgtccaggagccgtcgggcggagatgacgaggacctgcccgaaggggaggaagctgccgaatctctgggcgagtcggccgagtccgagtccgagcccgcggcggaagcggaaggcaacgaagagtaa

SEQ ID NO: 4989 - DNA, 1173 bp, Pseudomonas aeruginosa
ggctcggggcgggcgcctgcgcccgcccggccgatgacgtcggcggataactcacggctatccgccctacctatagcgagagtggatgtgagcaagcgagccttcaatttctgcgccggtcccgcggcgcttcccgacgcagttctgcaacgtgcccaggccgagcttctcgactggcggggcaagggcctttcggtcatggaaatgagccaccgtagtgatgactacgtggccatcgccagcaaggccgagcaggacctgcgcgacctgctcgacattccctcggactacaaggtgctgttcctgcagggcggcgccagccagcagttcgccgagattccgctgaacctgctgcccgaagatggcgtcgccgactatatcgataccggtatctggtcgaagaaggccatcgaggaggctcgtcgctatggcaccgtgaatgtcgcggccagcgccaaggagtacgactacttcgccattccgggtcagaacgagtggacgctgaccaaggacgcggcctatgtgcactacgcctccaacgagaccatcggcggcctcgagttcgactggattcccgagaccggcgacgtgccgctggtcaccgacatgtcctccgatatcctctcgcgcccgctcgacgtgtcccgcttcggcctgatctatgccggggcgcagaagaacatcggcccgtccggcctggtggtggtgatcgttcgcgaagacctgctcggccgcgcccgcagcgtctgcccgaccatgctcaactacaagatcgccgcggacaacggttccatgtacaacaccccggcgacctactcctggtacctgtccggcctggtcttcgaatggctgaaggagcagggcggggtgaccgcgatggagcagcgcaaccgcgccaagaaggacctgctgtacaagaccatcgatgccagcgacttctacaccaacccgatccagccgagcgcccgctcctggatgaacgtgccgttccgcctggccgacgagcgtctcgacaagccgttcctggaaggcgccgaggcgcgcgggctgctcaacctgaaaggccaccgctcggtcggcggcatgcgcgcttccatctacaacgcccttggcctggacgcggtcgaggcgctggtcgcatacatggcggagttcgagaaggagcacggctga

SEQ ID NO: 4990 - DNA, 396 bp, Pseudomonas aeruginosa
aggccgagccgaccccggatggcatcgtcatcgagggtggtgcgttcggtggcggcgaagtctgggcgcacggcgaccaccgtatcgccatgtccttcagcgtcgcttcgctgcgtgccagcgggccgatccgcatccacgactgcgccaacgtcgccacctccttccccaacttcctcgccctgtgtgcccagaccggtatccgggtcgccgtggagaacaattgatgaacggcgctgtaccgatgctcgccatcgatggccccagtggcgccggcaagggcacggtcgccgggctgctcgcccggcgcctgggctggaacctgctggattccggggcgctttatcggctgttggcgttcgccgcggtcaaccatggtgtcgacctgaccaatga

SEQ ID NO: 4991 - DNA, 1149 bp, Pseudomonas aeruginosa
gagggagaaaccgaaaccggaaggtataccacgggaccagtttgccctgtgggggggaaacagggacttgagagaatatctttcgggtggaaggacacggatttccagttcactgtcacggagcgcaacggcaagaccttttccaaggacggattgggagaccggcgtccgggacaattcagttcggtgcaggagttttggggccgcgggcagacctggcggctgacccagctgtggctcaagcagcagtacttcgacggcgcgctggacgtgaaattcggccgtttcggcgagggcgaggacttcaacagcttcccctgcgatttccagaacctggccttctgcggctcgcaggtgggcaactgggcggggagcatctggtacaactggccggtcagccagtgggcgttgcgggtgaagtacaacttcgcgccggactggtacgtgcaggtcggcgcctacgagcagaacccgtcgaacctggagaccggcaacggcttcaagatgagcggcagcgggaccaagggcgcgttgctgccggtggagctgatctggcagccgaaggtcggcgccgagcaactgccgggcgagtaccggctgggctactactacagcacggcgaaggccgatgacgtctacgacgacgtcgacggccagccgcaggggctgaccggcaacgacttcaagtcgcgcggcagcaagcatggctggtgggtggtggcgcagcagcaggtcacttcgcacaacggcgatgcctcgcgcgggttgagcctgttcgccaacctgacggtccacgacaaggcgaccaacgtggtggacaactaccagcagctcggggtggtctacaaggggccgttcgacgcgcggccgaaggacgacatcggcctgggcatcgcgcgcatccatgtcaacgacgatgtgaagaagcgccagcgcctggtgaaccaggtgaacggcatcgacgactacgacaacccgctgtaccagccgctgcaggacaccgagtacaacgccgagctgtactacggggtgcatgtgaccgactggctgacggtgcggccgaacctgcaatacatcaagcagccgggcggggtcgacgaggtcgacaacgcgctggtggcggggatcaagatccagacggtgttctga

SEQ ID NO: 4992 - DNA, 1332 bp, Pseudomonas aeruginosa
ggaagacgacgattgcctgttcagcttcgccctgcagccctactggcgggtcggcgcgctgagccgggtggtggtgcacggcatggagctggagtcggctcgcggccagcgcggcgcttcgcggattccgggaacctggataccgcgcggcgcggtcaagcaggtgctctaccatcccggatcgctggtgctggaggacggcggctggaaccgccgcttgcggatcgacaagaacgtcagcgccggcagcgtgatctggcaccccggcagccgcccggtggagcaggtcgagccgggcgaagcggaacgcttcctctgtatcggcgccgctggctaccgcccgggcgggctgatcctggcgcccggcgaacgcatgcgcctgagtctcgccgccggcctgcaataggtgggcggtcagttgtcctcgtcgaggggatagcgggtcggcaccaggctttccttgatccgccgcaggtgcggctggaagtccacgccgcggcgcagggtcactccggtggccagtacgtcgagcacggtgagctggacgatccgcgaagtcatcggcatgtagatgtcggtgtcttccggcaacgggatgtccaggcacagggtgctggccctggccagcggcgagccggcggcggtcaggccgagcaccgaggcgccgttctcccgcgccaggtgcgccacctccaccagctcgcgggtgcgtccggtataggaaatcaccacgaacaggtcgccggtatgcgccaccgaggcgatcatccgttgcatcagcacgtcggcctgggcgctcaccgccaggttgaagcggaagaacttgtgctgcgcgtcgagcgctaccgaggccgaggcgccaagaccgaagaagtggatctgccgggcctggatcaacaggtccacggcgcggtcgatgacgcgtgggtcgagcagcttgtgggcgctgtcgagggaggcgatggtgttgctgaagatcttccgcgtataggcttccggcccgtcgtcctcggctaccgcctgggtcacgaaggcagcgccgctggccaggctctgggccagctggatcttcagttccggatagccgctcatgccgaaggagcgacagaagcggttcaccgtcggttcgctgaccgctgccgcctgggccagggcggcgatgctgaaacgggtggcctgctgcgggttctgcaggatgacctcggcgactttgcgctccgccttgttcagttcgtccaggcggctctggatctgctccagcaggtttttcatccgggttcctcgtgttctgtcggcccggcggggaagggccggcggcggcgcctatcctaa

SEQ ID NO: 4993 - DNA, 1476 bp, Pseudomonas aeruginosa
caacaaatgcctgatgtccgcgttctgccttgcacgttagcgctgttcggtgcgctgggcgatctcgccttgcgcaagctgttcccggcgctctaccaactcgatcgtgagaacctgctgcaccgcgatacccgcgtcctggccctggcccgtgacgaaggcgctcccgccgaacacctggcgacgctggagcagcgcctgcgcctggcagtgccggcgaaggagtgggacgacgtggtctggcagcgtttccgcgaacgcctcgactacctgagcatggacttcctcgacccgcaggcctatgtcggcttgcgcgaggcggtggatgacgaactgccgctggtcgcctacttcgccacgccggcctcggtgttcggcggcatctgcgagaacctcgccgccgccggtctcgccgagcgcacccgggtggtgctggagaagcccatcggtcatgacctggagtcgtcccgcgaggtcaacgaggcagtcgcccggttcttcccggaaagccgcatctaccggatcgaccattacctgggcaaggagacggtgcagaacctgatcgccctgcgcttcgccaacagcctcttcgagacccagtggaaccagaaccacatctcccacgtggagatcaccgtggccgagaaggtcggcatcgaaggccgctggggctacttcgaccaggccgggcaactgcgcgacatggtgcagaaccacctgctgcaactgctctgcctgatcgccatggatccgcccagcgacctttcggcggacagcattcgcgacgagaaggtcaaggtcctccgcgccctcgagccgattcccgcagaacaactggcttcgcgcgtggtgcgtgggcagtacaccgccggtttcagcgacggcaaggcagtgccgggctacctggaggaggaacatgcgaatcgcgacagcgacgcggaaaccttcgtcgccctgcgcgtggacatccgcaactggcgctggtcgggcgtgccgttctacctgcgcaccggcaagcgcatgccgcagaagctgtcgcagatcgtcatccacttcaaggagccgccgcactacatcttcgctcccgagcagcgttcgctgatcagcaaccggctgatcatccgcctgcagccggacgaaggtatctccctgcaagtgatgaccaaggaccagggcctgggcaagggcatgcaattgcgtaccggcccgctgcaactgagtttttccgagacctaccacgcggcgcggattcccgatgcctacgagcgtctgctgctggaggtcacccagggcaaccagtacctgttcgtgcgcaaggacgaggtggagttcgcctggaagtggtgcgaccagctgatcgctggctgggaacgcctgagcgaagcgcccaagccgtatccggctgggagttgggggccggtggcctcggtggccctggtggcccgcgatgggaggagttggtatggcgatttctga

SEQ ID NO: 4994 - DNA, 1131 bp, Pseudomonas aeruginosa
caacgccggcctggttcgccgccacctgctccgtggcgaggcggcgaaggcgcgcttcatcggcctctaccagccggcggcgagcctggaggaagcggccgagctggccgaccatcacctgcacgagctgccattgccgatcgacgtgctggtcctcggcatgggcgacgacggccataccgcctcgctgttcccgaacagccctggcctggacctggcgatggatccccaggggacgcgccgttgcctgccgatgtgggcgccgagcgtgccgcaccagcgcctgaccctgccgcgcgccgtgctggcggcggcgaaggtgcagctgctggcgatccagggccagtccaagctggccaccctgaacgccgcgctggcggtcgaggacgaacggcggatgccggttcgcgccttcctccgcgcgcagctgacgatccattggtacccctgagtggcggagctgtagccatgcacaaccttgaacagaagaccgcccgcatcgacacgctgtgccgggaggcgcgcatcctcccggtgatcaccatcgaccgcgaggcggacatcctgccgatggccgatgccctcgccgccggcggcctgaccgccctggagatcaccctgcgcacgacgcacgggctgaccgccatccggcgcctcagcgaggagcgcccgcacctgcgtatcggcgccggcaccgtgctcgacccgcagaccttcgccgccgcggaaaaggccggggcgagcttcgtggtcaccccgggttgcaccgacgagttgctgcgcttcgccctggacagcgaagtcccgctgttgcccggcgtggccagcgcttccgagatcatgctcgcctaccgccatggctaccgccgcttcaagctgtttcccgccgaagtcagcggcggcccggcggcgctgaaggcgttctcgggaccattccccgatatccgcttctgccccaccggaggcgtcagcctgaacaatctcgccgactacctggcggtacccaacgtgatgtgcgtcggcggcacctggatgctgcccaaggccgtggtcgaccgcggcgactgggcccaggtcgagcgcctcagccgcgaagccctggagcgcttcgccgagcaccgcagacactga

SEQ ID NO: 4995 - DNA, 837 bp, Pseudomonas aeruginosa
ccaccaaggcgcgcgagaaggccgaacgccagcagcgcaagcaggcccgtccgctggcgcgcagcgagcgtccggaagccgggcgcaagcgtgcgccaaggcgcgaggacggcgagaatgccgctcgtcgcgcgccggcttcgcgtcccgcgcgcggtccgcagccgagcgccgagcgcaaggggcgcgagcagggcactccggttgccgagcggccccgcgagagcaaccgcaagccgcgcccgagcaagccgcgcgacgagcgtccggccagcgcgccgggcgacaagccggcggcccgcaagccgcaggtcaagcggcggccgaaaccggccggcgacggtatgcgtccgggcttccgccgctgagcggaaagcgccctggaaaggccccttcggggcctttttcatgcctgggaatcggtgtctaatggtcgcccgcacacaaggaggtggtgaaatgcacaggatcctggctatcgcgctctgcatgctatggagcgtcgccgggctggccgaggatgcggcgatgccggcgcagagctgtgcaagccttggcgaggcgacggccggccccgaggacaacttccgtccgccgctggagggcgaggtgatcgacaaggggcgcgcctatttccacagcgcgccgcgtgccgactgtgtcaccggggtcttcgtgattcccggcgacttcatcactgtctacaagccgagcggcgagtggctgaacgtcatgtacgtggctcgagacggcaaggaaaccagcggctggctgctggagaagcgcgtccgcttgcgccaggcctatggcgccccggacgagccggcgcagccataa

SEQ ID NO: 4996 - DNA, 2874 bp, Pseudomonas aeruginosa
gcagccagaccagggaggcgaagccgaagccggcgatcaccggcgacggtacgcacagacgtgtcagccagcggctgcgcttcttcaattggctgccgagggcgagcaggagcagggcgagggcggtggtggacagggcgtccaggtgcaatgtcggcatggcgtggctctattgttgttgtgtgggcgaaagggcgatcagttgaccaggctgtcgaccaggcgcgcggcgatccgggcggtgcgctggtcgctatcgagttgcgggttgagttcggcgatgtcggccaggcgcagcttgccgctggccttggcgcggcggaccaggtgctccaccaccggcatctccacgccgtgcgccgagggcgcgctgacgccgggcgcctgggcggccgggagcacgtcgaggcaaacggtcaggtagaggtggtcgacggattgcaggaagctgtcgaggaaggcttcgctgcgttccaggttccacggctgcaactggcggtccagcaggtagcgcacacccaggcgctgggcctggtcgaacagcgccgcggtgttgctcaggcggctgatgcccaggcagcagtaagcgaacggccagtcgctggcctggcagagttcggcgatctggcggaacggcgtgccggagctggcccgttcggcgtggcgcaggtcgaaatgcgcgtcgaaattgaggataccgatgcgcggcaggcgctcatgccgactcaagtggcgggcgaggccggcgaagctggcgtaggcgatttcgtggccgccgcccaggccgaccacccggtggccgcgcgcgagcaggtcggcgacgcgttgcgcgtagcgttcctgggcggcttccagatcgtcgccggcgacgatgtcgccggcgtcgtagatcgcttgctcgccgtgccaggccaggttggccagcgcgcgacgcaaggctggcggtccgtggcgcgcgccctggcgaccctggttgcggcgcacgccttcgtcgctggcgaacccgagcagcacgctggccgcttcggcgtcgtctgcgtagggacgcatccattggtgccagcgccgcgcgtcggcgccttcctggctatcgatccggccttgccagaggctcatgtcgggggcggggtacatcgaaactcctgtcggtcagtccagccgcgcggaaagtcgcgcggcggcgtcgagggtccattgccgcaagcgttcgctgcgcgactgggcgcgcaaggcgggggccatcaggctgagggcgccgtgcaggcgctggcggctgtccagcagcggtacgctgatgccccagacgccttcgtcgatctcgccctggctgacggcgtagccctgttcgcggatcagccggagttcctgctccagcttgtcgatacgctcggcggagagttcctgggcgaggtacagctcctcgcgccgttcgtcctccaggtgcgccagcagggctttggccgaggcgccatgcaacagcggctgcgccagccctttctggtagcagcagcgcagtggctgcggactgtcgaacagttccaggcagatcgcctgctggttgctggccaccatcagcgccacgctctcctggctcaggtcggccaggcgcttgagttccggtttggcgagaccgatcagcgaggcctcgcgatcgaatttcttcgccagttgcaggcaggccgggccgggcaggtagcggccctggccggcctgttcttcggccaggccccagcgcaacagggtcttcaggtgccggtaggtgctgctcagcggctgctccagggtcagcgacagctcctaggcagacagggcttcgggcgcctggccgagggcaatgaggatctgcagcaggcgatcggtgggggaatgcttcgacatgggaactccttgacccacagggtgaaggcgatttcccggaaaatgaaaccactttcccactcagtgggaaaaatatgcaaaaagaatgggaagttccggacgggaagagggaaggacagggcagcctcgccgggcggcgaggctgccggggaatcactgggcgtcgaaggcctggccgttgacgccggcgctgtccggccccatgaggtacaggtagaccggcatgatctcctcgccggtggggttgttcagcgggttttccccagggtaggcgagggcgcgcatgctggtgcgggtggcgccggggttgacgctgttggcgcggatcgcgctggtaccgtcgagttcgtcggcaagggtctgcatcaggccctcggtggcgaacttcgataccgaataggcgccccagtaggcgcggcccttccggcccacgctgctcgaggtgaagatgatcgaggcgtcgctggagagcttcatcagcggcagcatggcggtggtcagcatgaacatggcattgacgttcacctgcatcacgcgcatgaagttctccccggaaatctgctgcatcggcgagcgcggaccgaggatcgaagcgttgtgcagcaggccgtcgatgcggccgaactcgttctccagggttgccgccagttcctcgaactggtgcggctgggcggtctccaggttgaacgggatcacggcggcctgcggatggccggcggcctcgatggcgtcgtagacctcgttcaggtactcctcggtcttgcccagcagcagcacggtggcgccgtgggcggcgaaggtcttggcggcggcggcgccgatgccgcggccggcgccggtgaccaggatcacgcggtctttcagcaggtcggggcgggcggagtactggaacatgtcgaatcctttgaatgcatgacccgcctggcggcgggtcgttgtctgtcggcggcgctgcggatcagcagtcgcagagcgcgcggtcgagaacgtcgatga

SEQ ID NO: 4997 - DNA, 726 bp, Pseudomonas aeruginosa
gccgcatgcgcttcacgcctcccgctgggtctggaccatgtagttgacgtcgacgtcgttggccagcttgtagtgcttggtcagcgggttgtaggtcaggccgatgatgtccttgacctcgagaccggcctcgcgcgaccaggcgccgagttccgacggacggatgaacttgcggaaatcgtgggtcccgcgcggcagcaactggaggatgtattccgcgccgatcaccgcgaacaggtaggccttgggattgcggttgatggtcgagaggaaaacctgtccgcccggcttgaccaggcggtggcaggcgcggatcaccgaggccgggtccggcacgtgttcgagcatctccaggcaggtgaccacgtcgaactgcccgggcatttcctcggccatctgctcggcggtgatctgccggtagtcgacggcgacgccggattccagctggtgcaggcgcgccaccgcgagcggcgcttcgcccatgtcgatgccggtgacgttggcgccgcgctgggccatggcttcgctgaggatgccgccgccgcaaccgatgtcgagcaccttcttgccggccaggccggcgcgctcgtcgatccagttgacgcgcagcgggttgatgtcgtggagcggcttgaactcgctctcgcggtcccaccagcgatgggccagtgcctcgaatttggcgatctcggcgtggtcgacgttgctcataatcgttcccgttga

SEQ ID NO: 4998 - DNA, 1932 bp, Pseudomonas aeruginosa
agagtgaagcctttgggggaagggccgcggcggcggaatccaatccttcatgttgccagctttggcggagggatggggccggcggcggttcgccttcctatgtcagtttgtcgcagcgggccggcccgccgcggttcaggacctgtcgctggcggcgatcttcgccccccattcgcgggccctggcgatcaggcgctgttcgtcgtgacgaagcaggcggccgtcgtcgaggagttgcctgccgccgacccagacgtgccgcacgcagtcgcggccgctggcatagataagttgcgaaaccgggtcgtagaccggttgctgggccaggccggacagatcgaaggccaccaggtcggcggccttgccggcttccagggagccgatcaggcgctccaggccaagcgcgcgggcgccgttcagggtggccatgcgcagcgcgcggtgggcgtcgagggcggtggcctggccgtacacggccttggccagcagcgccgcggtgcgggtctcgccgagcaggtcgagatcgttgttgctcgccgcgccgtcggtgccgatggctacgttgaccccggcctgccagagtttttccaccgggcagaagccgctggccagcttgaggttggattccgggcagtggatcaccgagctgttggtttccaccagcatcgccaggtcgtcgtcgtccacctgggtcatgtgcaccgcctggaagcgtgggccgagcaggccgaggcggtgcaggcgggccagcgggcgctcgccgttgcgctccgtggcctgctccacctcgaaggcggtctcgtggacgtgcatctggatgctggcgtcgagttcctcggtgagcaccaggatctgctccagcttgtcgtcgctcaccgtataaggagcgtgcgggccgaaggcgatgcggatgcgcgggtggtgcttgaggtcgtcgaacagcgccatgccctggcggatcgcctcggcgctgtcgcgggcgccggggatcgggaagtccagtaccgggatcgccacctgggcgcggaccccgctgtcatggaccacgccgcagatggcctgtggatagaagtacatgtcggagaaacaggtgatgccgccctttacctgttcggcgatggccagctccgtgccgtcgcggatgaatcctcgctgacccattggccttcggccggccagatgtggtcctgcagccaggtcatcagcggcaggtcgtcggcgagaccgcggaacagactcatcgccgaatggccgtgggcgttgaccagaccgggggcgagcagcatgcccggcaattcgcggatttccgtggcgccatggcgcatggcctgctcgcgcggcgcgaccagggctatctggccgtcgcggatgcccagcgcgtggtcgcgcagcaccaccccggcgggctccacggggacgatccaggtcggcagcaggaggaggtcgaaggggttacggacgttgggcatggcggcgcatcctgggcgcagagcgggaagccggaagtatacccgagcgtccgcggctggggctcgttataatccgcagcttttccgtgattcagcgagaggtgtgtgcatgcgagagcgactgctggcggccgagcgggtcaaggcgatcgagtggcgggacggtacgctgcggttgctggatcagcgcctgctgccccaggaggaggtctggctcgaacacgagtcggcggccgaggtggccaaggccattcgcgatatggtcgtgcgcggcgcgccggccatcggcatcagcgccgcctacggcatcgtccttggcgcccgcgcgcgcttggcgcagggcggcgactggcgcgccgcgctggaggaggacttccgcctgctggccgactcgcgacccacggcggtcaacctgttctgggcgctgaaccgcatgcgcgaccgtctggagcgaatgaaatag

SEQ ID NO: 4999 - DNA, 723 bp, Pseudomonas aeruginosa
ggcgaccagccgctggcggtgctggaagccgaggcgatctccatccatgaaagcgaccgcgaggccaacctgaccatggcccagttgggcatggagctgatccgcaagcagcagggcagcccgcagaacatcctcacccactgcaataccggcgccctggcgaccggcgggttcggcaccgcgctgggggtgatccgcgccgcgcacctggaaggcctggtcaatcgcatctacgccgacgaaacccggccctggctccagggctcgcgactaaccgcctgggagctggccaacgaaggcatcccggtcagcctgaacgtggattcggccgccgcgcacctgatgaagaccgagaacatcacctgggtcatcgtcggcgccgaccgcatcaccgccaatggcgatgtcgccaacaagatcgggacctaccagttggcggtcaacgccatgcaccacggcgtgcgcttcatggtggtggcgccgagttcgaccatcgacatgaacctggagagcggcgaggacatcccgatcgaagagcgcgacggtcgcgagctgctggaaatcggcgggcgacgggtagcggccgaggtcgatgcctacaatccggtattcgacgtgaccccggcggaccttatcgatgccatcgtgaccgagcgtggcgtcgtcgagcgtcccgacgccgagcgcatggccgccctgatgagccgcaagcgcctgcattga

SEQ ID NO: 5000 - DNA, 1269 bp, Pseudomonas aeruginosa
agaaccgctgatcaaggacgtcctggagaagatcggccaggaagccgtcgccctgaaggtcctgggctcctatccgaaagcggtgctctgagcgcgctgtcattccgaagagacgggtcatcgatgaatgccccgtcccgcgtcgaggctgaactatccatgtccgatttccttgccctggcccagccgggggtgcaaaagctgtcgccctacgtccctggcaagccggtggacgaactggcccgcgagctgggcatcgaccctgcggcgatcgtcaagctcgccagcaacgagaacccgctgggtgcgagcccaaaggcgctggaggctatccgcgccgaactggcggaactgacccgttatcctgacggcaacggtttcgaactcaagcgcaagctggccgagcgttgcgcggtggatgcggcgcaggtgaccctgggcaacggctccaacgacattctcgacctggtcgcccgtgcctacctcgcgcctggtctgaacgccgtgttcagcgaacatgccttcgccgtctacccgatcgccacccaggccgtgggcgccgaggggcgggcggtcaaggcgcgcgcctgggggcatgacctggaagcgatgctcgccgccatcgatgggcaaactcgcgtggtgttcgtcgccaacccgaacaacccgaccgggacctggttcggtgcggacgccctggagcggttcctcgcccaggtgccggcggaggtgctggtggtgctggacgaggcctatatcgaatacgccgagggcgacgagctgcccgatggcctggactacctggcgcggcaccccaacctgctggtctcgcggaccttctccaaggcctatggcctggcttcgctgcgggtcggctacgcgctttcgagcaaggcggtggccgatgtgctcaaccgcgtgcgccagccgttcaatgtcaatagcctggccctggcggctgcctgcgcggcgctggatgaccatgactacctggcgcagagtcgccgcctaaacgattccggcatggcgcagctggaggatggcttccacgtgttgggcctgtcctggattccctcgaagggcaacttcatcgccgtggatctggctcgcgatgccggtccggtctaccaggcgctgctgcgcgaaggtgtgatcgtgcgtccggtggctggctacgggatgccgaccttcctgcgcgtctccatcgggctgccggaagagaacgatcgtttcctccaggcgctgggcaaggtgctggcgcatgactga

SEQ ID NO: 5001 - DNA, 1167 bp, Pseudomonas aeruginosa
cctgagcctggaaaaccagcgcgaggtcggcggcgagccggtcgccgacatccgcgtgcgctccgcgcggctcaagggcatcgacattcccgaggacctggtgccactggccatcgacgagttcccggtactcttcgtggctgccgcctgcgccgaggggcgcaccgtcctgcgtggcgccgaagagctgcgggtcaaggagtcggaccgtatccaggtcatggccgacggcctgaaggccctgggcgtgaaggccgagccgaccccggatggcatcgtcatcgagggtggtgcgttcggtggcggcgaagtctgggcgcacggcgaccaccgtatcgccatgtccttcagcgtcgcttcgctgcgtgccagcgggccgatccgcatccacgactgcgccaacgtcgccacctccttccccaacttcctcgccctgtgtgcccagaccggtatccgggtcgccgtggagaacaattgatgaacggcgctgtaccgatgctcgccatcgatggccccagtggcgccggcaagggcacggtcgccgggctgctcgcccggcgcctgggctggaacctgctggattccggggcgctttatcggctgttggcgttcgccgcggtcaaccatggtgtcgacctgaccaatgaagaagcgctgaaggttctggctgcgcacctcgatgtgcagttcgtcgctgccgatggcagccatgggcagcgcatcattctcgaaggcgaggaagtgaccgatgtgatccgtaccgagcaggtcggtgccggcgcctcacaggtcgccgccttaccggccgtgcgcgatgcgttgctgcagcgccagcgggcgttcctcgaagcgccggggttggtggccgacggccgcgacatgggcaccgtggtgtttcccgatgcgcctctgaagatcttcctcaccgcctcggcggaggagcgtgcgcgtcgacgctacctgcagttgaaggcgaagggcgcggatgtcgaccagtctgccttgctggaagaaatccgcgagcgcgacgagcgcgacagccagcgcgcggtcgcgccgctgaaaccggccgatgacgcgatcctgctggactccaccgaaatgagcatcgaggcggtggtcgagacgatcatccggcactgcgagcggcagggttgggacgtctga

SEQ ID NO: 5002 - DNA, 1047 bp, Pseudomonas aeruginosa
gggtatccgccaggccgctgccgtagctcttgtgcaggttgcgcagttcgagggttgccatgtttcgttcgtctccggggtcagcgacccgtctcagcctttcacggcgccggcggtgaggccgcgcacgaagtacttgccggccagtacgtagaccaccagcgtgggcagcgcggcgatcatcgccgcggccatgtcgacgttgtattccttgaccccggtggtgatgttcaccaggttgttcagggccacggtgatcggttgcgaatcgccgctggcgaacaccacgccgaacaggaagtcgttccagatctgggtgaactgccagatcaggcagaccatcacgatgggcgtggacatcggcagcaggatgcgcaggaagatggtgaagaagccggcgccgtccaggcgcgcggccttgaccagggcatccgggatcgccacgaaatagttgcggaagaacagcgtggtgaaggccaggccgtagatcacgtggaccagcaccaggccactggtggtattggccaggccgagcttgccgagggtgaaggacatcggcaggaggatcacctggaacggcaggaagcagccgaacaacagcgcgccgaagaacagctgggaaccgcggaagcgccacatcgacagcacgtagccgttcaacgcgccgatgaaggtggagatcagcacgccgggcacggtgatcagcaccgagttccagaagaacgcgccgacgctgtcccaggccttgagccagccgatgacggtgaaggtgtcgggcagcgacagcaggttgccggtgcggatgtcgtccggcgtcttgaagctggtcagcagcatcaccagcagcggcaccaggtaaagcgcgcaggcgccccagagggtcaggtgcacggccaggcggctgacgctgaagctcgggttcagggacgcgtcacgcatggcgcttgcctcgcagttcggaatacaggtaaggcaccacgatcgccagtacagcgccgagcatcagcatcgcgctcgccgcgccgagccccatctggccacgggtga

SEQ ID NO: 5003 - DNA, 981 bp, Pseudomonas aeruginosa
gcaggccctcgcgctggctggagcgcaggtgcgacagccagaacaggctggaaagcccttgcgcgaccagcaccgcgagcagggtcaggagcagcatgcgcccgagcagcgagcgcggcaccggcgaccagcgccgccgttcgctcatggctgcaggtgcggccgcacctgcgccgccagcaggtagccactgccgcgcacggtctggatcagccgcggcgccttgccggtgtcgcgcaggcgctggcgcaggcggctgaccgccatgtcgacgatgcgctcaagcggcagcacctcgcggccgcgggtggcgttggcgatggtgtcgcggtcgaggatctgctgcggatggtcgaggaacagcttgagcagggcgaaatccgcgccgctgaggaagaactcctcgccgtcctcatggaacagtcggtggctgaccgtgtccagccgccagtcctcgaaagccagtacgtcgccaccgcgcacctgggtgaactgcgcgcggcgcagcagggccttgatccgcgccagcagctcgcgcgggctgaacggcttgcccaggtagtcgtcggcacccagttccaggccgatcacccggtcggcctcgtcggaactggcggtgagcatgatgatcggcatgcaggccaggcgctggtgggagcgaatccagcgacagaggctgaagccgtcctcgtccggcagcatcacgtcgaggatcgccaggctcgcctcctcctcgcacagcgcctggcggaagtcggcgccccgcgagacgctgcggacctggaagccggcgcggctcaggtaggtctccagcaattcgcggatttcctggtcatcgtctaccagcaggatcgatcgtccgttcgcgctcacgaggctcctccttatgcggttgctcgacgccgactcagccctcgacgtccagggcctgctgcagggcgaccccggcgccgagcaggcccggatgttcggcggtcatga

SEQ ID NO: 5004 - DNA, 2223 bp, Pseudomonas aeruginosa
aacggaaatcggccgccccgaccggaccggcgcaggccaggcagaccgagtcgatgttcgccaccgattcgccgatccgcgccaggtagtcgcgcacggccagttcaggccgcgggtagtcggcgcaggcgagcacctcgatggattccaggcgctgcccgcgccagagcgcgaaacgcgcattggtgccgccgatatcgccgaccaggccgaggccgccagcgcttctcttgttgtcgttattcatcgtcgttgaaccgcaatgccccgcgccagggcgggacggtcggcagatgttgccggagagacagccgccagccaagcgccgggcggatatcgacctatcagaatcagcgccagcccgttgatgctctcggtaaaggtgcaggcgccttcttccgcgctgctcatggcgttgcgcatgaaggcgaacagctcgcggccgcaaccgagattgccgtcgtgcggcgccggctccaggctgcgcgcctgccattcggcgtcgtggaccagcacccgcaactcgccgttcaccccatccacccgcacccggtcgccgtcgcgcaggcgcgccagcggaccgccggcgatggcttccggactcacatggatggccgcgggcaccttgcccgacgccccggacatgcgcccgtcggtgaccagcgccaccttgaagccacgatcctgcaggaccccgaggaacggcgtgagcttgtgcagctccggcatgccgttcgcccgcgggccctggaaacgcaccacggcgaccaggtcgcgctccagctcgccggccttgaaggccgcggccaggctggcctggtcgtggaagatccgtaccggcgcctcgaccacctggtgttccggcgccaccgccgagaccttcatcacgccgcgaccgaggttgccctccatcaggcgcaagccgccttcggcggagaacggcttgtccagcggacgcaggatggcttcgtcgagactccgttccggcccttcgcgccagaccagccggccatcctcgaggaacggctcgcgggtgtagcggcgcaggccggggccggcgacggtctgtacgtcctcgtgaagcagcccgccgtcgagcagttggcggatcaggaaggacatgccgccggccgcctggaagtggttgatgtcggcctggccgttcggatagatgcgcgccagggtcggcaccacatgggacagctcggacatgtcctgccaggtcaactggatgcccgccgcctgggcgatcgccagcaggtgcagggtgtggttggtcgagcctccggtggcgagcagcgccaccaccgagttgacgatggccttctcgtcgacgatctccgccatcggcacgtagttgccgttctcgggggtcagccggctggcctggcgtgccgcttcgcgggtgagttcgtcgcgcaggggggtgttcgggttgacgaaggaggcaccgggcaggggcgggcccatcacctccaccagcaactggttggtattggcggcgccatagaaggtgcaggtgccgggtgcatggtaggaggccatttccgaggccagcagctcttcgcgagtggccttgccctcggcgaacagttggcgcaccgcggccttttccttgttggagatgccggtcggcatcggcccggccgggacgaacacggtgggcaggtggccgaagcgcagcgagccgatcagcaggcccggcacgatcttgtcgcaaacacccaggcacagcgctgcatcgaacatgttgtgagacagcgcgatggcggtggacatggcgatcacgtcgcggctggccagcgacagttccatgcccggctcgccctgggtcaccccgtcgcacatggccggcacgccgccggcgaactggccgaccgaaccgatctcgtgcagcgcctgcttgatcagccccggaaagcgctcgaacggctggtgcgccgagagcatgtcgttgtaggcggaaacgatggccacgttggcctggttcatcagccgcagggtctgcttgtcgctttcgccacaggccgcgaccccgtgggcgaggttgccgcacggcagggtgccgcggtgcggccccttgctggccgcagcccggaccatctcgaggtagcgctggcgagtggccgcgctacgggcctggatgcggcgggtgacttcgagcacacgagggtgcatggcagattctcctacagactatcaattgttgtttttacaacataa

SEQ ID NO: 5005 - DNA, 1371 bp, Pseudomonas aeruginosa
tcagttcgttcagggtctctttcatggggagttccagggtcgatgaaacggagcgggccggcctcgccggcgcggccggatgaattctacagggtgaaacgacggtcagcggcgcggccagtcgtcgtcggcgtccagtgcctcgcgctcctcgcgcatggcctccgccagggcgcgctcctcgtcatcgggatcggcgcccgcgacagcctccgcgacggcaggctcgacggcttgctccgcgaccacgggaatcggcccagccgctggctcggcggactcgtcgccctgctccgagggctccggagggtcgagcaggtcgtcgaagtcggtcttcaggccctgctccatctcgtccagttccagcagcaggctgcggaagctggtttcctcgcgcggcttctccggctcgccggcctccccctcgatctcctcgaggctttccccggcctcggcgatggcgcgatcggccagggcctggatcgaggcaggaatcgcatcctcgtcgagatcgtcgcgcggcggctgcgccgcgggcgccacttcgaccggcggttccggctcgggctccatctcgcgcagcgccgacagcggcggcagctcgtcgaggctcttcaggttgaaataatcgaggaacgccttggtagtcgccagcatcgccgggcgccccggcacctcgcggtagccaacgatgcggatccactcccgctccatcagcgtcttgacgatctgggtgttcaccgccacgccgcggatctcctcgatctcgccacgggtgatcggctggcggtaggcgatcagcaccagggtttccagcagcgcgcgcgaatagcgctgcggacgctcctcccagaggcggccgacccacggcgagaaacgctcgcgaatctgcaggcgatacccggacgcgacttccttcagctcgaaggagcgccccgcgcaggacagtgccaggatcgccagggcgtcgcggaactgccccggctccggccgctctgcctcgtcgaacagctcggccaggcgttccagcgacagcggcttgccggccgcgaggaggatgccttcgagcagagtggcgagttcgtggggatcggacaggttcatcgtcgcaacggataccggagccaggaagagggaaagatagcggaatcgggcatgcagcttaacaggccacggcagggagcgaagccggaagctcggaaaaggcgaccgtccgcaggaggacgaacggccagcggcgcgctcactcgaaatcgtctcccagggcttcctccagggtttcgccttcctccgcttcgcgggctatccgcaggcgcacatggatggcgccgaaagcctcgttctgcaccagttccaccatctgctccttga

SEQ ID NO: 5006 - DNA, 648 bp, Pseudomonas aeruginosa
ctgtttcagaacatccagaggttgctattatgccgtttcaaccgtgtcctgactgccaccatgaagcaattcatcgatttcatcccactgatcctgttcttcatcgtctacaagatagaccctcagaacgtcgagttcgccgggttcaatctgagtggcatctacggcgcgaccgcgaccctgatcctcgcctcggtgatcgtctacggcgccctctggctcaagcaccgccacctggaaaagagccagtggttcaccctcggcgcctgcctggtcctcggcggcctgaccctggccttccacgaggacaccttcctcaagtggaaggcgccgctggtcaactggctgttcgccctggccttcgccggcagtcacttcatcggcgacaagccgatgatccagcgcatcatgggccatgccatccagttgccgcagggcctctgggtgcgcctgaacatcgcctgggtggtgttcttcctggtgtgcggcttcgccaacctgtacgtggtcttcacctatccgaacttctgggtggacttcaaggtgttcggcagcctcggcatgaccttgctgttcctgatcggccagggcctgttcctggctcgccacctgcacgacgccgataccggcgaaaagcccaaggactga

SEQ ID NO: 5007 - DNA, 453 bp, Pseudomonas aeruginosa
catccccgcttcccaggaacgccgcctggccagccgcccggcccacctggcccgtctcgaacagctgaaggaagaaggccgcctggtactcgccggcccgcacccggcgatcgacagcaacgacccgggcgccgccggcttcaccggcagcctgatcgtcgccgaattcgattcgctggccgcggcgcagagctgggccgaggccgatccctaccgggccgccggggtgtacgccgaggtggtggtcaagccgttcaagaaagtcctgccctgaggcagtcgccgggtaccggcggccggcccggtcgccctcccggcaaacgttttcgcaccggacgccgctttccggtgcccgccgcagcgcaaccaggccggcccggcgctttcgccaagccggaagggcgaaccggaagacagtgcaatccgtcgcttcatcggtacaaggagtcatga

SEQ ID NO: 5008 - DNA, 327 bp, Pseudomonas aeruginosa
gcctgggagcttccctggccctggccgaggaacccgcgccggcacggattccagccggcgcagccttccattacgcaggctaccgccgaactggagcgccgcctggtggaaacggaacgccagcgcgacgaactggtcagtcgtatgcgccaggagaaccgccagttgcgcgagcagctgcaggcggcccaggcgcagcggcaaccgccgctgctcacggaagagcagacctggtatgtcgccggcgccgccacggccctgctcgcgttcgtcctcggtgccctgagccgcggccgccggcgacagcgacgcgaatggatcaattga

SEQ ID NO: 5009 - DNA, 1431 bp, Pseudomonas aeruginosa
cggcctggaactgctcaagcaactgcgcggcgaccatcccgacctgccggtgctgatgctgtccgcccgcggcgagccgctggaccgcatcctcggtctggaactgggcgccgacgactacctggccaagccctgcgacccgcgcgaactcaccgcacggctgcgcgccgtgctgcggcgaacccacccggcgcagcccagcgcgcagatgcaactgggcgacctgtcgctgaacctgacgcgcggcgtggcgcagatcgacggccaggagatcagcctgaccctttccgaaagccgcatcctcgaagcgctcctgcgccagcccggcgagccgctggacaagcaggccctggcgcaactggcgctgggccgcaagctgaccctctacgaccgcagcctggacatgcacgtcagcaacctgcgcaagaagctcggcagccaccccgacggcagcccgcgcatcctcgccctgcgcggccgcggctactactacagccactgagcgggtttcgtcagcccgccgacacaaggtctttacccaagctttactcagggctgaccgcgcttgaccttgacctccctagactgggctcatccggtaaatggccggacccagaaaggagaaacaccatgcgcaagacgctaaccgccctgttcatcgccgccgccctgccgaccttcgccatggccgcgcccgccgccaacgacctgccacccccgccgatggaaggcggccacatgatgggccagcacggtccccggcatgcgcggcccgatgaaggaactggacctgacccgcgaacagcgccagcagatgggcaaactgatgggcgaacaaatgaaggcccgccacgagatcacccagcgctacctggccaagctgccggcggccgagcagaaggccctgaaggacgaactcaaggccagccacgagaagacccagaaggacatccgtgccctgctcacccccgagcagcagaagaagttcgacgaactgcagaagaagcgcgagcagcgcaaggcagagtgggccgaattccagcaatggaaggccgacaagaagtccaactgacgtccgagccaccgctaccgggtcctccggtagcggtcttccgaccagccggaatcgcatatcctaggggtttaccctcgcggccggcccgacatgcgattcaacaggaaaaccatgcgttcactcttctggcgaatcctcgccgccttctggctggccctgctgctggtcgccgggctgtccatcctgctgggtcgtgcgctgaaccaggacacctggatcatcgcccgccatcctggcctgaaggatctcgccgagcagtggaccgccctctacgaagaacagggcagctacgcggcccagggcttgctggagcaacgccgtcgcgactacgggatttccatccaggtgctcgatga

SEQ ID NO: 5010 - DNA, 429 bp, Pseudomonas aeruginosa
cctgagcatcgacggctggccggacatgttcgaacgcgcggtggacaacctgctgcgcaacgccgtgcgcttcaaccccgtcggccaccccctggaggtgcgtgccagcagcgccggcgactacctgcgcctgagcgtccgcgaccatgggccaggcatcgccgccgaactgcaggagcagttgggcgagccgttcttccgcgcacccaaccagagcagcccgggacacggcctgggcctggccatcgcccgccgcgccatcgagcgccacggcgggcacctgcgcctgggcaaccatcccgacggcggcttcatcgccaccctcagcctgccgctacggcgcaaggcgaccgaatgacgccgcgcccagatgaacaattccccaggagcatccggcatggctcttcccgcttcgttgttcctcgatga

SEQ ID NO: 5011 - DNA, 510 bp, Pseudomonas aeruginosa
acgcccgctcgcccaggccatcgcgccgccgccggaacctcccggcgacgaaccgcaatcgctggtcctggcggtcgagctgggacaggtcgcccagcaactgcggcatcgctgggcgcgcctcgacctgaacctgccggaacgcggcacctggccgctggaaagctggcgcccggccttgcacgaggcgctctacggcctgctcggcggcgccgcgcaggcccgcccgtggcagcgcatcacactgaatccggcgctggacgcacgccacggccggctgcgcctggacatcctcggccaggcggaagaaggccggcgctggctgccggcggccgtggaagccgcccgacgactggccggctggcagggcggacgactgctctggcacgcccagggcgcgtattggtgcgtacgcctgctgttgccgctcagcccggccaggcgctgacgaaggccgacgggtcgagttccgccggcgtgcgcaactcgcccatcggcgtccccaggtag

SEQ ID NO: 5012 - DNA, 519 bp, Pseudomonas aeruginosa
acgcaatcgccaggctcacgcccgctctcaggcgacccgtcccggcgccaggtgcggctgcagcggcggggtcagcggcggcaggccgtaggcggcgcgcgcggcatcgcaggccgggttgggctggccgttggcccaggccgcctcgaactcgcggcaggtactcgagcgctgctcgtagacggtgcagcgaacgccgcaaccgacctcgccgagcagcccgacgcagcgtgccggcttgttctcggtaccgctcatggcaaccatctgcgggctgatgcggacggtcagttcgtcgggtacgacgccgcctgcggaacggcactcgccccaatagaaagacacacgaaaatgcgcacagcaggcgccgcaggtaagacacggattgtcagtggacatggttggcagaacaccagagaaaccggcgagcgccggcgggcgaagcgagattctagcgatttcgcggcagctgtgaagaggggtgcagcggcagatttactctccgcggacggctggtag

SEQ ID NO: 5013 - DNA, 1599 bp, Pseudomonas aeruginosa
aatggccggtccgccacagcccagagccccacgatccatggccttgccgaccctacgtatcctcggtttcatcatcggcatcttcctgatcactctggccgccagcatgctggtcccgatcctgaccatgctcgccttcgaccgtaccgaaggcatccaggcattcatctggtccagcgtcgccaccttcgtcaccggcctcggcctggtcctgccgggacgtcccgagcatgtccacctgcgcccgcgggacatgtacatgctcaccgtatcgagctgggtgctggtatgcatcttcgccgccctgccgttcgtcctgcagcagcacatcagctacaccgatgccttcttcgaaagcatgtcgggaatcaccgccaccggctccaccgtgctcagcgggctggacgacatgtccccgggcatcctcatctggcgctctctgctgcactggctgggcggcatcggcttcatcgccatggccgtggcgatcctgccgatgctgcggatcggcggcatgcgcctgttccagaccgaatcctcggaccgctcggaaaaggtcctgccacgctcgcacatggtcgccaagtacatcgtcgccacctatgtcggcatcaccctgctcggcagcctggccttctggggcgcgggcatgagcccgttcgacgcggtcaaccacgccatgtcggcgatttccaccggcggtttctccacctccgaccaatccctggccaagtggaagcagccagcggtgcactggaccgcggtagtggtgatgatcctcggcagcctgccgttcgcgctctacgtcgccaccctgcgcggacaccgcaaggcgctgatcaaggaccagcaggtccgcggcctgctcggcctgctgctggtgacctggctgctgatgggcacctggtacgcggtaacctccaagctgccctggatggatgctttccgcatcgtcgcagtgaacgtcacctcggtggtcaccaccaccggcttcgccctcggcgactacagcatgtgggggcacttctcgatcatgctgttcttctacctcggcttcatcggcggttgctccggttctaccgccggcggtatcaagatcttccgcttccaggtcgcctataccctgctcaaggccaacctctaccagttgatccatccgcgcgcagtgctcaagcagaactacaacggccatcgcctggacgaggaaatcgtccgctcgatcctgaccttctcgttcttcttcgcgatcgtcgtctgcctgctcgccctcggcctgtcgctgatcggcctggactggatgaccgcgctcaccggcgccgccagtaccgtggccggcgtaggcccggggatggggcccatcatcggcccctcgggcaacttcgccagcctgccggacgccgccaagtggctgctggccgccggcatgctgctcggtcgcctggagatcatcaccgtgctggtcctgctgaccccggcgttctggcgccactgagcgctcacgggcctgtctgcaatggctctactcagggactgaaaagccggtgtaagcttctgcaccatgacgacacagccgcaacccggccacgtgagcctggatag

SEQ ID NO: 5014 - DNA, 1860 bp, Pseudomonas aeruginosa
ttggacgctcgcccactacacggctctggagcgcgaggtgacgcgcctgcgcagcgaagtggcgggcaacgccagcttcgacctgagccaactgggcgccctggataccgccggcgccgccctgctcgccgaattgctcggcgccgagcgcctggccgacctcgccgagctggagcccggcctgccgcgcgagcgccaggccctgctgaagaccgtcggccacgccctgcacgacttctgcgagccggagaaacccaagccgccaaccaccgccatcgaactgctggctcgcatcggttgtgccatggagaccttctggctgcacctcaaggcactcctcggcttcatcggcctgaccctggagaccctgttccgcagcctggtccgcccggccagttggcgggtcacgccgctggtggcgaacatcgagaagagcggcctggacgcggtgccgatcatcgccctgctgaccttcctggtcggcgcggtgatcgccttcctcggcgccacggtgctggccaacttcggcgcgaccatctacacggtcaacctggtggtgttctccttcctccgcgagttcgccgtgctgctcaccgcgatcctcatggccggccgcaccgccagcgccttcaccgcgcagatcggctcgatgaaggccaacgaggaaatcgacgcgatccgcgccctcggcctcaaccccatcgagctgctggtgctgccgcgggtgctggcgctgctggtatcgctaccgatgctgaccttcgtcggcatgctctgcggcatcgtcggcggcatgaccgtctgcgcctggaccctggacatcccgccggcgatgttcctgtcgatcatggaggacggaatcggcgtacagcatttcctggtcggtatcagcaaggccccgctgttcgccttcctgatcgccgtgatcggctgcctggaaggcttcaaggtcagcggcagcgcccagtcggtgggcgagcacaccaccaccagcgtggtccactcgatcttcgtggtgatcctgctcgacgccctcgccgcgctgttcttcatggagatgggctggtgaaccaggacaacccgcaggcgatcatccaggtccgcgacctgtgcaaccgtttcggcgcccaggtggtccacgagcacctcgacctcgacgtccgtcgcggcgagatcctcggcgtggtcggcggctccggcaccggcaagtcggtgctgctgcgcagcatcgtcggcctgcgccggccgacctccggcagcgtgcgggtgttcggcgaagacctgctgcaactgccagaggagcgccgctccctggtcgaacggcgcttcggcgtgctgttccagcagggcgcgctgttttcctcgcttaccgtggtggagaacgtcgccctgccgctgatcgagaacgccggcctgccgcgcgccgacgccgagcacctggcccaggtcaagctggccctggccgggctaccggccaacgccggcgacaagtatccggcctcgctttccggcggcatgatcaagcgcgccgccctggcccgcgccctggcgctggacccggacatcctgttcctcgacgagcccaccgccggcctcgacccgatcggcgcggcggccttcgacaacctgatccgtaccctgcgcgacgccctcggcctgaccgtgttcctggtcacccatgacctggacaccctgtacaccatctgcgaccgggtcgccgtgctgtcgcagaagaaggtcctggtagtcgataccctggaacgggtcgccgccaccgacgacgcctgggtccgcgaatacttccacgggccgcgcgggcgcgccgcccaccaagccgccgccgtgccggagaatcactga

SEQ ID NO: 5015 - DNA, 1581 bp, Pseudomonas aeruginosa
gatggaaacccgagcccaccatgtgttgatcggcctgttcagcgtgatcgtgatcggcgccgccctgctcttcggcctgtggctggccaagtccggctcggagggcaagttcaactactacgacatcgtcttcaacgaagcggtcagtggcctttcccagggcagctcggtgcagtacagcgggatcaaggtcggcgacgtggccttcctccgcctcgatccgaaggacccgcgcaaggtctgggcacgcatccgcgtggtggccagcgcgccgatcaagcaggacaccaccgccaagctggcgctcaccgggatcaccggcacctcgatcatccagctcagcagcggcacgcccgccagcccgatgctggagggcaaggacgggaagatcccggtgatcgtcgccacgccctcgccgctgacccagttactgagcaacggcgaagacctgatgggcaacatcaaccagctcatcgcgcgcttcagcaacatgctctccgaggaaaacacagcgcgcatcagccgcaccctcgaccatctcgaccaggccaccggcgcgctctccgccgagcgcgagaacgtcagcgcggtgatgcagcagttggcccaggcgagcaggcaggccaacgccgccctggcccaggccagcgagttgatgcgcagcgccaacggcctgctcaacgagcaaggcaaggggatgctggaaaacgccaacaagaccatggcttcgctggagcgcaccagcgccaccctcgaccagttgatcagcgagaatcgccactcgctggacggcggcatccagggactcgccgagctgggcccggcggtcagcgaactgcgcgataccctggcggcactgcgcggaatcagccggcgcctggaagagaacccggcgaactacctgctgggccgggaaaaaaccaaggagttcaccccatgaggctcgcccttcgcccgctgcgtcgcctgtccctggccgccggcctggccgcgctcgccaccctcggcgcctgctcgatcctgccggaggcgcaggtcctccaggtctacctgctaccggtgcacaaccctccggccagcgccgccgcgcggccggtcgactggtcgctgcggatcgcccggccgcgtaccagcctggtgctggagagcccgcgcatcgcggtgcgcccgcacggcgacgaaatcagcgtgtaccagggcgcgcgctggagcgatccggcgccgtcgctgctgcgcgatcgtctgatgcaggcgttccaggccgacggccgggtccgcggcctgagcagcgacgacagcaacctgcaggccgatttcgaactgggcggcgaccttcgcgccttccagaccgagtacccgaacggccaggccagcgcgctgatccgctacgacgcgcgcctggtgcgtaccgacgacaagcgcgtggtcgccagccggcgtttcgaggtcagccagccggtggatggcaagaaggtcgcggcggtggtcagcgccttcggcaaggccggcgatacgctgtcggcccaggttctcgactggaccctacgccaggcctcggcgcaacccgccgtgcagccctga

SEQ ID NO: 5016 - DNA, 1251 bp, Pseudomonas aeruginosa
tcatgtgccgcgacaagggccagatcgcggtcaagggcttcagccgcccggtgcagatctaccaggtggtggactcgcgccgcgacctcggcgccgcgcccagctacgtcgagcacgaattgcccggcttctccatgtacctggacaccaacaacatccagaactacgacaaggaacgggtcatccaggccctgcaacaggccgccgaacgcctgcgcgacaaggtcatcctctaagttcgtcgaacgccgccggcagttcgtcgcgccattccggcgcagtccgtgggccgctcgcctgcagcgccaggaactcctccgccgaaacccgccaggactgctcccgcgcccagcgcccgcaggcctggcgatccagcgccagcgcctggcggcaggcttcgccaagatcctcgtgcatgaccccggtcacgccctgctgcaatacatccagcggccccggcacggcgaaggccgccaccggcacgccacaggccagggcttcgagcatcaccaggccataggtatcggtcagcgaggggaacaccagcaccgaggccgcccggtaggcgtcggccagcgcgcggccatggcggtagccgagaaaacgcgcctgtggatagcgctgctccagcgccgcccgctgcgggccgtcgcccaccagccatttttcgcccggcagttcgagatcgaggaacgcctccaggttcttttccgtcgccagccgcccgacatacaggaacaccggcggccgctctttcgccggaggtgtctcggcgggatggaacagttcggtatcgacgcccttgcgccacagccgcaggtgctggaagcgccaggcgcagaactcgtcgcgcaggcgcggggtgctcaccagcaccgcccggctcggccgatggaaggtgcgcaggaaggcatagccccaggacaacggcagccacggacagcggtcacgcaggtattcgggaaagcgcgtatggatcgccgaggtgaagtccaggccgcgcttgcccagccagcgccgcgtggcccagccgagcggcccctcggtggccaggtgcacggcatccggggcgaaggcctcgatcagcccgccgaggcgccagaggttccaggccagggggatttccggatagctgggacagggcaggcagcggaagtcggcgggcgacagcacccgtacctggtggcccagcagttccagctcgcgctgcagggccagcaggctggtgacgactccgttgacttgcggtaa

SEQ ID NO: 5017 - DNA, 924 bp, Pseudomonas aeruginosa
ccatgcccaattggtcctgggcctcagcggctgcctcgacttcgaggtcgaggggcgcggcagccgcgtgttgcggcagaccttcgcggtggttccggcgcaagcccggcatgcctgctcgagtccctccggcagccgctgcctggtcctcgacctgccctgcgacggcagcctgctgctgggcctgggcgaacacgccgaagccggcaggcggctgttcgagcgaccgcaggcgctgtcgctgacgcccgcccagggccaactggtgaactggctggccagcggcccgatcaacgacccggtgatcgcccaccagggcgccggcctgctcctcgccagcctggccagcgagcgccagccgccgcgccagcagccccgcctgccactggccagcctcgacgcctacctcgaccgccatgccgcccatccgctacaggtagccgacctggcgcggctggccggtctttcggtggcgcgcttccacagcctgttcctcgccgagaccggacagacgcccatggactacgcgcgcagccgacgcctgcaccaggcccacgaactgttgctggagagcagcctggcggtgggcgagatcgccgcccgggtcggctacgcctcgcagagcgccttcaccgcagcgctggtccgcgagttcggcgtcaccccgcgacaactgcgtcgcgagtcccgcgacaaaaccggctagccgcacgacagacaaatccgtcacgactccttactctctgcccatcgacagaacaggagtcagcatggacatcatcgaatggcaggatttcgaacgcgtcgaactgcgcgtcggcaccatcctcagcgccgctcccaaccccaaggcacgcaaacccgcctatgtcctcgaggtcgacctcggaccgctcggcctgcgcacctccagcgcgcaactga

SEQ ID NO: 5018 - DNA, 1029 bp, Pseudomonas aeruginosa
gcgaagtcgcccctccggcgcactcgtcatcgcctgccggccgcggaaacgccggcgaggcatccctgcattcgaggaggcggaaatgaaagcgccacgcgtaaccctggaccaatggcggaccctgcaggcggtggtcgaccacggcggcttcgcccaggccgcggaagccctgcaccgctcgcaatcgtcgatcagctataccgtggcgcgcatgcaggaacagctcggcgtgccgctgctgcgcatcgacggacgcaaggcggtgctgaccgaggccggcgaagtattgctgcgccgttcgcggcaactggtcaagcaggccgggcaactggaggagctggcgcaccacatggaacagggctgggaacccgaggtgcgcctggtggtggacgccgcctaccccaccgcgcggatcgtccgctcgctgtccgccttcatgccgcagagccgcggctgtcgcgtgctgctgcgcgaggaagtgctctccggcgtcgaggaagcgctgatccagggcgccgccgacctggcgatcagcggcctgatcattcccggccacctcggcgccgacctcagcgtggtcgagttcgtcgccgtggcccaccccgaccatccgctgcaccgcctgcaacgcgaactgacccaccaggacctggaaacccagatgcaggtggtgatccgcgacagcggccggctacagccgcgcgaccacggctggctgggcgccgaacagcgctggacggtgggcagcctggctaccgcggcgaccttcgtcggcaacggcctgggcttcgcctggctgccgcgacacatcatcgagcgcgaactgcagagtggccagctcaagccgctgccgctgagccagggcggcgtgcggcagagccgcttctacctctacaccaacaaggaaaagccgctcggcccggccagccagatcctcatggaaatgctcaagtcgttcgccaacgtaccgctcaacgcgcccttcgcggcgcccgaaccggccgccgagtgaacgcagatgcctga

SEQ ID NO: 5019 - DNA, 825 bp, Pseudomonas aeruginosa
  unsure (334): Identity of nucleotide at the above locations are unknown.
cttccagcaccgcgactgcaccctcgtgtacgacgaccaccccggtcccaccgtgcgcgcgccggtcctgttgctgcacggtctcggttcgagcgcccgcgactgagaataccagttgcccggccttgttggcccaataccgccttgctgggtccccggacatgcgcgggccacggccgttccggcaagccgcgcggcggatacagcatggccggtttcgccgaggactgcgcggcgctgctcgaccggctcggctgcggtccggtacacctggtcggcatcagcatgggcgggatgatcggcttccagttggcctgcgaccgacccgacctgntgcgcagcctgaccatcgtcaacagcactccggaagtcatcccgcgcaagcctcgcgaacatctggaggtggccaagcgcaagctcctctcgcgcctgctcagcctgcggaccatcggccgcgccctcggccggctgttgtttcccaaggcggaacaggccgggctgcgagagaagatcgaggcgcgctgggcggagaacgacaagcgcgcctacctggccagcctcgacgcgatcatcggctggggcgtgcaggaacgattggccgagatcgcctgtccgaccctggtgatcagcgcggatcgcgactacacgccggtatcgctgaagcaggcctattgcgagcggatcgccgacgcccgcctggtggtggtggaggactcccgccacgccacgccgatggaccaacccgagattttcaacaccaccctgctcggcttcctcgccgatatcgataaaaccaaggaacaaccatgctcaaacgtctcctga

SEQ ID NO: 5020 - DNA, 1962 bp, Pseudomonas aeruginosa
tcctgtccgccaaacgcctctgagtccagccgcaggggcttgatccggcgggcccaggacgggcccgctccagaagagagccatcatgctttatcgtcgtttcgaacgtctgatcgacccgttccgcagtgcttccgaacgcatgccgcccagcgaagtgctgcgtttctatgtctacttcctgcgccaggtctggccggtgttcctggccctgctggtggtcggcctgatcgtcgcgctgatcgaggtggcgctgttcagctacctcggccgcatcgtcgatctcgcccagagcacgcccagcgcggagttcttccgcgtgcacgccaacgaactgatctggatggcggtggtggcgctggtcctgcgcccgctgttcaacgccctgcacgacatgctggtgcaccagagcatcaacccgagcatgaccaacctgatccgctggcagaaccaccgctacgtgctcaagcagagcctcggcttcttccagaacgatttcgccgggcgcatcgcccagcgcatcatgcagaccggcaactcgttgcgcgattcggcggtgcaggtggtggacgccctctggcacgtgctgatctataccgtcagcgccctggtgctgttcgccgaggccgactggcgcctgatgatccctctggtgctgtgggtgttcgcctacgtcggcgccctcgcctacttcgttccccaggtcaagcgccgctcggtggaggcctcggattcgcgctcgaagctgatggggcggatcgtcgacggctacaccaacatcatcacgctgaagctgttcgcccacacccgccaggaagaggactacgcccgcgaagcgatcggcgaccagaccctcaagtcgcaacgcgccgggcgcgtagtgacctccatggacgtgaccatcacggtgatgaacggcgtgctgatcaccggcaccaccggcctggccctgtggctgtggagccaggagctgatctcggtgggcgccatcgccctggccaccgggctggtgatccgcatcaacaacatgtccggctggatcatgtgggtggtcggcggcatcttcgagaacatcggccaggtccaggatggcatgcagaccatcgccctgccgcgcaaggtggtcgaccgcgaggacgcccagccgctgcgggtagagcgcggcgaggtggagttcgagcacatcgccttccactacggcaagggcagcggcgtgatccagggtctcgacctgaaggtccggcccggcgagaagatcggcctggtcggaccttccggcgccggcaagtcgaccctggtcaacctgctgctgcgcctgtacgacctggagagcggacgcatcctggtcgatggccaggacatcgccggggtgacccaggaaagcctgcgcgcgcagatcggcatggtcacccaggacacctcgctgttgcaccgttcgatccgcgacaacctgctctacggccgccccggcgccagcgacgcggaactcatggaagcggtgcgcaaggctcgcgccgacgagttcatcccgctgctcagcgacgccgagggccgccgcggcttcgacgcccatgtcggcgaacgcggagtgaagctctccggcggccagcgccagcgcatcgccatcgcccgggtgctgctcaaggacgcgccgatcctgatcctcgacgaagcgacctcggcgctggactcggaagtcgaatcggcgatccaggaaagcctggagaccctgatgcagggcaagacggtgatcgccatcgcccaccgcctgtcgaccattgcgcgcatggaccgcctggtggtgctggacaagggccacatcgccgaaagcggcacgcatgccgagttgctcgcccatggcggcctctatgcgcgcctctggcaacaccagaccggcggcttcgtcggcgtcgactgaagcctcggcaccgggcggcggctcgcgccgcccggcctgggtga

SEQ ID NO: 5021 - DNA, 504 bp, Pseudomonas aeruginosa
ccttgtcaaaggctctgcaacgggccttttcgcggcaatcatcaccgccgtcgatctcgactagcacgcgcttcgattttttccgccagcgaaacggtgttcttatcgaacccgtgccccggctcgatcccgacgcctgccgcatcgtccccgtccacctggcgtcggccacggacgaccaaggatgccagtgctcggtaccggggatttcgccccatcgctacggagaatcacagaatgaaacttgcctctgtcgtgtccgccgtcatcaccagcctcgcccccatggccttcgcccaggacgtggacaaggacccgggccgcggcctgccggtcgaggaataccactacggcatgcaactggacgtgaagaatgtcctgcaccgtaccgacaattcgaccaggaccggcgtcgtgccggtgaccgtggtctacgaggaccatagcggcgagctgcacaagatccgcttcctcgaatggggcggcagcaccagcaacggctga

SEQ ID NO: 5022 - DNA, 1260 bp, Pseudomonas aeruginosa
cgcaggaatggctgggcgggaggcagcaaggcgtcccactcggcggcgtcgatatcggcaagggtggcaagcgtctggatcggcatgcgcgccagtctggcgcgagacgcaaggcaagtgaagccggtcgatggaaaaaaagcgcccggcggacccgcgatgaaaccgcccttcaccaagcgaaggcttcgatccatcctacgtagagcgcataacgccaacggcgttatccgccgataccccgccgcaacggcggagcgaaagctgggaaccctccgcgtagggcgaataacgccggaggcgttatccgccgatacccgccgcgacggcattcccgatcgggccctagatcatgcccagcagcaacaggaccaacagcaccaccagcaatgcgccgatgatccccgagggcccgtagccccagttgcgcgaatgaggaaagaccggcagaccgccgatcagcagcaggatcaggatgatcagaagaatcgtaccgagactcatgggcgtcgctcctgttcggctcatggggcaaagggcgggagattccgcccttgtagttctcgacccccgccgagcaacgaagattcaataaatccgcgacctccagcctcagtggatgaccttgggcgccggccccttgagcagacgcatgaacatcagcgccaccgcctgggcgtcgccgagggcggtgtggcgaccgctgaccggcacatccagggcccgcgccagggtgtcgaagcgcaggtcgatgtgtgcgtcgggaaaatgccggctgaccttccggtggtacagcgacgaaatctcgatggaggggttgtgcaactgtcggtcgaggagctggcgcaggtgccggttcagcacggcgacatcgaacgacagatagtagcccagcagcggtcggtcgccgatgaacgccagcacctggcgcagggcctgctccagctgcaactgtccctccaggtcggcgcggcgcagcttgtggatgcggatcgactccgcatccaggctcggcggcggctcgacgtagagttccaggcgctcgcccatgaccagtttgccgcgccgcaccagcaccgcgccgatgctgaggatgtcggcacgacgcgggtcgaggctggtggtctcgagatcgagggagatcacttcttccgcctcgaccgcctcgtgcatccaccagtacagccggcggcgccagcccggccagcggctgtcgggcaacttgaccatggtgttcatcgggtctccaggtggaattga

SEQ ID NO: 5023 - DNA, 531 bp, Pseudomonas aeruginosa
cgatggccgagacgttcagcggctggcgctgcacgtcgccggtcagcgcgtcggcccagagggccggagcgaaggccgcaaggccgagcgcggcaaggagacgagcgatcattgctgcgcctccttgaggatttcctggttcaggctgtcgaactcgccgttggcgcgacgcacgtacaggccggtcaggatgaacgcggcaaggatcagtccgacacccatcgggatgccccaggtcacggacgaatcgggactgatacgcgcgcccagcagctgcggctggaaagcgatcagcaggatgaatatcacgtagaggccaagcatgatcgaagaaagtatccaggcgaaacgctctcgcttggccaccaactccttgaagcgcggattggtatcaatccgctggtagatgctgtcgttcattgtttttatcctcacagcggggtgacgcggaatgtcgtcgatatccactgtaggacgctggtgcaagcgctccagacgactttagtcgtagcgtttcgccagccgctctag

SEQ ID NO: 5024 - DNA, 384 bp, Pseudomonas aeruginosa
cgacatgcctcgaactgcgctgcggcacgctgcggatgtgctccgagacagtgcgatcgaagcgctctatgcactcgattggacaggccgatttccgcttggccgagcgcctggataggctttcgccaaagaggaatgattctcgatcaaaggagagcagccatgctcaagaccctgaccttcaccgtcatgcacttcatcatcgccttcagcgtggcctatgcgctgaccggcagcatagcggtcggcgggctggtggcggcggtcgagccgctgtgcaactcggtcggtttctacttccacgagaagatctggaaacgcttcgagaaagacggcgcgccgcgcccggctagcgcccatggctggctgcaccgccacgcctga

SEQ ID NO: 5025 - DNA, 1506 bp, Pseudomonas aeruginosa
ctcgcgcaccttctacgaggtggtgctgagcaagctgacccgctacttccggcagaaaggctacgtcgacatcaacgacgccatgctctacgacttccagcagtcaaagcaacgcctgagcaacgaagaaatggccatgctgatcggcacctcgttccgcttctccgccgccgacatcgccttcacctcggacctggtcaaccgtcgcggcctgatcaccccgccgaactacccgatcaacgaaggcaccagcctggagcccttcttcaagcgcgcgctacagtgcgacttcgagtgctacatgaccgagcaactgatcccgatgtggcgagcccgttacgacggcggcagcctgacccaactggtcaaccaggtcagcctctacaagctgcaggactatctgcacgacagcccgaagatcgccgtgatgcacaacgccgacgacgtcatcctcggcccgggcgacctcggcttcctccgccgaaccttcggcgaacgcctgaccgtctatccctatggcggtcactgcggcaacctcaactacaaggtcaacgcgcaggacatgctggacttcttcgccacgcccgctgccggacagacccaggtcgccagcgcggccctcacccagcaggcaggaaactgatcgatgagccgaaccgcacactggatgttcgcccttctgctgagcgctgccgccagcgcccaggccgaccaggccgccgcgccggccgaactgccgccacgccagctcgacggcgacggtttcagccgtccactggaccaactcaagttcaatcccggcctggatcaacgcgaattcgagcgcgccaccctcgacgcactgaacatgtacgatccctgggaatcctggaaccgccgggtctaccacttcaactatcgcttcgacgagtgggtgttcctgcccgtggtacgaggctacgaatacgtcaccccacacttcgtccgcagcggcgtgagcaatttcttcgacaacctcggcgacgtgcccaatctgctgaacaacctcgcccaattgaagggcaaggcggcgatggaaaccaccgcgcggctgctgttcaacaccaccttcggtgtgctcggcctgtgggaccctgcgaccaggatgggcctgcacaagcgcagcgaggatttcggccagaccctcggcttctacggcgtgggcagcggcccctacctggtgctgccgatcctcggcccgtccaacctgcgcgacaccggcggactggtggtggactacgtcggcgaataccaggtgaactacctcaacgttccccaggccagcggcgaccacccggagatcaccgccctgcgcgtggtggacaggcgctacaacaccagcttccgctacggccagatgaattcgccgttcgagtacgagaaactgcgctacatctataccgaggcgcgcaagctgcagatcgccgagtgagacgaagaaccgccgccctggtgcggcggtttctttttctcaaaacaatccaataa

SEQ ID NO: 5026 - DNA, 999 bp, Pseudomonas aeruginosa
ctcgataggaatcacacaaaactcgcatccatatatcgagcacagaggactatcatcgagccatacacgaaccaggaggttcccatgacccgctaccgtgatgtcctcgaactgcataccggccaccccgcctccgatggcgccggcgtccgcctgacccgcgtgatcggcggcccttccccggaacgcttcgacccgttcctgatgctcgaccagttcgatacccagaacccggatgactatgtcgccggtttcccttcgcacccgcaccgcggcttcgagaccgtgacctacatgctcgaagggcgtatgcgccacgaagaccacctcggcaatcgcggcctgcctcaagcccggcggcgtacagtggatgaccgccgcccacggcatcatccacagcgagatgccggaacaggtggaaggcgcgatgcgtggcttccagctgtgggtcaacctgccggcgaagagcaagctggccccggccggctatcgcgatatcgagccggaagacgtgccgcgcctggaaaccgccggaggcgtgaaggtcacggtgatcgccggtcgcttcgacgacggccaggcgcagcagatcggcgccgtggaaaggccggacaccgagccgcactactacgacctgcaactgcctgccggcggccgcatcgccccgcgcctgccggacggccatcgcgtgctgctgtacgtctacgaaggcagcctgacggtggaaggcgaacgcccggtggaaatcgccaccaatcgcctggctcggctgtccgaagaaggggaactgagcctgcgcagcgaagccggcgcccgggtactggtgctcgccggcaagccgttgcgcgagccgatcgtccagtacggtccgttcgtgatgaacagccgcgaggaaatcgagcaggcgctacgcgactatcgcgacggtgtcctggccgtctgagccgtgcgcgagccgcccttcggggcggttttttccttccgcctgtcccgtcctga

SEQ ID NO: 5027 - DNA, 357 bp, Pseudomonas aeruginosa
ataaggtttaccgctcgatccgcaggaagcgctccagttccgcccgcttgcccatcgcatcgtggtagcccagttcgatcagttcgctgcaatagccgcgctcgaacaacaggtagctcaatacccccgccccgctggcgcgggtcgctccgggaccgcgcaggaaaagccgcagcacccgcgacagctcccggtagtgccgcgcggcgatctcgtccagcggccggctcggcgacaccagcaatacctccaccggctccagcccacccgcctggcggcgcacctccggcgccaccaactggccgatctggttcatccgctgcaactgctcgatgtcgccttccaggctgtcgatga

SEQ ID NO: 5028 - DNA, 450 bp, Pseudomonas aeruginosa
tccgcaccggcgggaacagcagcgggatcgccgcgctggccagcaggtgccgaagctccaggcgggtgggaatgcccaggcgccgatggcgtacccagggatcgatggtcgcgcgcccctggtagaaggtcaccgcctgccccgactcgtagccgaacgcggtcaccgccaccgcgcgcaactggcgctggcgcaccgccgcatgaatcccggaaaaatccagctcacgtgccagcagctcatgcaacggccggttgtccagcaacgccaccggcacccgccgccccaggccgagcaggctatggccgaggaagcgcgaggcctggcgggtcacgcccggccagtcgctgcgatagacatgttcggtgcggaatccctgccagaccgcggtcaggcgctggatcgcctggcggaattgcagggcgccgcaagccaggccaacggcgttga

SEQ ID NO: 5029 - DNA, 822 bp, Pseudomonas aeruginosa
gtccctgcaattcaacgaccgacaagccccatgagccaagccgacctcctcgatcaagaccccgtattccagctcaagggcagcatgctcgcggtgaccatcctcgaactggcgcacaacgacctggcgaggctcgaacggcaactcgccgacaaagtggcgcaagcgcccaacttcttccgcgacacccccctggtcatggccctcgacaagctgcccgaaggcgaaggtcgcctcgacctgccggcgctcctcgaggtctgtcgccgccacggcctgcgcaccctggcgatccgcgccgggcgcgaggaggacattgccgccgcccaggccctggacctgccggtgctgccgccctcgggcgcccgcgaacgaccgctggacatcaaggacagcgccccgcgcaagcctgccgaagagcccagcccgagcgccggtgaagccaggcccgagccggccaaggcggaagagaagcccgccgagcccgtcagccgcccgaccaaggtggtgaagaccccggtgcgcggcggcatgcagatctacgccgccggcggcgacctgatcgtgctggccgcggtcagtcccggcgcggaacttctcgccgacggaaacatccatgtgtacggcccgatgcgcggacgcgcactggccggcgtgaaaggcgacgccacggcgcgaatcttctgccagcagctggccgccgaactggtctccatcgccggtaactacaaggtcgcggaggacctgcgacgcagcccgcagtggggcaaggcagtgcacgtcagcctgtcgggtgacgtgttgaacatcacccgcctttaa

SEQ ID NO: 5030 - DNA, 678 bp, Pseudomonas aeruginosa
cctcgaccttatcatgggctgcgaacgccgcgtggtgtacgacttcgtcaacgtcgtcaacggcgaggccaccctcacccaggccctgatcaaggacaagcgcctcgaaaacctgcatgtcctggccgccagccagacccgcgacaaggacgccctgaccaaggaaggcgtcgagaaagtcatggccgaactgcgcaaggatttcgaatacatcatctgcgactccccggcgggcatcgagaaaggcgcccacctggccatgtacttcgccgacgaagcgatcgtcgtgaccaaccccgaggtttcctcggtacgcgactccgaccgcatgctcggcctgctggcaagcaagtcgcagcgcgccgagaaaggcgaggagccgatcaaggaacacctgctgctgacccgctacaacccggagcgcgtcaccaagggcgagatgctcggcgtcgacgacgtcgaggagatcctcgccatccgcctgctcggggtgatcccggaatcccaggccgtgctcaaggcgtcgaaccagggcgtgccggtgatcctcgacgagcagagcgacgccggccaggcgtacagcgatgcggtcgaccgcctgctcggcaaggaaataccgcatcgattcctcgatgtgcagaagaaaggattcctgcaaagactgttcggaggacgtga

SEQ ID NO: 5031 - DNA, 255 bp, Pseudomonas aeruginosa
atgagccttttagacttctttcgcagtcggaaatcgcagaacagcgcttccatcgcgaaagaacgactgcagatcatcgttgcccacgaacgtggccagcgcgcacagccggattatctgccccagttgcagaaagacctgctggaagtgatccgcaagtacgtaccgatcgaccaggagcagatccaggtggaactggagaaccagggcaactgctcgatcctggaactcaacatcaccctgccggatcgttga

SEQ ID NO: 5032 - DNA, 771 bp, Pseudomonas aeruginosa
acatgcgagggctccttttcccggagccccatcctcgcagaaggtgccgcaggtcgtcgacgcgtggcgttactgcggtacctcgacgctgatatggatggcgtcgtggcgccagaactccaggtcgcagtcgatcagccgaccacgctggtcgcggttgatccggctgatgcgcagggccgggctgcccaccgccaccttcagcggcgccgcagcctcggcatgcagtgcggtgggcaccatgtcgaaacgcacccgcccatagtggatgccgtactcgctggcatagagttcggtcagcgagcgggtcaggtcgtggccgaggattccggggaagtactgcgcgttcaggtagtgctcgacatacagcaccagccgcccgtccacccgccgcgcccggcggatctggtagacgctggacagcgccggcagctccagcagctcgcagaccgccgcgctcgccggcatctgccgggccgacagaacctcggtcgccggcacccggccctgttcgctgaccatcgcatggaagtgactgcggaccagcgggttgtaggccagccgctcgggggagacgaaccagccgcggcgctcctcgcgatagatcaggccctgcgactccagttggatcagcgcctcgcgcagggtgatccgggtcgtcgcgaacagctcgctgagcttgcgctcggccggcagcttgccacccgccggcagcagaccatggccgatctgctcgctgagcgcccggcagatcgccgttacggtgggtag

SEQ ID NO: 5033 - DNA, 1149 bp, Pseudomonas aeruginosa
tctagaccacacccgcggcagtcccgcccgaaggagcgtcgagaactcccgaggctgcccgaccgaacctctcgaacgaaggagcaccgaatgaaacgcatgcttgcttcattgctgggaaccgccatcgccctcggcagcggcctggcgttggccgccgaagcggacctgcaggcgctggaacaggccgcgcgcaaggaaggccaggtcaacagcgtcggcatgcccgacagctgggcgaactggaaggacacctggaaggaccttgagagcaagtatgggctcaagcacatggataccgacatgagttcggcccaggagctggccaagttcaaggccgagaaggacaacgccagcgccgacatcggcgacgtcggcgccgccttcggccccatcgccgtgcagcagggcgtcagccagccgtacaagccgagcacctgggaacagatcccggcctgggccaaggaccaggacggccactgggcactcgcctacaccgggaccatcgccttcatcgtcaacaaacaactggtgaaggacgtaccgcacagctgggccgacctgcttcagggcaagtacaaggtcaccatcggcgacgtcagcgctgccgcccaggcggtcaatggggtgctcgccgcggccatcgccaacggcggcgacgagaagaacatcaagccgggcctggagttcttcggcaagatcgccaagcagggccgcctgtcgctgaccaacccggtgatcgccaccctggaaaagggcgaggtcgaagtcggcatcgtctgggacttcaacggcctcagctaccgccagcagatcgacccggagcgcttcgaggtgctgatcccctcggacggctcggtgatctccggctacaccaccatcatcaacaagtacgccaagcacccgaacgccgccaagctcgcccgcgagtacatcttcagcgacgccggacagatcaacctggccaagggcaacgcgcgaccgatccgcgccgagagcctgaccctgccggacgacgtgaaggcccaactgctacccaacgagcagtacgccaaggcccagccgatcaaggacgccaaggcctgggaggaaacctccaagcgcctgccgcggcagtggcaggaagcggtgatcatcaacatgcagtga

SEQ ID NO: 5034 - DNA, 864 bp, Pseudomonas aeruginosa
cgcggagcgcggccgccctccccggcggccgccccgcatcgacggataccccgaatgcgccacgacgtcatcctcgtcctgttggacggcctcaaccatagcgtcgcccgcgactgcatggggcatctccaggccctctgcggcgccggccgcggccagtcgtaccgcctggaatgcgagttgccttcgctgtcccggccgctctacgaatgcatcctcaccggagtgccgccgatcgatagcggcatcctgcacaacgacgtggtccgcctgagccaggaacagagcctgttccactacgcccgcgcggccggcctgagtaccgcggcagcggcctaccactgggtcagcgaactgtacaaccgcgcgccgttcgacccggcccgcgaccgccacaccgacgacagcgcactgccgatccagcgcggacacttctactggagcgaccactatccggactcgcacctgttcgccgacgcggaaagcctgcgccgccggcacgcaccgaacttcatgctggtccactcgatgaacatcgacgacgccgggcacaggcacggcctcgccagccccgcctaccgcaacgccgcgcggcgcgccgacgcactgctgtcggaatacctgcaccagtggctggcggccggctaccaggtggcgatcaccgccgatcacggaatgaacgaggaccgcagccacggcggcatcctcgaggaggagcgcgaggtgccgctgttcgtcttcggcgacgccttcagccgcgacgacctggcgcaaccgctgcagaccgacctctgcggcacgctctgcgaaatcctcggcgccgcccacgacaaacccgtctgccgggagctgctcgccccatga

SEQ ID NO: 5035 - DNA, 837 bp, Pseudomonas aeruginosa
tcaccctggtccaccaatggctgctgcgcaggagctaccatgtcgcgcgctgatcgacgtcctgccgcgctctaccatcgcctggtggtctgcgcgctgttcctgatcctggtcctgccgctggcggcgaccctgctctactcgctggccacccagtggtcggcgaccctgctgccggacggcctgaccctgaagtggtacctgacgctgtggagcgaccagcgcttcctgctggccttcgcccgctcgctgctggtctgcttcggcgccctggcgttcagcgtgttgctgatcctgccgctgatgttcgtcatccactaccacttcccgcgcctggacggcgtgataaacgtgctcatcctgctgcccttcgcggtgccgccgatcgtctcctcggtgggcctgctgcaactctatgccagcgggccgctggaaatgatcggcacgccctgggtgctggtcggctgctacttcaccatcgccctgccgttcatgtaccgggcgatcaccaacaacctgcaggcgatcaacctgcgcgacctgatggacgccgcccacctgctcggcgccagcacctggaaggcggcgctgctggtcgtgctgccgaacctgcgcaagggcgtgatggtggccctgctgctgtcgttctccttcctcatcggcgaattcgtcttcgccaacctgctggtcggtacccgctacgagaccctgcaggtgttcctcaacaacatgcgcaacagcagcggccactacaccagcgcagtggtggtctcctacttcgtgttcgtcctggtcctgacctgggcggccaatcgactgaacaaggacaaggcctga

SEQ ID NO: 5036 - DNA, 1068 bp, Pseudomonas aeruginosa
gaaggactgataccgacctcccgggccacctgttccaggctcaggccgcgcgcctcgcggcgctccagcaggctcgcggaaggcggcgccggcgcggtcgtctccaccgcgacactggcggccgggcgaccagcggcggccagcaacgcctggtattcggcccagggcaacaccgcgtattccgcctcgccgtctcgcgtgatcacttggacattcatgtcggtctccttgcaagccgccatcttatcaggcaccgcgccgctgcggactggctatactgctgccctggtcacacagtctgcctggtggaggagcccacgggtgcgccggagaagtcttggtttgtgcatcctgctgggagtcggacaggccttcgccggcgagctgcgctggggcttcagccccgccgacggcatgccctacgtggacatcgtcgaccaccagctgcaaggcggcttcacccgccagttgggggagcgggtcgcgcagcggctgggattgtcgctgcgtttcgtggaaacgccgaaccgaaggatcgacggcttcatggccagcggacatattcacgtgatctgcaactccaaccccgaatgggatagcaaacccgaacgctaccattggtctcccgccctcttcgaagagcaggacgtcctcctgcagcgcgacgaccgtccggcgatccgcgacttcgccgagctgcgcggcaagaccctgggtacaagtctaggctatgtctacgcggacgatctcatgcaggccttcgctgccggggaaattcgccgcgaagatacccgcgacctggccagtcgcgtgcagatgctcaagcgttcgcgcctggacgccgcggtggacatgcgccgcccgctgctctacctgacgcgccagcatcccgagctgggcctgagcgtcagtccgctggtactgcagagctatcggatgcactgcatctatggcggacaactgccggtccccgtcgaaagtatggaccgggtgctcgacgagatggtcagggacggcagcatcgggcgcctgctggaaaacagcctgcaagcgcctcaggaaccctga

SEQ ID NO: 5037 - DNA, 1269 bp, Pseudomonas aeruginosa
gcagtacgaaaggattcaggagttcttctggcgattgccgttcaaggcggtgaccttctccgccaccacgcccgccgtgcgcacggccacgcgctcgccgctctgcgcgtcgaacagcaggacccgcgcgggatcgaagcgcaggctcatgccgctgcccgcggccggcgcgacgtccggcgccaggcggcaacagaccttgacctggttgacggtgacgaagaccagggtgtccggcccggtcggttcgagcacctcgacctcggtacgcaggtcatgggcagcgctgccatcgcccagggcgatctgctccggtcgtacgccgaggatcagctcgcgcccctcctccaggccgggctccaggctcagcggcagttcgatacggtcctggccgctatcgagcaggccggtccagcgtccgtcccggcgctgcaggcgcaacggaatgaaattcatcggcggcgaaccgatgaagctggcgacgaacaggttggccgggtcgttgtagatctgctgcggcgtgccgaactgctggatgacgccgtccttcatcaccgccaccttgtcgccgagggtcatggcctcgatctggtcgtgggtgacatacacggtcgtggtcttcagccgctggtgcatcagcttcagctcggtgcgcatttccacccgcagcttggcatcgaggttggacagcggctcgtcgaacaggtagaccttgggccgccgcgccagcgcccggcccatggccacccgctgctgctggccgccggagagctgcgagggcttgcgttcgagcaggtgctcgatctgcaacagcctggccacccgcgccacctcctcgtcgatggcggcctggggcatcttgcggatcttcaggccgaaggcgatgttctcgcgcacgctcatggtcgggtacagggcgtaggactggaagaccatggcgatgtcgcggtccttggggctcatgccgctgatgtcctggccgtccaccaggatcgcaccgccggtgatgctctccagcccggcgatgcagttcatcagggtcgacttgccgcaacccgagggcccgacgaggatcaggaattcgccggagtcgatcttcagccggatgtccctgagggtatccgccaggccgctgccgtagctcttgtgcaggttgcgcagttcgagggttgccatgtttcgttcgtctccggggtcagcgacccgtctcagcctttcacggcgccggcggtgaggccgcgcacgaagtacttgccggccagtacgtag

SEQ ID NO: 5038 - DNA, 1179 bp, Pseudomonas aeruginosa
agcgcgcaggcgccccagagggtcaggtgcacggccaggcggctgacgctgaagctcgggttcagggacgcgtcacgcatggcgcttgcctcgcagttcggaatacaggtaaggcaccacgatcgccagtacagcgccgagcatcagcatcgcgctcgccgcgccgagccccatctggccacgggtgaaggtatgcgcatacatgaacatcgccggcaggtcggaggaataacccgggccgccggcggtcatcgccgccaccaggtcgaagctcttgatcgcgatatgggcgaggatcatcagcgcgctgaagaacaccgggcgcaggctcggcaggacgatgcgcaggtagatggtcggcaggctcgcaccgtcgacctgggcggcgcgcacgatggccgggtcgaccccgcgcaggccggcgaggaacagcgccatgacgaagccggaggcctgccacacggcggcgatcaccaggcagtagacgacccgctccgggtccaccagccagtcgaagcggaaaccttcccagccccagtcgcggagcagcttgtccaggcccaggcccggattgagcagccacttccaggcggtgccggtgacgatcatcgacaacgccatgggatacaggtagagggtgcggatgaagccttcgcggcggatgcgctggtccagcagcactgcgaggaacactccgagcaccaggcagatggcgatgaacgagccgccgaagagcagcaggttcttgctcgccacccaccagcggtcgttgtcccacaggcgctggtactggctcagcccggcccacttgtagctgggcatgaagcgcgagttggtgaaggacagcagcagcgtccagccaatgtagccatacatgcagaacagcaccacgaccacgcttggcgccagcaccagcttcggcagccagccttgcaggcgatcgagtggcgagacgcgacgaggcgctaccggagccgtgggatagacaggggaattggtcgccatgcgttttctcgcgtgcgaaggaacccacccgtgccgctcggcggcacggagccagtcgggaggatcgagcggagccctggccgggatccgcgccagggacttactgcgccgccgcctcgatggcggccgccagttgctgggcggccttctgcggatccgcggcggggtcgttga

SEQ ID NO: 5039 - DNA, 1578 bp, Pseudomonas aeruginosa
cgcccgctccgcctctgtctgcggctgccgcagaacgcgggagaacctcgtgcctgcccgcctcgttcaagggcccaccaagccagcccatcactccagccccaggcgcggcaagcgcaggctgacccgcaggccgccctcgcgacggttctgcaaactgacttcgccgccatgggtgtgcgcgatgttgcgcgcgatgcccaggcccagcccgtagccctgccctcgcggagacagacggaagcgcggctcgaagatctgttccaggcgctgctcgggcacgccggggccgtcgtcgtcgacgtgcagcaccaccgcttccggcccgtcctccaggctcaggcgggcgcgttcgccgtatttcagcgcattgtccagcaggttgccgatacagcgcttgagcgccaggggcttgcccggataaggctccgcggcgcgaccgacgacctccacccggccatcggccaggtagggctcggcgatgtgctggagcaacaggttgaggtcgaccggctcgacgttctcgtggatatcggtgtccttcacgcactgcagcgcgcccttcaccagcagttccagctcgtccaggtcgcgcccgaacttctcctgcaagcgctcgtcctcgaggagttctacccgcaggcgcaggcgggtgatcggcgtgcgcaggtcgtgggagatggcgctgaacaactgcccgcgctcgttcaggtagcggtcgatgcgctcatgcatggtgttgaaggcgcgcgccacctccaccagttcgctggcgccgcgctcctccagcgctgccgacggactgcccagggccaggtcgcgggcggcgcgcgccaggcgcttgagcggacggctctgccaatgcatcagcaaaccggtgaaaagcagcagcaacaggctggtgaaaacgatcgagagcacctgctgcggttgcagtccctcgggttccaggctgacgtacggcgccggcatcaggctggcgatgtacagccactcgctttcgccgatgcggatctgggtcaccagcaccggcgggttcaccggctccagggtcagcgcgtagtgcgcccaggaacgcggcagctcgtcgagcttcagcgcgccgttgaacaggcgcagctcgtcgggactgacgaattcgacctgcagctcgacctccttgcccaggcgttggtgcaacacgtcctggacgatctccagcaccgcctgcttgttcggcgtgtccggcagggcacgcatctccagcggccggtcgttcagcgagacgaagaagcgcgtaccgcccatgctgcgcaactggtcgagcaccagcggacggtagccgagcggcagggaacggaagtagctgacgctggccgccatcgagtaggccaggctgcgcgagctggtgagcaggccctcgcgctggctggagcgcaggtgcgacagccagaacaggctggaaagcccttgcgcgaccagcaccgcgagcagggtcaggagcagcatgcgcccgagcagcgagcgcggcaccggcgaccagcgccgccgttcgctcatggctgcaggtgcggccgcacctgcgccgccagcaggtag

SEQ ID NO: 5040 - DNA, 783 bp, Pseudomonas aeruginosa
accgcaatgccccgcgccagggcgggacggtcggcagatgttgccggagagacagccgccagccaagcgccgggcggatatcgacctatcagaatcagcgccagcccgttgatgctctcggtaaaggtgcaggcgccttcttccgcgctgctcatggcgttgcgcatgaaggcgaacagctcgcggccgcaaccgagattgccgtcgtgcggcgccggctccaggctgcgcgcctgccattcggcgtcgtggaccagcacccgcaactcgccgttcaccccatccacccgcacccggtcgccgtcgcgcaggcgcgccagcggaccgccggcgatggcttccggactcacatggatggccgcgggcaccttgcccgacgccccggacatgcgcccgtcggtgaccagcgccaccttgaagccacgatcctgcaggaccccgaggaacggcgtgagcttgtgcagctccggcatgccgttcgcccgcgggccctggaaacgcaccacggcgaccaggtcgcgctccagctcgccggccttgaaggccgcggccaggctggcctggtcgtggaagatccgtaccggcgcctcgaccacctggtgttccggcgccaccgccgagaccttcatcacgccgcgaccgaggttgccctccatcaggcgcaagccgccttcggcggagaacggcttgtccagcggacgcaggatggcttcgtcgagactccgttccggcccttcgcgccagaccagccggccatcctcgaggaacggctcgcgggtgtag

SEQ ID NO: 5041 - DNA, 1023 bp, Pseudomonas aeruginosa
aaaagagacgacctcattatgactatccgcctggccatcaacggcttcggtcgcatcggccgaaacgttcttcgcgccctgtataccggccactaccgcgaacagttgcaggtagtggcgatcaatgacctcggcgacgccgcggtcaacgcccacctgttccagtacgacagcgtccatggacgctttcccggcgaggtcgagcacgatgccgaaagcctgcgggtgatgggcgaccgcatcgccgtcagcgccatccgcaacccggcggaactgccctggaagagcctcggcgtggacatcgtgctcgagtgcacggggctcttcaccagccgcgacaaagccgctgcccacctgcaggccggcgccggcaaggtgctgatctcggcgcccggcaaggacgtcgacgccaccgtggtctacggcgtcaaccacgaggtgctgcgcgcctcccatcggatcgtctcgaacgcctcctgcaccaccaactgcctggcaccggtggcccaggtgctgcatcgcgagctgggcatcgagcacggcctgatgaccaccatccatgcctacaccaacgaccagaacctctccgacgtgtaccacccggacctgtaccgcgcacgttcggcgacccagtcgatgatccccaccaagaccggcgccgccgaggcggtcggcctggtcctgccggaactcgccggcaagcttaccgggctggcggtgcgggtgccggtgatcaacgtgtcgctggtcgatctcaccgtgcaggtggcccgggataccagcgtagacgaggtcaaccgcctgctgcgcgaggccagcgagggctctccggtgctcggctacaacacccagccgctggtgtcggtggatttcaatcacgacccgcgctcgtcgatcttcgacgccaaccacaccaaggtcagcggccggctggtcaaggcgatggcctggtacgacaacgagtggggcttctccaaccgcatgctggacagcgccctggcgctggccgccgcccgcgactga

SEQ ID NO: 5042 - DNA, 531 bp, Pseudomonas aeruginosa
aacgacggtcagcggcgcggccagtcgtcgtcggcgtccagtgcctcgcgctcctcgcgcatggcctccgccagggcgcgctcctcgtcatcgggatcggcgcccgcgacagcctccgcgacggcaggctcgacggcttgctccgcgaccacgggaatcggcccagccgctggctcggcggactcgtcgccctgctccgagggctccggagggtcgagcaggtcgtcgaagtcggtcttcaggccctgctccatctcgtccagttccagcagcaggctgcggaagctggtttcctcgcgcggcttctccggctcgccggcctccccctcgatctcctcgaggctttccccggcctcggcgatggcgcgatcggccagggcctggatcgaggcaggaatcgcatcctcgtcgagatcgtcgcgcggcggctgcgccgcgggcgccacttcgaccggcggttccggctcgggctccatctcgcgcagcgccgacagcggcggcagctcgtcgaggctcttcaggttgaaataa

SEQ ID NO: 5043 - DNA, 369 bp, Pseudomonas aeruginosa
tcggccagggcctgttcctggctcgccacctgcacgacgccgataccggcgaaaagcccaaggactgacatgctctacgcgatcatcgcccgtgacatccccgcttcccaggaacgccgcctggccagccgcccggcccacctggcccgtctcgaacagctgaaggaagaaggccgcctggtactcgccggcccgcacccggcgatcgacagcaacgacccgggcgccgccggcttcaccggcagcctgatcgtcgccgaattcgattcgctggccgcggcgcagagctgggccgaggccgatccctaccgggccgccggggtgtacgccgaggtggtggtcaagccgttcaagaaagtcctgccctga

SEQ ID NO: 5044 - DNA, 729 bp, Pseudomonas aeruginosa
gccgcggccgccggcgacagcgacgcgaatggatcaattgagcgacactcgatgagcgaactgctgttgatcgacgatgaccgggagctctgcgagctgctcggtacctggctggtccaggaaggtttctccgtgcgtgccagccacgacggcgcccaggcccgtcgcgccctcgccgagcagacaccggatgccgtggtgctcgacgtgatgctgccggacggtagcggcctggaactgctcaagcaactgcgcggcgaccatcccgacctgccggtgctgatgctgtccgcccgcggcgagccgctggaccgcatcctcggtctggaactgggcgccgacgactacctggccaagccctgcgacccgcgcgaactcaccgcacggctgcgcgccgtgctgcggcgaacccacccggcgcagcccagcgcgcagatgcaactgggcgacctgtcgctgaacctgacgcgcggcgtggcgcagatcgacggccaggagatcagcctgaccctttccgaaagccgcatcctcgaagcgctcctgcgccagcccggcgagccgctggacaagcaggccctggcgcaactggcgctgggccgcaagctgaccctctacgaccgcagcctggacatgcacgtcagcaacctgcgcaagaagctcggcagccaccccgacggcagcccgcgcatcctcgccctgcgcggccgcggctactactacagccactga

SEQ ID NO: 5045 - DNA, 330 bp, Pseudomonas aeruginosa
tgggccagcacggtccccggcatgcgcggcccgatgaaggaactggacctgacccgcgaacagcgccagcagatgggcaaactgatgggcgaacaaatgaaggcccgccacgagatcacccagcgctacctggccaagctgccggcggccgagcagaaggccctgaaggacgaactcaaggccagccacgagaagacccagaaggacatccgtgccctgctcacccccgagcagcagaagaagttcgacgaactgcagaagaagcgcgagcagcgcaaggcagagtgggccgaattccagcaatggaaggccgacaagaagtccaactga

SEQ ID NO: 5046 - DNA, 1419 bp, Pseudomonas aeruginosa
cggtcttccgaccagccggaatcgcatatcctaggggtttaccctcgcggccggcccgacatgcgattcaacaggaaaaccatgcgttcactcttctggcgaatcctcgccgccttctggctggccctgctgctggtcgccgggctgtccatcctgctgggtcgtgcgctgaaccaggacacctggatcatcgcccgccatcctggcctgaaggatctcgccgagcagtggaccgccctctacgaagaacagggcagctacgcggcccagggcttgctggagcaacgccgtcgcgactacgggatttccatccaggtgctcgatgaaagcggccagcgcctggtcgacggcacctacctgccgcgcccccaccaccgcccgccgcgcaccagcgaccgcaacctgccgcgcttcccctggcgccagctgagccaggaatacgtcagcccgcaaagcaaccatacctatctgttcatctaccgcatcccgcacccggagctggaggcctggcaccgcggcagcctgctctggccgctcagcgcgctgggcatcgcactggtggtgctgaccctgttcagcctgctgctgacgctgtccatcacccgtccgctgaaccgtctgcggcgcgccgtgcacgacctcggccagaccgcctaccacaaggacagcctggcccgcctggcgcggcgcggcgatgaactgggcaccctggcgcgcgatttcaaccgcatgggcgaacgcctgcaaagcctgatcggcagccagcgtcagttgctccgcgacgtatcccacgaactgcgctcgccgctggctcgcctgcgcatcgccctggccctggccgaacgcgccgaaccggaagcgcgggcgcagatgtggccgcgcctggaacaggaatgcgaccgcctggaagcgctgatcggcgagatcctcgccctcgcccggctcgacgccgaacccggcgcgagccaacggatcgccctgctaccgctgctccagcggctgcgcgaagacgccctgctgctggctccggaacaggatatccgcctggaggtggcgcctgacctgagcatcgacggctggccggacatgttcgaacgcgcggtggacaacctgctgcgcaacgccgtgcgcttcaaccccgtcggccaccccctggaggtgcgtgccagcagcgccggcgactacctgcgcctgagcgtccgcgaccatgggccaggcatcgccgccgaactgcaggagcagttgggcgagccgttcttccgcgcacccaaccagagcagcccgggacacggcctgggcctggccatcgcccgccgcgccatcgagcgccacggcgggcacctgcgcctgggcaaccatcccgacggcggcttcatcgccaccctcagcctgccgctacggcgcaaggcgaccgaatga

SEQ ID NO: 5047 - DNA, 519 bp, Pseudomonas aeruginosa
cgccgcgcccagatgaacaattccccaggagcatccggcatggctcttcccgcttcgttgttcctcgatgaacgcccgctcgcccaggccatcgcgccgccgccggaacctcccggcgacgaaccgcaatcgctggtcctggcggtcgagctgggacaggtcgcccagcaactgcggcatcgctgggcgcgcctcgacctgaacctgccggaacgcggcacctggccgctggaaagctggcgcccggccttgcacgaggcgctctacggcctgctcggcggcgccgcgcaggcccgcccgtggcagcgcatcacactgaatccggcgctggacgcacgccacggccggctgcgcctggacatcctcggccaggcggaagaaggccggcgctggctgccggcggccgtggaagccgcccgacgactggccggctggcagggcggacgactgctctggcacgcccagggcgcgtattggtgcgtacgcctgctgttgccgctcagcccggccaggcgctga

SEQ ID NO: 5048 - DNA, 1536 bp, Pseudomonas aeruginosa
agaggggtgcagcggcagatttactctccgcggacggctggtagaatggccggtccgccacagcccagagccccacgatccatggccttgccgaccctacgtatcctcggtttcatcatcggcatcttcctgatcactctggccgccagcatgctggtcccgatcctgaccatgctcgccttcgaccgtaccgaaggcatccaggcattcatctggtccagcgtcgccaccttcgtcaccggcctcggcctggtcctgccgggacgtcccgagcatgtccacctgcgcccgcgggacatgtacatgctcaccgtatcgagctgggtgctggtatgcatcttcgccgccctgccgttcgtcctgcagcagcacatcagctacaccgatgccttcttcgaaagcatgtcgggaatcaccgccaccggctccaccgtgctcagcgggctggacgacatgtccccgggcatcctcatctggcgctctctgctgcactggctgggcggcatcggcttcatcgccatggccgtggcgatcctgccgatgctgcggatcggcggcatgcgcctgttccagaccgaatcctcggaccgctcggaaaaggtcctgccacgctcgcacatggtcgccaagtacatcgtcgccacctatgtcggcatcaccctgctcggcagcctggccttctggggcgcgggcatgagcccgttcgacgcggtcaaccacgccatgtcggcgatttccaccggcggtttctccacctccgaccaatccctggccaagtggaagcagccagcggtgcactggaccgcggtagtggtgatgatcctcggcagcctgccgttcgcgctctacgtcgccaccctgcgcggacaccgcaaggcgctgatcaaggaccagcaggtccgcggcctgctcggcctgctgctggtgacctggctgctgatgggcacctggtacgcggtaacctccaagctgccctggatggatgctttccgcatcgtcgcagtgaacgtcacctcggtggtcaccaccaccggcttcgccctcggcgactacagcatgtgggggcacttctcgatcatgctgttcttctacctcggcttcatcggcggttgctccggttctaccgccggcggtatcaagatcttccgcttccaggtcgcctataccctgctcaaggccaacctctaccagttgatccatccgcgcgcagtgctcaagcagaactacaacggccatcgcctggacgaggaaatcgtccgctcgatcctgaccttctcgttcttcttcgcgatcgtcgtctgcctgctcgccctcggcctgtcgctgatcggcctggactggatgaccgcgctcaccggcgccgccagtaccgtggccggcgtaggcccggggatggggcccatcatcggcccctcgggcaacttcgccagcctgccggacgccgccaagtggctgctggccgccggcatgctgctcggtcgcctggagatcatcaccgtgctggtcctgctgaccccggcgttctggcgccactga

SEQ ID NO: 5049 - DNA, 1170 bp, Pseudomonas aeruginosa
aaagccggtgtaagcttctgcaccatgacgacacagccgcaacccggccacgtgagcctggatagctccacccagcccgcccgcgtcagagccataggtgattggacgctcgcccactacacggctctggagcgcgaggtgacgcgcctgcgcagcgaagtggcgggcaacgccagcttcgacctgagccaactgggcgccctggataccgccggcgccgccctgctcgccgaattgctcggcgccgagcgcctggccgacctcgccgagctggagcccggcctgccgcgcgagcgccaggccctgctgaagaccgtcggccacgccctgcacgacttctgcgagccggagaaacccaagccgccaaccaccgccatcgaactgctggctcgcatcggttgtgccatggagaccttctggctgcacctcaaggcactcctcggcttcatcggcctgaccctggagaccctgttccgcagcctggtccgcccggccagttggcgggtcacgccgctggtggcgaacatcgagaagagcggcctggacgcggtgccgatcatcgccctgctgaccttcctggtcggcgcggtgatcgccttcctcggcgccacggtgctggccaacttcggcgcgaccatctacacggtcaacctggtggtgttctccttcctccgcgagttcgccgtgctgctcaccgcgatcctcatggccggccgcaccgccagcgccttcaccgcgcagatcggctcgatgaaggccaacgaggaaatcgacgcgatccgcgccctcggcctcaaccccatcgagctgctggtgctgccgcgggtgctggcgctgctggtatcgctaccgatgctgaccttcgtcggcatgctctgcggcatcgtcggcggcatgaccgtctgcgcctggaccctggacatcccgccggcgatgttcctgtcgatcatggaggacggaatcggcgtacagcatttcctggtcggtatcagcaaggccccgctgttcgccttcctgatcgccgtgatcggctgcctggaaggcttcaaggtcagcggcagcgcccagtcggtgggcgagcacaccaccaccagcgtggtccactcgatcttcgtggtgatcctgctcgacgccctcgccgcgctgttcttcatggagatgggctggtga

SEQ ID NO: 5050 - DNA, 1053 bp, Pseudomonas aeruginosa
tcgataccctggaacgggtcgccgccaccgacgacgcctgggtccgcgaatacttccacgggccgcgcgggcgcgccgcccaccaagccgccgccgtgccggagaatcactgagatggaaacccgagcccaccatgtgttgatcggcctgttcagcgtgatcgtgatcggcgccgccctgctcttcggcctgtggctggccaagtccggctcggagggcaagttcaactactacgacatcgtcttcaacgaagcggtcagtggcctttcccagggcagctcggtgcagtacagcgggatcaaggtcggcgacgtggccttcctccgcctcgatccgaaggacccgcgcaaggtctgggcacgcatccgcgtggtggccagcgcgccgatcaagcaggacaccaccgccaagctggcgctcaccgggatcaccggcacctcgatcatccagctcagcagcggcacgcccgccagcccgatgctggagggcaaggacgggaagatcccggtgatcgtcgccacgccctcgccgctgacccagttactgagcaacggcgaagacctgatgggcaacatcaaccagctcatcgcgcgcttcagcaacatgctctccgaggaaaacacagcgcgcatcagccgcaccctcgaccatctcgaccaggccaccggcgcgctctccgccgagcgcgagaacgtcagcgcggtgatgcagcagttggcccaggcgagcaggcaggccaacgccgccctggcccaggccagcgagttgatgcgcagcgccaacggcctgctcaacgagcaaggcaaggggatgctggaaaacgccaacaagaccatggcttcgctggagcgcaccagcgccaccctcgaccagttgatcagcgagaatcgccactcgctggacggcggcatccagggactcgccgagctgggcccggcggtcagcgaactgcgcgataccctggcggcactgcgcggaatcagccggcgcctggaagagaacccggcgaactacctgctgggccgggaaaaaaccaaggagttcaccccatga

SEQ ID NO: 5051 - DNA, 1617 bp, Pseudomonas aeruginosa
atactattcgcgcgtgctggcctatatcgcctgtggcgccagcatcgcggcgggaacctacacccagtatttcagctacggcatcctctggatggtgccctatgcgctgctctacccgcacctggcgtaccacctcggccagcgcttccgccagcacgacccgcgcaaggtgacccgcgccctgctcgcggtcgacgccgtgcactgtggcctgggcatggcgctgctcggcttctccgtggtgcccagcctgatgttcctgctggtgctgagcttcaccgcgctggtcatcggcggcctgcgcctgctcggcatggccttgctggtatcggccagcagcgccctgctggtcgccgtgctcgtcgccccgccgctgctgggcaataccccggtcgaggtggccgcggtcagcatcctgttctgcggactgtacatctgcatcaccgccttcttcggccaccagcagggcctgcgcctggcccaggtgcgccaggagatcgcccgcgagcaggaaaaggccgcgcggctcgcgcgcaacctggccaagtacctgtcgccgcaggtctgggaaatgatcttcagcggcaagaagagcgtgcgcctggaaacccagcgcaagaagctcaccgtgttcttctccgacatccgcggcttcaccgagctatccgaggaactggaagccgaggccctgaccgacctgctcaacaactacctcaacgaaatgtcgaagatcgccctcaagtacggcggcaccatcgacaagttcgtcggcgactgcgtcatggtgttcttcggcgaccccagcacccagggcgcgaagaaggacgccgtggctgcggtatcgatgggcatcgccatgcgcaagcacatgaaggtgctacgccagcagtggcgggcccagggcatcaccaagccgctggaaatccgcatgggcatcaacaccggctattgcacggtgggcaacttcggcgccgacacgcgcatggactacaccatcatcggccgcgaggtgaacctcgccagccgcctggaaagcgcctcggaagccggcgaaatcctcatttcccacgagacctactcgctgatcaaggacgtgatcatgtgccgcgacaagggccagatcgcggtcaagggcttcagccgcccggtgcagatctaccaggtggtggactcgcgccgcgacctcggcgccgcgcccagctacgtcgagcacgaattgcccggcttctccatgtacctggacaccaacaacatccagaactacgacaaggaacgggtcatccaggccctgcaacaggccgccgaacgcctgcgcgacaaggtcatcctctaagttcgtcgaacgccgccggcagttcgtcgcgccattccggcgcagtccgtgggccgctcgcctgcagcgccaggaactcctccgccgaaacccgccaggactgctcccgcgcccagcgcccgcaggcctggcgatccagcgccagcgcctggcggcaggcttcgccaagatcctcgtgcatgaccccggtcacgccctgctgcaatacatccagcggccccggcacggcgaaggccgccaccggcacgccacaggccagggcttcgagcatcaccaggccatag

SEQ ID NO: 5052 - DNA, 831 bp, Pseudomonas aeruginosa
cagggcccggctgtctgtcgccggcgccagcgggtagactgggcgcctgcctccgggagcttcgccatgggttcgatcctttccctgcgccactacagccacgaccagatcgtccacagccatgaccatgcccaattggtcctgggcctcagcggctgcctcgacttcgaggtcgaggggcgcggcagccgcgtgttgcggcagaccttcgcggtggttccggcgcaagcccggcatgcctgctcgagtccctccggcagccgctgcctggtcctcgacctgccctgcgacggcagcctgctgctgggcctgggcgaacacgccgaagccggcaggcggctgttcgagcgaccgcaggcgctgtcgctgacgcccgcccagggccaactggtgaactggctggccagcggcccgatcaacgacccggtgatcgcccaccagggcgccggcctgctcctcgccagcctggccagcgagcgccagccgccgcgccagcagccccgcctgccactggccagcctcgacgcctacctcgaccgccatgccgcccatccgctacaggtagccgacctggcgcggctggccggtctttcggtggcgcgcttccacagcctgttcctcgccgagaccggacagacgcccatggactacgcgcgcagccgacgcctgcaccaggcccacgaactgttgctggagagcagcctggcggtgggcgagatcgccgcccgggtcggctacgcctcgcagagcgccttcaccgcagcgctggtccgcgagttcggcgtcaccccgcgacaactgcgtcgcgagtcccgcgacaaaaccggctag

SEQ ID NO: 5053 - DNA, 1083 bp, Pseudomonas aeruginosa
aaaccacggcatcccgtacgtcaagagaatggacagctaccccgtacaggacgccgacgacacgataagcgaagtcgcccctccggcgcactcgtcatcgcctgccggccgcggaaacgccggcgaggcatccctgcattcgaggaggcggaaatgaaagcgccacgcgtaaccctggaccaatggcggaccctgcaggcggtggtcgaccacggcggcttcgcccaggccgcggaagccctgcaccgctcgcaatcgtcgatcagctataccgtggcgcgcatgcaggaacagctcggcgtgccgctgctgcgcatcgacggacgcaaggcggtgctgaccgaggccggcgaagtattgctgcgccgttcgcggcaactggtcaagcaggccgggcaactggaggagctggcgcaccacatggaacagggctgggaacccgaggtgcgcctggtggtggacgccgcctaccccaccgcgcggatcgtccgctcgctgtccgccttcatgccgcagagccgcggctgtcgcgtgctgctgcgcgaggaagtgctctccggcgtcgaggaagcgctgatccagggcgccgccgacctggcgatcagcggcctgatcattcccggccacctcggcgccgacctcagcgtggtcgagttcgtcgccgtggcccaccccgaccatccgctgcaccgcctgcaacgcgaactgacccaccaggacctggaaacccagatgcaggtggtgatccgcgacagcggccggctacagccgcgcgaccacggctggctgggcgccgaacagcgctggacggtgggcagcctggctaccgcggcgaccttcgtcggcaacggcctgggcttcgcctggctgccgcgacacatcatcgagcgcgaactgcagagtggccagctcaagccgctgccgctgagccagggcggcgtgcggcagagccgcttctacctctacaccaacaaggaaaagccgctcggcccggccagccagatcctcatggaaatgctcaagtcgttcgccaacgtaccgctcaacgcgcccttcgcggcgcccgaaccggccgccgagtga

SEQ ID NO: 5054 - DNA, 1875 bp, Pseudomonas aeruginosa
tccggcgggcccaggacgggcccgctccagaagagagccatcatgctttatcgtcgtttcgaacgtctgatcgacccgttccgcagtgcttccgaacgcatgccgcccagcgaagtgctgcgtttctatgtctacttcctgcgccaggtctggccggtgttcctggccctgctggtggtcggcctgatcgtcgcgctgatcgaggtggcgctgttcagctacctcggccgcatcgtcgatctcgcccagagcacgcccagcgcggagttcttccgcgtgcacgccaacgaactgatctggatggcggtggtggcgctggtcctgcgcccgctgttcaacgccctgcacgacatgctggtgcaccagagcatcaacccgagcatgaccaacctgatccgctggcagaaccaccgctacgtgctcaagcagagcctcggcttcttccagaacgatttcgccgggcgcatcgcccagcgcatcatgcagaccggcaactcgttgcgcgattcggcggtgcaggtggtggacgccctctggcacgtgctgatctataccgtcagcgccctggtgctgttcgccgaggccgactggcgcctgatgatccctctggtgctgtgggtgttcgcctacgtcggcgccctcgcctacttcgttccccaggtcaagcgccgctcggtggaggcctcggattcgcgctcgaagctgatggggcggatcgtcgacggctacaccaacatcatcacgctgaagctgttcgcccacacccgccaggaagaggactacgcccgcgaagcgatcggcgaccagaccctcaagtcgcaacgcgccgggcgcgtagtgacctccatggacgtgaccatcacggtgatgaacggcgtgctgatcaccggcaccaccggcctggccctgtggctgtggagccaggagctgatctcggtgggcgccatcgccctggccaccgggctggtgatccgcatcaacaacatgtccggctggatcatgtgggtggtcggcggcatcttcgagaacatcggccaggtccaggatggcatgcagaccatcgccctgccgcgcaaggtggtcgaccgcgaggacgcccagccgctgcgggtagagcgcggcgaggtggagttcgagcacatcgccttccactacggcaagggcagcggcgtgatccagggtctcgacctgaaggtccggcccggcgagaagatcggcctggtcggaccttccggcgccggcaagtcgaccctggtcaacctgctgctgcgcctgtacgacctggagagcggacgcatcctggtcgatggccaggacatcgccggggtgacccaggaaagcctgcgcgcgcagatcggcatggtcacccaggacacctcgctgttgcaccgttcgatccgcgacaacctgctctacggccgccccggcgccagcgacgcggaactcatggaagcggtgcgcaaggctcgcgccgacgagttcatcccgctgctcagcgacgccgagggccgccgcggcttcgacgcccatgtcggcgaacgcggagtgaagctctccggcggccagcgccagcgcatcgccatcgcccgggtgctgctcaaggacgcgccgatcctgatcctcgacgaagcgacctcggcgctggactcggaagtcgaatcggcgatccaggaaagcctggagaccctgatgcagggcaagacggtgatcgccatcgcccaccgcctgtcgaccattgcgcgcatggaccgcctggtggtgctggacaagggccacatcgccgaaagcggcacgcatgccgagttgctcgcccatggcggcctctatgcgcgcctctggcaacaccagaccggcggcttcgtcggcgtcgactga

SEQ ID NO: 5055 - DNA, 429 bp, Pseudomonas aeruginosa
ccgtggtctacgaggaccatagcggcgagctgcacaagatccgcttcctcgaatggggcggcagcaccagcaacggctgagcggacgccacgccctatcgttccggcccccttcaggcctggcggtagggcaacaggccgtgggcctcctcggcgtaggcgcgcacacccgcccgctcctgttcgaggaactgcgccacggcatcgcgcagaccgggatgcgccaggtagtgccaggagcgcgtcagcaccggctcgaaaccgcggatcagcttgtgttcgccctgggcgccggcgtcgaagcgcgccaggccggcgccgatggcgaattccaggccctggtagaagcaggtctcgaagtgcagccggtcgaactcggccaggcatccccagtagcgcccgtacagggtatctccagcgaccaggctga

SEQ ID NO: 5056 - DNA, 1860 bp, Pseudomonas aeruginosa
cgcttagtgggccaccgcgccagaggcgcccaggccggtctgggaacggatgaactgcgggaagaagcgcgcccgctcctcgtcggccgccgccgacttgtcggtgatggagaagaaccagatactgatgaaggcgacgatcatcgagaacagcgccgggtactcgtacgggtagatggctttctcgtggccgaggatctgcacccagatggtcgggccgaggaccatcaggcccaccgcggtgatcaggcccatccagccgccgatcatggcgccgcgggtggtcagcttcttccagtacatggagagcagcagcaccgggaagttgcagctggcggcgatggagaaggccaggccgaccatgaaggcgatgttctgcttctcgaagaggatgccgagcacgatggcgaccacgcccagggccacggtggtcatcttcgagacccgcagctcgtccttctcgttggccttgccgcccttgaacacgctggcgtacaggtcatgggagacggccgaggccccggccagggtcagcccggcgaccaccgcgaggatggtggcgaaggccaccgccgagatgaagccgaggaacaggctgccgcccaccgcgtcggccaggtgcaccgccgccatgttgttgccgccgatcagcgcgccggtggcgtccttgaagtccgggttggtgctgaccagcaggatcgcgccgaaaccgatgatgaaggtcaggatgtagaagtagccgatgaaaccggtggcgtagaacacgctcttgcgcgcttccttggcgtcgctgacggtgaagaagcgcatcaggatgtgcggcagcccggcggtgccgaacatcagcgcgaagcccagggagaatgccgagatcggatccttgaccaggccgcccggactcatgatcgcctcgcccttcggatgcaccttgatggcttcggagaacagcgtgctgacgtcgaagttgacgtgcttgagcaccatgatcgccatgaacgaggcgccggaaagcaacagcacggccttgatgatctgcacccaggtggtcgccagcatgccgccgaacagcacgtagagcaccatcaggatgcccaccaggaccaccgcgacatggtagttgaggccgaacagcagctcgatcagcttgccggcgccgaccatctgcgcgatcaggtagaacgccaccaccaccagcgagccgcaggccgacagggtgcggatctgcttctgcttgaggcggtaggaggcgacgtcggcgaaggtgtacttgcccaggttgcgcaggcgctcggcgatgaggaagaggatgatcggccagccgaccaggaagccgatcgagtagatcaggccgtcgtagccggaagtgaagaccagcgccgaaatacccaggaaggatgccgccgacatgtagtcgccggcgatcgccaggccattctggaagccggtgatgcggccgcctgcggcatagtagtcggccgccgagcggttgcgcttggatgcccagtaggtgatgcagagggtcgcgccgacgaaggcgacgaacatgacgatggccgagacgttcagcggctggcgctgcacgtcgccggtcagcgcgtcggcccagagggccggagcgaaggccgcaaggccgagcgcggcaaggagacgagcgatcattgctgcgcctccttgaggatttcctggttcaggctgtcgaactcgccgttggcgcgacgcacgtacaggccggtcaggatgaacgcggcaaggatcagtccgacacccatcgggatgccccaggtcacggacgaatcgggactgatacgcgcgcccagcagctgcggctggaaagcgatcagcaggatgaatatcacgtag

SEQ ID NO: 5057 - DNA, 1233 bp, Pseudomonas aeruginosa
cgtttcgccagccgctctagaccggtatttccgggccttccggcagattccggagccagccttcggcaaggaaaaacgccgtgcccggttgcccgggcacggcgttccccgatcgaaccagccgtgctactgcacccagtccttgacccgtcccgggttggccgccacccactgcttcgccgcatcctcgggtttggcgccctcctggatcgccagcatcacctggccgacctcgttgccatccttccagccgaacttcttcaggaactcccagaccggcttggccttggcctccagcgccgggttggcgacggtgtcgacatgctcggtatcgccatagaccttcttcggatcgtcgaggaacttcagcttccacttggcgaacatccagtgcggaatccagccggtcaccaccaccggcttcttctcgttctcggcacgggtcagctcggcgatcatgccgctgccggaactggccaccagcttgtagtcgaggccatattgcttgatcgcctcgtcggtcttgatcatcaccccggcgccggcatcgatacccaccacgcggccgccgaaagcgtccttctgcgcctggaggtcggcgatgctgttggcgctcacgtattcggggacgatcaggccgatgcgtgcgtccgggtagttgatggcaaggttgaccaccttatccttcatcttctcgtagtaggcgccgtgggtgcccggcagccaggccgagagcatggcatcgagcttgccgcgcgccacgccctgccacatgatccccgccgccaccggcatcagcttcacctcgtagccgagcttctcgcggatcacctcggcggccacatgggtggtcgccacgctgtccgaccagccgtccacgtaaccgatggtgatcaccggcttgtccgccgcggccgccatccccacagccgccgacattgccaggcccgcactccagcacaacagtcgtcgcatcattcgcatcagacgtaccccttgttctatgccgacggggacgctccccggcggtcgcggcactctgcggtgccgccgtccatcatcggcgcgcccggacggcggactgctctgagaacgacacccatcgcacccgataacgacatgcctcgaactgcgctgcggcacgctgcggatgtgctccgagacagtgcgatcgaagcgctctatgcactcgattggacaggccgatttccgcttggccgagcgcctggatag

SEQ ID NO: 5058 - DNA, 1647 bp, Pseudomonas aeruginosa
cggtcggcgggctggtggcggcggtcgagccgctgtgcaactcggtcggtttctacttccacgagaagatctggaaacgcttcgagaaagacggcgcgccgcgcccggctagcgcccatggctggctgcaccgccacgcctgaagggatattcgcgaggcacggcaagaggcgggaaagaccgattggaacgctggctgcaataacccactgcactactgaggcttgcagttgtcatagcggcagtatattcactcagtacttttccctcgaagggattcccccgatgccccacttcctccgtttcgctgccctgctcggcggcctcgccctcggttgtgccaatctggcgcaggcccgggacgtggacgccgcgagctacggctatccactgaccaacccgttcgaggcgaccatcgccaccacgccgccggaactgcgtcccgagcttccgcacagcgaggacatcgaccagaaggactacagcctgaaattgcgcccggagcgcgagttcgccctgccggacaacttctggccggtgaagaagctgcgctaccgcctggcccgccaggatcatgcggcgccgctgatcttcatcattgccgggactggcgcccactacgccagcagcttcccggaatacctgaagaagctcttctaccaggccggctaccacgtggtgcagttgtcctcgccgaccagttgggacttcatggccagcgcctcgcgcttcgccacaccgggcttttccagcgacgacgccgatgacctgtaccgggtgatgcaggcggtgcgcgcgcagcagcgcgacctgccggtgaccgactattacctcaccggctatagcctgggggcgctgaacgccgcgttcgtcagccacctcgacgaaagccgccggagcttcaacttcaagaaagtgctgctgctcaacccaccggtgaacctctacacctcggtgagcaacctcgacaaactggtggaaacccaggtcaagggcatcactgactcgcgcaccttctacgaggtggtgctgagcaagctgacccgctacttccggcagaaaggctacgtcgacatcaacgacgccatgctctacgacttccagcagtcaaagcaacgcctgagcaacgaagaaatggccatgctgatcggcacctcgttccgcttctccgccgccgacatcgccttcacctcggacctggtcaaccgtcgcggcctgatcaccccgccgaactacccgatcaacgaaggcaccagcctggagcccttcttcaagcgcgcgctacagtgcgacttcgagtgctacatgaccgagcaactgatcccgatgtggcgagcccgttacgacggcggcagcctgacccaactggtcaaccaggtcagcctctacaagctgcaggactatctgcacgacagcccgaagatcgccgtgatgcacaacgccgacgacgtcatcctcggcccgggcgacctcggcttcctccgccgaaccttcggcgaacgcctgaccgtctatccctatggcggtcactgcggcaacctcaactacaaggtcaacgcgcaggacatgctggacttcttcgccacgcccgctgccggacagacccaggtcgccagcgcggccctcacccagcaggcaggaaactga

SEQ ID NO: 5059 - DNA, 807 bp, Pseudomonas aeruginosa
tcgatgagccgaaccgcacactggatgttcgcccttctgctgagcgctgccgccagcgcccaggccgaccaggccgccgcgccggccgaactgccgccacgccagctcgacggcgacggtttcagccgtccactggaccaactcaagttcaatcccggcctggatcaacgcgaattcgagcgcgccaccctcgacgcactgaacatgtacgatccctgggaatcctggaaccgccgggtctaccacttcaactatcgcttcgacgagtgggtgttcctgcccgtggtacgaggctacgaatacgtcaccccacacttcgtccgcagcggcgtgagcaatttcttcgacaacctcggcgacgtgcccaatctgctgaacaacctcgcccaattgaagggcaaggcggcgatggaaaccaccgcgcggctgctgttcaacaccaccttcggtgtgctcggcctgtgggaccctgcgaccaggatgggcctgcacaagcgcagcgaggatttcggccagaccctcggcttctacggcgtgggcagcggcccctacctggtgctgccgatcctcggcccgtccaacctgcgcgacaccggcggactggtggtggactacgtcggcgaataccaggtgaactacctcaacgttccccaggccagcggcgaccacccggagatcaccgccctgcgcgtggtggacaggcgctacaacaccagcttccgctacggccagatgaattcgccgttcgagtacgagaaactgcgctacatctataccgaggcgcgcaagctgcagatcgccgagtga

SEQ ID NO: 5060 - DNA, 654 bp, Pseudomonas aeruginosa
cctacatgctcgaagggcgtatgcgccacgaagaccacctcggcaatcgcggcctgcctcaagcccggcggcgtacagtggatgaccgccgcccacggcatcatccacagcgagatgccggaacaggtggaaggcgcgatgcgtggcttccagctgtgggtcaacctgccggcgaagagcaagctggccccggccggctatcgcgatatcgagccggaagacgtgccgcgcctggaaaccgccggaggcgtgaaggtcacggtgatcgccggtcgcttcgacgacggccaggcgcagcagatcggcgccgtggaaaggccggacaccgagccgcactactacgacctgcaactgcctgccggcggccgcatcgccccgcgcctgccggacggccatcgcgtgctgctgtacgtctacgaaggcagcctgacggtggaaggcgaacgcccggtggaaatcgccaccaatcgcctggctcggctgtccgaagaaggggaactgagcctgcgcagcgaagccggcgcccgggtactggtgctcgccggcaagccgttgcgcgagccgatcgtccagtacggtccgttcgtgatgaacagccgcgaggaaatcgagcaggcgctacgcgactatcgcgacggtgtcctggccgtctga

SEQ ID NO: 5061 - DNA, 1296 bp, Pseudomonas aeruginosa
ggtttaccgctcgatccgcaggaagcgctccagttccgcccgcttgcccatcgcatcgtggtagcccagttcgatcagttcgctgcaatagccgcgctcgaacaacaggtagctcaatacccccgccccgctggcgcgggtcgctccgggaccgcgcaggaaaagccgcagcacccgcgacagctcccggtagtgccgcgcggcgatctcgtccagcggccggctcggcgacaccagcaatacctccaccggctccagcccacccgcctggcggcgcacctccggcgccaccaactggccgatctggttcatccgctgcaactgctcgatgtcgccttccaggctgtcgatgaaggtgctgttcaacaggtgggcgccgatctgcgccaggctcggcggtcggtcggacggcggcaggccggtcatggcactgtcgccaccggtggccgggttgccgctgacgccgatcaccagcacccgcgtggcgcccaggtgcaacgccgggctgatgggcgcctgggaacgcaccgcgccgtcgccgaagtattcgcggttgatccgcaccggcgggaacagcagcgggatcgccgcgctggccagcaggtgccgaagctccaggcgggtgggaatgcccaggcgccgatggcgtacccagggatcgatggtcgcgcgcccctggtagaaggtcaccgcctgccccgactcgtagccgaacgcggtcaccgccaccgcgcgcaactggcgctggcgcaccgccgcatgaatcccggaaaaatccagctcacgtgccagcagctcatgcaacggccggttgtccagcaacgccaccggcacccgccgccccaggccgagcaggctatggccgaggaagcgcgaggcctggcgggtcacgcccggccagtcgctgcgatagacatgttcggtgcggaatccctgccagaccgcggtcaggcgctggatcgcctggcggaattgcagggcgccgcaagccaggccaacggcgttgatggcgccggcggaggtaccgacgatgaccgggaaaggattgccggcgctgtccggcagcaggtcggcgatggcggccaggacaccgacctggtaggccgcgcgggcgccgcccccggaaaggatcaggccggtgagcggcggacgtggggcaaggggatcggacacagcggggcttccgtcatgaactgcggcgagtatagccagaccccgcgcgcgtccggaatgcccgtcctcagcgcttgcgccgtttcggatagagcttggcttcgcctggcgggcgggtcttga

SEQ ID NO: 5062 - DNA, 414 bp, Pseudomonas aeruginosa
ccatcctcgaactggcgcacaacgacctggcgaggctcgaacggcaactcgccgacaaagtggcgcaagcgcccaacttcttccgcgacacccccctggtcatggccctcgacaagctgcccgaaggcgaaggtcgcctcgacctgccggcgctcctcgaggtctgtcgccgccacggcctgcgcaccctggcgatccgcgccgggcgcgaggaggacattgccgccgcccaggccctggacctgccggtgctgccgccctcgggcgcccgcgaacgaccgctggacatcaaggacagcgccccgcgcaagcctgccgaagagcccagcccgagcgccggtgaagccaggcccgagccggccaaggcggaagagaagcccgccgagcccgtcagccgcccgaccaaggtggtga

SEQ ID NO: 5063 - DNA, 822 bp, Pseudomonas aeruginosa
atcaccttggccaaaattctcgtagtcacttccggtaagggtggcgtcggtaaaaccaccaccagcgcagctatcggcaccggcctggccttgcgcggtttcaagaccgtcatcgtcgacttcgacgtcggcctgcgtaacctcgaccttatcatgggctgcgaacgccgcgtggtgtacgacttcgtcaacgtcgtcaacggcgaggccaccctcacccaggccctgatcaaggacaagcgcctcgaaaacctgcatgtcctggccgccagccagacccgcgacaaggacgccctgaccaaggaaggcgtcgagaaagtcatggccgaactgcgcaaggatttcgaatacatcatctgcgactccccggcgggcatcgagaaaggcgcccacctggccatgtacttcgccgacgaagcgatcgtcgtgaccaaccccgaggtttcctcggtacgcgactccgaccgcatgctcggcctgctggcaagcaagtcgcagcgcgccgagaaaggcgaggagccgatcaaggaacacctgctgctgacccgctacaacccggagcgcgtcaccaagggcgagatgctcggcgtcgacgacgtcgaggagatcctcgccatccgcctgctcggggtgatcccggaatcccaggccgtgctcaaggcgtcgaaccagggcgtgccggtgatcctcgacgagcagagcgacgccggccaggcgtacagcgatgcggtcgaccgcctgctcggcaaggaaataccgcatcgattcctcgatgtgcagaagaaaggattcctgcaaagactgttcggaggacgtgaatga

SEQ ID NO: 5064 - DNA, 843 bp, Pseudomonas aeruginosa
tccgcaagtacgtaccgatcgaccaggagcagatccaggtggaactggagaaccagggcaactgctcgatcctggaactcaacatcaccctgccggatcgttgattcgcccagggtccatactgcggcggccattggccgccgcagtcgtttcaccgagcctgcccgccaggctccctgccgcctcccggcgatgagcccgttcgctatgccgctgtcccagatccgaatcgttcaccaggatgacgccctgctggtggtcgacaagcccaccctgctgctgtcggtgcccggtcgcgccgatgacaacaaggactgcctggtcacccgcctgcaggaaaacggctatcccgaggcccgcatcgtccaccgcctggactgggaaacttccggcctgatggtgctcgcccgcgacgccgacagccaccgcgagctgtcccgccagttccacgaccgcgagaccgagaaagcctataccgccctttgctggggcctgccggaactggacagcgggcgcatcgaactgccgctgcgctacgacccgccgaccaagccgcgtcacgtggtggacttcgagcacggccgccacgccctgaccttctggcgtgtgatcgagcgtcatgaacgctggagcagggtcgagctgacgccgatcaccggccgttcgcaccagttgcgcgtgcacatgctctccatcggccatccgctgctcggcgaccgcctctacgccaaccccgaagccctcgccgcccacgaacgcctgtgcctgcacgccagcctgctgtgcctgacccatccgcagagcggcgaacgcctgcgcttcgagtcgccggcgccgttctga

SEQ ID NO: 5065 - DNA, 1458 bp, Pseudomonas aeruginosa
gccttccccgccgcgtcccggcccgccgggacgccgcccgccgatttccggtaccccgtcttgccatacaacgaccagcttccgctttttctggccggccccgccgccaacgacctgaaccccgtcggacaatacgatagactgcatggattgccgtccggagccactatgcgcgcagaactcaaccagggcctgatcgatttcctcaaggcctcgcccacgcctttccatgccaccgccagcctcgcccgccgcctggaagccgccggctaccgccgcctcgacgagcgcgacgcctggcacaccgaaaccggcggccgctactacgtgacccgtaacgactcgtcgctgatcgccatccgcctgggccgtcgctcgcccctggaaagcggcttccgcctggtcggcgcgcacaccgacagcccctgcctgcgggtcaagccgaacccggagatcgctcgcaacggcttcctccagctcggcgtcgaagtctatggcggcgccctcttcgccccctggttcgaccgcgacctgtcgctggccgggcgcgtcaccttccgcgccaatggcaagctggaaagccgcctggtcgacttccgcaaggccatcgcggtaatccccaacctggccatccatctcaaccgcgccgccaacgagggttggccgatcaacgcgcagaacgaactgccgccgatcatcgcccagctggcgccgggcgaggccgccgacttccgcctgctgctcgacgaacagctgctgcgcgagcacggcatcaccgccgacgtggtactggactacgagctgtcgttctacgacacccagtccgccgcggtggtaggtctcaacgacgagttcatcgccggggcgcgcctggacaacctgctgtcctgccacgccggcctggaagccctgctcaacgccgaaggcgacgagaactgcatcctggtctgcaccgaccacgaggaagtcggttcctgttcgcattgcggcgccgacggcccgttcctcgaacaggtactgcgccgcctgctgccggaaggcgacgccttcagccgggcgatccagcgctcgctgctggtctcggccgacaacgcccatggcgtacacccgaactacgccgacaagcacgacgccaatcatggcccggcgctgaacggcggtccggtgatcaagatcaacagcaaccagcgctatgccaccaacagcgaaaccgccggcttcttccgccacctctgtcaggacagcgaagtgccggtgcagagtttcgtgacccgcagcgacatgggatgcggctcgaccatcggcccgatcaccgccagccaggtcggcgtgcgcaccgtcgacataggcctgccgaccttcgccatgcactcgattcgcgagctggccggcagccatgacctggcgcacctggtcaaggtgctcggcgccttctacgccagcagcgagctgccctga

SEQ ID NO: 5066 - DNA, 597 bp, Pseudomonas aeruginosa
acaaggacaaggcctgatcatgtcgttcgtcagcgtcgaacagctcgacaagagctacggtgccaccagcatcttccgcgatatcgacttcgccgccgcccgcggcgagttcgtcaccctgctcggccccagcggctgcggcaagtccaccctgctgcgctgcatcgccgggctgaccgaggtcgacagcgggcgcatcctcatcgacggcgaggatgtggtgcctttgccgccgcagaagcgcgggatcgccatggtgttccagagctacgcgctgttccccaacatgaccgtgcaacagaacgtcgccttcggcctgcgcatgcagaaggtgcctgcggcggaactgaagcagcgggtcgccgaagccatcgaactggtggaactgggcgagtacgccgcacgctacccgcaccaactctccggcggccagtgccagcgcgtggcgctggcccgctcgctggtgacgcgcccgcgcctgctgctgctcgacgagccgctgtcggccctcgacgcgcgcatccgcaagcacctgcgcgaacagattcgccgcatccagcaggagctggggctgaccacggtgttcgtcacccatga

SEQ ID NO: 5067 - DNA, 1311 bp, Pseudomonas aeruginosa
ccaggaggaagcgctgaccctgtccgaccgcatcgtcctgatgaacgccggacgcatcgtccagagcggcgacgcggagaccctctacaccgcgccggaaaacgccttcgccgccggcttcatcggcaactacaacctgctcgacgccgaacaggccagccgcctgctcggccagccctgcgcgcaacaggtggcgatccgcccggaatccctgcgcctgggcaacgaaccgagcgaaggcgtgccggcgctggtacgctcgcacagtctgctcggcaacgtgatccgttaccgcgtcgaggccgccggggtggaactcaccgtcgacgtcctcaaccgcagcgcagaccgcctgtatccggccggcagtcagctgacgctggtcatcgatcgcaacagtattcgagaggtagcttgatgagcctggtgatcttcgacctggacgagaccatgatccactgcgactgctccagcctgtggagccagcgcatggcgagtctcggctgggtcgacgaatccttcgtccgccacgacgccgaactgatggagcagtacgccgaaggcaagctgtccatggacctgtacatggactacaccctgcaaccgctgatcggtcgcagcgtcgaggaagtcgagcgggaagtggaggcctacgtcgaggaggtcatcgagccgctgatctacagcgacgcctgcgcctgcctggcgcgccaccgcagcgccaacgaccgggtgctgatcgtctccgcatccggggtgcacctggtcaagccgatcgcggcgcggatcggcgtcgacgaagtcctcgccatcgatctcgaagtgctcgacggacaatacaccggccgcaccctcgggcaccctcacctatcgcgaaggcaaggtattgcgtctgctcgacctgctggaaggagacgatcgccaactggccgacgcctggttctattcggactcgcgcaacgacctgccgctgctgaagctggtcggccatccgaatacggtcaatccggacccgaccctgctcgcctacgccaaggaaatgggctggccggtcaacacctggcgctgacaggctcgctgcgaaagcgcgagcggatcgcgctttccatcgcctcgccgaagcggcccttcaggccagcgacgggtccaccaccagcacgaccttgccctgcacctggttgctcgccaacgcctcgaacgccgcctcggcgtcgccgatcgggaaggttcgctccagctgcgcgcggagtttcccggcggagaacaatggccagaccttcaaccccagttcggcgatcaactgcgccttga

SEQ ID NO: 5068 - DNA, 1191 bp, Pseudomonas aeruginosa
agtggtcaagctgatccgtgggccgaaaggttcccaggtacgcctggaagtgattccggcgagcaacgcgccgaacgaccagaccagcaagatcgtcgccatcacccgcgaggcggtgaagctggaggaccaggcggcgaagaaatccatcatcaaggtcgaccacgaaggccgcagctacaagctcggcgtgatcgacctgccggccttctacctggacttcaaggcctaccgcgccggcgacccgaactacaagagcaccacccgcgacgtgaagaagctggtcgccgaattgcagaaggacaaggtcgacggcatcgtcctcgacctgcgcaacaacggcggcggctccctgcaggaggccaccgagctgaccggcctgttcatcgaccagggcccgaccgtactggtgcgcaacagcgacggccgcgtcgacgtgctcaacgacgacgaaggcaaggccttctataccggcccgctggcggtactggtcaaccgtctctcggcctccgcctcggagatcttcgccggcgccatgcaggactaccaccgcgcgctgatcctcggtggacagaccttcggcaagggcaccgtgcagaccatccagccgctcaaccacggcgaactgaagctgaccctggcgaagttctaccgagtctccggtcagagcacccagcaccagggcgtgatcccggacatcagctacccgtccatcgtcgacgacaaggaaatcggcgaaagcgccctgcccgactcgatgccctgggacaccatccgcccggtggtgaaggacgaggccaacccgttcaagccgttcctcgcgcaactcaaggcccagcacgacgcgcgcaccgagaacaacgccgacttcgtctacgcccgcgagcgcctggcgctggcccaggagctgatgaaggagaagaccgtcagcctgaacgaggccaagcgccgcgcccagcagaccagcatcgagaaccgccagttggccatggagaacgccctgcgcaagtccaagggccaggagccgctgaaggaactcaagcgcgaggacgagaacgccctgccggaagaggacgacaagaccaagccgcaggacgacgcctacctcaccgagtccgggcacatcctgctggactacctgaacctcaactcggcggtggccaagcactgagttcagcgggagcgtcataa

SEQ ID NO: 5069 - DNA, 1824 bp, Pseudomonas aeruginosa
aacagtcatgggactgtcgtgaaatacggggccggttgcacaaccggccctttttcattgcgacgagagcgttccatgaccgtcaccgagcagttgagcgccctggacagcatcctggcccacggcgacctgcactgcctgttccagcccatcctctcgctttccgaacggcgcctggtcggctacgaagcgctgacccgcggtccgtccaacagcccgctgcactcgcccctggcgttgttcgccgtggcccgccaatgcggacggctgagcgaactggaactactctgccgacaacgcgccttcagccgcttccgcgacatccagggcgacgccatgctgttcctcaacgtctccccggagtccctcctcgaggccggtcatccgcccggccgcaccctgcaattgctgcaacagctggggatctcgccgaaccgggtggtgatcgaactgaccgagcagacccccatcgacgacttcgacctgctcgacaccgcgctgcaccactatcgcgccatgggcttctccatcgccctcgacgacctcggcgctggctactccagcctgcgcctgtggtcggaactgcgtccggactacgtgaagatcgaccgccacttcgtcgacggcatccacctggacaccgtgaaacgcgagttcgtcggctccatcctgaagatggcgcgggcctctcgcgcccaggtcatcgccgaaggcatcgaactgcccgaggaactcgcggtgcttagcgagatgggggtcgacctggtgcaaggctatctgttcggccgcccgctggaacacccggcgagcgacgtacaacagatgctgcccagcgctgacgcccccagccagtcttccagcgacgagcacggcgacctgcgtgcgctgctgctggaacagcgcgcggtcgacgttcgcacctcgacccaggaagtggtggaaatcttccgccgccaggccaacctgaactccctggcgatcctcgacgaagaagggcgtcccatcggcatcgtccatcgccacgcgctcaccgacgccttgctccggcccttcgcctgcgacctgttcctgcgcaagccgatcagccgcctgatgagcgacgattttctcgccgtggaactcggccagaccctgcagcaggtcagccgcctgctgaccagccgcgcacgccagcgtatcgaggaagatttcatcgtcacccgcggcgggcactatgcgggcatgggccgggtgatcgacgtgctcaggctgatcaccgaggaaaagctccagcaggcgcggcacgccaatccgctcaccttgcttcccggcaacgtgccgatccagcaatgcctcgaacacctgctgcaacaaaggcgcgaggcggtgatctgctacatcgacgtcgacagcttcaaacccttcaacgatctctacggctacgcccgcggcgacgaggtcctgctgtgcctggcacagtgcctgagcgaacggatcgacccgggcagcgacttcgtcggccacatcggcggcgacgacttcatgctggtgctcggccccgaggactggcgcacacggatcgaccggttgctggaaaccttccagagccaatgccggcgcttctacagccgcgagcacctggacgccggctgtttcgttgcgcacaaccgccatggccagcgcgaggagtacccgctgctgtcattgtccgtcggcgtggtgcatctaccggccgaagcctgccagggaatggatgccgcgcacctggcgacgctggcctccgaggccaagcgccaggccaaggcagtgccaggctacagcctgcacctgatcgagaccgcctga

SEQ ID NO: 5070 - DNA, 1467 bp, Pseudomonas aeruginosa
acaggggaattggtcgccatgcgttttctcgcgtgcgaaggaacccacccgtgccgctcggcggcacggagccagtcgggaggatcgagcggagccctggccgggatccgcgccagggacttactgcgccgccgcctcgatggcggccgccagttgctgggcggccttctgcggatccgcggcggggtcgttgaagaagttggtcaccacgtcgaagatcgccccctgcacgtagctggaagcggccatgctgtgggccatgctcggcaccaggttgccgtcctgggaagcctgcttgaagtccttcatcgactgctgggcgcaactgtcgaacggcgccatgtcggcgtccaggcgaaccgggatggagcccttgttgaggttgaagtccttctggaaggacgggtcgagcacgctgcgcgccaggtcttcctgggccttgcggttctccgcgttgctcagcttgaacatcaccagcgagtcgatgttgtagtcgaaggctttctgcgtgccggggaacggcaggcactggtagtccttgcccggcaccttgccggcggcggtgaactcgctcttcgcccagtcgcccatgatctgcatcccggccttgccgttgatcaccatcgccgtggcggcgctccattcgcgaccggcggcgtcggcatcgacatagccgcggagcttcttcagcgcggcgaacacctcgaccatctgcgctccggtgagggtcgccttgtcctgttcgacgaaggccttgcgatagccttccggacccatcttgctcagcaccaggttctcgaacacggtgccgtcctgccacggttggctgccatgggccagcggcgtgaaaccggcggccttgagcttgtcggcggcgacgaacagttcgtcgagggtggtcggcggggtggcgccggccttcttgaacacttccgggttgatgtagagccagttcacccggtgtacgttgatcggcactgctacgtagtcgccgtcgtacttcatgatctgcgccacctgcttcggcagcaggctgtcccacttgccttcggcggccaccgcgttgaggtcggcgagcaggcccagttcgccccactcctggatatccggccccttgatctgcgccgcggccggcggattgccggacaccgcgcgggtcttcagcacggtcatcgccgcctcgccgccaccgccggccacggcgaagtccttccaggtgtggcccttggcttcgaccagcttcttcagggtttcggcggcgcgcttctcgccggcggaggtccaccagtgcagcacttcgacttcgccggcctgggccagcagtggggagagacagagggaggaaagacagatgacggcagagaggcgacggatcgcattcatgaggaaaaccttcttcttgttattcggagcaagtctgcgcttgcaatgcttcgagtctattcaagcgttccgcgtcgcgggtaa

SEQ ID NO: 5071 - DNA, 234 bp, Pseudomonas aeruginosa
aggcgaacagctcgcggccgcaaccgagattgccgtcgtgcggcgccggctccaggctgcgcgcctgccattcggcgtcgtggaccagcacccgcaactcgccgttcaccccatccacccgcacccggtcgccgtcgcgcaggcgcgccagcggaccgccggcgatggcttccggactcacatggatggccgcgggcaccttgcccgacgccccggacatgcgcccgtcggtga

SEQ ID NO: 5072 - DNA, 468 bp, Pseudomonas aeruginosa
cgaaggaggcaccgggcaggggcgggcccatcacctccaccagcaactggttggtattggcggcgccatagaaggtgcaggtgccgggtgcatggtaggaggccatttccgaggccagcagctcttcgcgagtggccttgccctcggcgaacagttggcgcaccgcggccttttccttgttggagatgccggtcggcatcggcccggccgggacgaacacggtgggcaggtggccgaagcgcagcgagccgatcagcaggcccggcacgatcttgtcgcaaacacccaggcacagcgctgcatcgaacatgttgtgagacagcgcgatggcggtggacatggcgatcacgtcgcggctggccagcgacagttccatgcccggctcgccctgggtcaccccgtcgcacatggccggcacgccgccggcgaactggccgaccgaaccgatctcgtgcagcgcctgcttga

SEQ ID NO: 5073 - DNA, 540 bp, Pseudomonas aeruginosa
attctacagggtgaaacgacggtcagcggcgcggccagtcgtcgtcggcgtccagtgcctcgcgctcctcgcgcatggcctccgccagggcgcgctcctcgtcatcgggatcggcgcccgcgacagcctccgcgacggcaggctcgacggcttgctccgcgaccacgggaatcggcccagccgctggctcggcggactcgtcgccctgctccgagggctccggagggtcgagcaggtcgtcgaagtcggtcttcaggccctgctccatctcgtccagttccagcagcaggctgcggaagctggtttcctcgcgcggcttctccggctcgccggcctccccctcgatctcctcgaggctttccccggcctcggcgatggcgcgatcggccagggcctggatcgaggcaggaatcgcatcctcgtcgagatcgtcgcgcggcggctgcgccgcgggcgccacttcgaccggcggttccggctcgggctccatctcgcgcagcgccgacagcggcggcagctcgtcgaggctcttcaggttga

SEQ ID NO: 5074 - DNA, 711 bp, Pseudomonas aeruginosa
caggccacggcagggagcgaagccggaagctcggaaaaggcgaccgtccgcaggaggacgaacggccagcggcgcgctcactcgaaatcgtctcccagggcttcctccagggtttcgccttcctccgcttcgcgggctatccgcaggcgcacatggatggcgccgaaagcctcgttctgcaccagttccaccatctgctccttgaccagttcgaggatcgccatgaaggtgaccaccacgccgagcttgccctcctccagggtgaacaactggatgaagggcacgaaggcgccgcctttcaggcgctccagcacttcgctcatgcgttcgcgggtggacagtacctcgcgggtcacctggtggctctcgaacaggtcggcgcggcgcagcatctcgcccatcaccagcatcagctcctgcagcgccagctccggcagcagcttgcgcgcccgcgcctcgggagcagccaccgccggcaccagcacgtcgcggccgacccggggcagttcgtcgaggtcttcggcggccttcttgaaccgttcgtactcctgcaggcggcggatcagctcggcccgtggatcttcctcttcctcctcggcttccgccgagcgcggcagcaacatgcgcgacttgatctccgccagcatcgccgccatcaccaggtactcggcggccagctccaggcgcaccgccttcatcagctcgacatag

SEQ ID NO: 5075 - DNA, 771 bp, Pseudomonas aeruginosa
accagcgccagttgcagcggcacccgctcggcggcgggttcggctggaggggtgtcggcgttggccgggttatcgtcctgcatcgctaggctcgtggtgggcggattcgggcggcgctcaggccggctgcatgaacggcgccggatcgccgcaacccacgcggatcacttcgggatcggtgtcggtcaggctgatcacggtggaggcctcgccgccgccatagcccccgtccacgatcaggtcgacctggtgttccagtacctggcgcatttcatagggatcgttcagtggctcgccgctgccgggcatgatcaggctcacgctcatcagcggctcgcccagttcctccagcagcgcacgggcgatcgggcagttcggcacgcgcaagccgatggtgcggcgcttggggtgcaggagcatgcgcggcacctcgcgggtggcgctgaggatgaaggtgtagggaccgggggtgtgcgccttgagcaggcggaacaggccggtgtcgaccttggcatagacgcccagctcggaaaggtcgcggcagaccagggtgaagttgtgcttgtcgtccagttggcggatgcggcggatgcgatccaccgcggtcttttcgccgatgcggcagcccagggcataggacgagtcggtgggatagacgatcaccccaccctggcggacaatttccaccgcctgcttgaccagccgcggctggggattttccggatggatctggaagaactggctcattcggcccccttggcttcggaatga

SEQ ID NO: 5076 - DNA, 1056 bp, Pseudomonas aeruginosa
atccggcgctggacgcacgccacggccggctgcgcctggacatcctcggccaggcggaagaaggccggcgctggctgccggcggccgtggaagccgcccgacgactggccggctggcagggcggacgactgctctggcacgcccagggcgcgtattggtgcgtacgcctgctgttgccgctcagcccggccaggcgctgacgaaggccgacgggtcgagttccgccggcgtgcgcaactcgcccatcggcgtccccaggtagacgaagccgatgatccgctcctgctcgccgagccccaggccggcgtgcaccaccggatcggtggccatctcgccggtccgccacatcgcccccagtccctgggcataggcgcccagcaccaggccgtgggcggcgcagccggcagccagcagttgctcagcgtgcggcaccttcgggtggtcctgcaggcaagcgaccgccacgaccagcagcggtgcgcgcagcggcatgttgcgggccttggccagcgcttcctcggcggcgtccggctggcggctcgccagggcgcgggcgtagaggtcgcccagggcccggcggccttcgccctctaccaggatgaagcgccagggccgcagttgcccgtggtccggggcacgcaaggcgacccggaacagccggtcgagctgctccggcgagggcgcgggatcgctcaggcgggcgtgggaaacgcgagtgagcaaggcgtcgagagcctccatgggcgaactcctgtcagaaacgaaatcgccattgtagacgcaatcgccaggctcacgcccgctctcaggcgacccgtcccggcgccaggtgcggctgcagcggcggggtcagcggcggcaggccgtaggcggcgcgcgcggcatcgcaggccgggttgggctggccgttggcccaggccgcctcgaactcgcggcaggtactcgagcgctgctcgtagacggtgcagcgaacgccgcaaccgacctcgccgagcagcccgacgcagcgtgccggcttgttctcggtaccgctcatggcaaccatctgcgggctga

SEQ ID NO: 5077 - DNA, 528 bp, Pseudomonas aeruginosa
ccatgctcgccttcgaccgtaccgaaggcatccaggcattcatctggtccagcgtcgccaccttcgtcaccggcctcggcctggtcctgccgggacgtcccgagcatgtccacctgcgcccgcgggacatgtacatgctcaccgtatcgagctgggtgctggtatgcatcttcgccgccctgccgttcgtcctgcagcagcacatcagctacaccgatgccttcttcgaaagcatgtcgggaatcaccgccaccggctccaccgtgctcagcgggctggacgacatgtccccgggcatcctcatctggcgctctctgctgcactggctgggcggcatcggcttcatcgccatggccgtggcgatcctgccgatgctgcggatcggcggcatgcgcctgttccagaccgaatcctcggaccgctcggaaaaggtcctgccacgctcgcacatggtcgccaagtacatcgtcgccacctatgtcggcatcaccctgctcggcagcctggccttctggggcgcgggcatga

SEQ ID NO: 5078 - DNA, 663 bp, Pseudomonas aeruginosa
tcctgctcgacgccctcgccgcgctgttcttcatggagatgggctggtgaaccaggacaacccgcaggcgatcatccaggtccgcgacctgtgcaaccgtttcggcgcccaggtggtccacgagcacctcgacctcgacgtccgtcgcggcgagatcctcggcgtggtcggcggctccggcaccggcaagtcggtgctgctgcgcagcatcgtcggcctgcgccggccgacctccggcagcgtgcgggtgttcggcgaagacctgctgcaactgccagaggagcgccgctccctggtcgaacggcgcttcggcgtgctgttccagcagggcgcgctgttttcctcgcttaccgtggtggagaacgtcgccctgccgctgatcgagaacgccggcctgccgcgcgccgacgccgagcacctggcccaggtcaagctggccctggccgggctaccggccaacgccggcgacaagtatccggcctcgctttccggcggcatgatcaagcgcgccgccctggcccgcgccctggcgctggacccggacatcctgttcctcgacgagcccaccgccggcctcgacccgatcggcgcggcggccttcgacaacctgatccgtaccctgcgcgacgccctcggcctgaccgtgttcctggtcacccatga

SEQ ID NO: 5079 - DNA, 843 bp, Pseudomonas aeruginosa
tcagcgagaatcgccactcgctggacggcggcatccagggactcgccgagctgggcccggcggtcagcgaactgcgcgataccctggcggcactgcgcggaatcagccggcgcctggaagagaacccggcgaactacctgctgggccgggaaaaaaccaaggagttcaccccatgaggctcgcccttcgcccgctgcgtcgcctgtccctggccgccggcctggccgcgctcgccaccctcggcgcctgctcgatcctgccggaggcgcaggtcctccaggtctacctgctaccggtgcacaaccctccggccagcgccgccgcgcggccggtcgactggtcgctgcggatcgcccggccgcgtaccagcctggtgctggagagcccgcgcatcgcggtgcgcccgcacggcgacgaaatcagcgtgtaccagggcgcgcgctggagcgatccggcgccgtcgctgctgcgcgatcgtctgatgcaggcgttccaggccgacggccgggtccgcggcctgagcagcgacgacagcaacctgcaggccgatttcgaactgggcggcgaccttcgcgccttccagaccgagtacccgaacggccaggccagcgcgctgatccgctacgacgcgcgcctggtgcgtaccgacgacaagcgcgtggtcgccagccggcgtttcgaggtcagccagccggtggatggcaagaaggtcgcggcggtggtcagcgccttcggcaaggccggcgatacgctgtcggcccaggttctcgactggaccctacgccaggcctcggcgcaacccgccgtgcagccctgaagcgtcccgcctggcctggcgactag

SEQ ID NO: 5080 - DNA, 393 bp, Pseudomonas aeruginosa
actggccctgtatgtcatccgcgacatcgtgcggcccgcattacactgcgcggacacaacgagaggaggcattccatgagcagccctgatgacgagcgtttccacagtttcgccgagttctacccctactacctgcaggaacacagcaacgcggtgtgccgccgcctgcactacgtcggcagcctgctggtgctggcggtgctcttccacgccgtggccagccagcagtggctatggctgctggcgctgccgctggtgggctacggcttcgcctgggtcggccacttcgtcttcgagaagaaccgcccggccaccttcaagtacccgctgtggtcgttcatgggcgactgggtgatgctcaaggacgctttcaccggccgcatccgcttctga

SEQ ID NO: 5081 - DNA, 1608 bp, Pseudomonas aeruginosa
cccatccgcgcggctggcccccgggccggtcgctcccccgggacgaccgtcggtcccggatcggcgcgctttcctgaactatcgatcagctgtcactggccgccgcgcaaacgcttggttaagattccgccagcaacctggccacccgccattccccaggcggaaagctcacgaggccgagccgggacgaaaatacacagggatcctctccagcgcatgaagcctaccctccccgaccgctcgccgacgagccggtccgtcgcgtccatgcgtgaatactattcgcgcgtgctggcctatatcgcctgtggcgccagcatcgcggcgggaacctacacccagtatttcagctacggcatcctctggatggtgccctatgcgctgctctacccgcacctggcgtaccacctcggccagcgcttccgccagcacgacccgcgcaaggtgacccgcgccctgctcgcggtcgacgccgtgcactgtggcctgggcatggcgctgctcggcttctccgtggtgcccagcctgatgttcctgctggtgctgagcttcaccgcgctggtcatcggcggcctgcgcctgctcggcatggccttgctggtatcggccagcagcgccctgctggtcgccgtgctcgtcgccccgccgctgctgggcaataccccggtcgaggtggccgcggtcagcatcctgttctgcggactgtacatctgcatcaccgccttcttcggccaccagcagggcctgcgcctggcccaggtgcgccaggagatcgcccgcgagcaggaaaaggccgcgcggctcgcgcgcaacctggccaagtacctgtcgccgcaggtctgggaaatgatcttcagcggcaagaagagcgtgcgcctggaaacccagcgcaagaagctcaccgtgttcttctccgacatccgcggcttcaccgagctatccgaggaactggaagccgaggccctgaccgacctgctcaacaactacctcaacgaaatgtcgaagatcgccctcaagtacggcggcaccatcgacaagttcgtcggcgactgcgtcatggtgttcttcggcgaccccagcacccagggcgcgaagaaggacgccgtggctgcggtatcgatgggcatcgccatgcgcaagcacatgaaggtgctacgccagcagtggcgggcccagggcatcaccaagccgctggaaatccgcatgggcatcaacaccggctattgcacggtgggcaacttcggcgccgacacgcgcatggactacaccatcatcggccgcgaggtgaacctcgccagccgcctggaaagcgcctcggaagccggcgaaatcctcatttcccacgagacctactcgctgatcaaggacgtgatcatgtgccgcgacaagggccagatcgcggtcaagggcttcagccgcccggtgcagatctaccaggtggtggactcgcgccgcgacctcggcgccgcgcccagctacgtcgagcacgaattgcccggcttctccatgtacctggacaccaacaacatccagaactacgacaaggaacgggtcatccaggccctgcaacaggccgccgaacgcctgcgcgacaaggtcatcctctaa

SEQ ID NO: 5082 - DNA, 570 bp, Pseudomonas aeruginosa
ccccggtcacgccctgctgcaatacatccagcggccccggcacggcgaaggccgccaccggcacgccacaggccagggcttcgagcatcaccaggccataggtatcggtcagcgaggggaacaccagcaccgaggccgcccggtaggcgtcggccagcgcgcggccatggcggtagccgagaaaacgcgcctgtggatagcgctgctccagcgccgcccgctgcgggccgtcgcccaccagccatttttcgcccggcagttcgagatcgaggaacgcctccaggttcttttccgtcgccagccgcccgacatacaggaacaccggcggccgctctttcgccggaggtgtctcggcgggatggaacagttcggtatcgacgcccttgcgccacagccgcaggtgctggaagcgccaggcgcagaactcgtcgcgcaggcgcggggtgctcaccagcaccgcccggctcggccgatggaaggtgcgcaggaaggcatagccccaggacaacggcagccacggacagcggtcacgcaggtattcgggaaagcgcgtatggatcgccgaggtga

SEQ ID NO: 5083 - DNA, 666 bp, Pseudomonas aeruginosa
ccgacctggcgcggctggccggtctttcggtggcgcgcttccacagcctgttcctcgccgagaccggacagacgcccatggactacgcgcgcagccgacgcctgcaccaggcccacgaactgttgctggagagcagcctggcggtgggcgagatcgccgcccgggtcggctacgcctcgcagagcgccttcaccgcagcgctggtccgcgagttcggcgtcaccccgcgacaactgcgtcgcgagtcccgcgacaaaaccggctagccgcacgacagacaaatccgtcacgactccttactctctgcccatcgacagaacaggagtcagcatggacatcatcgaatggcaggatttcgaacgcgtcgaactgcgcgtcggcaccatcctcagcgccgctcccaaccccaaggcacgcaaacccgcctatgtcctcgaggtcgacctcggaccgctcggcctgcgcacctccagcgcgcaactgaccgcacactaccaggccgagcaactggtcggacgccaggtcctctgcgtctgcaacttcgctccgaagcagatcgccggggtgcgctcggaggtcctggtcaccggggtctacgatagcgaggacaaggtggtcctggccggcttcgacaagcccctgcccaacggtgcgcgcctggcctga

SEQ ID NO: 5084 - DNA, 909 bp, Pseudomonas aeruginosa
aggatccccatgaatcgacgttccgccctcgccgccctgcacggcggcgccctcctcttcggcctgaccggggtgttcggcaagctggccagcgcctcccccggggtgatcgtgttcggtcgtgcgctgttcgcggtgctcgccctcggcctcttcgcccgcctcgcgggccaggcctggcgcgccctgggacccgcgcaatggctgcgcctggcgctctgcggcctgctcctggccggccactgggtgagtttcttcatcgccgtgaagaccgccggcgtggccatcgccaccctcggcttcgccagcttcccggccttcacggtaatcctcgaagggctgctcttccgcgagcgcattcatctcgcggaaggactgctggtggtcctggtcagccttggcctggtgctggtcacgccgaacttcgacctcgccagcggcgccaccctcggcctgctctgggcgatcctttccggcctgctgttcgccctgctgtcgctggccaaccgtagcaacagcgggcaggtcggcccggtgcaggcggcgctctggcagaacctggtagtcgccctgtgcctgctgccattcgcggtcggcgaactaccggcgctacccgctctcgactggctctggctggccctgctgggcgtcttctgcaccggcctggcgcacagcctgttcgtggccagcctggcggtggtcaaggcccgcaccgcggcactggtattcgccctggagccggtctacgggatcgccttcgcctggctgctgttccatgagacgccggggccgcggatgttcctcggcggtgccctgatcatcctcgccatcgtgctgtcggcgcgcctcggtgcacggggcaggaaaaccgcagtcggcgacgaacgaggcgatcccgagcgcgcctga

SEQ ID NO: 5085 - DNA, 960 bp, Pseudomonas aeruginosa
  unsure (503): Identity of nucleotide at the above locations are unknown.
gccagggcggcgtgcggcagagccgcttctacctctacaccaacaaggaaaagccgctcggcccggccagccagatcctcatggaaatgctcaagtcgttcgccaacgtaccgctcaacgcgcccttcgcggcgcccgaaccggccgccgagtgaacgcagatgcctgacttccagcaccgcgactgcaccctcgtgtacgacgaccaccccggtcccaccgtgcgcgcgccggtcctgttgctgcacggtctcggttcgagcgcccgcgactgagaataccagttgcccggccttgttggcccaataccgccttgctgggtccccggacatgcgcgggccacggccgttccggcaagccgcgcggcggatacagcatggccggtttcgccgaggactgcgcggcgctgctcgaccggctcggctgcggtccggtacacctggtcggcatcagcatgggcgggatgatcggcttccagttggcctgcgaccgacccgacctgntgcgcagcctgaccatcgtcaacagcactccggaagtcatcccgcgcaagcctcgcgaacatctggaggtggccaagcgcaagctcctctcgcgcctgctcagcctgcggaccatcggccgcgccctcggccggctgttgtttcccaaggcggaacaggccgggctgcgagagaagatcgaggcgcgctgggcggagaacgacaagcgcgcctacctggccagcctcgacgcgatcatcggctggggcgtgcaggaacgattggccgagatcgcctgtccgaccctggtgatcagcgcggatcgcgactacacgccggtatcgctgaagcaggcctattgcgagcggatcgccgacgcccgcctggtggtggtggaggactcccgccacgccacgccgatggaccaacccgagattttcaacaccaccctgctcggcttcctcgccgatatcgataa

SEQ ID NO: 5086 - DNA, 579 bp, Pseudomonas aeruginosa
aaccaaggaacaaccatgctcaaacgtctcctgatcgccgcctgcaccctgctcttcgccggttccctgctggccgccactcctgccgccaagccgcacgtcctgatcgccaccagcctcggcgagatcgaggtagaactcgatccggccaaggcgccgatcagcgtgaagaacttcctcgagtacgtcgacagcggctactacgacggcaccctgttccaccgcgtgatcccgggcttcatggtgcagaccggcggcttcagcgccggcatgcaggagaagaagacccgtgcaccgatcaagaacgaggccgacaacggcctgcttaacgagcgcggcaccctcgccatggcccgtaccggagtggtcgattcggccaccagccagttcttcatcaacctgaccgacaacgacttcctcaaccatggtgcccgcgacttcggctatgccgtgttcggcaaggtggtgcgtggcatgggcgtggtcgaccagatcgccaaggttcccaccacccgccgcaacggcttcgccgacgtgccgagcgacgacgtggtgatcctgtccgccaaacgcctctga

SEQ ID NO: 5087 - DNA, 1335 bp, Pseudomonas aeruginosa
cggcgagctgcacaagatccgcttcctcgaatggggcggcagcaccagcaacggctgagcggacgccacgccctatcgttccggcccccttcaggcctggcggtagggcaacaggccgtgggcctcctcggcgtaggcgcgcacacccgcccgctcctgttcgaggaactgcgccacggcatcgcgcagaccgggatgcgccaggtagtgccaggagcgcgtcagcaccggctcgaaaccgcggatcagcttgtgttcgccctgggcgccggcgtcgaagcgcgccaggccggcgccgatggcgaattccaggccctggtagaagcaggtctcgaagtgcagccggtcgaactcggccaggcatccccagtagcgcccgtacagggtatctccagcgaccaggctgaacgccatcgccaccggcttgccacgctggtgggcgaagaccacgcggatcgcctccggcatgcgctcggccagcaggccgaagaactcgcggctcaggtagggatcgcggtcgcgcaccaggtaggtgttggcgtagcagagatagacgaaatcccactccagttcggacaactggccgccttcccgccattcgaactcgatgccctgtccgccgacctgttcgcgctccttgcgcagttgcttgcgcttacgcgaactgagggcctcgaggaagtcctggaagtcccgatagccgcggttgtgccagtggtactggcaccccaggcgttcgagccaaccgtcacgcgcggcaagcaaggtgtccgcccgggcgtcggtgaaattcacatggatgctcgacagaccgctcgcctcggcctcctcgccaagggacgcgagcagcccctgcaacccttcgtcctcgcccagcaggcgcgcaccggcgaccggggtgaagggcacccctaccagcagcttcgggtagtagcggacaccggcccgctggcaggcgtcggcccagctccagtcgaacacgtattcgccgtacgagtgcgccttcacataggccggcagcgccgcgcacagccgcccttgcggatcgcgcagcacgcgatgagccgggcgccagccggtagcgggcgtcacgctgtggctgtcttccagcgcggacaggaaagcatgacgcaggaatggctgggcgggaggcagcaaggcgtcccactcggcggcgtcgatatcggcaagggtggcaagcgtctggatcggcatgcgcgccagtctggcgcgagacgcaaggcaagtgaagccggtcgatggaaaaaaagcgcccggcggacccgcgatgaaaccgcccttcaccaagcgaaggcttcgatccatcctacgtag

SEQ ID NO: 5088 - DNA, 1902 bp, Pseudomonas aeruginosa
ccatggtgttcatcgggtctccaggtggaattgacgggccacgctctgcttgaacttcttcaccacatgcaggccgtagcgcagcatgtcgcgatcgtggcggctcatgccgctgacgtccaggccctgctggcgaccgtcgcgttggccggccaactggcgggtcaggcgcagttgcaggaacagctcgaaagactcgctcaggtcgtccgccaggcgtgcttcgaggaccttgtgtcgcttcagcgcctcgatccgtgccagggtcccgcgggtctccaggccttcgcgcagggccagggtgcggatgccgtggacgatggggaagatcccgccgcgcttgagatcgaggcgggcgtcctgggttttcagctggccgaggaaggtcagcggcgtatcgaattgcagggccgccgccgcgatatccgccagccagcgctcgccgccgtcggcgaaaccgcgcagttgccgacgcaacggctcgaacagctgcaggttgccggccaccggccaggcatcggccaggatcgacaggcgcaacagctgctccggcttgccctccagcagcgtcccgcgcagctccgcctgccaggccaccagcggcttgcaccattccggccgactggccatcacccctccgggacagggcggataaccgaactccagcaaggccgcgctgaagcgctgcatcatcgccagggcctgttcctgcggcagatcgtcggccaggaccagggcattgtcctggtcggtcttcagcaactgctcgccgcgtccttcgctgcccatcaccagcaagcagcagcgcccgcgcagggttggcggcagcaacaattcgaaaagccgttcgagcaattgctcgttgagcgcgctgaccagctgcatgatgaagcgcaggcggataccgttgccggccagggtagcgatcagggtgtccagggtttccgcgcagcggcgcaggtcgccgaggtcgtcggcgcgggcgatgcgcagcgccaggacgtgggaatgggtggagaacaggctgagcacctgggtcaggtgcaacaggccgatcacctgaccgtcctccgtgaccgcgacccgctcgatacgctggcgcgtcatgaggatcatcgcgtcgaacaggaaatcgcccagttcgacgctggccagcggaccatgggccaacggcccgatagcctccagctcgctgcgcccgtcgcggaagtgcgcgctcatgaggtcggtgcgggtgacgatgccgagctcgggcccgtccctctccagccgcaccagcagggcatcggcgccgtggctcaattgcaggcgcgcggcgtcgccgagggacagcgaggcctccacctccagcgccggcagcaagtgctcgcgggcgatgcgggtaaggatgaactcggcaaggttctgcccgtcgcgctgggccaactggcgcttggccgccaggtcggcctggaagaaccgggcgaaacccgggttctccccgcacaactggtggaagcaactggccggcagttcgtagacgatgctttcctcgatcgccaggtagcgatgcttgctgctgccggaaaacagcccgcggacgtcgaacaggtcgtccgcggcgtactgggcgaacactcgcccgtcgtcgccgcgctcctcgaccacgcccttgagcaggacgaacagcccggggaccgccgaaccggcctccagcaaggtttcccccggcgcgtagtagcctacgctgagggcctgcttgagggtctcgcgctgatggggacgcaactggtcgaagggcggcgaggcgaagttgaaactgtcaggcatggctcatctcgctgtaaccgggacgctgaaacgaaaggcggcggaccggaaatccggccgccgcctcgggctacgtcttcacgtagcgcttag

SEQ ID NO: 5089 - DNA, 558 bp, Pseudomonas aeruginosa
atggctttctcgtggccgaggatctgcacccagatggtcgggccgaggaccatcaggcccaccgcggtgatcaggcccatccagccgccgatcatggcgccgcgggtggtcagcttcttccagtacatggagagcagcagcaccgggaagttgcagctggcggcgatggagaaggccaggccgaccatgaaggcgatgttctgcttctcgaagaggatgccgagcacgatggcgaccacgcccagggccacggtggtcatcttcgagacccgcagctcgtccttctcgttggccttgccgcccttgaacacgctggcgtacaggtcatgggagacggccgaggccccggccagggtcagcccggcgaccaccgcgaggatggtggcgaaggccaccgccgagatgaagccgaggaacaggctgccgcccaccgcgtcggccaggtgcaccgccgccatgttgttgccgccgatcagcgcgccggtggcgtccttgaagtccgggttggtgctgaccagcaggatcgcgccgaaaccgatgatgaaggtcaggatgtag

SEQ ID NO: 5090 - DNA, 1557 bp, Pseudomonas aeruginosa
actgcggcgagtatagccagaccccgcgcgcgtccggaatgcccgtcctcagcgcttgcgccgtttcggatagagcttggcttcgcctggcgggcgggtcttgaaacgccggtgcgcccacaggtactgctcgggctgctggcgcacgcagcgctcgacccactggttgatccgcaggcaatcggcttcctcgctctcgccggggaagtcctccagcggcgggtggatggtcaggcgataaccgctgccatcggccaggcggctctgggtgaacggcaacacccgcgcccggcccaggcgggcgaacttggtggtggcggtgacggtggccgccgggatgccgaacagcggcacgaacaggctctgcttggcgccgtagtcctggtccggtgcgtaccagatggcgcggccgccacgcagcaccttgagcatcgagcgcacgtcctcgcgctcgatggcggtggcatcgaggttgtgccgctcgcggccacggcgctggacgtagtcgaacaccgggttgtcgtgctcacggtacatgccgtcgatggtgtgcacctggccgagcagcgccgcgccgatctccagagtggtgaaatgcagggccatgaggatcaccccctcgccctgcgcctgggcctcgcgcagatgctccaggccttctatatgggcaagacgggccaggcgcgccttcggccaccaccagctcatggccatctcgaaaaaggcgatgccgctggaggcgaagttctccttcagcagaggctcgcgttcggcgggcgcacttttcccgaaagcacagttcgaggttgcgcgcggcaatctcgcggcgcgagccgaccaagcggtacatcagcgcccccaggccacggccgagcatcagcaggacgggatacggcaactgcaccaccagccagagcagtcccaggccgaaccagagcggccagtagcggggatggaggaaagcgctggagaaacgggggcgatccatggacggttccgacgacgatcaaagcccgccattctaccctgcccgccgtcccggcgggacgccgcgttgccgatcgatgccgccccggctatctgccacgcttgcgggcatccggcgttctcgttataagtccctgcaattcaacgaccgacaagccccatgagccaagccgacctcctcgatcaagaccccgtattccagctcaagggcagcatgctcgcggtgaccatcctcgaactggcgcacaacgacctggcgaggctcgaacggcaactcgccgacaaagtggcgcaagcgcccaacttcttccgcgacacccccctggtcatggccctcgacaagctgcccgaaggcgaaggtcgcctcgacctgccggcgctcctcgaggtctgtcgccgccacggcctgcgcaccctggcgatccgcgccgggcgcgaggaggacattgccgccgcccaggccctggacctgccggtgctgccgccctcgggcgcccgcgaacgaccgctggacatcaaggacagcgccccgcgcaagcctgccgaagagcccagcccgagcgccggtga

SEQ ID NO: 5091 - DNA, 264 bp, Pseudomonas aeruginosa
tcgccatccgcctgggccgtcgctcgcccctggaaagcggcttccgcctggtcggcgcgcacaccgacagcccctgcctgcgggtcaagccgaacccggagatcgctcgcaacggcttcctccagctcggcgtcgaagtctatggcggcgccctcttcgccccctggttcgaccgcgacctgtcgctggccgggcgcgtcaccttccgcgccaatggcaagctggaaagccgcctggtcgacttccgcaaggccatcgcggtaa

SEQ ID NO: 5092 - DNA, 981 bp, Pseudomonas aeruginosa
gagcaagtatgggctcaagcacatggataccgacatgagttcggcccaggagctggccaagttcaaggccgagaaggacaacgccagcgccgacatcggcgacgtcggcgccgccttcggccccatcgccgtgcagcagggcgtcagccagccgtacaagccgagcacctgggaacagatcccggcctgggccaaggaccaggacggccactgggcactcgcctacaccgggaccatcgccttcatcgtcaacaaacaactggtgaaggacgtaccgcacagctgggccgacctgcttcagggcaagtacaaggtcaccatcggcgacgtcagcgctgccgcccaggcggtcaatggggtgctcgccgcggccatcgccaacggcggcgacgagaagaacatcaagccgggcctggagttcttcggcaagatcgccaagcagggccgcctgtcgctgaccaacccggtgatcgccaccctggaaaagggcgaggtcgaagtcggcatcgtctgggacttcaacggcctcagctaccgccagcagatcgacccggagcgcttcgaggtgctgatcccctcggacggctcggtgatctccggctacaccaccatcatcaacaagtacgccaagcacccgaacgccgccaagctcgcccgcgagtacatcttcagcgacgccggacagatcaacctggccaagggcaacgcgcgaccgatccgcgccgagagcctgaccctgccggacgacgtgaaggcccaactgctacccaacgagcagtacgccaaggcccagccgatcaaggacgccaaggcctgggaggaaacctccaagcgcctgccgcggcagtggcaggaagcggtgatcatcaacatgcagtgacgcggagcgcggccgccctccccggcggccgccccgcatcgacggataccccgaatgcgccacgacgtcatcctcgtcctgttggacggcctcaaccatag

SEQ ID NO: 5093 - DNA, 1458 bp, Pseudomonas aeruginosa
cggcatcctgcacaacgacgtggtccgcctgagccaggaacagagcctgttccactacgcccgcgcggccggcctgagtaccgcggcagcggcctaccactgggtcagcgaactgtacaaccgcgcgccgttcgacccggcccgcgaccgccacaccgacgacagcgcactgccgatccagcgcggacacttctactggagcgaccactatccggactcgcacctgttcgccgacgcggaaagcctgcgccgccggcacgcaccgaacttcatgctggtccactcgatgaacatcgacgacgccgggcacaggcacggcctcgccagccccgcctaccgcaacgccgcgcggcgcgccgacgcactgctgtcggaatacctgcaccagtggctggcggccggctaccaggtggcgatcaccgccgatcacggaatgaacgaggaccgcagccacggcggcatcctcgaggaggagcgcgaggtgccgctgttcgtcttcggcgacgccttcagccgcgacgacctggcgcaaccgctgcagaccgacctctgcggcacgctctgcgaaatcctcggcgccgcccacgacaaacccgtctgccgggagctgctcgccccatgaaacgactctccggcaaatggctggcgctgctgttcctgctgcccttcgcggcgttcttcgtgattttccagatagcgccgctggcctgggtcgcgctgaacagcctgaaggccagcgacgcctggagcctggccaactacctcgagctgttcggctcgcccttctaccgccaggcgatccgccacagcctggagatcgccggctggtcgagcctgctcggcctgctcatcgcggtgctcggcagccattcgctgcgccacgtcgacagccgcctgcgcgacttcgtcatggccttctccaacatgaccagcaacttcgccggggtaccgctggcgttcgccttcatcatcctgctcggcttcaacggcgcgctgaccctgttgctcaagcaggccggctggatcgacgacttcaatctctactcgaagatcggcctgataatcctctacacctatttccagatccccctcggggtgatgctgctctacccggccttcgacgccctgcgcgaggactggcgcgagtccgccgcgctgctcggcgccaacggctggcagtactggcgacacatcggcatcccggtgctgaccccggcgctgctgggtaccttcgtcatcctcctggccaacgccctcggcgcctacgccacggtgtactcgctgaccaccggcaacttcaacgtgatcccgatccgcatcggcgcgctggtcgccggcgacgtgttccccgacccgaacatggccagcgccctggccatggtgctggtcggcctgatgaccctgatcaccctggtccaccaatggctgctgcgcaggagctaccatgtcgcgcgctga

SEQ ID NO: 5094 - DNA, 1782 bp, Pseudomonas aeruginosa
tcgacgtcctgccgcgctctaccatcgcctggtggtctgcgcgctgttcctgatcctggtcctgccgctggcggcgaccctgctctactcgctggccacccagtggtcggcgaccctgctgccggacggcctgaccctgaagtggtacctgacgctgtggagcgaccagcgcttcctgctggccttcgcccgctcgctgctggtctgcttcggcgccctggcgttcagcgtgttgctgatcctgccgctgatgttcgtcatccactaccacttcccgcgcctggacggcgtgataaacgtgctcatcctgctgcccttcgcggtgccgccgatcgtctcctcggtgggcctgctgcaactctatgccagcgggccgctggaaatgatcggcacgccctgggtgctggtcggctgctacttcaccatcgccctgccgttcatgtaccgggcgatcaccaacaacctgcaggcgatcaacctgcgcgacctgatggacgccgcccacctgctcggcgccagcacctggaaggcggcgctgctggtcgtgctgccgaacctgcgcaagggcgtgatggtggccctgctgctgtcgttctccttcctcatcggcgaattcgtcttcgccaacctgctggtcggtacccgctacgagaccctgcaggtgttcctcaacaacatgcgcaacagcagcggccactacaccagcgcagtggtggtctcctacttcgtgttcgtcctggtcctgacctgggcggccaatcgactgaacaaggacaaggcctgatcatgtcgttcgtcagcgtcgaacagctcgacaagagctacggtgccaccagcatcttccgcgatatcgacttcgccgccgcccgcggcgagttcgtcaccctgctcggccccagcggctgcggcaagtccaccctgctgcgctgcatcgccgggctgaccgaggtcgacagcgggcgcatcctcatcgacggcgaggatgtggtgcctttgccgccgcagaagcgcgggatcgccatggtgttccagagctacgcgctgttccccaacatgaccgtgcaacagaacgtcgccttcggcctgcgcatgcagaaggtgcctgcggcggaactgaagcagcgggtcgccgaagccatcgaactggtggaactgggcgagtacgccgcacgctacccgcaccaactctccggcggccagtgccagcgcgtggcgctggcccgctcgctggtgacgcgcccgcgcctgctgctgctcgacgagccgctgtcggccctcgacgcgcgcatccgcaagcacctgcgcgaacagattcgccgcatccagcaggagctggggctgaccacggtgttcgtcacccatgaccaggaggaagcgctgaccctgtccgaccgcatcgtcctgatgaacgccggacgcatcgtccagagcggcgacgcggagaccctctacaccgcgccggaaaacgccttcgccgccggcttcatcggcaactacaacctgctcgacgccgaacaggccagccgcctgctcggccagccctgcgcgcaacaggtggcgatccgcccggaatccctgcgcctgggcaacgaaccgagcgaaggcgtgccggcgctggtacgctcgcacagtctgctcggcaacgtgatccgttaccgcgtcgaggccgccggggtggaactcaccgtcgacgtcctcaaccgcagcgcagaccgcctgtatccggccggcagtcagctgacgctggtcatcgatcgcaacagtattcgagaggtagcttga

SEQ ID NO: 5095 - DNA, 330 bp, Pseudomonas aeruginosa
tcgtctccgcatccggggtgcacctggtcaagccgatcgcggcgcggatcggcgtcgacgaagtcctcgccatcgatctcgaagtgctcgacggacaatacaccggccgcaccctcgggcaccctcacctatcgcgaaggcaaggtattgcgtctgctcgacctgctggaaggagacgatcgccaactggccgacgcctggttctattcggactcgcgcaacgacctgccgctgctgaagctggtcggccatccgaatacggtcaatccggacccgaccctgctcgcctacgccaaggaaatgggctggccggtcaacacctggcgctga

SEQ ID NO: 5096 - DNA, 2952 bp, Pseudomonas aeruginosa
cagttgagccaggtccagttgcgcctcgcggccgcccatcaggccgatgatcacccagcgcccgtcgcgccgcagcaactccaggttcaacccggcatagcgggcgccgaccggatcgaggatcacgtcgaacggggcgaaatcgcgcagcgattccaggctctgcttgcgcagcacgccgccggcggcgcccagggattcgcagtaggccaggcgttcggcggaaccgacgctgacccagcaggggttgccgaacgccttgcacaattggatgccggccgaaccgacgccgctggcgccggcgtgcagcagcactttttcgccgggctgcaacgccgccaactggaacaggttcagccaggccgtggcgtaaacctccggaatccccgccgcctccgccaggctcagccctgccgggaccggcagtacgtggcgcgcgtccaccaccacttcctcggccatgccgccgccggcgagcagcgcgcagacccggtcgccgacctgccaggtgctgcccgcgcccacctcgctgaccacacccgcacactcgagccccagcgccgggctggcgccgggtggcggcgggtaaagcccggccttctgcaacaggtcggcgcggttgagtccggcggccgccacgcggatgcggatttcgccctgaccgcaggacggggcggcgatttccgaccactcgacacgaccttcgataccttgcaatgcgttcacgctgcctccatagtggggttgtcacggcccgatcacccagagtcgggctttttgcattgcgccaagggaacccggcgccggctaataaggcctaatatgcgtcattactccgcgatcagtcgaatcagcatgaagcgttttctgccccgtaccgccctgttgctcctcctcggcgccagttcgctgccgctgttcgcctcgaccgccgtctccgtcggcagcgcccagaattcctgggacagcctgcagccggaccgcgagcaggtcatcgccagcctcaacgtcgtggaactgctcaagcggcaccactacaacaagccgccgctgaacgatgaacgctcggccaagatctacgacagctacctgaagatgctcgatccggcgcggatgtacttcaccgccggcgacatcgccgagttcgatcgctggcgcaacaggttcgacgacttcctcaagagcggcgacctcgatcccggcttcgtcatctacaagcgccacctcgaccgcctgaaaggtcggctcgactatgccctggcgatgctcgacaagggcgtcgacaagatcgacttcagcgtcgacgagagcctgctgatcgaccgcgaaaaggccccctgggcgaaggacaccgcagagctcgacgacctctggcgcaagaaggtgaaggacgaggtcctgcgcctgaagatcaccggcaaggacgacaaggcgatccaggaacagctcaccaagcgctacaagaaccagctgtcgcgcctcaagcagacccgcagcgaagacatcttccaggcctacatcaacgccttcgcccagtcctacgatccgcacacccagtacctgtcgccggacaacgcggaaaacttcgacatcaacatgagcctctcgctggaaggcatcggcgcggtgctgcagagcgacaacgactacgtcaaggtcgtacgcctggtgccggccggcccggcggcgaagagcaagcagatcgccacctccgacaagatcatcggcgtcgcccagggcaagggcgaaatggtcgacgtggtcggctggcgcctggatgaagtggtcaagctgatccgtgggccgaaaggttcccaggtacgcctggaagtgattccggcgagcaacgcgccgaacgaccagaccagcaagatcgtcgccatcacccgcgaggcggtgaagctggaggaccaggcggcgaagaaatccatcatcaaggtcgaccacgaaggccgcagctacaagctcggcgtgatcgacctgccggccttctacctggacttcaaggcctaccgcgccggcgacccgaactacaagagcaccacccgcgacgtgaagaagctggtcgccgaattgcagaaggacaaggtcgacggcatcgtcctcgacctgcgcaacaacggcggcggctccctgcaggaggccaccgagctgaccggcctgttcatcgaccagggcccgaccgtactggtgcgcaacagcgacggccgcgtcgacgtgctcaacgacgacgaaggcaaggccttctataccggcccgctggcggtactggtcaaccgtctctcggcctccgcctcggagatcttcgccggcgccatgcaggactaccaccgcgcgctgatcctcggtggacagaccttcggcaagggcaccgtgcagaccatccagccgctcaaccacggcgaactgaagctgaccctggcgaagttctaccgagtctccggtcagagcacccagcaccagggcgtgatcccggacatcagctacccgtccatcgtcgacgacaaggaaatcggcgaaagcgccctgcccgactcgatgccctgggacaccatccgcccggtggtgaaggacgaggccaacccgttcaagccgttcctcgcgcaactcaaggcccagcacgacgcgcgcaccgagaacaacgccgacttcgtctacgcccgcgagcgcctggcgctggcccaggagctgatgaaggagaagaccgtcagcctgaacgaggccaagcgccgcgcccagcagaccagcatcgagaaccgccagttggccatggagaacgccctgcgcaagtccaagggccaggagccgctgaaggaactcaagcgcgaggacgagaacgccctgccggaagaggacgacaagaccaagccgcaggacgacgcctacctcaccgagtccgggcacatcctgctggactacctgaacctcaactcggcggtggccaagcactga

SEQ ID NO: 5097 - DNA, 705 bp, Pseudomonas aeruginosa
gatggcggcttgcaaggagaccgacatgaatgtccaagtgatcacgcgagacggcgaggcggaatacgcggtgttgccctgggccgaataccaggcgttgctggccgccgctggtcgcccggccgccagtgtcgcggtggagacgaccgcgccggcgccgccttccgcgagcctgctggagcgccgcgaggcgcgcggcctgagcctggaacaggtggcccgggaggtcggtatcagtccttcctacatggcgatgatcgaacgcggcgaacgcgaggccagcgaggccatcctgttcgccctggagcgtgtgctgggcaaagcgacgggggcctgaccttgagtgtgctgatcagccgtaaacactgggatagcctgctgctggaaatcgaggatgcgcgtcgccagcgtcatctgctcacctaccgggcgctgatcgagcgcctgcaactgccgacgccggcgatgaccaccctcacagcggctctcgagcacctggcatcgctggatgcgcgctcggggcgtccgttgcgcagttcgctggtcatcagccagggcgcaagccgcttgccgcgcaccggtttcttcgagtgcgtggagcgcctcgggcgtttttccggtccgccggacggcccggccgcggctggctggcatgcggcggaagtggtccgtgtcttcgaattcgagtatcccgatgaactctga

SEQ ID NO: 5098 - DNA, 513 bp, Pseudomonas aeruginosa
atggatctggcgcctgcgcgcccgcctcggttacggcgtggcccggcagttgctgggctggccctggctggtcaagcagccgcgagcctggcagtggatgcaggggcagttctcgcgcatggccaacctcggacaccgcgacgcccaggcgttctacggtcacctgctgctgttccgtggacagggcttcggcgcgcgcgaggagggcctgcgcctgctgcgcctggctgccagcgcgggcgatgggaaagcggcctaccagctcggcgtgcaggcgctcaagggcgacagccggcaagcgcccgacgcgctggcagccagccgccactgggcgcaagcggcagaggcgggccacccgctggcggcgcgcaagctggcggaactctaccgcgatggaggcccgggcctggcgccggacagcgagcgcgccgagcactatgcgcaacgggcgtccgcgctcggtctatagctgaacgaacggttcaggcggtctcgatcaggtgcaggctgtag

SEQ ID NO: 5099 - DNA, 864 bp, Pseudomonas aeruginosa
gccttattagccggcgccgggttcccttggcgcaatgcaaaaagcccgactctgggtgatcgggccgtgacaaccccactatggaggcagcgtgaacgcattgcaaggtatcgaaggtcgtgtcgagtggtcggaaatcgccgccccgtcctgcggtcagggcgaaatccgcatccgcgtggcggccgccggactcaaccgcgccgacctgttgcagaaggccgggctttacccgccgccacccggcgccagcccggcgctggggctcgagtgtgcgggtgtggtcagcgaggtgggcgcgggcagcacctggcaggtcggcgaccgggtctgcgcgctgctcgccggcggcggcatggccgaggaagtggtggtggacgcgcgccacgtactgccggtcccggcagggctgagcctggcggaggcggcggggattccggaggtttacgccacggcctggctgaacctgttccagttggcggcgttgcagcccggcgaaaaagtgctgctgcacgccggcgccagcggcgtcggttcggccggcatccaattgtgcaaggcgttcggcaacccctgctgggtcagcgtcggttccgccgaacgcctggcctactgcgaatccctgggcgccgccggcggcgtgctgcgcaagcagagcctggaatcgctgcgcgatttcgccccgttcgacgtgatcctcgatccggtcggcgcccgctatgccgggttgaacctggagttgctgcggcgcgacgggcgctgggtgatcatcggcctgatgggcggccgcgaggcgcaactggacctggctcaactgctaggcaaacgcatccagttgaccggctcgaccctgcgtacccgtga

SEQ ID NO: 5100 - DNA, 837 bp, Pseudomonas aeruginosa
tcaggccttgtccttgttcagtcgattggccgcccaggtcaggaccaggacgaacacgaagtaggagaccaccactgcgctggtgtagtggccgctgctgttgcgcatgttgttgaggaacacctgcagggtctcgtagcgggtaccgaccagcaggttggcgaagacgaattcgccgatgaggaaggagaacgacagcagcagggccaccatcacgcccttgcgcaggttcggcagcacgaccagcagcgccgccttccaggtgctggcgccgagcaggtgggcggcgtccatcaggtcgcgcaggttgatcgcctgcaggttgttggtgatcgcccggtacatgaacggcagggcgatggtgaagtagcagccgaccagcacccagggcgtgccgatcatttccagcggcccgctggcatagagttgcagcaggcccaccgaggagacgatcggcggcaccgcgaagggcagcaggatgagcacgtttatcacgccgtccaggcgcgggaagtggtagtggatgacgaacatcagcggcaggatcagcaacacgctgaacgccagggcgccgaagcagaccagcagcgagcgggcgaaggccagcaggaagcgctggtcgctccacagcgtcaggtaccacttcagggtcaggccgtccggcagcagggtcgccgaccactgggtggccagcgagtagagcagggtcgccgccagcggcaggaccaggatcaggaacagcgcgcagaccaccaggcgatggtagagcgcggcaggacgtcgatcagcgcgcgacatggtagctcctgcgcagcagccattggtggaccagggtga

SEQ ID NO: 5101 - DNA, 1206 bp, Pseudomonas aeruginosa
gcaggccgagcaggctcgaccagccggcgatctccaggctgtggcggatcgcctggcggtagaagggcgagccgaacagctcgaggtagttggccaggctccaggcgtcgctggccttcaggctgttcagcgcgacccaggccagcggcgctatctggaaaatcacgaagaacgccgcgaagggcagcaggaacagcagcgccagccatttgccggagagtcgtttcatggggcgagcagctcccggcagacgggtttgtcgtgggcggcgccgaggatttcgcagagcgtgccgcagaggtcggtctgcagcggttgcgccaggtcgtcgcggctgaaggcgtcgccgaagacgaacagcggcacctcgcgctcctcctcgaggatgccgccgtggctgcggtcctcgttcattccgtgatcggcggtgatcgccacctggtagccggccgccagccactggtgcaggtattccgacagcagtgcgtcggcgcgccgcgcggcgttgcggtaggcggggctggcgaggccgtgcctgtgcccggcgtcgtcgatgttcatcgagtggaccagcatgaagttcggtgcgtgccggcggcgcaggctttccgcgtcggcgaacaggtgcgagtccggatagtggtcgctccagtagaagtgtccgcgctggatcggcagtgcgctgtcgtcggtgtggcggtcgcgggccgggtcgaacggcgcgcggttgtacagttcgctgacccagtggtaggccgctgccgcggtactcaggccggccgcgcgggcgtagtggaacaggctctgttcctggctcaggcggaccacgtcgttgtgcaggatgccgctatcgatcggcggcactccggtgaggatgcattcgtagagcggccgggacagcgaaggcaactcgcattccaggcggtacgactggccgcggccggcgccgcagagggcctggagatgccccatgcagtcgcgggcgacgctatggttgaggccgtccaacaggacgaggatgacgtcgtggcgcattcggggtatccgtcgatgcggggcggccgccggggagggcggccgcgctccgcgtcactgcatgttgatgatcaccgcttcctgccactgccgcggcaggcgcttggaggtttcctcccaggccttggcgtccttgatcggctgggccttggcgtactgctcgttgggtag

SEQ ID NO: 5102 - DNA, 882 bp, Pseudomonas aeruginosa
gccctcgattccatgggcgccgggcgcctccgggaagaccgttgtcttgtgcctgtcacgtcccggtcatctgggtttcctagcatcggacgagccggaggcacagggcgggccggcggaaatgccccttgttggggctggactagaccaataaggaagctgtcgatgcgtgacgaagcgctacccaccgtaacggcgatctgccgggcgctcagcgagcagatcggccatggtctgctgccggcgggtggcaagctgccggccgagcgcaagctcagcgagctgttcgcgacgacccggatcaccctgcgcgaggcgctgatccaactggagtcgcagggcctgatctatcgcgaggagcgccgcggctggttcgtctcccccgagcggctggcctacaacccgctggtccgcagtcacttccatgcgatggtcagcgaacagggccgggtgccggcgaccgaggttctgtcggcccggcagatgccggcgagcgcggcggtctgcgagctgctggagctgccggcgctgtccagcgtctaccagatccgccgggcgcggcgggtggacgggcggctggtgctgtatgtcgagcactacctgaacgcgcagtacttccccggaatcctcggccacgacctgacccgctcgctgaccgaactctatgccagcgagtacggcatccactatgggcgggtgcgtttcgacatggtgcccaccgcactgcatgccgaggctgcggcgccgctgaaggtggcggtgggcagcccggccctgcgcatcagccggatcaaccgcgaccagcgtggtcggctgatcgactgcgacctggagttctggcgccacgacgccatccatatcagcgtcgaggtaccgcagtaa

SEQ ID NO: 5103 - DNA, 480 bp, Pseudomonas aeruginosa
tcgtcgtcggaaccgtccatggatcgcccccgtttctccagcgctttcctccatccccgctactggccgctctggttcggcctgggactgctctggctggtggtgcagttgccgtatcccgtcctgctgatgctcggccgtggcctgggggcgctgatgtaccgcttggtcggctcgcgccgcgagattgccgcgcgcaacctcgaactgtgctttcgggaaaagtgcgcccgccgaacgcgagcctctgctgaaggagaacttcgcctccagcggcatcgcctttttcgagatggccatgagctggtggtggccgaaggcgcgcctggcccgtcttgcccatatagaaggcctggagcatctgcgcgaggcccaggcgcagggcgagggggtgatcctcatggccctgcatttcaccactctggagatcggcgcggcgctgctcggccaggtgcacaccatcgacggcatgtaccgtga

SEQ ID NO: 5104 - DNA, 393 bp, Pseudomonas aeruginosa
agtcgtctggagcgcttgcaccagcgtcctacagtggatatcgacgacattccgcgtcaccccgctgtgaggataaaaacaatgaacgacagcatctaccagcggattgataccaatccgcgcttcaaggagttggtggccaagcgagagcgtttcgcctggatactttcttcgatcatgcttggcctctacgtgatattcatcctgctgatcgctttccagccgcagctgctgggcgcgcgtatcagtcccgattcgtccgtgacctggggcatcccgatgggtgtcggactgatccttgccgcgttcatcctgaccggcctgtacgtgcgtcgcgccaacggcgagttcgacagcctgaaccaggaaatcctcaaggaggcgcagcaatga

SEQ ID NO: 5105 - DNA, 2415 bp, Pseudomonas aeruginosa
cagtttcaacttcgcctcgccgcccttcgaccagttgcgtccccatcagcgcgagaccctcaagcaggccctcagcgtaggctactacgcgccgggggaaaccttgctggaggccggttcggcggtccccgggctgttcgtcctgctcaagggcgtggtcgaggagcgcggcgacgacgggcgagtgttcgcccagtacgccgcggacgacctgttcgacgtccgcgggctgttttccggcagcagcaagcatcgctacctggcgatcgaggaaagcatcgtctacgaactgccggccagttgcttccaccagttgtgcggggagaacccgggtttcgcccggttcttccaggccgacctggcggccaagcgccagttggcccagcgcgacgggcagaaccttgccgagttcatccttacccgcatcgcccgcgagcacttgctgccggcgctggaggtggaggcctcgctgtccctcggcgacgccgcgcgcctgcaattgagccacggcgccgatgccctgctggtgcggctggagagggacgggcccgagctcggcatcgtcacccgcaccgacctcatgagcgcgcacttccgcgacgggcgcagcgagctggaggctatcgggccgttggcccatggtccgctggccagcgtcgaactgggcgatttcctgttcgacgcgatgatcctcatgacgcgccagcgtatcgagcgggtcgcggtcacggaggacggtcaggtgatcggcctgttgcacctgacccaggtgctcagcctgttctccacccattcccacgtcctggcgctgcgcatcgcccgcgccgacgacctcggcgacctgcgccgctgcgcggaaaccctggacaccctgatcgctaccctggccggcaacggtatccgcctgcgcttcatcatgcagctggtcagcgcgctcaacgagcaattgctcgaacggcttttcgaattgttgctgccgccaaccctgcgcgggcgctgctgcttgctggtgatgggcagcgaaggacgcggcgagcagttgctgaagaccgaccaggacaatgccctggtcctggccgacgatctgccgcaggaacaggccctggcgatgatgcagcgcttcagcgcggccttgctggagttcggttatccgccctgtcccggaggggtgatggccagtcggccggaatggtgcaagccgctggtggcctggcaggcggagctgcgcgggacgctgctggagggcaagccggagcagctgttgcgcctgtcgatcctggccgatgcctggccggtggccggcaacctgcagctgttcgagccgttgcgtcggcaactgcgcggtttcgccgacggcggcgagcgctggctggcggatatcgcggcggcggccctgcaattcgatacgccgctgaccttcctcggccagctgaaaacccaggacgcccgcctcgatctcaagcgcggcgggatcttccccatcgtccacggcatccgcaccctggccctgcgcgaaggcctggagacccgcgggaccctggcacggatcgaggcgctgaagcgacacaaggtcctcgaagcacgcctggcggacgacctgagcgagtctttcgagctgttcctgcaactgcgcctgacccgccagttggccggccaacgcgacggtcgccagcagggcctggacgtcagcggcatgagccgccacgatcgcgacatgctgcgctacggcctgcatgtggtgaagaagttcaagcagagcgtggcccgtcaattccacctggagacccgatgaacaccatggtcaagttgcccgacagccgctggccgggctggcgccgccggctgtactggtggatgcacgaggcggtcgaggcggaagaagtgatctccctcgatctcgagaccaccagcctcgacccgcgtcgtgccgacatcctcagcatcggcgcggtgctggtgcggcgcggcaaactggtcatgggcgagcgcctggaactctacgtcgagccgccgccgagcctggatgcggagtcgatccgcatccacaagctgcgccgcgccgacctggagggacagttgcagctggagcaggccctgcgccaggtgctggcgttcatcggcgaccgaccgctgctgggctactatctgtcgttcgatgtcgccgtgctgaaccggcacctgcgccagctcctcgaccgacagttgcacaacccctccatcgagatttcgtcgctgtaccaccggaaggtcagccggcattttcccgacgcacacatcgacctgcgcttcgacaccctggcgcgggccctggatgtgccggtcagcggtcgccacaccgccctcggcgacgcccaggcggtggcgctgatgttcatgcgtctgctcaaggggccggcgcccaaggtcatccactga

SEQ ID NO: 5106 - DNA, 243 bp, Pseudomonas aeruginosa
atcttcgttgctcggcgggggtcgagaactacaagggcggaatctcccgccctttgccccatgagccgaacaggagcgacgcccatgagtctcggtacgattcttctgatcatcctgatcctgctgctgatcggcggtctgccggtctttcctcattcgcgcaactggggctacgggccctcggggatcatcggcgcattgctggtggtgctgttggtcctgttgctgctgggcatgatctag

SEQ ID NO: 5107 - DNA, 411 bp, Pseudomonas aeruginosa
aggccgccatgggcgagcaactcggcatgcgtgccgctttcggcgatgtggcccttgtccagcaccaccaggcggtccatgcgcgcaatggtcgacaggcggtgggcgatggcgatcaccgtcttgccctgcatcagggtctccaggctttcctggatcgccgattcgacttccgagtccagcgccgaggtcgcttcgtcgaggatcaggatcggcgcgtccttgagcagcacccgggcgatggcgatgcgctggcgctggccgccggagagcttcactccgcgttcgccgacatgggcgtcgaagccgcggcggccctcggcgtcgctgagcagcgggatgaactcgtcggcgcgagccttgcgcaccgcttccatgagttccgcgtcgctggcgccggggcggccgtag

SEQ ID NO: 5108 - DNA, 384 bp, Pseudomonas aeruginosa
cgtacgggatgccgtggttttcagggtgttgccatttttccatctgtcgctaccgggagtccggccatgaaaaggctttgctgtttcgcactatcgctgctgcccctgtccgctttcgcctatccgatcgaggtcgacccgcaactcaacggcaccgaggtctcctacagcacccaggacatcgggcgcgacatgggcgcgatccttctcaccaacctgggaggccaggcggcagagtgcacggcggtgttccgcaacggcccggagaccccgaaagtgcgcaagggcgtgatccagcccgggcagaacagcaacttcaccgcgcagttcggccgcgacatcatcaagttgcggatcaagctgacctgcaagatcgcgaaatag

SEQ ID NO: 5109 - DNA, 1584 bp, Pseudomonas aeruginosa
cgaattcctgcgccgctattcgagcctgatcctcggcaacatccgcctggtcgacgaggcggtgcacagtaccgccgacggccgcaagctgctggtgatacacggcgaccagttcgacgtgatcacccgctaccaccgctggctggcgttcctcggcgattccgcctacgagttcaccctgctcctcaaccgttggctgaaccactggcggcggcgctggggctacggctactggtcgctgtcggcgtacctcaagcacaaggtcaagaccgcggtgaacttcatcagcgacttcgaggaagccatcgcccacgagtgccacaagcgcgggctcgacggggtggtctgcgggcacatccaccatgccgagatccgccgcatcgagggcgtcgattacctcaactgcggcgactgggtggagtcctgcacggcgctgatcgaacactgggacggcagcatccagctctaccgcctggccgaggagcaggcgcggctggcggcgcaggccgcggcggtcgagccggcggcatgaggctattgatcgtcagcgacgcctggttaccgcaagtcaacggagtcgtcaccagcctgctggccctgcagcgcgagctggaactgctgggccaccaggtacgggtgctgtcgcccgccgacttccgctgcctgccctgtcccagctatccggaaatccccctggcctggaacctctggcgcctcggcgggctgatcgaggccttcgccccggatgccgtgcacctggccaccgaggggccgctcggctgggccacgcggcgctggctgggcaagcgcggcctggacttcacctcggcgatccatacgcgctttcccgaatacctgcgtgaccgctgtccgtggctgccgttgtcctggggctatgccttcctgcgcaccttccatcggccgagccgggcggtgctggtgagcaccccgcgcctgcgcgacgagttctgcgcctggcgcttccagcacctgcggctgtggcgcaagggcgtcgataccgaactgttccatcccgccgagacacctccggcgaaagagcggccgccggtgttcctgtatgtcgggcggctggcgacggaaaagaacctggaggcgttcctcgatctcgaactgccgggcgaaaaatggctggtgggcgacggcccgcagcgggcggcgctggagcagcgctatccacaggcgcgttttctcggctaccgccatggccgcgcgctggccgacgcctaccgggcggcctcggtgctggtgttcccctcgctgaccgatacctatggcctggtgatgctcgaagccctggcctgtggcgtgccggtggcggccttcgccgtgccggggccgctggatgtattgcagcagggcgtgaccggggtcatgcacgaggatcttggcgaagcctgccgccaggcgctggcgctggatcgccaggcctgcgggcgctgggcgcgggagcagtcctggcgggtttcggcggaggagttcctggcgctgcaggcgagcggcccacggactgcgccggaatggcgcgacgaactgccggcggcgttcgacgaacttagaggatga

SEQ ID NO: 5110 - DNA, 507 bp, Pseudomonas aeruginosa
ttgaacttgccctccgagccggacttggccagccacaggccgaagagcagggcggcgccgatcacgatcacgctgaacaggccgatcaacacatggtgggctcgggtttccatctcagtgattctccggcacggcggcggcttggtgggcggcgcgcccgcgcggcccgtggaagtattcgcggacccaggcgtcgtcggtggcggcgacccgttccagggtatcgactaccaggaccttcttctgcgacagcacggcgacccggtcgcagatggtgtacagggtgtccaggtcatgggtgaccaggaacacggtcaggccgagggcgtcgcgcagggtacggatcaggttgtcgaaggccgccgcgccgatcgggtcgaggccggcggtgggctcgtcgaggaacaggatgtccgggtccagcgccagggcgcgggccagggcggcgcgcttgatcatgccgccggaaagcgaggccggatacttgtcgccggcgttggccggtag

SEQ ID NO: 5111 - DNA, 930 bp, Pseudomonas aeruginosa
cccggccagggccagcttgacctgggccaggtgctcggcgtcggcgcgcggcaggccggcgttctcgatcagcggcagggcgacgttctccaccacggtaagcgaggaaaacagcgcgccctgctggaacagcacgccgaagcgccgttcgaccagggagcggcgctcctctggcagttgcagcaggtcttcgccgaacacccgcacgctgccggaggtcggccggcgcaggccgacgatgctgcgcagcagcaccgacttgccggtgccggagccgccgaccacgccgaggatctcgccgcgacggacgtcgaggtcgaggtgctcgtggaccacctgggcgccgaaacggttgcacaggtcgcggacctggatgatcgcctgcgggttgtcctggttcaccagcccatctccatgaagaacagcgcggcgagggcgtcgagcaggatcaccacgaagatcgagtggaccacgctggtggtggtgtgctcgcccaccgactgggcgctgccgctgaccttgaagccttccaggcagccgatcacggcgatcaggaaggcgaacagcggggccttgctgataccgaccaggaaatgctgtacgccgattccgtcctccatgatcgacaggaacatcgccggcgggatgtccagggtccaggcgcagacggtcatgccgccgacgatgccgcagagcatgccgacgaaggtcagcatcggtagcgataccagcagcgccagcacccgcggcagcaccagcagctcgatggggttgaggccgagggcgcggatcgcgtcgatttcctcgttggccttcatcgagccgatctgcgcggtgaaggcgctggcggtgcggccggccatgaggatcgcggtgagcagcacggcgaactcgcggaggaaggagaacaccaccaggttgaccgtgtag

SEQ ID NO: 5112 - DNA, 468 bp, Pseudomonas aeruginosa
atctgccgctgcacccctcttcacagctgccgcgaaatcgctagaatctcgcttcgcccgccggcgctcgccggtttctctggtgttctgccaaccatgtccactgacaatccgtgtcttacctgcggcgcctgctgtgcgcattttcgtgtgtctttctattggggcgagtgccgttccgcaggcggcgtcgtacccgacgaactgaccgtccgcatcagcccgcagatggttgccatgagcggtaccgagaacaagccggcacgctgcgtcgggctgctcggcgaggtcggttgcggcgttcgctgcaccgtctacgagcagcgctcgagtacctgccgcgagttcgaggcggcctgggccaacggccagcccaacccggcctgcgatgccgcgcgcgccgcctacggcctgccgccgctgaccccgccgctgcagccgcacctggcgccgggacgggtcgcctga

SEQ ID NO: 5113 - DNA, 414 bp, Pseudomonas aeruginosa
tcgccggcgctgctggcacgcacctccagggggtggccgacggggttgaagcgcacggcgttgcgcagcaggttgtccaccgcgcgttcgaacatgtccggccagccgtcgatgctcaggtcaggcgccacctccaggcggatatcctgttccggagccagcagcagggcgtcttcgcgcagccgctggagcagcggtagcagggcgatccgttggctcgcgccgggttcggcgtcgagccgggcgagggcgaggatctcgccgatcagcgcttccaggcggtcgcattcctgttccaggcgcggccacatctgcgcccgcgcttccggttcggcgcgttcggccagggccagggcgatgcgcaggcgagccagcggcgagcgcagttcgtgggatacgtcgcggagcaactga

SEQ ID NO: 5114 - DNA, 669 bp, Pseudomonas aeruginosa
tcgtcggcgcccagttccagaccgaggatgcggtccagcggctcgccgcgggcggacagcatcagcaccggcaggtcgggatggtcgccgcgcagttgcttgagcagttccaggccgctaccgtccggcagcatcacgtcgagcaccacggcatccggtgtctgctcggcgagggcgcgacgggcctgggcgccgtcgtggctggcacgcacggagaaaccttcctggaccagccaggtaccgagcagctcgcagagctcccggtcatcgtcgatcaacagcagttcgctcatcgagtgtcgctcaattgatccattcgcgtcgctgtcgccggcggccgcggctcagggcaccgaggacgaacgcgagcagggccgtggcggcgccggcgacataccaggtctgctcttccgtgagcagcggcggttgccgctgcgcctgggccgcctgcagctgctcgcgcaactggcggttctcctggcgcatacgactgaccagttcgtcgcgctggcgttccgtttccaccaggcggcgctccagttcggcggtagcctgcgtaatggaaggctgcgccggctggaatccgtgccggcgcgggttcctcggccagggccagggaagctcccaggctcagcagcaggcaatgggcagcggatggacgcatcatga

SEQ ID NO: 5115 - DNA, 1197 bp, Pseudomonas aeruginosa
cccgcgaagcggaggaaggcgaaaccctggaggaagccctgggagacgatttcgagtgagcgcgccgctggccgttcgtcctcctgcggacggtcgccttttccgagcttccggcttcgctccctgccgtggcctgttaagctgcatgcccgattccgctatctttccctcttcctggctccggtatccgttgcgacgatgaacctgtccgatccccacgaactcgccactctgctcgaaggcatcctcctcgcggccggcaagccgctgtcgctggaacgcctggccgagctgttcgacgaggcagagcggccggagccggggcagttccgcgacgccctggcgatcctggcactgtcctgcgcggggcgctccttcgagctgaaggaagtcgcgtccgggtatcgcctgcagattcgcgagcgtttctcgccgtgggtcggccgcctctgggaggagcgtccgcagcgctattcgcgcgcgctgctggaaaccctggtgctgatcgcctaccgccagccgatcacccgtggcgagatcgaggagatccgcggcgtggcggtgaacacccagatcgtcaagacgctgatggagcgggagtggatccgcatcgttggctaccgcgaggtgccggggcgcccggcgatgctggcgactaccaaggcgttcctcgattatttcaacctgaagagcctcgacgagctgccgccgctgtcggcgctgcgcgagatggagcccgagccggaaccgccggtcgaagtggcgcccgcggcgcagccgccgcgcgacgatctcgacgaggatgcgattcctgcctcgatccaggccctggccgatcgcgccatcgccgaggccggggaaagcctcgaggagatcgagggggaggccggcgagccggagaagccgcgcgaggaaaccagcttccgcagcctgctgctggaactggacgagatggagcagggcctgaagaccgacttcgacgacctgctcgaccctccggagccctcggagcagggcgacgagtccgccgagccagcggctgggccgattcccgtggtcgcggagcaagccgtcgagcctgccgtcgcggaggctgtcgcgggcgccgatcccgatgacgaggagcgcgccctggcggaggccatgcgcgaggagcgcgaggcactggacgccgacgacgactggccgcgccgctga

SEQ ID NO: 5116 - DNA, 1953 bp, Pseudomonas aeruginosa
tctgtaggagaatctgccatgcaccctcgtgtgctcgaagtcacccgccgcatccaggcccgtagcgcggccactcgccagcgctacctcgagatggtccgggctgcggccagcaaggggccgcaccgcggcaccctgccgtgcggcaacctcgcccacggggtcgcggcctgtggcgaaagcgacaagcagaccctgcggctgatgaaccaggccaacgtggccatcgtttccgcctacaacgacatgctctcggcgcaccagccgttcgagcgctttccggggctgatcaagcaggcgctgcacgagatcggttcggtcggccagttcgccggcggcgtgccggccatgtgcgacggggtgacccagggcgagccgggcatggaactgtcgctggccagccgcgacgtgatcgccatgtccaccgccatcgcgctgtctcacaacatgttcgatgcagcgctgtgcctgggtgtttgcgacaagatcgtgccgggcctgctgatcggctcgctgcgcttcggccacctgcccaccgtgttcgtcccggccgggccgatgccgaccggcatctccaacaaggaaaaggccgcggtgcgccaactgttcgccgagggcaaggccactcgcgaagagctgctggcctcggaaatggcctcctaccatgcacccggcacctgcaccttctatggcgccgccaataccaaccagttgctggtggaggtgatgggcccgcccctgcccggtgcctccttcgtcaacccgaacacccccctgcgcgacgaactcacccgcgaagcggcacgccaggccagccggctgacccccgagaacggcaactacgtgccgatggcggagatcgtcgacgagaaggccatcgtcaactcggtggtggcgctgctcgccaccggaggctcgaccaaccacaccctgcacctgctggcgatcgcccaggcggcgggcatccagttgacctggcaggacatgtccgagctgtcccatgtggtgccgaccctggcgcgcatctatccgaacggccaggccgacatcaaccacttccaggcggccggcggcatgtccttcctgatccgccaactgctcgacggcgggctgcttcacgaggacgtacagaccgtcgccggccccggcctgcgccgctacacccgcgagccgttcctcgaggatggccggctggtctggcgcgaagggccggaacggagtctcgacgaagccatcctgcgtccgctggacaagccgttctccgccgaaggcggcttgcgcctgatggagggcaacctcggtcgcggcgtgatgaaggtctcggcggtggcgccggaacaccaggtggtcgaggcgccggtacggatcttccacgaccaggccagcctggccgcggccttcaaggccggcgagctggagcgcgacctggtcgccgtggtgcgtttccagggcccgcgggcgaacggcatgccggagctgcacaagctcacgccgttcctcggggtcctgcaggatcgtggcttcaaggtggcgctggtcaccgacgggcgcatgtccggggcgtcgggcaaggtgcccgcggccatccatgtgagtccggaagccatcgccggcggtccgctggcgcgcctgcgcgacggcgaccgggtgcgggtggatggggtgaacggcgagttgcgggtgctggtccacgacgccgaatggcaggcgcgcagcctggagccggcgccgcacgacggcaatctcggttgcggccgcgagctgttcgccttcatgcgcaacgccatgagcagcgcggaagaaggcgcctgcacctttaccgagagcatcaacgggctggcgctgattctgataggtcgatatccgcccggcgcttggctggcggctgtctctccggcaacatctgccgaccgtcccgccctggcgcggggcattgcggttcaacgacgatga

SEQ ID NO: 5117 - DNA, 507 bp, Pseudomonas aeruginosa
tcatcggtcccggcaccggccttggcgtcggcagcctgctgccgctgggcgggggacgttgggaagtgctgccctgcgagggcgggcacgtcgacctgccggtcacttcgccgcgcgacttcgcgctctggcagggcctgcaggcgcgctacggacatgtctccgccgagcgcgcactgtccggcaacggcctgctcgccctctatgaaatcagctgtgccctggacggggtcgccgtacgcgcgagcagtgcggcggaagtcggtgccctggccatggccggcgacgcccaggcggacgccgtgctggagcacttcttcctgtggctggcgcgggtcgccggcaacgcggtgctcaccgtcggcgcgctcggtggcgtctacattaccggcggcatcgtcccgcgtttcctcgagcgtttcatcgccagcggcttcgccgaggccttcgccagccgtggcaagactagcggcgcttacctgcaggacgtaccggtatgggtcatga

SEQ ID NO: 5118 - DNA, 831 bp, Pseudomonas aeruginosa
ccgccgaacatccgggcctgctcggcgccggggtcgccctgcagcaggccctggacgtcgagggctgagtcggcgtcgagcaaccgcataaggaggagcctcgtgagcgcgaacggacgatcgatcctgctggtagacgatgaccaggaaatccgcgaattgctggagacctacctgagccgcgccggcttccaggtccgcagcgtctcgcggggcgccgacttccgccaggcgctgtgcgaggaggaggcgagcctggcgatcctcgacgtgatgctgccggacgaggacggcttcagcctctgtcgctggattcgctcccaccagcgcctggcctgcatgccgatcatcatgctcaccgccagttccgacgaggccgaccgggtgatcggcctggaactgggtgccgacgactacctgggcaagccgttcagcccgcgcgagctgctggcgcggatcaaggccctgctgcgccgcgcgcagttcacccaggtgcgcggtggcgacgtactggctttcgaggactggcggctggacacggtcagccaccgactgttccatgaggacggcgaggagttcttcctcagcggcgcggatttcgccctgctcaagctgttcctcgaccatccgcagcagatcctcgaccgcgacaccatcgccaacgccacccgcggccgcgaggtgctgccgcttgagcgcatcgtcgacatggcggtcagccgcctgcgccagcgcctgcgcgacaccggcaaggcgccgcggctgatccagaccgtgcgcggcagtggctacctgctggcggcgcaggtgcggccgcacctgcagccatga

SEQ ID NO: 5119 - DNA, 1422 bp, Pseudomonas aeruginosa
caagaagaaggttttcctcatgaatgcgatccgtcgcctctctgccgtcatctgtctttcctccctctgtctctccccactgctggcccaggccggcgaagtcgaagtgctgcactggtggacctccgccggcgagaagcgcgccgccgaaaccctgaagaagctggtcgaagccaagggccacacctggaaggacttcgccgtggccggcggtggcggcgaggcggcgatgaccgtgctgaagacccgcgcggtgtccggcaatccgccggccgcggcgcagatcaaggggccggatatccaggagtggggcgaactgggcctgctcgccgacctcaacgcggtggccgccgaaggcaagtgggacagcctgctgccgaagcaggtggcgcagatcatgaagtacgacggcgactacgtagcagtgccgatcaacgtacaccgggtgaactggctctacatcaacccggaagtgttcaagaaggccggcgccaccccgccgaccaccctcgacgaactgttcgtcgccgccgacaagctcaaggccgccggtttcacgccgctggcccatggcagccaaccgtggcaggacggcaccgtgttcgagaacctggtgctgagcaagatgggtccggaaggctatcgcaaggccttcgtcgaacaggacaaggcgaccctcaccggagcgcagatggtcgaggtgttcgccgcgctgaagaagctccgcggctatgtcgatgccgacgccgccggtcgcgaatggagcgccgccacggcgatggtgatcaacggcaaggccgggatgcagatcatgggcgactgggcgaagagcgagttcaccgccgccggcaaggtgccgggcaaggactaccagtgcctgccgttccccggcacgcagaaagccttcgactacaacatcgactcgctggtgatgttcaagctgagcaacgcggagaaccgcaaggcccaggaagacctggcgcgcagcgtgctcgacccgtccttccagaaggacttcaacctcaacaagggctccatcccggttcgcctggacgccgacatggcgccgttcgacagttgcgcccagcagtcgatgaaggacttcaagcaggcttcccaggacggcaacctggtgccgagcatggcccacagcatggccgcttccagctacgtgcagggggcgatcttcgacgtggtgaccaacttcttcaacgaccccgccgcggatccgcagaaggccgcccagcaactggcggccgccatcgaggcggcggcgcagtaagtccctggcgcggatcccggccagggctccgctcgatcctcccgactggctccgtgccgccgagcggcacgggtgggttccttcgcacgcgagaaaacgcatggcgaccaattcccctgtctatcccacggctccggtag

SEQ ID NO: 5120 - DNA, 909 bp, Pseudomonas aeruginosa
tgctcggcgctgtactggcgatcgtggtgccttacctgtattccgaactgcgaggcaagcgccatgcgtgacgcgtccctgaacccgagcttcagcgtcagccgcctggccgtgcacctgaccctctggggcgcctgcgcgctttacctggtgccgctgctggtgatgctgctgaccagcttcaagacgccggacgacatccgcaccggcaacctgctgtcgctgcccgacaccttcaccgtcatcggctggctcaaggcctgggacagcgtcggcgcgttcttctggaactcggtgctgatcaccgtgcccggcgtgctgatctccaccttcatcggcgcgttgaacggctacgtgctgtcgatgtggcgcttccgcggttcccagctgttcttcggcgcgctgttgttcggctgcttcctgccgttccaggtgatcctcctgccgatgtccttcaccctcggcaagctcggcctggccaataccaccagtggcctggtgctggtccacgtgatctacggcctggccttcaccacgctgttcttccgcaactatttcgtggcgatcccggatgccctggtcaaggccgcgcgcctggacggcgccggcttcttcaccatcttcctgcgcatcctgctgccgatgtccacgcccatcgtgatggtctgcctgatctggcagttcacccagatctggaacgacttcctgttcggcgtggtgttcgccagcggcgattcgcaaccgatcaccgtggccctgaacaacctggtgaacatcaccaccggggtcaaggaatacaacgtcgacatggccgcggcgatgatcgccgcgctgcccacgctggtggtctacgtactggccggcaagtacttcgtgcgcggcctcaccgccggcgccgtgaaaggctga

SEQ ID NO: 5121 - DNA, 882 bp, Pseudomonas aeruginosa
accacaaccacgaggacgctggaaatgtacaagaacaagaaaaccagaccggccgccaggaccgttggctgcctgtttgcccttggagcgctgggcttggggagcgcggcgcacgccgccgaggcgttctccccgaactcgaaatggatgctcggcgactggggcggcaagcgcaccgagctgctggagaagggctacgacttcaagctggagtacgtcggcgaggcggcggccaacctcgacggcggctatgacgacgacaagacaggacgctacaccgaccagttcgccctgggcgtgcacatggacctggagaagatcctcggctggaaggctaccgagttccagttcaccgtcaccgagcgcaacggcaagaacctttccaacgaccgcatcggcgacccgcgtgccgggcacatcagctcggtgcaggaggtctggggccgcgggcagacctggcggctgacccagctgtggctcaagcagcagtacttcgacggcgcgctggacgtgaaattcggccgtttcggcgagggcgaggacttcaacagcttcccctgcgatttccagaacctggccttctgcggctcgcaggtgggcaactgggcggggagcatctggtacaactggccggtcagccagtgggcgttgcgggtgaagtacaacttcgcgccggactggtacgtgcaggtcggcgcctacgaacagaacccgtcgaacctggagaccggcaacggcttcaagatgagcggcagcgggaccaagggcgcgttgctgccggtggagctgatctggcagccgaaggtcggcgccgagcaactgccgggcgagtaccggctgggctactactacagcacggcgaaagccgatgacgtctacgac

SEQ ID NO: 5122 - DNA, 474 bp, Pseudomonas aeruginosa
cccggagagcctcggcggcaagcgcttgagcgaggtggaaggatggatgcaccacgaggattcagtcgttacctggggatcgcggaacgtttcctggcccgtggccgggtgcccgccttgttgattgcggtagcacgcaagcgctcgcgcctgaagctggtgaagagcgacctgcgcctgctgcaggaactgctggtggcctgggttcgcggcgaataccgcggactcagccgccaggcgttgctctcggtgatcgcggcgctggcctatttcctttcgccggtggatatcgttcccgacttcatcttcggtgtcggcctgctcgacgatctcgccgtcctggcctgggtagtgcgtcgctggcaggccgagctggatgccttcaaggtctggcgcgacgcccagggcgtcgagacgcaacaggcgctgcgagagctgccggctcccagggcggagcgcgttcagggttcctga

SEQ ID NO: 5123 - DNA, 366 bp, Pseudomonas aeruginosa
ccagtccgcagcggcgcggtgcctgataagatggcggcttgcaaggagaccgacatgaatgtccaagtgatcacgcgagacggcgaggcggaatacgcggtgttgccctgggccgaataccaggcgttgctggccgccgctggtcgcccggccgccagtgtcgcggtggagacgaccgcgccggcgccgccttccgcgagcctgctggagcgccgcgaggcgcgcggcctgagcctggaacaggtggcccgggaggtcggtatcagtccttcctacatggcgatgatcgaacgcggcgaacgcgaggccagcgaggccatcctgttcgccctggagcgtgtgctgggcaaagcgacgggggcctga

SEQ ID NO: 5124 - DNA, 705 bp, Pseudomonas aeruginosa
ccaccctcacagcggctctcgagcacctggcatcgctggatgcgcgctcggggcgtccgttgcgcagttcgctggtcatcagccagggcgcaagccgcttgccgcgcaccggtttcttcgagtgcgtggagcgcctcgggcgtttttccggtccgccggacggcccggccgcggctggctggcatgcggcggaagtggtccgtgtcttcgaattcgagtatcccgatgaactctgaatggatctggcgcctgcgcgcccgcctcggttacggcgtggcccggcagttgctgggctggccctggctggtcaagcagccgcgagcctggcagtggatgcaggggcagttctcgcgcatggccaacctcggacaccgcgacgcccaggcgttctacggtcacctgctgctgttccgtggacagggcttcggcgcgcgcgaggagggcctgcgcctgctgcgcctggctgccagcgcgggcgatgggaaagcggcctaccagctcggcgtgcaggcgctcaagggcgacagccggcaagcgcccgacgcgctggcagccagccgccactgggcgcaagcggcagaggcgggccacccgctggcggcgcgcaagctggcggaactctaccgcgatggaggcccgggcctggcgccggacagcgagcgcgccgagcactatgcgcaacgggcgtccgcgctcggtctatag

SEQ ID NO: 5125 - DNA, 2247 bp, Pseudomonas aeruginosa
cggtcatggaacgctctcgtcgcaatgaaaaagggccggttgtgcaaccggccccgtatttcacgacagtcccatgactgttttatgacgctcccgctgaactcagtgcttggccaccgccgagttgaggttcaggtagtccagcaggatgtgcccggactcggtgaggtaggcgtcgtcctgcggcttggtcttgtcgtcctcttccggcagggcgttctcgtcctcgcgcttgagttccttcagcggctcctggcccttggacttgcgcagggcgttctccatggccaactggcggttctcgatgctggtctgctgggcgcggcgcttggcctcgttcaggctgacggtcttctccttcatcagctcctgggccagcgccaggcgctcgcgggcgtagacgaagtcggcgttgttctcggtgcgcgcgtcgtgctgggccttgagttgcgcgaggaacggcttgaacgggttggcctcgtccttcaccaccgggcggatggtgtcccagggcatcgagtcgggcagggcgctttcgccgatttccttgtcgtcgacgatggacgggtagctgatgtccgggatcacgccctggtgctgggtgctctgaccggagactcggtagaacttcgccagggtcagcttcagttcgccgtggttgagcggctggatggtctgcacggtgcccttgccgaaggtctgtccaccgaggatcagcgcgcggtggtagtcctgcatggcgccggcgaagatctccgaggcggaggccgagagacggttgaccagtaccgccagcgggccggtatagaaggccttgccttcgtcgtcgttgagcacgtcgacgcggccgtcgctgttgcgcaccagtacggtcgggccctggtcgatgaacaggccggtcagctcggtggcctcctgcagggagccgccgccgttgttgcgcaggtcgaggacgatgccgtcgaccttgtccttctgcaattcggcgaccagcttcttcacgtcgcgggtggtgctcttgtagttcgggtcgccggcgcggtaggccttgaagtccaggtagaaggccggcaggtcgatcacgccgagcttgtagctgcggccttcgtggtcgaccttgatgatggatttcttcgccgcctggtcctccagcttcaccgcctcgcgggtgatggcgacgatcttgctggtctggtcgttcggcgcgttgctcgccggaatcacttccaggcgtacctgggaacctttcggcccacggatcagcttgaccacttcatccaggcgccagccgaccacgtcgaccatttcgcccttgccctgggcgacgccgatgatcttgtcggaggtggcgatctgcttgctcttcgccgccgggccggccggcaccaggcgtacgaccttgacgtagtcgttgtcgctctgcagcaccgcgccgatgccttccagcgagaggctcatgttgatgtcgaagttttccgcgttgtccggcgacaggtactgggtgtgcggatcgtaggactgggcgaaggcgttgatgtaggcctggaagatgtcttcgctgcgggtctgcttgaggcgcgacagctggttcttgtagcgcttggtgagctgttcctggatcgccttgtcgtccttgccggtgatcttcaggcgcaggacctcgtccttcaccttcttgcgccagaggtcgtcgagctctgcggtgtccttcgcccagggggccttttcgcggtcgatcagcaggctctcgtcgacgctgaagtcgatcttgtcgacgcccttgtcgagcatcgccagggcatagtcgagccgacctttcaggcggtcgaggtggcgcttgtagatgacgaagccgggatcgaggtcgccgctcttgaggaagtcgtcgaacctgttgcgccagcgatcgaactcggcgatgtcgccggcggtgaagtacatccgcgccggatcgagcatcttcaggtagctgtcgtagatcttggccgagcgttcatcgttcagcggcggcttgttgtagtggtgccgcttgagcagttccacgacgttgaggctggcgatgacctgctcgcggtccggctgcaggctgtcccaggaattctgggcgctgccgacggagacggcggtcgaggcgaacagcggcagcgaactggcgccgaggaggagcaacagggcggtacggggcagaaaacgcttcatgctgattcgactgatcgcggagtaatgacgcatattaggccttattag

SEQ ID NO: 5126 - DNA, 984 bp, Pseudomonas aeruginosa
caaccccactatggaggcagcgtgaacgcattgcaaggtatcgaaggtcgtgtcgagtggtcggaaatcgccgccccgtcctgcggtcagggcgaaatccgcatccgcgtggcggccgccggactcaaccgcgccgacctgttgcagaaggccgggctttacccgccgccacccggcgccagcccggcgctggggctcgagtgtgcgggtgtggtcagcgaggtgggcgcgggcagcacctggcaggtcggcgaccgggtctgcgcgctgctcgccggcggcggcatggccgaggaagtggtggtggacgcgcgccacgtactgccggtcccggcagggctgagcctggcggaggcggcggggattccggaggtttacgccacggcctggctgaacctgttccagttggcggcgttgcagcccggcgaaaaagtgctgctgcacgccggcgccagcggcgtcggttcggccggcatccaattgtgcaaggcgttcggcaacccctgctgggtcagcgtcggttccgccgaacgcctggcctactgcgaatccctgggcgccgccggcggcgtgctgcgcaagcagagcctggaatcgctgcgcgatttcgccccgttcgacgtgatcctcgatccggtcggcgcccgctatgccgggttgaacctggagttgctgcggcgcgacgggcgctgggtgatcatcggcctgatgggcggccgcgaggcgcaactggacctggctcaactgctaggcaaacgcatccagttgaccggctcgaccctgcgtacccgtgatgccgagttcaaggcgcagttgatcgccgaactggggttgaaggtctggccattgttctccgccgggaaactccgcgcgcagctggagcgaaccttcccgatcggcgacgccgaggcggcgttcgaggcgttggcgagcaaccaggtgcagggcaaggtcgtgctggtggtggacccgtcgctggcctga

SEQ ID NO: 5127 - DNA, 1308 bp, Pseudomonas aeruginosa
cctcctcgacgtaggcctccacttcccgctcgacttcctcgacgctgcgaccgatcagcggttgcagggtgtagtccatgtacaggtccatggacagcttgccttcggcgtactgctccatcagttcggcgtcgtggcggacgaaggattcgtcgacccagccgagactcgccatgcgctggctccacaggctggagcagtcgcagtggatcatggtctcgtccaggtcgaagatcaccaggctcatcaagctacctctcgaatactgttgcgatcgatgaccagcgtcagctgactgccggccggatacaggcggtctgcgctgcggttgaggacgtcgacggtgagttccaccccggcggcctcgacgcggtaacggatcacgttgccgagcagactgtgcgagcgtaccagcgccggcacgccttcgctcggttcgttgcccaggcgcagggattccgggcggatcgccacctgttgcgcgcagggctggccgagcaggcggctggcctgttcggcgtcgagcaggttgtagttgccgatgaagccggcggcgaaggcgttttccggcgcggtgtagagggtctccgcgtcgccgctctggacgatgcgtccggcgttcatcaggacgatgcggtcggacagggtcagcgcttcctcctggtcatgggtgacgaacaccgtggtcagccccagctcctgctggatgcggcgaatctgttcgcgcaggtgcttgcggatgcgcgcgtcgagggccgacagcggctcgtcgagcagcagcaggcgcgggcgcgtcaccagcgagcgggccagcgccacgcgctggcactggccgccggagagttggtgcgggtagcgtgcggcgtactcgcccagttccaccagttcgatggcttcggcgacccgctgcttcagttccgccgcaggcaccttctgcatgcgcaggccgaaggcgacgttctgttgcacggtcatgttggggaacagcgcgtagctctggaacaccatggcgatcccgcgcttctgcggcggcaaaggcaccacatcctcgccgtcgatgaggatgcgcccgctgtcgacctcggtcagcccggcgatgcagcgcagcagggtggacttgccgcagccgctggggccgagcagggtgacgaactcgccgcgggcggcggcgaagtcgatatcgcggaagatgctggtggcaccgtagctcttgtcgagctgttcgacgctgacgaacgacatgatcaggccttgtccttgttcagtcgattggccgcccaggtcaggaccaggacgaacacgaagtag

SEQ ID NO: 5128 - DNA, 1050 bp, Pseudomonas aeruginosa
agcgcggcaggacgtcgatcagcgcgcgacatggtagctcctgcgcagcagccattggtggaccagggtgatcagggtcatcaggccgaccagcaccatggccagggcgctggccatgttcgggtcggggaacacgtcgccggcgaccagcgcgccgatgcggatcgggatcacgttgaagttgccggtggtcagcgagtacaccgtggcgtaggcgccgagggcgttggccaggaggatgacgaaggtacccagcagcgccggggtcagcaccgggatgccgatgtgtcgccagtactgccagccgttggcgccgagcagcgcggcggactcgcgccagtcctcgcgcagggcgtcgaaggccgggtagagcagcatcaccccgagggggatctggaaataggtgtagaggattatcaggccgatcttcgagtagagattgaagtcgtcgatccagccggcctgcttgagcaacagggtcagcgcgccgttgaagccgagcaggatgatgaaggcgaacgccagcggtaccccggcgaagttgctggtcatgttggagaaggccatgacgaagtcgcgcaggcggctgtcgacgtggcgcagcgaatggctgccgagcaccgcgatgagcaggccgagcaggctcgaccagccggcgatctccaggctgtggcggatcgcctggcggtagaagggcgagccgaacagctcgaggtagttggccaggctccaggcgtcgctggccttcaggctgttcagcgcgacccaggccagcggcgctatctggaaaatcacgaagaacgccgcgaagggcagcaggaacagcagcgccagccatttgccggagagtcgtttcatggggcgagcagctcccggcagacgggtttgtcgtgggcggcgccgaggatttcgcagagcgtgccgcagaggtcggtctgcagcggttgcgccaggtcgtcgcggctgaaggcgtcgccgaagacgaacagcggcacctcgcgctcctcctcgaggatgccgccgtggctgcggtcctcgttcattccgtga

SEQ ID NO: 5129 - DNA, 801 bp, Pseudomonas aeruginosa
tgtaccgcttggtcggctcgcgccgcgagattgccgcgcgcaacctcgaactgtgctttcgggaaaagtgcgcccgccgaacgcgagcctctgctgaaggagaacttcgcctccagcggcatcgcctttttcgagatggccatgagctggtggtggccgaaggcgcgcctggcccgtcttgcccatatagaaggcctggagcatctgcgcgaggcccaggcgcagggcgagggggtgatcctcatggccctgcatttcaccactctggagatcggcgcggcgctgctcggccaggtgcacaccatcgacggcatgtaccgtgagcacgacaacccggtgttcgactacgtccagcgccgtggccgcgagcggcacaacctcgatgccaccgccatcgagcgcgaggacgtgcgctcgatgctcaaggtgctgcgtggcggccgcgccatctggtacgcaccggaccaggactacggcgccaagcagagcctgttcgtgccgctgttcggcatcccggcggccaccgtcaccgccaccaccaagttcgcccgcctgggccgggcgcgggtgttgccgttcacccagagccgcctggccgatggcagcggttatcgcctgaccatccacccgccgctggaggacttccccggcgagagcgaggaagccgattgcctgcggatcaaccagtgggtcgagcgctgcgtgcgccagcagcccgagcagtacctgtgggcgcaccggcgtttcaagacccgcccgccaggcgaagccaagctctatccgaaacggcgcaagcgctga

SEQ ID NO: 5130 - DNA, 1239 bp, Pseudomonas aeruginosa
gctggatttttccgggattcatgcggcggtgcgccagcgccagttgcgcgcggtggcggtgaccgcgttcggctacgagtcggggcaggcggtgaccttctaccaggggcgcgcgaccatcgatccctgggtacgccatcggcgcctgggcattcccacccgcctggagcttcggcacctgctggccagcgcggcgatcccgctgctgttcccgccggtgcggatcaaccgcgaatacttcggcgacggcgcggtgcgttcccaggcgcccatcagcccggcgttgcacctgggcgccacgcgggtgctggtgatcggcgtcagcggcaacccggccaccggtggcgacagtgccatgaccggcctgccgccgtccgaccgaccgccgagcctggcgcagatcggcgcccacctgttgaacagcaccttcatcgacagcctggaaggcgacatcgagcagttgcagcggatgaaccagatcggccagttggtggcgccggaggtgcgccgccaggcgggtgggctggagccggtggaggtattgctggtgtcgccgagccggccgctggacgagatcgccgcgcggcactaccgggagctgtcgcgggtgctgcggcttttcctgcgcggtcccggagcgacccgcgccagcggggcgggggtattgagctacctgttgttcgagcgcggctattgcagcgaactgatcgaactgggctaccacgatgcgatgggcaagcgggcggaactggagcgcttcctgcggatcgagcggtaaaccttattcaggacgggacaggcggaaggaaaaaaccgccccgaagggcggctcgcgcacggctcagacggccaggacaccgtcgcgatagtcgcgtagcgcctgctcgatttcctcgcggctgttcatcacgaacggaccgtactggacgatcggctcgcgcaacggcttgccggcgagcaccagtacccgggcgccggcttcgctgcgcaggctcagttccccttcttcggacagccgagccaggcgattggtggcgatttccaccgggcgttcgccttccaccgtcaggctgccttcgtagacgtacagcagcacgcgatggccgtccggcaggcgcggggcgatgcggccgccggcaggcagttgcaggtcgtagtagtgcggctcggtgtccggcctttccacggcgccgatctgctgcgcctggccgtcgtcgaagcgaccggcgatcaccgtga

SEQ ID NO: 5131 - DNA, 1188 bp, Pseudomonas aeruginosa
accaggaaatcctcaaggaggcgcagcaatgatcgctcgtctccttgccgcgctcggccttgcggccttcgctccggccctctgggccgacgcgctgaccggcgacgtgcagcgccagccgctgaacgtctcggccatcgtcatgttcgtcgccttcgtcggcgcgaccctctgcatcacctactgggcatccaagcgcaaccgctcggcggccgactactatgccgcaggcggccgcatcaccggcttccagaatggcctggcgatcgccggcgactacatgtcggcggcatccttcctgggtatttcggcgctggtcttcacttccggctacgacggcctgatctactcgatcggcttcctggtcggctggccgatcatcctcttcctcatcgccgagcgcctgcgcaacctgggcaagtacaccttcgccgacgtcgcctcctaccgcctcaagcagaagcagatccgcaccctgtcggcctgcggctcgctggtggtggtggcgttctacctgatcgcgcagatggtcggcgccggcaagctgatcgagctgctgttcggcctcaactaccatgtcgcggtggtcctggtgggcatcctgatggtgctctacgtgctgttcggcggcatgctggcgaccacctgggtgcagatcatcaaggccgtgctgttgctttccggcgcctcgttcatggcgatcatggtgctcaagcacgtcaacttcgacgtcagcacgctgttctccgaagccatcaaggtgcatccgaagggcgaggcgatcatgagtccgggcggcctggtcaaggatccgatctcggcattctccctgggcttcgcgctgatgttcggcaccgccgggctgccgcacatcctgatgcgcttcttcaccgtcagcgacgccaaggaagcgcgcaagagcgtgttctacgccaccggtttcatcggctacttctacatcctgaccttcatcatcggtttcggcgcgatcctgctggtcagcaccaacccggacttcaaggacgccaccggcgcgctgatcggcggcaacaacatggcggcggtgcacctggccgacgcggtgggcggcagcctgttcctcggcttcatctcggcggtggccttcgccaccatcctcgcggtggtcgccgggctgaccctggccggggcctcggccgtctcccatga

SEQ ID NO: 5132 - DNA, 1803 bp, Pseudomonas aeruginosa
gccatgcctgacagtttcaacttcgcctcgccgcccttcgaccagttgcgtccccatcagcgcgagaccctcaagcaggccctcagcgtaggctactacgcgccgggggaaaccttgctggaggccggttcggcggtccccgggctgttcgtcctgctcaagggcgtggtcgaggagcgcggcgacgacgggcgagtgttcgcccagtacgccgcggacgacctgttcgacgtccgcgggctgttttccggcagcagcaagcatcgctacctggcgatcgaggaaagcatcgtctacgaactgccggccagttgcttccaccagttgtgcggggagaacccgggtttcgcccggttcttccaggccgacctggcggccaagcgccagttggcccagcgcgacgggcagaaccttgccgagttcatccttacccgcatcgcccgcgagcacttgctgccggcgctggaggtggaggcctcgctgtccctcggcgacgccgcgcgcctgcaattgagccacggcgccgatgccctgctggtgcggctggagagggacgggcccgagctcggcatcgtcacccgcaccgacctcatgagcgcgcacttccgcgacgggcgcagcgagctggaggctatcgggccgttggcccatggtccgctggccagcgtcgaactgggcgatttcctgttcgacgcgatgatcctcatgacgcgccagcgtatcgagcgggtcgcggtcacggaggacggtcaggtgatcggcctgttgcacctgacccaggtgctcagcctgttctccacccattcccacgtcctggcgctgcgcatcgcccgcgccgacgacctcggcgacctgcgccgctgcgcggaaaccctggacaccctgatcgctaccctggccggcaacggtatccgcctgcgcttcatcatgcagctggtcagcgcgctcaacgagcaattgctcgaacggcttttcgaattgttgctgccgccaaccctgcgcgggcgctgctgcttgctggtgatgggcagcgaaggacgcggcgagcagttgctgaagaccgaccaggacaatgccctggtcctggccgacgatctgccgcaggaacaggccctggcgatgatgcagcgcttcagcgcggccttgctggagttcggttatccgccctgtcccggaggggtgatggccagtcggccggaatggtgcaagccgctggtggcctggcaggcggagctgcgcgggacgctgctggagggcaagccggagcagctgttgcgcctgtcgatcctggccgatgcctggccggtggccggcaacctgcagctgttcgagccgttgcgtcggcaactgcgcggtttcgccgacggcggcgagcgctggctggcggatatcgcggcggcggccctgcaattcgatacgccgctgaccttcctcggccagctgaaaacccaggacgcccgcctcgatctcaagcgcggcgggatcttccccatcgtccacggcatccgcaccctggccctgcgcgaaggcctggagacccgcgggaccctggcacggatcgaggcgctgaagcgacacaaggtcctcgaagcacgcctggcggacgacctgagcgagtctttcgagctgttcctgcaactgcgcctgacccgccagttggccggccaacgcgacggtcgccagcagggcctggacgtcagcggcatgagccgccacgatcgcgacatgctgcgctacggcctgcatgtggtgaagaagttcaagcagagcgtggcccgtcaattccacctggagacccgatga

SEQ ID NO: 5133 - DNA, 1389 bp, Pseudomonas aeruginosa
tctagggcccgatcgggaatgccgtcgcggcgggtatcggcggataacgcctccggcgttattcgccctacgcggagggttcccagctttcgctccgccgttgcggcggggtatcggcggataacgccgttggcgttatgcgctctacgtaggatggatcgaagccttcgcttggtgaagggcggtttcatcgcgggtccgccgggcgctttttttccatcgaccggcttcacttgccttgcgtctcgcgccagactggcgcgcatgccgatccagacgcttgccacccttgccgatatcgacgccgccgagtgggacgccttgctgcctcccgcccagccattcctgcgtcatgctttcctgtccgcgctggaagacagccacagcgtgacgcccgctaccggctggcgcccggctcatcgcgtgctgcgcgatccgcaagggcggctgtgcgcggcgctgccggcctatgtgaaggcgcactcgtacggcgaatacgtgttcgactggagctgggccgacgcctgccagcgggccggtgtccgctactacccgaagctgctggtaggggtgcccttcaccccggtcgccggtgcgcgcctgctgggcgaggacgaagggttgcaggggctgctcgcgtcccttggcgaggaggccgaggcgagcggtctgtcgagcatccatgtgaatttcaccgacgcccgggcggacaccttgcttgccgcgcgtgacggttggctcgaacgcctggggtgccagtaccactggcacaaccgcggctatcgggacttccaggacttcctcgaggccctcagttcgcgtaagcgcaagcaactgcgcaaggagcgcgaacaggtcggcggacagggcatcgagttcgaatggcgggaaggcggccagttgtccgaactggagtgggatttcgtctatctctgctacgccaacacctacctggtgcgcgaccgcgatccctacctgagccgcgagttcttcggcctgctggccgagcgcatgccggaggcgatccgcgtggtcttcgcccaccagcgtggcaagccggtggcgatggcgttcagcctggtcgctggagataccctgtacgggcgctactggggatgcctggccgagttcgaccggctgcacttcgagacctgcttctaccagggcctggaattcgccatcggcgccggcctggcgcgcttcgacgccggcgcccagggcgaacacaagctgatccgcggtttcgagccggtgctgacgcgctcctggcactacctggcgcatcccggtctgcgcgatgccgtggcgcagttcctcgaacaggagcgggcgggtgtgcgcgcctacgccgaggaggcccacggcctgttgccctaccgccaggcctga

SEQ ID NO: 5134 - DNA, 762 bp, Pseudomonas aeruginosa
tggctctcttctggagcgggcccgtcctgggcccgccggatcaagcccctgcggctggactcagaggcgtttggcggacaggatcaccacgtcgtcgctcggcacgtcggcgaagccgttgcggcgggtggtgggaaccttggcgatctggtcgaccacgcccatgccacgcaccaccttgccgaacacggcatagccgaagtcgcgggcaccatggttgaggaagtcgttgtcggtcaggttgatgaagaactggctggtggccgaatcgaccactccggtacgggccatggcgagggtgccgcgctcgttaagcaggccgttgtcggcctcgttcttgatcggtgcacgggtcttcttctcctgcatgccggcgctgaagccgccggtctgcaccatgaagcccgggatcacgcggtggaacagggtgccgtcgtagtagccgctgtcgacgtactcgaggaagttcttcacgctgatcggcgccttggccggatcgagttctacctcgatctcgccgaggctggtggcgatcaggacgtgcggcttggcggcaggagtggcggccagcagggaaccggcgaagagcagggtgcaggcggcgatcaggagacgtttgagcatggttgttccttggttttatcgatatcggcgaggaagccgagcagggtggtgttgaaaatctcgggttggtccatcggcgtggcgtggcgggagtcctccaccaccaccaggcgggcgtcggcgatccgctcgcaatag

SEQ ID NO: 5135 - DNA, 1047 bp, Pseudomonas aeruginosa
ttcgccgaccgcgaatggcagcaggcacagggcgactaccaggttctgccagagcgccgcctgcaccgggccgacctgcccgctgttgctacggttggccagcgacagcagggcgaacagcaggccggaaaggatcgcccagagcaggccgagggtggcgccgctggcgaggtcgaagttcggcgtgaccagcaccaggccaaggctgaccaggaccaccagcagtccttccgcgagatgaatgcgctcgcggaagagcagcccttcgaggattaccgtgaaggccgggaagctggcgaagccgagggtggcgatggccacgccggcggtcttcacggcgatgaagaaactcacccagtggccggccaggagcaggccgcagagcgccaggcgcagccattgcgcgggtcccagggcgcgccaggcctggcccgcgaggcgggcgaagaggccgagggcgagcaccgcgaacagcgcacgaccgaacacgatcaccccgggggaggcgctggccagcttgccgaacaccccggtcaggccgaagaggagggcgccgccgtgcagggcggcgagggcggaacgtcgattcatggggatccttcaggccaggcgcgcaccgttgggcaggggcttgtcgaagccggccaggaccaccttgtcctcgctatcgtagaccccggtgaccaggacctccgagcgcaccccggcgatctgcttcggagcgaagttgcagacgcagaggacctggcgtccgaccagttgctcggcctggtagtgtgcggtcagttgcgcgctggaggtgcgcaggccgagcggtccgaggtcgacctcgaggacataggcgggtttgcgtgccttggggttgggagcggcgctgaggatggtgccgacgcgcagttcgacgcgttcgaaatcctgccattcgatgatgtccatgctgactcctgttctgtcgatgggcagagagtaaggagtcgtgacggatttgtctgtcgtgcggctagccggttttgtcgcgggactcgcgacgcagttgtcgcggggtga

SEQ ID NO: 5136 - DNA, 339 bp, Pseudomonas aeruginosa
aggcgctctgcgaggcgtagccgacccgggcggcgatctcgcccaccgccaggctgctctccagcaacagttcgtgggcctggtgcaggcgtcggctgcgcgcgtagtccatgggcgtctgtccggtctcggcgaggaacaggctgtggaagcgcgccaccgaaagaccggccagccgcgccaggtcggctacctgtagcggatgggcggcatggcggtcgaggtaggcgtcgaggctggccagtggcaggcggggctgctggcgcggcggctggcgctcgctggccaggctggcgaggagcaggccggcgccctggtgggcgatcaccgggtcgttga

SEQ ID NO: 5137 - DNA, 1041 bp, Pseudomonas aeruginosa
ggcccaggaccaattgggcatggtcatggctgtggacgatctggtcgtggctgtagtggcgcagggaaaggatcgaacccatggcgaagctcccggaggcaggcgcccagtctacccgctggcgccggcgacagacagccgggccctgtcacgcaacggtcgccggcctgtcacagtcgtttcaccggcgccggccaagatcggaaaaacaccgtcggagacccgccgatgagcaccgcgcaacgcttcacctcgaaccgcaagcagcgggtccggaccctgtggatctcggatgtccacctggggacgcgggattgccaggccgaacacctggcggcgttcctcaagcgctaccacgccgatcgcatctacctggtgggcgacatcatcgacggctggaagctgcgcggcggcatctactggccgcaggcgcacaccaacgtgatccgccgcctgctcaccctgagcaagcgcggcaccgaggtgatctacgtcaccggcaaccatgacgaattcctgcgccgctattcgagcctgatcctcggcaacatccgcctggtcgacgaggcggtgcacagtaccgccgacggccgcaagctgctggtgatacacggcgaccagttcgacgtgatcacccgctaccaccgctggctggcgttcctcggcgattccgcctacgagttcaccctgctcctcaaccgttggctgaaccactggcggcggcgctggggctacggctactggtcgctgtcggcgtacctcaagcacaaggtcaagaccgcggtgaacttcatcagcgacttcgaggaagccatcgcccacgagtgccacaagcgcgggctcgacggggtggtctgcgggcacatccaccatgccgagatccgccgcatcgagggcgtcgattacctcaactgcggcgactgggtggagtcctgcacggcgctgatcgaacactgggacggcagcatccagctctaccgcctggccgaggagcaggcgcggctggcggcgcaggccgcggcggtcgagccggcggcatga

SEQ ID NO: 5138 - DNA, 1530 bp, Pseudomonas aeruginosa
ccactgctggctggccacggcgtggaagagcaccgccagcaccagcaggctgccgacgtagtgcaggcggcggcacaccgcgttgctgtgttcctgcaggtagtaggggtagaactcggcgaaactgtggaaacgctcgtcatcagggctgctcatggaatgcctcctctcgttgtgtccgcgcagtgtaatgcgggccgcacgatgtcgcggatgacatacagggccagtttagtatccttgggccgccaggccggacgacggtcggcgtgcctcccgccagaacaagaagagaccgatgccggaacgtacaaccttgtccagctgggtccagggcatcatcctcgccctggagctggaaggcctagacggacgccagctgttcgccgagctgggcctcgactaccaggccttgcaggaccccgacgcgcgcttcccgcaggacgccatgagccgtctgtggcagcgtgcggtggcgctcagcggcaacccggcgatcgccctgaacatcgcccgggtccggcgcccggctttccacgtcgtcggctatgcgctgatgtcgagccgcaacctggcggaaggcttcgcgcgcctggagcgctaccagcggatcatcgcggaagcgtccgacctgactttccgccgcacgccgcagggctatcgaatcggcgtcacggtgcatggcgatcgcctgccggcgccaccgcagagtgccgaatgctcgctggcctacctggtggacatggtccgctggatcaccggccggtcgctggacccgctggcggtggaactgcccggcgcgccccgcgagccgctggcaccctatgtcgagctgttccgcgcgccgctgcgctttcacgccgaggagttcgcgctggtgttttcccgcgtcgacctcgagacgccgctaccctcggccaacgaggcgctggcccagttgcacgatcgcttcgccggcgaatacctggcgcgtttcagtaccagccgcattacccatctgacccggcagaccttgtgccggctgctgccgcagggagaacccaagcgcgaacgggtggcccaggcgctgcacctgtcgcagcgcaccttgcaacggcgcctccaggaagaaggcaccagctaccagcaactgctcgacgacacgcgccgggatatggccgaacagtatctccagcagcccggcctgaccttgctggaagtcgcctacctgctgggtttcgccgatccgagcaatttcttccgggcattccgccgctggttcggctgcacgcccaacgaataccgggcgcgccgccaggagcgcccgggctagtcgccaggccaggcgggacgcttcagggctgcacggcgggttgcgccgaggcctggcgtagggtccagtcgagaacctgggccgacagcgtatcgccggccttgccgaaggcgctgaccaccgccgcgaccttcttgccatccaccggctggctgacctcgaaacgccggctggcgaccacgcgcttgtcgtcggtacgcaccaggcgcgcgtcgtag

SEQ ID NO: 5139 - DNA, 804 bp, Pseudomonas aeruginosa
ttctccggcacggcggcggcttggtgggcggcgcgcccgcgcggcccgtggaagtattcgcggacccaggcgtcgtcggtggcggcgacccgttccagggtatcgactaccaggaccttcttctgcgacagcacggcgacccggtcgcagatggtgtacagggtgtccaggtcatgggtgaccaggaacacggtcaggccgagggcgtcgcgcagggtacggatcaggttgtcgaaggccgccgcgccgatcgggtcgaggccggcggtgggctcgtcgaggaacaggatgtccgggtccagcgccagggcgcgggccagggcggcgcgcttgatcatgccgccggaaagcgaggccggatacttgtcgccggcgttggccggtagcccggccagggccagcttgacctgggccaggtgctcggcgtcggcgcgcggcaggccggcgttctcgatcagcggcagggcgacgttctccaccacggtaagcgaggaaaacagcgcgccctgctggaacagcacgccgaagcgccgttcgaccagggagcggcgctcctctggcagttgcagcaggtcttcgccgaacacccgcacgctgccggaggtcggccggcgcaggccgacgatgctgcgcagcagcaccgacttgccggtgccggagccgccgaccacgccgaggatctcgccgcgacggacgtcgaggtcgaggtgctcgtggaccacctgggcgccgaaacggttgcacaggtcgcggacctggatgatcgcctgcgggttgtcctggttcaccagcccatctccatga

SEQ ID NO: 5140 - DNA, 669 bp, Pseudomonas aeruginosa
ccccgccgctgcagccgcacctggcgccgggacgggtcgcctgagagcgggcgtgagcctggcgattgcgtctacaatggcgatttcgtttctgacaggagttcgcccatggaggctctcgacgccttgctcactcgcgtttcccacgcccgcctgagcgatcccgcgccctcgccggagcagctcgaccggctgttccgggtcgccttgcgtgccccggaccacgggcaactgcggccctggcgcttcatcctggtagagggcgaaggccgccgggccctgggcgacctctacgcccgcgccctggcgagccgccagccggacgccgccgaggaagcgctggccaaggcccgcaacatgccgctgcgcgcaccgctgctggtcgtggcggtcgcttgcctgcaggaccacccgaaggtgccgcacgctgagcaactgctggctgccggctgcgccgcccacggcctggtgctgggcgcctatgcccagggactgggggcgatgtggcggaccggcgagatggccaccgatccggtggtgcacgccggcctggggctcggcgagcaggagcggatcatcggcttcgtctacctggggacgccgatgggcgagttgcgcacgccggcggaactcgacccgtcggccttcgtcagcgcctggccgggctga

SEQ ID NO: 5141 - DNA, 582 bp, Pseudomonas aeruginosa
gcagttccaggccgctaccgtccggcagcatcacgtcgagcaccacggcatccggtgtctgctcggcgagggcgcgacgggcctgggcgccgtcgtggctggcacgcacggagaaaccttcctggaccagccaggtaccgagcagctcgcagagctcccggtcatcgtcgatcaacagcagttcgctcatcgagtgtcgctcaattgatccattcgcgtcgctgtcgccggcggccgcggctcagggcaccgaggacgaacgcgagcagggccgtggcggcgccggcgacataccaggtctgctcttccgtgagcagcggcggttgccgctgcgcctgggccgcctgcagctgctcgcgcaactggcggttctcctggcgcatacgactgaccagttcgtcgcgctggcgttccgtttccaccaggcggcgctccagttcggcggtagcctgcgtaatggaaggctgcgccggctggaatccgtgccggcgcgggttcctcggccagggccagggaagctcccaggctcagcagcaggcaatgggcagcggatggacgcatcatgactccttgtaccgatga

SEQ ID NO: 5142 - DNA, 756 bp, Pseudomonas aeruginosa
aacagtcatcctgtctttccgaatgcgtcaggcctgtgccgcaggcgcattcgccaggtggagcaggctccccggacccatgaacggtacgtctcgataccgcgaggcagcgaatcggcgttgcttcatcaccattcttcactggaatcaggattcagccatgcgtgtcgatctgcattgccacagtaccgcctccgatggcgtgctcgcgcccgccgccctggtgcagcgggcccacgagaaaggcgtcgggctgctggcgctgaccgaccacgacaccctggaaggcctgccggaagcccaccaggcggccgctcgactcggtatcgaactggtcaacggtgtcgagctgtcctgcacctggggcggtgccaccattcatgtgctgggctacggtttcgacctcgacgccgctcccctgcgccaggcgaccgaagccctgcaccggggccgctgggcgcgcgccgaggaaatcgaccggcggcttgcggccaagggtatgcccggtgcgctggagggcgcgcgggcgatccagcgggccctgggcgacagcggcaacgcgccggcgcggccgcatttcgccgagttcctggtccagggcggctgggtcaaggatcgcgccgacgcgttccgcaagtggctgggggccggcaagctgggagacgtcaagcagcactggccgaccctggaggaagtggtcggctgcctgcgcgaggcgcgcgcctggatcagcctggcgcacccgtatcattatga

SEQ ID NO: 5143 - DNA, 918 bp, Pseudomonas aeruginosa
tttcacccggaccaagcgccggcgcctggtcgccgactttctccaggccggcggacacgccatcgaggtggtcaatggcgtgcagccggccgaacaggtcggtaccctgtcgatcctggcccgcgagttcggcctgatggtcaccgccggcagcgatttccacgcgccgggcgactggtccgaactgggcatgtaccgtgcggttccagaggaccttccggccatgtggccgcgtttcgccaggcattttcgcgataccgaacgtcattccgaagccaagggggccgaatgagccagttcttccagatccatccggaaaatccccagccgcggctggtcaagcaggcggtggaaattgtccgccagggtggggtgatcgtctatcccaccgactcgtcctatgccctgggctgccgcatcggcgaaaagaccgcggtggatcgcatccgccgcatccgccaactggacgacaagcacaacttcaccctggtctgccgcgacctttccgagctgggcgtctatgccaaggtcgacaccggcctgttccgcctgctcaaggcgcacacccccggtccctacaccttcatcctcagcgccacccgcgaggtgccgcgcatgctcctgcaccccaagcgccgcaccatcggcttgcgcgtgccgaactgcccgatcgcccgtgcgctgctggaggaactgggcgagccgctgatgagcgtgagcctgatcatgcccggcagcggcgagccactgaacgatccctatgaaatgcgccaggtactggaacaccaggtcgacctgatcgtggacgggggctatggcggcggcgaggcctccaccgtgatcagcctgaccgacaccgatcccgaagtgatccgcgtgggttgcggcgatccggcgccgttcatgcagccggcctga

SEQ ID NO: 5144 - DNA, 1020 bp, Pseudomonas aeruginosa
cccggccaacgccgacacccctccagccgaacccgccgccgagcgggtgccgctgcaactggcgctggtctacggcgaggcggtcaccgagctgccgcaggacctctatatcccgccggacgcgctggaggtcttcctcgaggccttcgagggcccgctcgacctgctgctgtacctgatccgcaagcagaacatcgacatcctggatatcccggtggcggaaatcacccgccagtacatgggctatgtcgagctgatgaaggcggtgcgcctggagctggccgccgagtacctggtgatggcggcgatgctggcggagatcaagtcgcgcatgttgctgccgcgctcggcggaagccgaggaggaagaggaagatccacgggccgagctgatccgccgcctgcaggagtacgaacggttcaagaaggccgccgaagacctcgacgaactgccccgggtcggccgcgacgtgctggtgccggcggtggctgctcccgaggcgcgggcgcgcaagctgctgccggagctggcgctgcaggagctgatgctggtgatgggcgagatgctgcgccgcgccgacctgttcgagagccaccaggtgacccgcgaggtactgtccacccgcgaacgcatgagcgaagtgctggagcgcctgaaaggcggcgccttcgtgcccttcatccagttgttcaccctggaggagggcaagctcggcgtggtggtcaccttcatggcgatcctcgaactggtcaaggagcagatggtggaactggtgcagaacgaggctttcggcgccatccatgtgcgcctgcggatagcccgcgaagcggaggaaggcgaaaccctggaggaagccctgggagacgatttcgagtgagcgcgccgctggccgttcgtcctcctgcggacggtcgccttttccgagcttccggcttcgctccctgccgtggcctgttaagctgcatgcccgattccgctatctttccctcttcctggctccggtatccgttgcgacgatga

SEQ ID NO: 5145 - DNA, 378 bp, Pseudomonas aeruginosa
tcggcctggaactgggtgccgacgactacctgggcaagccgttcagcccgcgcgagctgctggcgcggatcaaggccctgctgcgccgcgcgcagttcacccaggtgcgcggtggcgacgtactggctttcgaggactggcggctggacacggtcagccaccgactgttccatgaggacggcgaggagttcttcctcagcggcgcggatttcgccctgctcaagctgttcctcgaccatccgcagcagatcctcgaccgcgacaccatcgccaacgccacccgcggccgcgaggtgctgccgcttgagcgcatcgtcgacatggcggtcagccgcctgcgccagcgcctgcgcgacaccggcaaggcgccgcggctga

SEQ ID NO: 5146 - DNA, 873 bp, Pseudomonas aeruginosa
tccagaccgtgcgcggcagtggctacctgctggcggcgcaggtgcggccgcacctgcagccatgagcgaacggcggcgctggtcgccggtgccgcgctcgctgctcgggcgcatgctgctcctgaccctgctcgcggtgctggtcgcgcaagggctttccagcctgttctggctgtcgcacctgcgctccagccagcgcgagggcctgctcaccagctcgcgcagcctggcctactcgatggcggccagcgtcagctacttccgttccctgccgctcggctaccgtccgctggtgctcgaccagttgcgcagcatgggcggtacgcgcttcttcgtctcgctgaacgaccggccgctggagatgcgtgccctgccggacacgccgaacaagcaggcggtgctggagatcgtccaggacgtgttgcaccaacgcctgggcaaggaggtcgagctgcaggtcgaattcgtcagtcccgacgagctgcgcctgttcaacggcgcgctgaagctcgacgagctgccgcgttcctgggcgcactacgcgctgaccctggagccggtgaacccgccggtgctggtgacccagatccgcatcggcgaaagcgagtggctgtacatcgccagcctgatgccggcgccgtacgtcagcctggaacccgagggactgcaaccgcagcaggtgctctcgatcgttttcaccagcctgttgctgctgcttttcaccggtttgctgatgcattggcagagccgtccgctcaagcgcctggcgcgcgccgcccgcgacctggccctgggcagtccgtcggcagcgctggaggagcgcggcgccagcgaactggtggaggtggcgcgcgccttcaacaccatgcatga

SEQ ID NO: 5147 - DNA, 1323 bp, Pseudomonas aeruginosa
atagactcgaagcattgcaagcgcagacttgctccgaataacaagaagaaggttttcctcatgaatgcgatccgtcgcctctctgccgtcatctgtctttcctccctctgtctctccccactgctggcccaggccggcgaagtcgaagtgctgcactggtggacctccgccggcgagaagcgcgccgccgaaaccctgaagaagctggtcgaagccaagggccacacctggaaggacttcgccgtggccggcggtggcggcgaggcggcgatgaccgtgctgaagacccgcgcggtgtccggcaatccgccggccgcggcgcagatcaaggggccggatatccaggagtggggcgaactgggcctgctcgccgacctcaacgcggtggccgccgaaggcaagtgggacagcctgctgccgaagcaggtggcgcagatcatgaagtacgacggcgactacgtagcagtgccgatcaacgtacaccgggtgaactggctctacatcaacccggaagtgttcaagaaggccggcgccaccccgccgaccaccctcgacgaactgttcgtcgccgccgacaagctcaaggccgccggtttcacgccgctggcccatggcagccaaccgtggcaggacggcaccgtgttcgagaacctggtgctgagcaagatgggtccggaaggctatcgcaaggccttcgtcgaacaggacaaggcgaccctcaccggagcgcagatggtcgaggtgttcgccgcgctgaagaagctccgcggctatgtcgatgccgacgccgccggtcgcgaatggagcgccgccacggcgatggtgatcaacggcaaggccgggatgcagatcatgggcgactgggcgaagagcgagttcaccgccgccggcaaggtgccgggcaaggactaccagtgcctgccgttccccggcacgcagaaagccttcgactacaacatcgactcgctggtgatgttcaagctgagcaacgcggagaaccgcaaggcccaggaagacctggcgcgcagcgtgctcgacccgtccttccagaaggacttcaacctcaacaagggctccatcccggttcgcctggacgccgacatggcgccgttcgacagttgcgcccagcagtcgatgaaggacttcaagcaggcttcccaggacggcaacctggtgccgagcatggcccacagcatggccgcttccagctacgtgcagggggcgatcttcgacgtggtgaccaacttcttcaacgaccccgccgcggatccgcagaaggccgcccagcaactggcggccgccatcgaggcggcggcgcagtaa

SEQ ID NO: 5148 - DNA, 801 bp, Pseudomonas aeruginosa
ccccggagacgaacgaaacatggcaaccctcgaactgcgcaacctgcacaagagctacggcagcggcctggcggataccctcagggacatccggctgaagatcgactccggcgaattcctgatcctcgtcgggccctcgggttgcggcaagtcgaccctgatgaactgcatcgccgggctggagagcatcaccggcggtgcgatcctggtggacggccaggacatcagcggcatgagccccaaggaccgcgacatcgccatggtcttccagtcctacgccctgtacccgaccatgagcgtgcgcgagaacatcgccttcggcctgaagatccgcaagatgccccaggccgccatcgacgaggaggtggcgcgggtggccaggctgttgcagatcgagcacctgctcgaacgcaagccctcgcagctctccggcggccagcagcagcgggtggccatgggccgggcgctggcgcggcggcccaaggtctacctgttcgacgagccgctgtccaacctcgatgccaagctgcgggtggaaatgcgcaccgagctgaagctgatgcaccagcggctgaagaccacgaccgtgtatgtcacccacgaccagatcgaggccatgaccctcggcgacaaggtggcggtgatgaaggacggcgtcatccagcagttcggcacgccgcagcagatctacaacgacccggccaacctgttcgtcgccagcttcatcggttcgccgccgatgaatttcattccgttgcgcctgcagcgccgggacggacgctggaccggcctgctcgatag

SEQ ID NO: 5149 - DNA, 744 bp, Pseudomonas aeruginosa
cctgcgtaccgaggtcgaggtgctcgaaccgaccgggccggacaccctggtcttcgtcaccgtcaaccaggtcaaggtctgttgccgcctggcgccggacgtcgcgccggccgcgggcagcggcatgagcctgcgcttcgatcccgcgcgggtcctgctgttcgacgcgcagagcggcgagcgcgtggccgtgcgcacggcgggcgtggtggcggagaaggtcaccgccttgaacggcaatcgccagaagaactcctgaatcctttcgtactgcctagaccacaaccacgaggacgctggaaatgtacaagaacaagaaaaccagaccggccgccaggaccgttggctgcctgtttgcccttggagcgctgggcttggggagcgcggcgcacgccgccgaggcgttctccccgaactcgaaatggatgctcggcgactggggcggcaagcgcaccgagctgctggagaagggctacgacttcaagctggagtacgtcggcgaggcggcggccaacctcgacggcggctatgacgacgacaagacaggacgctacaccgaccagttcgccctgggcgtgcacatggacctggagaagatcctcggctggaaggctaccgagttccagttcaccgtcaccgagcgcaacggcaagaacctttccaacgaccgcatcggcgacccgcgtgccgggcacatcagctcggtgcaggaggtctggggccgcgggcagacctggcggctga

SEQ ID NO: 5150 - DNA, 1398 bp, Pseudomonas aeruginosa
cagcagcgggtactcctcgcgctggccatggcggttgtgcgcaacgaaacagccggcgtccaggtgctcgcggctgtagaagcgccggcattggctctggaaggtttccagcaaccggtcgatccgtgtgcgccagtcctcggggccgagcaccagcatgaagtcgtcgccgccgatgtggccgacgaagtcgctgcccgggtcgatccgttcgctcaggcactgtgccaggcacagcaggacctcgtcgccgcgggcgtagccgtagagatcgttgaagggtttgaagctgtcgacgtcgatgtagcagatcaccgcctcgcgcctttgttgcagcaggtgttcgaggcattgctggatcggcacgttgccgggaagcaaggtgagcggattggcgtgccgcgcctgctggagcttttcctcggtgatcagcctgagcacgtcgatcacccggcccatgcccgcatagtgcccgccgcgggtgacgatgaaatcttcctcgatacgctggcgtgcgcggctggtcagcaggcggctgacctgctgcagggtctggccgagttccacggcgagaaaatcgtcgctcatcaggcggctgatcggcttgcgcaggaacaggtcgcaggcgaagggccggagcaaggcgtcggtgagcgcgtggcgatggacgatgccgatgggacgcccttcttcgtcgaggatcgccagggagttcaggttggcctggcggcggaagatttccaccacttcctgggtcgaggtgcgaacgtcgaccgcgcgctgttccagcagcagcgcacgcaggtcgccgtgctcgtcgctggaagactggctgggggcgtcagcgctgggcagcatctgttgtacgtcgctcgccgggtgttccagcgggcggccgaacagatagccttgcaccaggtcgacccccatctcgctaagcaccgcgagttcctcgggcagttcgatgccttcggcgatgacctgggcgcgagaggcccgcgccatcttcaggatggagccgacgaactcgcgtttcacggtgtccaggtggatgccgtcgacgaagtggcggtcgatcttcacgtagtccggacgcagttccgaccacaggcgcaggctggagtagccagcgccgaggtcgtcgagggcgatggagaagcccatggcgcgatagtggtgcagcgcggtgtcgagcaggtcgaagtcgtcgatgggggtctgctcggtcagttcgatcaccacccggttcggcgagatccccagctgttgcagcaattgcagggtgcggccgggcggatgaccggcctcgaggagggactccggggagacgttgaggaacagcatggcgtcgccctggatgtcgcggaagcggctgaaggcgcgttgtcggcagagtag

SEQ ID NO: 5151 - DNA, 498 bp, Pseudomonas aeruginosa
gtgagggtgcccgagggtgcggccggtgtattgtccgtcgagcacttcgagatcgatggcgaggacttcgtcgacgccgatccgcgccgcgatcggcttgaccaggtgcaccccggatgcggagacgatcagcacccggtcgttggcgctgcggtggcgcgccaggcaggcgcaggcgtcgctgtagatcagcggctcgatgacctcctcgacgtaggcctccacttcccgctcgacttcctcgacgctgcgaccgatcagcggttgcagggtgtagtccatgtacaggtccatggacagcttgccttcggcgtactgctccatcagttcggcgtcgtggcggacgaaggattcgtcgacccagccgagactcgccatgcgctggctccacaggctggagcagtcgcagtggatcatggtctcgtccaggtcgaagatcaccaggctcatcaagctacctctcgaatactgttgcgatcgatgaccagcgtcagctga

SEQ ID NO: 5152 - DNA, 1326 bp, Pseudomonas aeruginosa
cgaagcgctacccaccgtaacggcgatctgccgggcgctcagcgagcagatcggccatggtctgctgccggcgggtggcaagctgccggccgagcgcaagctcagcgagctgttcgcgacgacccggatcaccctgcgcgaggcgctgatccaactggagtcgcagggcctgatctatcgcgaggagcgccgcggctggttcgtctcccccgagcggctggcctacaacccgctggtccgcagtcacttccatgcgatggtcagcgaacagggccgggtgccggcgaccgaggttctgtcggcccggcagatgccggcgagcgcggcggtctgcgagctgctggagctgccggcgctgtccagcgtctaccagatccgccgggcgcggcgggtggacgggcggctggtgctgtatgtcgagcactacctgaacgcgcagtacttccccggaatcctcggccacgacctgacccgctcgctgaccgaactctatgccagcgagtacggcatccactatgggcgggtgcgtttcgacatggtgcccaccgcactgcatgccgaggctgcggcgccgctgaaggtggcggtgggcagcccggccctgcgcatcagccggatcaaccgcgaccagcgtggtcggctgatcgactgcgacctggagttctggcgccacgacgccatccatatcagcgtcgaggtaccgcagtaacgccacgcgtcgacgacctgcggcaccttctgcgaggatggggctccgggaaaaggagccctcgcatgttcatactgccgatttcgtccgacctgcacctggagctgctcgaccagccgcgcgcggaggaactgttccgcctggtacgtgccaacagcgagcacctggcgccctggatgccgtgggtgccactgacgcagagcgcggacgatacccgccgtttcattggcgaaagccagcggttgtgggcggagcgcaggagttgccgctgcgggatcgtcgaatccggatgcctggtcggcgtcatcgacctgcacgatttcaccgaggacagccgcagcgccagcatcggctactggctggcggcgtccgcgcaagggcgcgggctgctcgccagggcgctggggaagacgatcgagctgggtttccttggctacgacctgcagcgcctggtgatccgctgttccaccgagaacctgcgcagccagcgcgccgccgagcgccagggcttccggcgcgacggagtgatccgggccaacgagatcatcgccgggcgtgcccacgaccatgcgatctacacgctgttgcgcagcgaatggcacgctgcgcacgcctga

SEQ ID NO: 5153 - DNA, 2259 bp, Pseudomonas aeruginosa
gtggccccgggcgaatgcccggggcgtgagcgaggctggcgctcagggcagctcgctgctggcgtagaaggcgccgagcaccttgaccaggtgcgccaggtcatggctgccggccagctcgcgaatcgagtgcatggcgaaggtcggcaggcctatgtcgacggtgcgcacgccgacctggctggcggtgatcgggccgatggtcgagccgcatcccatgtcgctgcgggtcacgaaactctgcaccggcacttcgctgtcctgacagaggtggcggaagaagccggcggtttcgctgttggtggcatagcgctggttgctgttgatcttgatcaccggaccgccgttcagcgccgggccatgattggcgtcgtgcttgtcggcgtagttcgggtgtacgccatgggcgttgtcggccgagaccagcagcgagcgctggatcgcccggctgaaggcgtcgccttccggcagcaggcggcgcagtacctgttcgaggaacgggccgtcggcgccgcaatgcgaacaggaaccgacttcctcgtggtcggtgcagaccaggatgcagttctcgtcgccttcggcgttgagcagggcttccaggccggcgtggcaggacagcaggttgtccaggcgcgccccggcgatgaactcgtcgttgagacctaccaccgcggcggactgggtgtcgtagaacgacagctcgtagtccagtaccacgtcggcggtgatgccgtgctcgcgcagcagctgttcgtcgagcagcaggcggaagtcggcggcctcgcccggcgccagctgggcgatgatcggcggcagttcgttctgcgcgttgatcggccaaccctcgttggcggcgcggttgagatggatggccaggttggggattaccgcgatggccttgcggaagtcgaccaggcggctttccagcttgccattggcgcggaaggtgacgcgcccggccagcgacaggtcgcggtcgaaccagggggcgaagagggcgccgccatagacttcgacgccgagctggaggaagccgttgcgagcgatctccgggttcggcttgacccgcaggcaggggctgtcggtgtgcgcgccgaccaggcggaagccgctttccaggggcgagcgacggcccaggcggatggcgatcagcgacgagtcgttacgggtcacgtagtagcggccgccggtttcggtgtgccaggcgtcgcgctcgtcgaggcggcggtagccggcggcttccaggcggcgggcgaggctggcggtggcatggaaaggcgtgggcgaggccttgaggaaatcgatcaggccctggttgagttctgcgcgcatagtggctccggacggcaatccatgcagtctatcgtattgtccgacggggttcaggtcgttggcggcggggccggccagaaaaagcggaagctggtcgttgtatggcaagacggggtaccggaaatcggcgggcggcgtcccggcgggccgggacgcggcggggaaggctcagaacggcgccggcgactcgaagcgcaggcgttcgccgctctgcggatgggtcaggcacagcaggctggcgtgcaggcacaggcgttcgtgggcggcgagggcttcggggttggcgtagaggcggtcgccgagcagcggatggccgatggagagcatgtgcacgcgcaactggtgcgaacggccggtgatcggcgtcagctcgaccctgctccagcgttcatgacgctcgatcacacgccagaaggtcagggcgtggcggccgtgctcgaagtccaccacgtgacgcggcttggtcggcgggtcgtagcgcagcggcagttcgatgcgcccgctgtccagttccggcaggccccagcaaagggcggtataggctttctcggtctcgcggtcgtggaactggcgggacagctcgcggtggctgtcggcgtcgcgggcgagcaccatcaggccggaagtttcccagtccaggcggtggacgatgcgggcctcgggatagccgttttcctgcaggcgggtgaccaggcagtccttgttgtcatcggcgcgaccgggcaccgacagcagcagggtgggcttgtcgaccaccagcagggcgtcatcctggtgaacgattcggatctgggacagcggcatagcgaacgggctcatcgccgggaggcggcagggagcctggcgggcaggctcggtgaaacgactgcggcggccaatggccgccgcagtatggaccctgggcgaatcaacgatccggcagggtga

SEQ ID NO: 5154 - DNA, 903 bp, Pseudomonas aeruginosa
tctgcagtcgttctttcgcgatggaagcgctgttctgcgatttccgactgcgaaagaagtctaaaaggctcattcacgtcctccgaacagtctttgcaggaatcctttcttctgcacatcgaggaatcgatgcggtatttccttgccgagcaggcggtcgaccgcatcgctgtacgcctggccggcgtcgctctgctcgtcgaggatcaccggcacgccctggttcgacgccttgagcacggcctgggattccgggatcaccccgagcaggcggatggcgaggatctcctcgacgtcgtcgacgccgagcatctcgcccttggtgacgcgctccgggttgtagcgggtcagcagcaggtgttccttgatcggctcctcgcctttctcggcgcgctgcgacttgcttgccagcaggccgagcatgcggtcggagtcgcgtaccgaggaaacctcggggttggtcacgacgatcgcttcgtcggcgaagtacatggccaggtgggcgcctttctcgatgcccgccggggagtcgcagatgatgtattcgaaatccttgcgcagttcggccatgactttctcgacgccttccttggtcagggcgtccttgtcgcgggtctggctggcggccaggacatgcaggttttcgaggcgcttgtccttgatcagggcctgggtgagggtggcctcgccgttgacgacgttgacgaagtcgtacaccacgcggcgttcgcagcccatgataaggtcgaggttacgcaggccgacgtcgaagtcgacgatgacggtcttgaaaccgcgcaaggccaggccggtgccgatagctgcgctggtggtggttttaccgacgccacccttaccggaagtgactacgagaattttggccaaggtgattcaccccaatga

SEQ ID NO: 5155 - DNA, 381 bp, Pseudomonas aeruginosa
tcctcatggccctgcatttcaccactctggagatcggcgcggcgctgctcggccaggtgcacaccatcgacggcatgtaccgtgagcacgacaacccggtgttcgactacgtccagcgccgtggccgcgagcggcacaacctcgatgccaccgccatcgagcgcgaggacgtgcgctcgatgctcaaggtgctgcgtggcggccgcgccatctggtacgcaccggaccaggactacggcgccaagcagagcctgttcgtgccgctgttcggcatcccggcggccaccgtcaccgccaccaccaagttcgcccgcctgggccgggcgcgggtgttgccgttcacccagagccgcctggccgatggcagcggttatcgcctga

SEQ ID NO: 5156 - DNA, 1419 bp, Pseudomonas aeruginosa
ccatccacccgccgctggaggacttccccggcgagagcgaggaagccgattgcctgcggatcaaccagtgggtcgagcgctgcgtgcgccagcagcccgagcagtacctgtgggcgcaccggcgtttcaagacccgcccgccaggcgaagccaagctctatccgaaacggcgcaagcgctgaggacgggcattccggacgcgcgcggggtctggctatactcgccgcagttcatgacggaagccccgctgtgtccgatccccttgccccacgtccgccgctcaccggcctgatcctttccgggggcggcgcccgcgcggcctaccaggtcggtgtcctggccgccatcgccgacctgctgccggacagcgccggcaatcctttcccggtcatcgtcggtacctccgccggcgccatcaacgccgttggcctggcttgcggcgccctgcaattccgccaggcgatccagcgcctgaccgcggtctggcagggattccgcaccgaacatgtctatcgcagcgactggccgggcgtgacccgccaggcctcgcgcttcctcggccatagcctgctcggcctggggcggcgggtgccggtggcgttgctggacaaccggccgttgcatgagctgctggcacgtgagctggatttttccgggattcatgcggcggtgcgccagcgccagttgcgcgcggtggcggtgaccgcgttcggctacgagtcggggcaggcggtgaccttctaccaggggcgcgcgaccatcgatccctgggtacgccatcggcgcctgggcattcccacccgcctggagcttcggcacctgctggccagcgcggcgatcccgctgctgttcccgccggtgcggatcaaccgcgaatacttcggcgacggcgcggtgcgttcccaggcgcccatcagcccggcgttgcacctgggcgccacgcgggtgctggtgatcggcgtcagcggcaacccggccaccggtggcgacagtgccatgaccggcctgccgccgtccgaccgaccgccgagcctggcgcagatcggcgcccacctgttgaacagcaccttcatcgacagcctggaaggcgacatcgagcagttgcagcggatgaaccagatcggccagttggtggcgccggaggtgcgccgccaggcgggtgggctggagccggtggaggtattgctggtgtcgccgagccggccgctggacgagatcgccgcgcggcactaccgggagctgtcgcgggtgctgcggcttttcctgcgcggtcccggagcgacccgcgccagcggggcgggggtattgagctacctgttgttcgagcgcggctattgcagcgaactgatcgaactgggctaccacgatgcgatgggcaagcgggcggaactggagcgcttcctgcggatcgagcggtaa

SEQ ID NO: 5157 - DNA, 1212 bp, Pseudomonas aeruginosa
gaaaaagaaaccgccgcaccagggcggcggttcttcgtctcactcggcgatctgcagcttgcgcgcctcggtatagatgtagcgcagtttctcgtactcgaacggcgaattcatctggccgtagcggaagctggtgttgtagcgcctgtccaccacgcgcagggcggtgatctccgggtggtcgccgctggcctggggaacgttgaggtagttcacctggtattcgccgacgtagtccaccaccagtccgccggtgtcgcgcaggttggacgggccgaggatcggcagcaccaggtaggggccgctgcccacgccgtagaagccgagggtctggccgaaatcctcgctgcgcttgtgcaggcccatcctggtcgcagggtcccacaggccgagcacaccgaaggtggtgttgaacagcagccgcgcggtggtttccatcgccgccttgcccttcaattgggcgaggttgttcagcagattgggcacgtcgccgaggttgtcgaagaaattgctcacgccgctgcggacgaagtgtggggtgacgtattcgtagcctcgtaccacgggcaggaacacccactcgtcgaagcgatagttgaagtggtagacccggcggttccaggattcccagggatcgtacatgttcagtgcgtcgagggtggcgcgctcgaattcgcgttgatccaggccgggattgaacttgagttggtccagtggacggctgaaaccgtcgccgtcgagctggcgtggcggcagttcggccggcgcggcggcctggtcggcctgggcgctggcggcagcgctcagcagaagggcgaacatccagtgtgcggttcggctcatcgatcagtttcctgcctgctgggtgagggccgcgctggcgacctgggtctgtccggcagcgggcgtggcgaagaagtccagcatgtcctgcgcgttgaccttgtagttgaggttgccgcagtgaccgccatagggatagacggtcaggcgttcgccgaaggttcggcggaggaagccgaggtcgcccgggccgaggatgacgtcgtcggcgttgtgcatcacggcgatcttcgggctgtcgtgcagatagtcctgcagcttgtagaggctgacctggttgaccagttgggtcaggctgccgccgtcgtaacgggctcgccacatcgggatcagttgctcggtcatgtagcactcgaagtcgcactgtag

SEQ ID NO: 5158 - DNA, 1155 bp, Pseudomonas aeruginosa
gcatggctgctctcctttgatcgagaatcattcctctttggcgaaagcctatccaggcgctcggccaagcggaaatcggcctgtccaatcgagtgcatagagcgcttcgatcgcactgtctcggagcacatccgcagcgtgccgcagcgcagttcgaggcatgtcgttatcgggtgcgatgggtgtcgttctcagagcagtccgccgtccgggcgcgccgatgatggacggcggcaccgcagagtgccgcgaccgccggggagcgtccccgtcggcatagaacaaggggtacgtctgatgcgaatgatgcgacgactgttgtgctggagtgcgggcctggcaatgtcggcggctgtggggatggcggccgcggcggacaagccggtgatcaccatcggttacgtggacggctggtcggacagcgtggcgaccacccatgtggccgccgaggtgatccgcgagaagctcggctacgaggtgaagctgatgccggtggcggcggggatcatgtggcagggcgtggcgcgcggcaagctcgatgccatgctctcggcctggctgccgggcacccacggcgcctactacgagaagatgaaggataaggtggtcaaccttgccatcaactacccggacgcacgcatcggcctgatcgtccccgaatacgtgagcgccaacagcatcgccgacctccaggcgcagaaggacgctttcggcggccgcgtggtgggtatcgatgccggcgccggggtgatgatcaagaccgacgaggcgatcaagcaatatggcctcgactacaagctggtggccagttccggcagcggcatgatcgccgagctgacccgtgccgagaacgagaagaagccggtggtggtgaccggctggattccgcactggatgttcgccaagtggaagctgaagttcctcgacgatccgaagaaggtctatggcgataccgagcatgtcgacaccgtcgccaacccggcgctggaggccaaggccaagccggtctgggagttcctgaagaagttcggctggaaggatggcaacgaggtcggccaggtgatgctggcgatccaggagggcgccaaacccgaggatgcggcgaagcagtgggtggcggccaacccgggacgggtcaaggactgggtgcagtag

SEQ ID NO: 5159 - DNA, 1935 bp, Pseudomonas aeruginosa
taccaatccgcgcttcaaggagttggtggccaagcgagagcgtttcgcctggatactttcttcgatcatgcttggcctctacgtgatattcatcctgctgatcgctttccagccgcagctgctgggcgcgcgtatcagtcccgattcgtccgtgacctggggcatcccgatgggtgtcggactgatccttgccgcgttcatcctgaccggcctgtacgtgcgtcgcgccaacggcgagttcgacagcctgaaccaggaaatcctcaaggaggcgcagcaatgatcgctcgtctccttgccgcgctcggccttgcggccttcgctccggccctctgggccgacgcgctgaccggcgacgtgcagcgccagccgctgaacgtctcggccatcgtcatgttcgtcgccttcgtcggcgcgaccctctgcatcacctactgggcatccaagcgcaaccgctcggcggccgactactatgccgcaggcggccgcatcaccggcttccagaatggcctggcgatcgccggcgactacatgtcggcggcatccttcctgggtatttcggcgctggtcttcacttccggctacgacggcctgatctactcgatcggcttcctggtcggctggccgatcatcctcttcctcatcgccgagcgcctgcgcaacctgggcaagtacaccttcgccgacgtcgcctcctaccgcctcaagcagaagcagatccgcaccctgtcggcctgcggctcgctggtggtggtggcgttctacctgatcgcgcagatggtcggcgccggcaagctgatcgagctgctgttcggcctcaactaccatgtcgcggtggtcctggtgggcatcctgatggtgctctacgtgctgttcggcggcatgctggcgaccacctgggtgcagatcatcaaggccgtgctgttgctttccggcgcctcgttcatggcgatcatggtgctcaagcacgtcaacttcgacgtcagcacgctgttctccgaagccatcaaggtgcatccgaagggcgaggcgatcatgagtccgggcggcctggtcaaggatccgatctcggcattctccctgggcttcgcgctgatgttcggcaccgccgggctgccgcacatcctgatgcgcttcttcaccgtcagcgacgccaaggaagcgcgcaagagcgtgttctacgccaccggtttcatcggctacttctacatcctgaccttcatcatcggtttcggcgcgatcctgctggtcagcaccaacccggacttcaaggacgccaccggcgcgctgatcggcggcaacaacatggcggcggtgcacctggccgacgcggtgggcggcagcctgttcctcggcttcatctcggcggtggccttcgccaccatcctcgcggtggtcgccgggctgaccctggccggggcctcggccgtctcccatgacctgtacgccagcgtgttcaagggcggcaaggccaacgagaaggacgagctgcgggtctcgaagatgaccaccgtggccctgggcgtggtcgccatcgtgctcggcatcctcttcgagaagcagaacatcgccttcatggtcggcctggccttctccatcgccgccagctgcaacttcccggtgctgctgctctccatgtactggaagaagctgaccacccgcggcgccatgatcggcggctggatgggcctgatcaccgcggtgggcctgatggtcctcggcccgaccatctgggtgcagatcctcggccacgagaaagccatctacccgtacgagtacccggcgctgttctcgatgatcgtcgccttcatcagtatctggttcttctccatcaccgacaagtcggcggcggccgacgaggagcgggcgcgcttcttcccgcagttcatccgttcccagaccggcctgggcgcctctggcgcggtggcccactaa

SEQ ID NO: 5160 - DNA, 423 bp, Pseudomonas aeruginosa
gctactacgcgccgggggaaaccttgctggaggccggttcggcggtccccgggctgttcgtcctgctcaagggcgtggtcgaggagcgcggcgacgacgggcgagtgttcgcccagtacgccgcggacgacctgttcgacgtccgcgggctgttttccggcagcagcaagcatcgctacctggcgatcgaggaaagcatcgtctacgaactgccggccagttgcttccaccagttgtgcggggagaacccgggtttcgcccggttcttccaggccgacctggcggccaagcgccagttggcccagcgcgacgggcagaaccttgccgagttcatccttacccgcatcgcccgcgagcacttgctgccggcgctggaggtggaggcctcgctgtccctcggcgacgccgcgcgcctgcaattga

SEQ ID NO: 5161 - DNA, 1059 bp, Pseudomonas aeruginosa
agaagttcaagcagagcgtggcccgtcaattccacctggagacccgatgaacaccatggtcaagttgcccgacagccgctggccgggctggcgccgccggctgtactggtggatgcacgaggcggtcgaggcggaagaagtgatctccctcgatctcgagaccaccagcctcgacccgcgtcgtgccgacatcctcagcatcggcgcggtgctggtgcggcgcggcaaactggtcatgggcgagcgcctggaactctacgtcgagccgccgccgagcctggatgcggagtcgatccgcatccacaagctgcgccgcgccgacctggagggacagttgcagctggagcaggccctgcgccaggtgctggcgttcatcggcgaccgaccgctgctgggctactatctgtcgttcgatgtcgccgtgctgaaccggcacctgcgccagctcctcgaccgacagttgcacaacccctccatcgagatttcgtcgctgtaccaccggaaggtcagccggcattttcccgacgcacacatcgacctgcgcttcgacaccctggcgcgggccctggatgtgccggtcagcggtcgccacaccgccctcggcgacgcccaggcggtggcgctgatgttcatgcgtctgctcaaggggccggcgcccaaggtcatccactgaggctggaggtcgcggatttattgaatcttcgttgctcggcgggggtcgagaactacaagggcggaatctcccgccctttgccccatgagccgaacaggagcgacgcccatgagtctcggtacgattcttctgatcatcctgatcctgctgctgatcggcggtctgccggtctttcctcattcgcgcaactggggctacgggccctcggggatcatcggcgcattgctggtggtgctgttggtcctgttgctgctgggcatgatctagggcccgatcgggaatgccgtcgcggcgggtatcggcggataacgcctccggcgttattcgccctacgcggagggttcccagctttcgctccgccgttgcggcggggtatcggcggataa

SEQ ID NO: 5162 - DNA, 2295 bp, Pseudomonas aeruginosa
cgatggggcgaaatccccggtaccgagcactggcatccttggtcgtccgtggccgacgccaggtggacggggacgatgcggcaggcgtcgggatcgagccggggcacgggttcgataagaacaccgtttcgctggcggaaaaaatcgaagcgcgtgctagtcgagatcgacggcggtgatgattgccgcgaaaaggcccgttgcagagcctttgacaaggtcacccaggccgggcggcgcgagccgccgcccggtgccgaggcttcagtcgacgccgacgaagccgccggtctggtgttgccagaggcgcgcatagaggccgccatgggcgagcaactcggcatgcgtgccgctttcggcgatgtggcccttgtccagcaccaccaggcggtccatgcgcgcaatggtcgacaggcggtgggcgatggcgatcaccgtcttgccctgcatcagggtctccaggctttcctggatcgccgattcgacttccgagtccagcgccgaggtcgcttcgtcgaggatcaggatcggcgcgtccttgagcagcacccgggcgatggcgatgcgctggcgctggccgccggagagcttcactccgcgttcgccgacatgggcgtcgaagccgcggcggccctcggcgtcgctgagcagcgggatgaactcgtcggcgcgagccttgcgcaccgcttccatgagttccgcgtcgctggcgccggggcggccgtagagcaggttgtcgcggatcgaacggtgcaacagcgaggtgtcctgggtgaccatgccgatctgcgcgcgcaggctttcctgggtcaccccggcgatgtcctggccatcgaccaggatgcgtccgctctccaggtcgtacaggcgcagcagcaggttgaccagggtcgacttgccggcgccggaaggtccgaccaggccgatcttctcgccgggccggaccttcaggtcgagaccctggatcacgccgctgcccttgccgtagtggaaggcgatgtgctcgaactccacctcgccgcgctctacccgcagcggctgggcgtcctcgcggtcgaccaccttgcgcggcagggcgatggtctgcatgccatcctggacctggccgatgttctcgaagatgccgccgaccacccacatgatccagccggacatgttgttgatgcggatcaccagcccggtggccagggcgatggcgcccaccgagatcagctcctggctccacagccacagggccaggccggtggtgccggtgatcagcacgccgttcatcaccgtgatggtcacgtccatggaggtcactacgcgcccggcgcgttgcgacttgagggtctggtcgccgatcgcttcgcgggcgtagtcctcttcctggcgggtgtgggcgaacagcttcagcgtgatgatgttggtgtagccgtcgacgatccgccccatcagcttcgagcgcgaatccgaggcctccaccgagcggcgcttgacctggggaacgaagtaggcgagggcgccgacgtaggcgaacacccacagcaccagagggatcatcaggcgccagtcggcctcggcgaacagcaccagggcgctgacggtatagatcagcacgtgccagagggcgtccaccacctgcaccgccgaatcgcgcaacgagttgccggtctgcatgatgcgctgggcgatgcgcccggcgaaatcgttctggaagaagccgaggctctgcttgagcacgtagcggtggttctgccagcggatcaggttggtcatgctcgggttgatgctctggtgcaccagcatgtcgtgcagggcgttgaacagcgggcgcaggaccagcgccaccaccgccatccagatcagttcgttggcgtgcacgcggaagaactccgcgctgggcgtgctctgggcgagatcgacgatgcggccgaggtagctgaacagcgccacctcgatcagcgcgacgatcaggccgaccaccagcagggccaggaacaccggccagacctggcgcaggaagtagacatagaaacgcagcacttcgctgggcggcatgcgttcggaagcactgcggaacgggtcgatcagacgttcgaaacgacgataaagcatgatggctctcttctggagcgggcccgtcctgggcccgccggatcaagcccctgcggctggactcagaggcgtttggcggacaggatcaccacgtcgtcgctcggcacgtcggcgaagccgttgcggcgggtggtgggaaccttggcgatctggtcgaccacgcccatgccacgcaccaccttgccgaacacggcatag

SEQ ID NO: 5163 - DNA, 726 bp, Pseudomonas aeruginosa
ccggccgctgtcgcggatcaccacctgcatctgggtttccaggtcctggtgggtcagttcgcgttgcaggcggtgcagcggatggtcggggtgggccacggcgacgaactcgaccacgctgaggtcggcgccgaggtggccgggaatgatcaggccgctgatcgccaggtcggcggcgccctggatcagcgcttcctcgacgccggagagcacttcctcgcgcagcagcacgcgacagccgcggctctgcggcatgaaggcggacagcgagcggacgatccgcgcggtggggtaggcggcgtccaccaccaggcgcacctcgggttcccagccctgttccatgtggtgcgccagctcctccagttgcccggcctgcttgaccagttgccgcgaacggcgcagcaatacttcgccggcctcggtcagcaccgccttgcgtccgtcgatgcgcagcagcggcacgccgagctgttcctgcatgcgcgccacggtatagctgatcgacgattgcgagcggtgcagggcttccgcggcctgggcgaagccgccgtggtcgaccaccgcctgcagggtccgccattggtccagggttacgcgtggcgctttcatttccgcctcctcgaatgcagggatgcctcgccggcgtttccgcggccggcaggcgatgacgagtgcgccggaggggcgacttcgcttatcgtgtcgtcggcgtcctgtacggggtag

SEQ ID NO: 5164 - DNA, 726 bp, Pseudomonas aeruginosa
cagcggttttttcaactttttaatcgattaatcattctctaccctcacctccatcgttgtagcgcagtgggtggaggtcgagtcatgtcccgtgtcctggttatcgagagcagtgcccgccaacggggctcggtttcccgcctgctgacggcggaattcatctcccactggaaaatcgcgcatcccgctgatcgcttccaggtccgcgacctggcgcgcgagccgctgccgcacctcgatgaattattgctgggagcctggaccaccccctgtgatggccatagcgctgcggaaaggcgcgccctcgagcgttccaatcgcctgaccgaggagttgcggatggcggacgtgctggtgctggcggcaccgatgtacaacttcgccattcccagcagcctgaagagctggttcgaccatgtgctgcgcgccggcctgaccttccgttacgccgagcaggggccggaaggcctgctacagggcaagcgcgccttcgttctcaccgcccgcggcgggatctacgccggcggtggtctcgatcaccaggaaccctatctgcgccaggtgctgggcttcgtcggcatccacgacgtcaccttcatccacgcggagggcatgaacatgggcccggaattccgtgagaaaggcctggcgcgagcccgtgagcggatgcggcaggcgctggaaaccgacacctccctttgcgtccctctgccaacgctccggtga

SEQ ID NO: 5165 - DNA, 714 bp, Pseudomonas aeruginosa
ccgctgtccgtggctgccgttgtcctggggctatgccttcctgcgcaccttccatcggccgagccgggcggtgctggtgagcaccccgcgcctgcgcgacgagttctgcgcctggcgcttccagcacctgcggctgtggcgcaagggcgtcgataccgaactgttccatcccgccgagacacctccggcgaaagagcggccgccggtgttcctgtatgtcgggcggctggcgacggaaaagaacctggaggcgttcctcgatctcgaactgccgggcgaaaaatggctggtgggcgacggcccgcagcgggcggcgctggagcagcgctatccacaggcgcgttttctcggctaccgccatggccgcgcgctggccgacgcctaccgggcggcctcggtgctggtgttcccctcgctgaccgatacctatggcctggtgatgctcgaagccctggcctgtggcgtgccggtggcggccttcgccgtgccggggccgctggatgtattgcagcagggcgtgaccggggtcatgcacgaggatcttggcgaagcctgccgccaggcgctggcgctggatcgccaggcctgcgggcgctgggcgcgggagcagtcctggcgggtttcggcggaggagttcctggcgctgcaggcgagcggcccacggactgcgccggaatggcgcgacgaactgccggcggcgttcgacgaacttag

SEQ ID NO: 5166 - DNA, 1077 bp, Pseudomonas aeruginosa
tatccttgggccgccaggccggacgacggtcggcgtgcctcccgccagaacaagaagagaccgatgccggaacgtacaaccttgtccagctgggtccagggcatcatcctcgccctggagctggaaggcctagacggacgccagctgttcgccgagctgggcctcgactaccaggccttgcaggaccccgacgcgcgcttcccgcaggacgccatgagccgtctgtggcagcgtgcggtggcgctcagcggcaacccggcgatcgccctgaacatcgcccgggtccggcgcccggctttccacgtcgtcggctatgcgctgatgtcgagccgcaacctggcggaaggcttcgcgcgcctggagcgctaccagcggatcatcgcggaagcgtccgacctgactttccgccgcacgccgcagggctatcgaatcggcgtcacggtgcatggcgatcgcctgccggcgccaccgcagagtgccgaatgctcgctggcctacctggtggacatggtccgctggatcaccggccggtcgctggacccgctggcggtggaactgcccggcgcgccccgcgagccgctggcaccctatgtcgagctgttccgcgcgccgctgcgctttcacgccgaggagttcgcgctggtgttttcccgcgtcgacctcgagacgccgctaccctcggccaacgaggcgctggcccagttgcacgatcgcttcgccggcgaatacctggcgcgtttcagtaccagccgcattacccatctgacccggcagaccttgtgccggctgctgccgcagggagaacccaagcgcgaacgggtggcccaggcgctgcacctgtcgcagcgcaccttgcaacggcgcctccaggaagaaggcaccagctaccagcaactgctcgacgacacgcgccgggatatggccgaacagtatctccagcagcccggcctgaccttgctggaagtcgcctacctgctgggtttcgccgatccgagcaatttcttccgggcattccgccgctggttcggctgcacgcccaacgaataccgggcgcgccgccaggagcgcccgggctag

SEQ ID NO: 5167 - DNA, 1467 bp, Pseudomonas aeruginosa
agccattgcagacaggcccgtgagcgctcagtggcgccagaacgccggggtcagcaggaccagcacggtgatgatctccaggcgaccgagcagcatgccggcggccagcagccacttggcggcgtccggcaggctggcgaagttgcccgaggggccgatgatgggccccatccccgggcctacgccggccacggtactggcggcgccggtgagcgcggtcatccagtccaggccgatcagcgacaggccgagggcgagcaggcagacgacgatcgcgaagaagaacgagaaggtcaggatcgagcggacgatttcctcgtccaggcgatggccgttgtagttctgcttgagcactgcgcgcggatggatcaactggtagaggttggccttgagcagggtataggcgacctggaagcggaagatcttgataccgccggcggtagaaccggagcaaccgccgatgaagccgaggtagaagaacagcatgatcgagaagtgcccccacatgctgtagtcgccgagggcgaagccggtggtggtgaccaccgaggtgacgttcactgcgacgatgcggaaagcatccatccagggcagcttggaggttaccgcgtaccaggtgcccatcagcagccaggtcaccagcagcaggccgagcaggccgcggacctgctggtccttgatcagcgccttgcggtgtccgcgcagggtggcgacgtagagcgcgaacggcaggctgccgaggatcatcaccactaccgcggtccagtgcaccgctggctgcttccacttggccagggattggtcggaggtggagaaaccgccggtggaaatcgccgacatggcgtggttgaccgcgtcgaacgggctcatgcccgcgccccagaaggccaggctgccgagcagggtgatgccgacataggtggcgacgatgtacttggcgaccatgtgcgagcgtggcaggaccttttccgagcggtccgaggattcggtctggaacaggcgcatgccgccgatccgcagcatcggcaggatcgccacggccatggcgatgaagccgatgccgcccagccagtgcagcagagagcgccagatgaggatgcccggggacatgtcgtccagcccgctgagcacggtggagccggtggcggtgattcccgacatgctttcgaagaaggcatcggtgtagctgatgtgctgctgcaggacgaacggcagggcggcgaagatgcataccagcacccagctcgatacggtgagcatgtacatgtcccgcgggcgcaggtggacatgctcgggacgtcccggcaggaccaggccgaggccggtgacgaaggtggcgacgctggaccagatgaatgcctggatgccttcggtacggtcgaaggcgagcatggtcaggatcgggaccagcatgctggcggccagagtgatcaggaagatgccgatgatgaaaccgaggatacgtag

SEQ ID NO: 5168 - DNA, 933 bp, Pseudomonas aeruginosa
agggcgaaggccgccgggccctgggcgacctctacgcccgcgccctggcgagccgccagccggacgccgccgaggaagcgctggccaaggcccgcaacatgccgctgcgcgcaccgctgctggtcgtggcggtcgcttgcctgcaggaccacccgaaggtgccgcacgctgagcaactgctggctgccggctgcgccgcccacggcctggtgctgggcgcctatgcccagggactgggggcgatgtggcggaccggcgagatggccaccgatccggtggtgcacgccggcctggggctcggcgagcaggagcggatcatcggcttcgtctacctggggacgccgatgggcgagttgcgcacgccggcggaactcgacccgtcggccttcgtcagcgcctggccgggctgagcggcaacagcaggcgtacgcaccaatacgcgccctgggcgtgccagagcagtcgtccgccctgccagccggccagtcgtcgggcggcttccacggccgccggcagccagcgccggccttcttccgcctggccgaggatgtccaggcgcagccggccgtggcgtgcgtccagcgccggattcagtgtgatgcgctgccacgggcgggcctgcgcggcgccgccgagcaggccgtagagcgcctcgtgcaaggccgggcgccagctttccagcggccaggtgccgcgttccggcaggttcaggtcgaggcgcgcccagcgatgccgcagttgctgggcgacctgtcccagctcgaccgccaggaccagcgattgcggttcgtcgccgggaggttccggcggcggcgcgatggcctgggcgagcgggcgttcatcgaggaacaacgaagcgggaagagccatgccggatgctcctggggaattgttcatctgggcgcggcgtcattcggtcgccttgcgccgtag

SEQ ID NO: 5169 - DNA, 774 bp, Pseudomonas aeruginosa
ggaggtcaaggtcaagcgcggtcagccctgagtaaagcttgggtaaagaccttgtgtcggcgggctgacgaaacccgctcagtggctgtagtagtagccgcggccgcgcagggcgaggatgcgcgggctgccgtcggggtggctgccgagcttcttgcgcaggttgctgacgtgcatgtccaggctgcggtcgtagagggtcagcttgcggcccagcgccagttgcgccagggcctgcttgtccagcggctcgccgggctggcgcaggagcgcttcgaggatgcggctttcggaaagggtcaggctgatctcctggccgtcgatctgcgccacgccgcgcgtcaggttcagcgacaggtcgcccagttgcatctgcgcgctgggctgcgccgggtgggttcgccgcagcacggcgcgcagccgtgcggtgagttcgcgcgggtcgcagggcttggccaggtagtcgtcggcgcccagttccagaccgaggatgcggtccagcggctcgccgcgggcggacagcatcagcaccggcaggtcgggatggtcgccgcgcagttgcttgagcagttccaggccgctaccgtccggcagcatcacgtcgagcaccacggcatccggtgtctgctcggcgagggcgcgacgggcctgggcgccgtcgtggctggcacgcacggagaaaccttcctggaccagccaggtaccgagcagctcgcagagctcccggtcatcgtcgatcaacagcagttcgctcatcgagtgtcgctcaattga

SEQ ID NO: 5170 - DNA, 1080 bp, Pseudomonas aeruginosa
aacggcataatagcaacctctggatgttctgaaacagtcatcctgtctttccgaatgcgtcaggcctgtgccgcaggcgcattcgccaggtggagcaggctccccggacccatgaacggtacgtctcgataccgcgaggcagcgaatcggcgttgcttcatcaccattcttcactggaatcaggattcagccatgcgtgtcgatctgcattgccacagtaccgcctccgatggcgtgctcgcgcccgccgccctggtgcagcgggcccacgagaaaggcgtcgggctgctggcgctgaccgaccacgacaccctggaaggcctgccggaagcccaccaggcggccgctcgactcggtatcgaactggtcaacggtgtcgagctgtcctgcacctggggcggtgccaccattcatgtgctgggctacggtttcgacctcgacgccgctcccctgcgccaggcgaccgaagccctgcaccggggccgctgggcgcgcgccgaggaaatcgaccggcggcttgcggccaagggtatgcccggtgcgctggagggcgcgcgggcgatccagcgggccctgggcgacagcggcaacgcgccggcgcggccgcatttcgccgagttcctggtccagggcggctgggtcaaggatcgcgccgacgcgttccgcaagtggctgggggccggcaagctgggagacgtcaagcagcactggccgaccctggaggaagtggtcggctgcctgcgcgaggcgcgcgcctggatcagcctggcgcacccgtatcattatgatttcacccggaccaagcgccggcgcctggtcgccgactttctccaggccggcggacacgccatcgaggtggtcaatggcgtgcagccggccgaacaggtcggtaccctgtcgatcctggcccgcgagttcggcctgatggtcaccgccggcagcgatttccacgcgccgggcgactggtccgaactgggcatgtaccgtgcggttccagaggaccttccggccatgtggccgcgtttcgccaggcattttcgcgataccgaacgtcattccgaagccaagggggccgaatga

SEQ ID NO: 5171 - DNA, 972 bp, Pseudomonas aeruginosa
tccgcgtgggttgcggcgatccggcgccgttcatgcagccggcctgagcgccgcccgaatccgcccaccacgagcctagcgatgcaggacgataacccggccaacgccgacacccctccagccgaacccgccgccgagcgggtgccgctgcaactggcgctggtctacggcgaggcggtcaccgagctgccgcaggacctctatatcccgccggacgcgctggaggtcttcctcgaggccttcgagggcccgctcgacctgctgctgtacctgatccgcaagcagaacatcgacatcctggatatcccggtggcggaaatcacccgccagtacatgggctatgtcgagctgatgaaggcggtgcgcctggagctggccgccgagtacctggtgatggcggcgatgctggcggagatcaagtcgcgcatgttgctgccgcgctcggcggaagccgaggaggaagaggaagatccacgggccgagctgatccgccgcctgcaggagtacgaacggttcaagaaggccgccgaagacctcgacgaactgccccgggtcggccgcgacgtgctggtgccggcggtggctgctcccgaggcgcgggcgcgcaagctgctgccggagctggcgctgcaggagctgatgctggtgatgggcgagatgctgcgccgcgccgacctgttcgagagccaccaggtgacccgcgaggtactgtccacccgcgaacgcatgagcgaagtgctggagcgcctgaaaggcggcgccttcgtgcccttcatccagttgttcaccctggaggagggcaagctcggcgtggtggtcaccttcatggcgatcctcgaactggtcaaggagcagatggtggaactggtgcagaacgaggctttcggcgccatccatgtgcgcctgcggatagcccgcgaagcggaggaaggcgaaaccctggaggaagccctgggagacgatttcgagtga

SEQ ID NO: 5172 - DNA, 978 bp, Pseudomonas aeruginosa
gctgcatgcccgattccgctatctttccctcttcctggctccggtatccgttgcgacgatgaacctgtccgatccccacgaactcgccactctgctcgaaggcatcctcctcgcggccggcaagccgctgtcgctggaacgcctggccgagctgttcgacgaggcagagcggccggagccggggcagttccgcgacgccctggcgatcctggcactgtcctgcgcggggcgctccttcgagctgaaggaagtcgcgtccgggtatcgcctgcagattcgcgagcgtttctcgccgtgggtcggccgcctctgggaggagcgtccgcagcgctattcgcgcgcgctgctggaaaccctggtgctgatcgcctaccgccagccgatcacccgtggcgagatcgaggagatccgcggcgtggcggtgaacacccagatcgtcaagacgctgatggagcgggagtggatccgcatcgttggctaccgcgaggtgccggggcgcccggcgatgctggcgactaccaaggcgttcctcgattatttcaacctgaagagcctcgacgagctgccgccgctgtcggcgctgcgcgagatggagcccgagccggaaccgccggtcgaagtggcgcccgcggcgcagccgccgcgcgacgatctcgacgaggatgcgattcctgcctcgatccaggccctggccgatcgcgccatcgccgaggccggggaaagcctcgaggagatcgagggggaggccggcgagccggagaagccgcgcgaggaaaccagcttccgcagcctgctgctggaactggacgagatggagcagggcctgaagaccgacttcgacgacctgctcgaccctccggagccctcggagcagggcgacgagtccgccgagccagcggctgggccgattcccgtggtcgcggagcaagccgtcgagcctgccgtcgcggaggctgtcgcgggcgccgatcccgatga

SEQ ID NO: 5173 - DNA, 690 bp, Pseudomonas aeruginosa
cgaggagcgcgccctggcggaggccatgcgcgaggagcgcgaggcactggacgccgacgacgactggccgcgccgctgaccgtcgtttcaccctgtagaattcatccggccgcgccggcgaggccggcccgctccgtttcatcgaccctggaactccccatgaaagagaccctgaacgaactgatcaccctcatcagcaccggctgcatgggcgccgaggagatccggcggatcgccgacgaggcggcccaggcctatgccgatccggcagggttcctcgccgccaacccggacatcaactacgacgacagtttcccgatcccgctcggcgagtgggtggtggtcggtagcctgccggatatcgtgctgttccaggccgacacctatgccgagctgttcgcccggatcgtcgcctccttcggcaaggacgtggcgttcaacatcaagccgaagcagttgctcaagaccgagccgctggtcgccctcaaccgtatccaggtgcaactgagcagcatgtatccggaaaagggcggctacgtgctggtggatttcagcgagccgctggacgacgagttgcaggcggtgctggtctatacccaggacctgccgcgggtcatggcgctctgcgtcgaggccggcatctatgccgcgcctgcctacgaaagcctgcgcgacgccgaggccgagtga

SEQ ID NO: 5174 - DNA, 270 bp, Pseudomonas aeruginosa
tcattccctcctggacgccggcccgccgcctgtcgtgaagtgacgggcgaggaccggttgcggtccgcgccaaaaaagggggaacgcttgaaaagtccttgcatcaatatctgtgagttcgatgccgacgtgtgccgtggctgcgggcgtacgcgccaggaaatccgtgcctggaagcgcgcggacaaggccgagcagcgactgatcctcgccgaggccgacctgcgcctgctggcgttgcaggcgcgcggtcggcgcaagttccgctga

SEQ ID NO: 5175 - DNA, 1107 bp, Pseudomonas aeruginosa
ggcgcgtcagtcgcgggcggcggccagcgccagggcgctgtccagcatgcggttggagaagccccactcgttgtcgtaccaggccatcgccttgaccagccggccgctgaccttggtgtggttggcgtcgaagatcgacgagcgcgggtcgtgattgaaatccaccgacaccagcggctgggtgttgtagccgagcaccggagagccctcgctggcctcgcgcagcaggcggttgacctcgtctacgctggtatcccgggccacctgcacggtgagatcgaccagcgacacgttgatcaccggcacccgcaccgccagcccggtaagcttgccggcgagttccggcaggaccaggccgaccgcctcggcggcgccggtcttggtggggatcatcgactgggtcgccgaacgtgcgcggtacaggtccgggtggtacacgtcggagaggttctggtcgttggtgtaggcatggatggtggtcatcaggccgtgctcgatgcccagctcgcgatgcagcacctgggccaccggtgccaggcagttggtggtgcaggaggcgttcgagacgatccgatgggaggcgcgcagcacctcgtggttgacgccgtagaccacggtggcgtcgacgtccttgccgggcgccgagatcagcaccttgccggcgccggcctgcaggtgggcagcggctttgtcgcggctggtgaagagccccgtgcactcgagcacgatgtccacgccgaggctcttccagggcagttccgccgggttgcggatggcgctgacggcgatgcggtcgcccatcacccgcaggctttcggcatcgtgctcgacctcgccgggaaagcgtccatggacgctgtcgtactggaacaggtgggcgttgaccgcggcgtcgccgaggtcattgatcgccactacctgcaactgttcgcggtagtggccggtatacagggcgcgaagaacgtttcggccgatgcgaccgaagccgttgatggccaggcggatagtcataatgaggtcgtctcttttctacttgttgtggtaaaaaccattacatttcgtccagaaagaaaagtaaacatccttcaaccgatgattatgttgtaa

SEQ ID NO: 5176 - DNA, 2880 bp, Pseudomonas aeruginosa
cgcggccactcgccagcgctacctcgagatggtccgggctgcggccagcaaggggccgcaccgcggcaccctgccgtgcggcaacctcgcccacggggtcgcggcctgtggcgaaagcgacaagcagaccctgcggctgatgaaccaggccaacgtggccatcgtttccgcctacaacgacatgctctcggcgcaccagccgttcgagcgctttccggggctgatcaagcaggcgctgcacgagatcggttcggtcggccagttcgccggcggcgtgccggccatgtgcgacggggtgacccagggcgagccgggcatggaactgtcgctggccagccgcgacgtgatcgccatgtccaccgccatcgcgctgtctcacaacatgttcgatgcagcgctgtgcctgggtgtttgcgacaagatcgtgccgggcctgctgatcggctcgctgcgcttcggccacctgcccaccgtgttcgtcccggccgggccgatgccgaccggcatctccaacaaggaaaaggccgcggtgcgccaactgttcgccgagggcaaggccactcgcgaagagctgctggcctcggaaatggcctcctaccatgcacccggcacctgcaccttctatggcgccgccaataccaaccagttgctggtggaggtgatgggcccgcccctgcccggtgcctccttcgtcaacccgaacacccccctgcgcgacgaactcacccgcgaagcggcacgccaggccagccggctgacccccgagaacggcaactacgtgccgatggcggagatcgtcgacgagaaggccatcgtcaactcggtggtggcgctgctcgccaccggaggctcgaccaaccacaccctgcacctgctggcgatcgcccaggcggcgggcatccagttgacctggcaggacatgtccgagctgtcccatgtggtgccgaccctggcgcgcatctatccgaacggccaggccgacatcaaccacttccaggcggccggcggcatgtccttcctgatccgccaactgctcgacggcgggctgcttcacgaggacgtacagaccgtcgccggccccggcctgcgccgctacacccgcgagccgttcctcgaggatggccggctggtctggcgcgaagggccggaacggagtctcgacgaagccatcctgcgtccgctggacaagccgttctccgccgaaggcggcttgcgcctgatggagggcaacctcggtcgcggcgtgatgaaggtctcggcggtggcgccggaacaccaggtggtcgaggcgccggtacggatcttccacgaccaggccagcctggccgcggccttcaaggccggcgagctggagcgcgacctggtcgccgtggtgcgtttccagggcccgcgggcgaacggcatgccggagctgcacaagctcacgccgttcctcggggtcctgcaggatcgtggcttcaaggtggcgctggtcaccgacgggcgcatgtccggggcgtcgggcaaggtgcccgcggccatccatgtgagtccggaagccatcgccggcggtccgctggcgcgcctgcgcgacggcgaccgggtgcgggtggatggggtgaacggcgagttgcgggtgctggtccacgacgccgaatggcaggcgcgcagcctggagccggcgccgcacgacggcaatctcggttgcggccgcgagctgttcgccttcatgcgcaacgccatgagcagcgcggaagaaggcgcctgcacctttaccgagagcatcaacgggctggcgctgattctgataggtcgatatccgcccggcgcttggctggcggctgtctctccggcaacatctgccgaccgtcccgccctggcgcggggcattgcggttcaacgacgatgaataacgacaacaagagaagcgctggcggcctcggcctggtcggcgatatcggcggcaccaatgcgcgtttcgcgctctggcgcgggcagcgcctggaatccatcgaggtgctcgcctgcgccgactacccgcggcctgaactggccgtgcgcgactacctggcgcggatcggcgaatcggtggcgaacatcgactcggtctgcctggcctgcgccggtccggtcggggcggccgatttccgtttcaccaacaaccactgggtgatcaatcgtgcagcgttccgcgaggagctggggctggatcacctgctgctggtcaacgacttcagcaccatggcctgggccgcctcgcggctaggcgcggacgagctggtgcaggtccgcgccggcagcgcccaggcggatcgcgcccggctgatcatcggtcccggcaccggccttggcgtcggcagcctgctgccgctgggcgggggacgttgggaagtgctgccctgcgagggcgggcacgtcgacctgccggtcacttcgccgcgcgacttcgcgctctggcagggcctgcaggcgcgctacggacatgtctccgccgagcgcgcactgtccggcaacggcctgctcgccctctatgaaatcagctgtgccctggacggggtcgccgtacgcgcgagcagtgcggcggaagtcggtgccctggccatggccggcgacgcccaggcggacgccgtgctggagcacttcttcctgtggctggcgcgggtcgccggcaacgcggtgctcaccgtcggcgcgctcggtggcgtctacattaccggcggcatcgtcccgcgtttcctcgagcgtttcatcgccagcggcttcgccgaggccttcgccagccgtggcaagactagcggcgcttacctgcaggacgtaccggtatgggtcatgaccgccgaacatccgggcctgctcggcgccggggtcgccctgcagcaggccctggacgtcgagggctga

SEQ ID NO: 5177 - DNA, 1581 bp, Pseudomonas aeruginosa
gcgcatcgtcgacatggcggtcagccgcctgcgccagcgcctgcgcgacaccggcaaggcgccgcggctgatccagaccgtgcgcggcagtggctacctgctggcggcgcaggtgcggccgcacctgcagccatgagcgaacggcggcgctggtcgccggtgccgcgctcgctgctcgggcgcatgctgctcctgaccctgctcgcggtgctggtcgcgcaagggctttccagcctgttctggctgtcgcacctgcgctccagccagcgcgagggcctgctcaccagctcgcgcagcctggcctactcgatggcggccagcgtcagctacttccgttccctgccgctcggctaccgtccgctggtgctcgaccagttgcgcagcatgggcggtacgcgcttcttcgtctcgctgaacgaccggccgctggagatgcgtgccctgccggacacgccgaacaagcaggcggtgctggagatcgtccaggacgtgttgcaccaacgcctgggcaaggaggtcgagctgcaggtcgaattcgtcagtcccgacgagctgcgcctgttcaacggcgcgctgaagctcgacgagctgccgcgttcctgggcgcactacgcgctgaccctggagccggtgaacccgccggtgctggtgacccagatccgcatcggcgaaagcgagtggctgtacatcgccagcctgatgccggcgccgtacgtcagcctggaacccgagggactgcaaccgcagcaggtgctctcgatcgttttcaccagcctgttgctgctgcttttcaccggtttgctgatgcattggcagagccgtccgctcaagcgcctggcgcgcgccgcccgcgacctggccctgggcagtccgtcggcagcgctggaggagcgcggcgccagcgaactggtggaggtggcgcgcgccttcaacaccatgcatgagcgcatcgaccgctacctgaacgagcgcgggcagttgttcagcgccatctcccacgacctgcgcacgccgatcacccgcctgcgcctgcgggtagaactcctcgaggacgagcgcttgcaggagaagttcgggcgcgacctggacgagctggaactgctggtgaagggcgcgctgcagtgcgtgaaggacaccgatatccacgagaacgtcgagccggtcgacctcaacctgttgctccagcacatcgccgagccctacctggccgatggccgggtggaggtcgtcggtcgcgccgcggagccttatccgggcaagcccctggcgctcaagcgctgtatcggcaacctgctggacaatgcgctgaaatacggcgaacgcgcccgcctgagcctggaggacgggccggaagcggtggtgctgcacgtcgacgacgacggccccggcgtgcccgagcagcgcctggaacagatcttcgagccgcgcttccgtctgtctccgcgagggcagggctacgggctgggcctgggcatcgcgcgcaacatcgcgcacacccatggcggcgaagtcagtttgcagaaccgtcgcgagggcggcctgcgggtcagcctgcgcttgccgcgcctggggctggagtga

SEQ ID NO: 5178 - DNA, 387 bp, Pseudomonas aeruginosa
acgaggcgggcaggcacgaggttctcccgcgttctgcggcagccgcagacagaggcggagcgggcgctatggcagtgtttgcgcgggcatcgattgctcgggctgaagtttcgtcggcagaaggttctcgggccgtacatcgtcgatttcgtctgccatgagcggatgctggtgatcgaactggatggcgggcagcatgtgggttcgccggccgatgcctggctggagagccggggaccagggtactgcggttctggaacgacaaggtgctggcgcgcagggaggtgctgctggaggtcattctcgtgttgtaggaggtttctgtcgcgaaaccgccttgccgagttcaagtccagattttcctgctctgcctcaatcccaatgtaa

SEQ ID NO: 5179 - DNA, 1116 bp, Pseudomonas aeruginosa
ccaacttcttcaacgaccccgccgcggatccgcagaaggccgcccagcaactggcggccgccatcgaggcggcggcgcagtaagtccctggcgcggatcccggccagggctccgctcgatcctcccgactggctccgtgccgccgagcggcacgggtgggttccttcgcacgcgagaaaacgcatggcgaccaattcccctgtctatcccacggctccggtagcgcctcgtcgcgtctcgccactcgatcgcctgcaaggctggctgccgaagctggtgctggcgccaagcgtggtcgtggtgctgttctgcatgtatggctacattggctggacgctgctgctgtccttcaccaactcgcgcttcatgcccagctacaagtgggccgggctgagccagtaccagcgcctgtgggacaacgaccgctggtgggtggcgagcaagaacctgctgctcttcggcggctcgttcatcgccatctgcctggtgctcggagtgttcctcgcagtgctgctggaccagcgcatccgccgcgaaggcttcatccgcaccctctacctgtatcccatggcgttgtcgatgatcgtcaccggcaccgcctggaagtggctgctcaatccgggcctgggcctggacaagctgctccgcgactggggctgggaaggtttccgcttcgactggctggtggacccggagcgggtcgtctactgcctggtgatcgccgccgtgtggcaggcctccggcttcgtcatggcgctgttcctcgccggcctgcgcggggtcgacccggccatcgtgcgcgccgcccaggtcgacggtgcgagcctgccgaccatctacctgcgcatcgtcctgccgagcctgcgcccggtgttcttcagcgcgctgatgatcctcgcccatatcgcgatcaagagcttcgacctggtggcggcgatgaccgccggcggcccgggttattcctccgacctgccggcgatgttcatgtatgcgcataccttcacccgtggccagatggggctcggcgcggcgagcgcgatgctgatgctcggcgctgtactggcgatcgtggtgccttacctgtattccgaactgcgaggcaagcgccatgcgtga

SEQ ID NO: 5180 - DNA, 2031 bp, Pseudomonas aeruginosa
cgcgtccctgaacccgagcttcagcgtcagccgcctggccgtgcacctgaccctctggggcgcctgcgcgctttacctggtgccgctgctggtgatgctgctgaccagcttcaagacgccggacgacatccgcaccggcaacctgctgtcgctgcccgacaccttcaccgtcatcggctggctcaaggcctgggacagcgtcggcgcgttcttctggaactcggtgctgatcaccgtgcccggcgtgctgatctccaccttcatcggcgcgttgaacggctacgtgctgtcgatgtggcgcttccgcggttcccagctgttcttcggcgcgctgttgttcggctgcttcctgccgttccaggtgatcctcctgccgatgtccttcaccctcggcaagctcggcctggccaataccaccagtggcctggtgctggtccacgtgatctacggcctggccttcaccacgctgttcttccgcaactatttcgtggcgatcccggatgccctggtcaaggccgcgcgcctggacggcgccggcttcttcaccatcttcctgcgcatcctgctgccgatgtccacgcccatcgtgatggtctgcctgatctggcagttcacccagatctggaacgacttcctgttcggcgtggtgttcgccagcggcgattcgcaaccgatcaccgtggccctgaacaacctggtgaacatcaccaccggggtcaaggaatacaacgtcgacatggccgcggcgatgatcgccgcgctgcccacgctggtggtctacgtactggccggcaagtacttcgtgcgcggcctcaccgccggcgccgtgaaaggctgagacgggtcgctgaccccggagacgaacgaaacatggcaaccctcgaactgcgcaacctgcacaagagctacggcagcggcctggcggataccctcagggacatccggctgaagatcgactccggcgaattcctgatcctcgtcgggccctcgggttgcggcaagtcgaccctgatgaactgcatcgccgggctggagagcatcaccggcggtgcgatcctggtggacggccaggacatcagcggcatgagccccaaggaccgcgacatcgccatggtcttccagtcctacgccctgtacccgaccatgagcgtgcgcgagaacatcgccttcggcctgaagatccgcaagatgccccaggccgccatcgacgaggaggtggcgcgggtggccaggctgttgcagatcgagcacctgctcgaacgcaagccctcgcagctctccggcggccagcagcagcgggtggccatgggccgggcgctggcgcggcggcccaaggtctacctgttcgacgagccgctgtccaacctcgatgccaagctgcgggtggaaatgcgcaccgagctgaagctgatgcaccagcggctgaagaccacgaccgtgtatgtcacccacgaccagatcgaggccatgaccctcggcgacaaggtggcggtgatgaaggacggcgtcatccagcagttcggcacgccgcagcagatctacaacgacccggccaacctgttcgtcgccagcttcatcggttcgccgccgatgaatttcattccgttgcgcctgcagcgccgggacggacgctggaccggcctgctcgatagcggccaggaccgtatcgaactgccgctgagcctggagcccggcctggaggaggggcgcgagctgatcctcggcgtacgaccggagcagatcgccctgggcgatggcagcgctgcccatgacctgcgtaccgaggtcgaggtgctcgaaccgaccgggccggacaccctggtcttcgtcaccgtcaaccaggtcaaggtctgttgccgcctggcgccggacgtcgcgccggccgcgggcagcggcatgagcctgcgcttcgatcccgcgcgggtcctgctgttcgacgcgcagagcggcgagcgcgtggccgtgcgcacggcgggcgtggtggcggagaaggtcaccgccttgaacggcaatcgccagaagaactcctga

SEQ ID NO: 5181 - DNA, 1794 bp, Pseudomonas aeruginosa
tccgccgaggctggcggcccgccccgggccggcgcggtgccggccttctcggtgctctacgtgtacgcccgcaagcaggtcggcggcagcccctggctgcgcgtcggcgcctccagcaacggcgagggcgacggctggctgccggccagcgcggtgagcgactggaagcagagcctggtgctgaagttcaccgaacgctccggccgcgcgccggtgatgttcctcaacagcgccgagcaggtcgagcgcctgctcggcgatacccgcgcagcgcgcgacaccctgacccaggcggtggaccacaagggcgatccgcaggtggtcgcggtcgagcccaacgaccgggcgatcccccaggaccagttctacctgctgccgatcttcgactcgaaggaaagcttcgacgccgacggccagccggcgcagttgctggaggtcgcctcgatcgaccccggcggcagcgccgcggcaccccaggcgccgggccaggccgggcatggcggcgccagcggcgcggcgagcgacaccttccgcaccggcatcgtcctggtggtggacacctcggtgtcgatgcagccctacatcgaccgcgtgcgcgaggtgatcgacggcctgcagcggcagatcggcgagcgcggcgacctggacaaggtcagcttcggcctggtcggtttccgcaacaacaccgacaagacccccggcctggaatacgtcagcaagaccctggtgccgctgcaaccgggcaacgacgcgcagcgcttcgccgagttgagcagccaggtgcgcgccaccgacgtctccagccactcgttcaacgaagacgccttcgccgggatcatgcaggcggtcgacgaaatggactggtcgccctacgccgggcgcgtggtgctgctggtcaccgacgccggcgcgctgcgcaagaacgacccgctcgggcgcacccagatgaacgaggccgaggtccgccaggcggcgctgcgcaagggcgtgaagatctatgccctgcacctgcgcaccccggccgggaagaacaaccacggctacgccgagcagcagtaccgcagcctcaccgccgacgccaacccgaagatcgccgacctctacatcccggtggccggcggcgaggtgaacgccttcggcaacacggtgaaggagatcggcacggtgttcgccgacctggtccacgacgccggcaaccgcaagccgcaggcgccgcgcttcgacgccgcgccaagcgtggcgagcaagtcgtcggccatcggctacgccatgcagatggaattcctcggtcgccgcgacccggtgcgcgcgccgcaggtcgtcaccgcctggaccgccgaccgtgacctgaccaacccggcgctgccggcgttccaggtttgcgtgctgctgagcaagctgcaactcaacgaactgcaacagtcgctgaaactgatcgtcgacgcggccaagcgcacccagacctcgcccaaggacttcttccaggaaatcgccagcgccagcgcctacatgagccgcgacccggcgcaactggtgaagggcagcaacctggcgcagagcggcgtgctcggcgaatacctggaaggcctgccgtaccgcagcaagtcgctgaacatgacccaggacctctggctgtcgctgagcgtcgccgaacagcaggacttcatcgacgaactggagtcgaagatccgcctctacgaaaccttccacaacgacgtcgccaactgggtccggttcggcgacgccgacgccggcgacgcgctgtaccgcgtgccgctgtcgacgctgccatga

SEQ ID NO: 5182 - DNA, 1629 bp, Pseudomonas aeruginosa
tgcgcctgctggtggagcaggcccgcgagcgcggcgcctgcaccgtggtcgccacccacgacgagcgcctggctcgcgcagccggcctggaagtcctggccatccgctggcaacgcgaggccgacgacagcgtcggcgcctgcctcgaggaagttggctgatgcgcgccggcctgctgctctcgctggcctgggccgactatcgcggcgaggcgcgcctgtcgctctgcgcgatcttcgccctggcggcggtgatcaccccgctgctggtgctgttcggcctcaagtacggcctggtcagcaccctcaccgagcggctggagcgcgcgccttctgtgcgcgagatcattccggtcggcggcgcccgctaccgtgccgaggacatcgccgccctggccgcacgcgcggacgtcgccttcgccgtgccgcgcacccggcagatcgccgccaccgccgacctcagcggcggcggcgagaccgccctgagcgtcgagatgattcccagcgccgccggcgacccgctgctggccggcctgccgcaacccgaccggccgacccgcgtggtgctcagccacggcgccgcggaaaaactcggcgcccagcctggcgagcgcatcgtcgcgcgcatcggccggcgcatggatggccaggcacagagccagcgcctggagctggaagtgctcgcggtgctgccgcaggagcgtttcgcccgcgacgcgctgttcgccccgctggccctgctggaagccgccgaggactatcgcgacggtcgcgcggtggccgcctacggctggccggggaaggccggcgagaccccgcgcgcacgcatctacccgggcttccgcctgtacgcccgagacctcgatgcggtggaagggctgcgccggcacttcgtcgcgagtggcgtggaagtcgccacccaggccgaggccatcgcccaggtgcgcagcctcagccgcaacctcggcctggtgttctggatcgtcgccgcgctggccatcggcggtgccttcgccgccatcgccgccagcagcctggccgccgtcgaacgcaagcgccgcgccctggcggtgctgcgtctgctgggcttcccgaccgccgcgctggtcggcttcgtcatgctcctggcgctgttcagcgccgtcttcggcctgttcctcgccgggctgctgtacgccgccacggccggcgcgctgaaccacctgttcgacaaccagagcggcgagttcgtctgccgcctgctgcccagccactacctgacggcgctgctcgccacgctgctgtgcagcgtcctggccgccgccagcggcggctggcgcgcggcgcggatcgaagccgcagagggattacgcgatgtttgagaaagccattcttccgctcgccctcggcgcctgcctggcatttgccgcgccggcctgggccgaaggcgactcgccggacaatcccaagccgctggccgacgacgtcgccctgccgctgccgtgtggcggcgagatggtcttccggcatgtctacgtactcgccgaaggcgccctcgacgatcgcgaggtcaacctcggctacgccttcaacgaaggcgaggcgggctaccagcagtcgttcatctccggctaccggcgcgactacgtga

SEQ ID NO: 5183 - DNA, 921 bp, Pseudomonas aeruginosa
gatgcaatgagccaacccagcgaaaaccgtttgatcacctcggcgcgctacgcgctctgcctgttgaccgccagcggcgtgctgctcagcggctgcgccagcagcggcgtcggctcggtcgcccagaccacccgcgcggaatactacccgtcctgctacgagccggtgtcgcacctgcgcagcaccgataacgcagtgcgcaattcggccatcaccggcgccattaccggcggcctcctgggcggcctggccggcggcctggccagcgacgagaaccgcggccgcaatgccgccctcgctgccgcaggcggcgccctggccggcggcgcggcgggctactacatggagaagcagaagcagatcagcgatgaccgcgcgcgcatcggctcctacggtaccgacgtcgaccgcagcaccgtcgagatcaaccgtagcgtggcctacgccaagtcggcgcaaagctgctaccagagccagttcaaggctctgctcgacggtcgcaagaacaagtcgatcaacgaagccgaagggcgcaagcgcctggccgagatcgtcagcggcctgcaggagaccaacgccttgctggtcgccgccaacggccgtgccggcgagaacatcagcaactacacccaggcctacgagaaagacctgcagcaggtcggcgtaccgcgcgccgaggtgaccaaggtcgccgaggccgagaaccgcgccagcactacgaaaggcggcagcaagcccaagaccggcagcaatcccaaggtgccgaaggaagcggtcgccaccgagcagaccatccgcaaggcccaggacgcgcaaagcgaaggcaacaaggtggcctcccagggccagggcatgatccgggaagtctgcaacagcccggacatgggcgactgggcgccgccgagctgcgccaaggcctga

SEQ ID NO: 5184 - DNA, 543 bp, Pseudomonas aeruginosa
cacagcacgcggaccgcccgccgccctaccagcaccggtccgcgatccggcgaggcggaggaacgcaaggcgtttttccaaggcgcaacggatggcggccgggttaaaggagcttcggagtcttctatgcgtacgctgctgcttgccggtggcctgctcgtcctgagcggctgctcactgctgatgcccacccccgacccgaaccgcgcctgggtcgacctcgatacccagcccgacgccgatctcgccgccgtggaagtcgacgacaagagctgggaccgcacgcgctacttcgaggtcgatcccggcacccgcgaactcacggtgcgctaccagttcaccgtcgacccgaccaacatcggccccgtggacagcccgctctggcgcgattgccagctcaacctcaagttcaaggacttcagcgccggccagcgctaccgcctggaggccgggcacatcggcttccgtccctgggcgaagctctacgaccaggacaacagggaactggcgcgcggccgcgagggacgctgcgcgaaggtctga

SEQ ID NO: 5185 - DNA, 768 bp, Pseudomonas aeruginosa
cccgtcactcctcgtcgatgcctggcagccgagtgctgcgcagcgcatcctgccgcattcgactgcggcaggccagggccagttcgccgggctggggaagcgttccgctcagccgtcgaggctggcgtccaggctgatcttcgcgttgagcaccttggataccgggcaaccggccttggccttgttggcgatctgctcgaaggtctgcgcgtccgcccccggcacgcgcgccctgagcaccaggtgcacggcagtgatggcgaaaccgtcggactgcttgtcgagggtgacctcggcgcgggtctcgatacgttcggcggtcaggccggcctcgccgagcatcatcgacagggccatgctgaagcagccggcgtgggccgcgccgatcagctcttccgggttggttcccggtgcgccctcgaagcgggtattgaagccataggggttgtccttgagcgcgccgctttcggtggaaagggtgcccttgccgtctttcaggccgccttgccagaccgccgatgccgtcttcttcatgtcgactcctccggagctgtggatggacatccgctcgcgtcggcgagcgggcatgtctacatgggaggacgacgcagccggacaagttcagtccgcctgcgcggcggcgggattcaggcgcaaccgtcgatgcggcagagcggcgccgcggccccgcccacggcatcgctgccgccggcaaggcgcagctgcgtttcgagaagagcccgccagtcgtccggctggccgaggtag

SEQ ID NO: 5186 - DNA, 1026 bp, Pseudomonas aeruginosa
gcggttctccaggcagtgggatcagaggcttgccatgttagttgcttgaaagcgcgcaaaaagccccgcaataatcacagctttgttgcatggatcgagcgaatcatggaccgcctgaccgccactcgcgtcttcgtcgaagtcatcgacagcggcagccagaccgccgccgccgagcgtctggacatgtcccgggcgatggtctcgcgctacctcgccgagttggaggagtgggtcggcgcacgcctgctgcaccgcagcacccgccgcctgagcctgaccgacgccggcgcggagctgttgccgcagtgccgcgagatgctcgccgtggccgacgccatgcaggccaccggccagacccgccgcgacagcccgcgcggcactctgcgcatcaccagcagcctgtccttcgcccaggcctggctgacccgtgccgccgccgccttcgtcgagcgctacccgggcaccgccatcgacctgcaggtcaacagccaggtggtcaacctggtggaggagcgcatcgacctagccctgcgcatcgccaaccagctcgaccccaacctgatcgcccgccgcctcggcgaatgccgctcggtgatctgcgccgcgccggactacctgcgccgccacggcaccccgcggcgcccggaggacctggcgctgcacaactgcctgacctactcctacttcggccgcagtctctggcagttcgagcgcgacggcgagccgaccagcgtgccggtgggtggcagtctcagcgccaacgaatccaccgtgctgctggaggccgccgccgccggtgccgggatcagccagcagccgctgtactcggcagccccgctgatccgtagcggacgcctggtggcgctgctgccggagtggtcgccgcaggtgctcggcatccacgcggtgtacgcctcgcgccggcagatgccgccggcgctgcgggcgctgctggacttcctggtcgaacggatggcggccgatccgcactgggacgaggcgggccccctggcgctggcgtga

SEQ ID NO: 5187 - DNA, 765 bp, Pseudomonas aeruginosa
ccctcaaggtgcgcggccaggagatcagcttcaacggccgcgacttcctcttcggcttcgccctgcccaacttcttcttccacgtcaccaccgcctacgccatcctccgccacaacggcgtcgaactgggcaagatggacttcctcggcggcgcctgaggttcccgcgccgggatggcacgcacaaggaccatggaatggatcggaaaaccctcgacgacaccagcaagttcctcagctatgtccttcgccaccagcccgaggccatcggcctgacgctggacggcgaaggctgggccgacatcgacgccctgatcgccggcgcggcgcgggacggccgcgccctcgaccgcatgctgctcggcgcggtggtcgagaacaacgacaagaagcgcttcgccctctccgccgatggccagcgcatccgcgccgtgcaaggccactcgcatgccgcggtggccatcgcctacgcccccgcggtcccgcccgcagtgctctaccacggcaccgccagccgcttcctcgactccatccgcgagcgcggcctggttcccggcagccgccaccacgtccatctctccgcccgccgcgccaccgccctggaagtcggccgccgctacggcagcccggttctgctggaaatcgacgcgcgcgacatgcatctggccgggcacctattccaccaggcggagaacggcgtctggctgaccgagcgggtacccgtgcggttcatccgcgaggcttgagaaggcgttctacggactaa

SEQ ID NO: 5188 - DNA, 714 bp, Pseudomonas aeruginosa
ggaaagataccgacaagcgcaggacgcccgatggaccttcgccccagccacgtgcatgtgttcccacccagccgcgacctcccggccgcaaccagtccgcaccgcgaaaccctgctgcgcagcggctgcgcctggaacggctcgctctacctcggctatcccctcggccagccgcagctcaccgtgcagcgcctgagcctggccgcccacgaacgcctggactggcaggtccatccgatgcccagcgcgctttacgtgctcaagggcgaactgcgcctggagacccgcgacggtgcccagagcacgcgggtgctggaaggcgaaggcggcgggttgcctgatgaacatcatccatcgcctgatagccggggccgaaccggtggaagccctgctgttccatgccggcgtggaaggcatgccggtggggctcggcgaacgcggcgaaatgcccgacgcctgaagacgccggcgggccggacagcagcccgaacccgccacgccccgagtcacgctcaggcggagagcccgtacaacatgagccagccttccagcgccagcgcggtctccaggttgtggcggctcacctgggtgttgaagtacccctccggatgctccagttcggcggccaggaactctcgcgaaacgatgccgaacaccgggttcgccgcgtcctccagcagacgccgcacgctcccgcgcaggaaacgctcgtag

SEQ ID NO: 5189 - DNA, 1176 bp, Pseudomonas aeruginosa
  unsure (919),(922): Identity of nucleotide at the above locations are unknown.
tggagacaaccgccatcgcccgcatcaccggggcggtggcaaggatttcccctgacttggagagttttccatgagcttcgcgcagaatctcctacgcctacgccagcagaacgccctgacccaacggcagatggccgagcgattgggcgtcaccgtgagccagttgcggcacttcgaaaccaagggcgggcacccgtcgctggtggtgctgcaaaccatcgccggacgtttcgcggtgcccctcgactggctggtctgcgagcgcagcgagcggcaggcactaccggaagacctgcgcctgcagttcgaggccatcggccgcctgcggctggacgagcggcgcgccatccgggcgttgctcgacgacctgatccgccagtacatggccaagcgcaacgcagcggccaagcccctcccggcggcttgcaccgaggccacggagacgtccccgtagccccggcgcacggctcagtcgctgccgtacctcggcgagcgcgggccgtacaacagtccgcccggctggccggccgagagcaggcgcgcactggtcatcccggcgatcggataaccggcgtcctccaccgaactgttgatgatctgcttgaccgccgcggtgatcagcatgcccaccaggccgccgttgttgccgccgttgccttcctcgctggaggcggtcgccgagccggtccacagggtggtgccggatcgcaggtcgaccagcttggcgctggcggtgacgatggtcgcgctgctgatcaccatgtagcgcgtgccgtagtcgctcaccgtgacgtacagcgccgcgtcggcgccatagatctcgcgcagcttggccggggacacctggtgcacgtcgccggcgctggtcaggccgttctggcggaaggtctcgtcggccagcgccaccggcactacgtantanccggcctcggccagcgggaaggtgacctgcgagagcatgctgtaggtcgccttcacgtcgggcgactcgttcagcggcggcaggaccaggatcgagcgcggcttggcctgcttgaacgccgagtagtcgacgctcttggtcggcgcgcagccgccgagcagggccagcagggtgaaaccggccaccaggccggacagtcgggcgagtttcaacgggcacctccacgggcgttgttcaggaggaagtccatgtag

SEQ ID NO: 5190 - DNA, 231 bp, Pseudomonas aeruginosa
ccctcccactggtacagcgtcttcggtccgctgcacccggccagcgccatgctccccagcagcgccgccgtccatgtgatcgtcttgctcatgtgtgccgtgattccctggtttctggtggattattggttctgtggcttccaggcgccgctatcgaccgcgttgaccaacttgttcaccgcctcgcgcatggccaggtcgagaaccttgccgttgagggtcgagtcgtag

SEQ ID NO: 5191 - DNA, 1554 bp, Pseudomonas aeruginosa
tgtttccccgccagtctaggaacgaggcgcccctccgcctatcaggattggccgtggtttttttactgttggcggccgtcggagcacgcggaaagagaaccgtcagcggccgaaaaacagcggactttccctacgccagctcccgtgcgcctacaccggggcggagaacccgatggatatcggcggcagcgacgggctcttggtggacggcgcaccgccgtgcgggcgcctcggggtcgtctgctgctatggtgcgcacaggcacgtcgccatcctctctcccggcgaatggaatcgagcatgacgctttccctggatctgttgttgagcctgtgcacggccctggccatcggcctcctgatcggcgccgagcgcggctggcaggagcgcgaccacgaagatgcgcggcagatcgccggaatccgcaccttcagcctggccggcctgctcggcggcttcgccaccctgctcgcgggcgaactgggcagcgcagtctgggtagccttgctgctggccctcgcggcgctggccgtggccggctacgtgagcgatgtcaggcgtggcggcgaccagggcatgaccaccgagatcgccctgctgatgaccttcctcctcggcagcctcgccctcaccgaacagcgcctgctggctgccgccggcggcatcgtgctgaccctgctgctgagcctcaaggacaagctccacgccctgctgaagcgcctgaccgccgaggagctatcgggcaccctcaagctgctgttcatttccgtggtcctgctgccggtgctgcccaaccagggctatggtccctgggcgttcttcaatccctacctgacctggtggatggtggtgctgatcgccgccctcggtttctccgcctacctggccatccgcctgatcggctcgcgcaagggcctgttgctgaccgcggtgctcggcggcctggtgtcctccacggtgatgaccctgaccctggcgcgcctgcgcgagcgcatgcccgacgccctgttggcgtgcgccctgctggcgacctcggcgctgatgttcccgcgcatcctcgtcgagatcggcgcgatccacccggccttgctgaaggaactggccctgccattcgccgccaccaccctcgtctaccttggcggcacgctgttccacgccctgcgcggcggccgcgccagccaggaggcgcccgacgagccaggcctgcgcaaccccttcgaactgctcccggccatgcgtttcgccgccctgctgagcgcgatcctgctgttggtggaggtcggccggcggctgttcggcgacgccggcatctatgcggtcgcgttgctctccggcctcgccgacgtcgacgcgatcaccctgtccctggcccgcgcggcgcagggcgaactcgatccaggcgtggccagccgcggcatcgcccttgccgccctgagcaacagcctggtcaaggccggcctggtcgtgctggtgggcggcaagcggctggccctgcaaacgctgcccttcagcctggcggggctgctggtaggagcgctgctgatcctgttgtga

SEQ ID NO: 5192 - DNA, 5103 bp, Pseudomonas aeruginosa
gctgctgaggtctaccgtgacctttccagtaagcggatcagtcttggtctgaagaatcccgtcgaagtactcagccgtcagccccccggtcaggctcgcaatagcaatctgcttcagactgtcactactgaagctgtctttcagcaccttcccgagatcgcccttgttgttgatcaggctgaccgctgccgtgcccgacaggcttcctgccgcaccaactcctgcgcccatggcgaagctactggcacccactcctgcaccactgagcgctcccgctgccgccatgccaccgatggctgccgccgcgatggcgacagcgatctgcgtcgccggccccatgcccgagttgctgtacttccagctatcgtgcacctcctgcaccatgcgccagtccacatccccgcgctgctcggcctccttcagccacgccagttgcggatccgcctgcaccatcgcgtcgatggtctggctcacggtcttctggtcgatatgcttgaggtcgatcttcagcccttccacggccttgatcgccagattcccctgggccacgatctggctctggcgcacggtttcgtcggtctggcccttgcccttcgacgactgccacgccaggtcgcccttgctcttctcgtggctctcctggtgcaggtccttcaccgcctcgaaggtcaccgcgccgccgctgacgatggccaggtcgttgcccgattccagcttcgcgccctggtaggtctggtcgccgccgctgagcagggtgaggtcgccgccgctgctgatctggctgcccaccgccttgacgtcggtgacttcgtcgcgccgggtttccttgcggccgaagtcgcctttcttcttcttgtcgtacaggtagtagttgctgtcgttggcggccagcagttccagcttgtcgccggccaccaggtaggcctcgtcgccggcgctggcctggctcgcgatcaggcgcaggtcctgtccggcattgatcgccaggtcgccgccggcgtccacgcgggtgccttgctgggcaaccttgtcttcctggtaggtgaccttcctggtcttgctgtaggcatgctcctcgttcgccgccgccgccagggtcacgtcgcgcccggtggagagggcgatgtcgcggcgcgcttcgagggtgctggccaccgccgtcaagtcgcggccggcgctgacgttcaggtcccgcccggcgctgacttcggcgccgagctgggtcacgctctggagccgcgacgtgctccagcgggtctggccctggcggtcctcgacggcggcgacggtgacgtcgcgtccggcgtcgaggctgaggtcgccgcggctctgcagcaccccgccgaggttggcgatgtcgcgtccggcctggacgttcaggctgttcgccgcctccacccgcgcggcgctgtcggcgaagctgcgttcccaggtgcggccgtcgagcgcgctgtcgtagcgggtcacgctgcgttcgttgatcacgtcgccggtaagcgcggtgaggctcacgtcacgcccggcgatgaccccgccctggcggttgcggatcgagtcgccggcgagcaggtcgaggcgcttgccggcctcgatcaggccgctgttgtcgaggttgtcggccgtcgccgagaggtcgttccgcgcgcgcagggtgccgacgttatgcaggtcgccgccgctcaccagcttcacgtcgcggccctggatcagcgcaccgttgggtgccagccgaccctccgcctgggccaggtagaccaccggcgcgaggaccttctcgccgttcacctcgacctcttccagccacacgatgtcgtgggtcagcgccgccatctgctccgcgctcagacccacacccagttgcaggtgcagttggtccttgtaagcgatggcgttgtccatcaggtagcggaacagcgcctcgtcgctgctcagcccatcgatgtagcgctggccggtgcgcgccaccaccgcgtcgcggatcagccgctgctcgtagagaccgtcgccgaggcgcttcttgctagcgtccgggttcatgcccaggccgctgagcaggtagtccgagttgaggaactgcttcagttcggtgagcgccgggttggtctcgatcaggtacttgtggctggcgctcggcgtggcgttgccgggcacgccctggacccgggcgacgcccggcaggctaccgccgagcgtgctgccgccctgaccctggacgttggccgcgccagccaggccgtcgactcgcacgccctggccctgccaggtaccggcggcgttgccggcgccttgctggccgaccgagacgccgctaccgccctgggtgcggtcggcgccggcaccgagcgcggcgctgccattgccgtcctcggcgaagcgcgagctgagacggaacaggccgttgtcaccctggggcaggctgaagccgggcagggtaaccgggttgacctggcgccgcgccaggtcgggcggcagttgcgaggtcagcggcacgaccaccgaaaccccgctgccgcccaccgcgctgtcgcccacctggcggccgctgccgacgaaggtgtagccggggcgggtgacgccgttgtcgatgcgcgtgctggcattgaccgtgacgtcgccggcggcctggatcaccgctgcgtaggactggtcgccactgctgatcggggtcggccccttgctcgggaattcgtactcgaaggaccagtcgctgaggatcgcgttgagcgcggcggggatctcgcccgcgcgcgccgggtcgaaattggcgctctggtaccagtagaggttggtgaagttgcgcgacttctggtcgatgccgccgatatcgccgccgcgagcggtacgcagcacgcggatggtttccagctcgccggtttccaggccctggttgtcgaggacttcgaggttggcggtgaggttgccgccgctgccgatcagactggaaaggttgttcagggtgccgccgtcgatggcgaagtcgcctccggccagcagttgccccatggcgctgctggcggtgacctcggtcttgtcgcgctgggtgatggtccagatggcgttgcgcttgccgctgcagtcgcccgcgttgacgccttcgatgcaggcggtctgctccatcttcgcggtgtacaggcccgacttgctttccagcacggcgcgacggttctcgatcaggctggcacgcaggctgaagtccttgccgctctcgatcaccccggaaaggttgcgcaggctggcggcacggttgccggcatcgtcgcgggcgatatccagcctgccgaggctgtacacatccccgtagaggttggtgatgtcgccggcgcgcagggtcatgtcggcgccactgaacagcaacccgcgctcgttgagcagggcgggcgcgttcaatcgcaggctgccgccgccgcccagggtgccgtagttgttcagactcgcggcgctggccacgaggtcgccggcggcggtgatccgcccacggttgaccagcaggttgccggcgccgagcgtgacattggcgccgccggcgaggctggcggcgttgccgaggtcgaggctggcggcgttcagggcgaagtcgccgaggctggtggcgcggccgttgccacggtagccgccgctcaggtcgaggcgcaagctgccgtcgctggccagcaggccgtcgttgctccagtcgccgccgcggccagtgaaggactgcaccgccagcagcttgccctcggccgtctggcggaaggtgccgatgtccaggttcaggcgtccggcttgcagcacgctgctgttggtccattcgctggcgcggatgtccagcaggccattggtggtcagttcgccgccggcgcggatcacctgcccggaatccaggccgaaggtgccattgccggtgtggaggatgcgcccgccggcgttggccaggctgcccagttgcaggtcgaggtcctggttggcgctttccagcacgccgtaggcgttgttcaggccgccagcgaccagccgcgtgctgccgctgcggccgagggcgcgcaggctgccgccgctgttgtcgatcgcggcggcgcgcaggtgcagctcgctttcgctttccaactggccgaagcggttggccagcgcgccggccaggctgaagtcgatgcgcccggcgccgaccttgccgccctgacccgccgccgcgccctggttgaggaaacgctggccgtcgaggctgagcaggccgctggcgtagaggccgccaccctggttgtcgaagtcggcggtgacgatgcggttgtcgccgcccagcgccgagagatggccctgctggttgcgcacgccttgcccggcgcgaatctccagcgactgcgcctgggtgacgccggcgctgttgtcgaacagcccggtgaccagcgtcagccaacccttggcgctgttgagcacgccgccggcgccgttgtcgaggctgccgctctgcaggtcgaggttgccggcccggctgtccaggcggccgccctggttgtccagcgcgccaccgatacgcagccggttgtcgccctgggcctggagcgtgccctggcggttgtccaggctgccggcctgcacctcgagggcgccggcctggctgaagatcaggccgtcctgctggttgcgcagggcgccgccgcccaggcgcaggctcatgtcggcctggctggcgagggtgccggaggcgctgttgtcgaggctgccggtggtgatctccagcagcccctggctgaccagcttgccgccgcggttgtcgacgctggcgctgcgcagcagcaggtcgccgccgctggccaggcgcgccgcgccggcgttgaccagggcgccgccgaggatggcgtcgagccggccctggctgatcaactggccgtcgctgttatccaggctggcgcccttgagcagcaggctgccgccgttgatccggccgccggcgttgttcagcagcgtatcgtcgcgctcgaagctcagcgcgcgctgcgccgagaccaggccgccctggccgttgtccagcttcccggcgatgctcagggtcacgtcgctttcgccggagacgatgccctgggcgttatcccaggctggcggcgtccatccgttgcgcgcccttgctga

SEQ ID NO: 5193 - DNA, 249 bp, Pseudomonas aeruginosa
acagcttgccaccctggtcgttgcgcaggctggcgacctccacgcgcacgccagccttgccgctggcgctgccgccgtcgcggttgtcgaaggcgcctcccgtggcgctcaagccggcgtcggccaccagcacgccgccacggttgtccaggctggcgccgtggacgttcaactcgctgcggctcgacagcaggccgccggcgcggttgtccagttgccccaccgtcacgcgctgcgcgccctggctga

SEQ ID NO: 5194 - DNA, 675 bp, Pseudomonas aeruginosa
cgcagcgcctccgccgccagcccctggctcgcggcccaggccggccaggcctggggtcgcgaggcggtatgcagcagcggctcctgcaacagccgcgcggcgggcgcctgggccaggccggtttcctgcgccaggcgcgggctgaccaccgggcccatgcgctcgggcgccagttcgaagacctgcatgtccgccggccagggcggctcggcgaaccagagcatggcgtccaggccgggacgacgcggatcgaactcgccctcgctggtggacagttgcaggcgcaggtcggggagggcacggttgagctggtccagccgcgggatgaaccagcgcgccagcaggctgccgggtacgccgaggacgaacggggcctcggcggtctgccggcgcagctcggcacagacgccacgcagtcgctcgaacgcatcgccgcaggcgtcacgcaggcgaacgccggaatcggtgagttttacgccgcgtccatccttgccgaacagggccaccccgagatcgtcctcgagcaaccgcacctgccggctcacggcgccatgggtaacgtgcagttcctcggccgccaggctgatgctgtgcaaccgggcagcggcttcgaaagcgcgcagggcattcagggaagggaggtcgcggctcatggctattcgtgagttttcctga

SEQ ID NO: 5195 - DNA, 1242 bp, Pseudomonas aeruginosa
attctgcccatacgtcatttcctggagccctccatgacttcctatcgcaacggccccgacgccaagggcctgttcggccgcttcggcggccagtacgtcgccgagaccctgatgccgctgatcctcgacctcgcccgcgagtacgagaaggccaaggacgacccggcgttccaggaggaactggcctacttccagcgcgactacgtcggccggccgagcccgctttacttcgccgagcgcctgaccgagcactgcggcggggcgaagatctacctcaagcgcgaggagctgaaccataccggcgcgcacaagatcaacaactgcatcggccagatcctcctggcccggcgcatgggcaagaaacgcatcatcgccgagaccggcgccggcatgcacggcgtggccaccgccaccgtcgccgcgcgcttcggcctgcagtgcgtgatctacatgggcactaccgacatcgaccggcagcaggccaacgtcttccgcatgaagctgctgggcgccgaggtgatcccggtgaccgccggcaccggtaccctgaaggacgccatgaacgaggcgctgcgcgactgggtgaccaacgtcgacagcaccttctacctgatcggcacggtcgccggcccgcatccgtacccggcgatggtccgcgatttccaggcggtgatcggcaaggaaacccgcgagcaactggccgagaaggaagggcgcctgcccgattcgctggtcgcctgcatcggcggcggctccaacgccatgggcctgttccacccgttcctcgacgacgccggggtgcagatcgtcggcgtggaagccgccggccacggcatcgacaccggcaagcacgcggccagcctgaacggcggggttcccggcgtgctgcacggcaaccgcaccttcctgctgcaggacgcggatggccagatcatcgacgcacactccatctccgccggcctcgactatcccggcatcggcccggaacacgcctggctgcacgacaccggccgcgtcgagtacacctcgatcaccgacgacgaagccctggaggccttccacacctgctgccgcctcgaaggcatcatcccggcgctggaaagctcccatgccctggccgaggtcttcaagcgtgcgcccagcctgcccaaggagcacatcatggtggtgaacctgtccggtcgcggcgacaaggacatgcagaccgtcatgcaccacatgcaacaggagtcgaaagcatga

SEQ ID NO: 5196 - DNA, 234 bp, Pseudomonas aeruginosa
acgcgctggaacagaggggtcgccagctctttctccaggcgtttgatctgctggctgaccgcaggctgggtggtccccagttcctcggcggcagcggtgaagctgagttggcgggcggcggactcgaatacccggagcaggtcgagggatggcggcatgaggtgttctcacataagcccggcttatccaacgcatccagccccatgcggtttaccagggatttcgatgcactga

SEQ ID NO: 5197 - DNA, 1173 bp, Pseudomonas aeruginosa
tcgacgcagcactatcgcataacccaatcgcatgggataagccgcccgatgaagacctcgccgaacatcctgttcatcatggccgaccagatggccgcgccgctgctgccgcttcacgatccgcgctcggcgctgcgcatgcctcacctctcgcgcctcgccgaacgggccgtggtgttcgactcggcatactgcaacagcccgctctgcgcgccgtcgcgcttcaccctggtcagcggtcgcttgcctacccgcatcggcgcctgggacaacgctgccgatttcgccgccgatacccccacctacgcccactacttgcgcaacctcggctatcgcacggcgctgtcgggcaagatgcacttctgcggtcccgaccagttgcacggctacgaggaacgcctgaccagcgacatctatccggcggactatggctgggcggtgaactgggacgagccggaggtgcgcccgagctggtaccacaacatgtcctcggttttgcaggccggtccctgcgtgcgcaccaaccagctggacttcgacgaggaggtggtgttcaaggcccgccagtacctctacgaccatgttcgccagcacgccggccagccattctgcctgaccgtgtcgatgacccatccgcacgacccctacagcatcccggcgagctactggaatctctaccgcgacgaggacatcccgctgccgcgccagcgcttcgcccaggaggagcaggaccctcattcgcaacgcctgctgaaggtcatcgacctgtgggacaagccgttgcccgaggagcgcatccgcgccgcccggcgtgcctacttcggcgcctgcagctacgtcgacgcacagatcggtgcgctgctggcgaccctggaggaatgcgggctggccgacgacaccatcgtggtgttctccggcgaccatggcgacatgctcggcgagcgcggcctctggtacaagatgcactggttcgagatggccgcgcgcgtaccgctgctggtccatgcgccggcgcgcttcgcgccgcgccgcatcggcgcttcggtatccaccgtggacctgctgccgaccctggtggagctgggccggcgggccagtcgatccacgcctgccgctggaaggccgctcgctgctgccgcacctgcgcgacggcagcggggcatgacgatgtga

SEQ ID NO: 5198 - DNA, 1284 bp, Pseudomonas aeruginosa
tccgccgcggcgactacaagttcatctactccgagcaggacccctgcctgctctacgacctgcgcaacgacccgcaggagcgcgagaacctcgccgccagtccggcccatcgcggaacgttcgaggcgttcctcgacgaggcccggcgacgctgggacatccccgcgatcacccgcgccgtactcgacagccagcgccgccgacgcctggtggccgccgcgctggcgcgaggacggctggccagctgggaccaccagccgtgggtcgatgcaagccagcagtacatgcgcaaccatatcgacctggacgatctcgagcgccgcgcgcgcttcccgcaaccctgagcacgagggcacttccatgaaccggcttcccacctgcctgctggccgccaccctgttcctgggcagcgcctcgctatacgccgaagaccccgcctgtgcccgcgtcaggctggccgatccaggctggagcgatatcgcggtaaccaacgccactgccgcgtttctcctggaaagcctcggctaccaggtgaagatcgataccctgtcggtgccgattatctatggcggcctgcgcgacggccaggtggacgccttcctcggcggctggatgcccgcgcaccaggactatcacgacaagttcgtcgccagcggccaggtcgaacgcctcggtcgcaacctcgacggcacccgcttcaccctggcggtgccgcgctacgtctgggacgccggcgtacaccgcttcgaggacctcgccgcgcaagggcaacgcttcaaccgcaagctgtacgggatcggctccggcgcgccggccaatcagtcgatccagaagatgatcgacgccaaccagttcggcctcggcgactggaagctggtggagtccagcgagcaggcgatgctcgccgaactcggccgggccgagaagcgccagcgctggctggtgttcctcggctggacgccgcacccgatgaacatccgccatgacctgcgctacctggaaggcggcgagcagtacttcggcgaccgcggccaggtctacaccctggcacgcaagggctacgccgcgcagtgcccgaacccggcgcggctgctggccaacctgcgcttcgacctggacatggagaaccgcctgatgagcgacgcgctggaaggcacggcgactccggcctcggcgacccgcgcctggctcaaggccaacccgcgggtgctcgaggcctggctgcaaggggtgaccagccgcgacggcggcgacgccctggccgcggttcgcggccagccatag

SEQ ID NO: 5199 - DNA, 1911 bp, Pseudomonas aeruginosa
cgccatgtggacgcgcttgctgccgttcctcgcctggctaccggggctgcaccggggcatgctcgggcgcgaggcttgggtcggcctgaatggcgcaatcctggcactgccgcaatcgatggcctatgcgctgatcgccggcctgccagcggagtacggcctgtacgcggcgatgctgccagtggcgatcgcctgcctgtggggctcgtcgcgctacctggtgagcggtcccaccgcggcgatctcggtgctgctgttcagttcggtggccccgctggcgccgctgggcagcccgcaatacgtccaggccgtgctgctgctgacctttctcgccggcgccttccagtggctgctcggcgtcctgcgcgtcgggtcgctggtcaatttcgtctcgcattcggtgatgctcggcttcacccttggcgcggcgctgctgatcgtcctcggccaactgccctatcttctcggcctggccgcgagcggggagggcgcagcgccgggaaacggctggcggctgctggcgcggttcgccgagttcgatggcccatcgctgctggtgggcggcttcagcttcgcgctcagcctgctggtcaggcgcctgcgaccgcgctggccggccctgctgcttggcttgctgggcggtgccacgctggtctgggcgctacccgggaccttcgcctcggtagcccatgtgcaggccttatcgagcgcactgccgggctggaatccgctggtcttcgattcccgatcgatcctcgacctgctacctgcggcggtggcctgcggcatgctcgggctggtcaccagcctgtcgatcgcccgcgccctggccgcgcgccagggagacgcgttcgatgccaaccaggaggtccgcgcccagggcctgtcgaacctgctcgggccttggctgtcggcgagcctgtcggcgggctccttcacccgctccgggctgaatctggaagccggtgcgcgctccccgctggcgggtgcgttttcggcgctctgggtggcactgctggccgtgctcggtgcgcgcctgatcgagcatgtaccgttgccggcgatggccgcaggcatcctgctgatcgcctggggcctgatcgaccgcccgacgctccgcgcgctctaccgcagcggccgcgccgaatgcctggtggccggcctaaccgccctggccacgctgctgttgccgctgcagaacgccatctacgcgggagtgctggcgtcgctggtcttctacctgcggcgcacctcgacaccacgcgtactgcgccagcgcaacgacgaggaagaagtgctgcgcatcgaaggctcgatcttcttcggcgcctgcgactacctgcaacgcctcatgcgccaatgcgacaggccacggctggtgctggacgcccgccaggtgaacttcatcgacttcgccggcgcagtgctgttgcagcaggaagcccgccgcctgcacgccgagggccgccgcctggtattgcgccacgcccgcccgcaggtccgcgaagcgctgggccggcaggccgacgaaggctgccgcctgcactacgaaggctgacgctcagggcgccgccggcgatgtcggtgcgctgtcgccgggcagcagttgcggcgattcccgctgcagcttgtcgcgcatcatctccaactgtccaagggcggcgcgagcctcgtcgatttcctcggcgctgcgctcgccaccctgttcggccgcctcgatccgcgcgcggatttccggtatctgctgtacgccgctggtgtaggcctgtaccagttcgcgggtctgtcgttcctcgaaggcctggtactgcttcggatcggccagctcctgcgccgtcgcgccctggcgtggttgcaggccgccgagcggcgggctgcgcgggtcgccctcgtcgcgcagcatctgcatga

SEQ ID NO: 5200 - DNA, 519 bp, Pseudomonas aeruginosa
actggatcgcctgctcgcgatccagttccgccgccggaggctccgcctcgtacgccggtgctgccgcttgcgatcgcaccggcgccggcggcggcggacggtcgtcgaccgcgggcagtgccgcaagcgtcctggctggcgacggagaagacgaggaagcggccatatcggcaggcgccagcaacacgccggcgcaggtcagggcgatcgccagcccgctgcagccgagggcaacgccgagccagcgcttcacaggccttccaccctggcgccggccagcaggttgcgcaggcgcgtctcgaactgcgctgccagttgctcgcgcgccaccgcctggttcacctcgaagcgcacgctgcggtcgtcgaggggcaactggcgatcctcgcggctacgcacccggacgatctcgaacgcgccgtcgatgcgcatcggctgggaaaccgtatcggccttctggatcagcgcagtcttgcgcagcaggtcgagccggccgtcctggggccgtatcaggcctag

SEQ ID NO: 5201 - DNA, 549 bp, Pseudomonas aeruginosa
ccttgccggcgagttcccgcagcgcatcggactcatggtggaaatcactgtagaggccgatctggtgcagatagcgatggcgcaccagcttgtcccgcaccagggtcctcacgccctgccgctctgccgggccgaagccgtcccgggccaggcggtaccagaggtagtcgcggcggatgcgggtctggacctggcgcgccaggtaagcgaggttgccctgttgcaattccacctggccctggacgttgtcgccttcgtacagcgatagcaggtcgaggacctgtgccggctggccgggaaactgccagccgatcagctcgaccccggccgcctcgcggcgctgcgtctcgtccagcagcaggctgttttccaccaggccacggctcctcggcgccagcacctcgcgcaaacgctccgcgctcagggcccggggctggcgcaggtatggcccgaggtcctcgcggtagcgcctgccgtatacctgttcgagcaggttgccggcctcgatctccacgctggcgtcgagatcggcgcggctctgcgcggtga

SEQ ID NO: 5202 - DNA, 498 bp, Pseudomonas aeruginosa
ggtggaagtagcggtcgcaccattccttgtagcgcgggtagacgtccgcgccgaacggcgcgcaggcgtcgcgagcgacccggtgccaatgcacgcagtcttcctcgtgggcgtagtagggggtcagatcgaagccgccgccgaaccaccagaccggctcctcgccttccttctcggcgcagaagaaacgcacgttggcatgggacgtcggcacgtgggggttttccggatggatcaccagcgacacgccgagcgcctggaaaccgcgcccggccagttccggccgatgggcgctggccgagggcggcaggctatcgccgaagacgtgggaaaaattcaccccgcccttctcgatcaatgcgccgtcgccgattacccgcgtccgtccgccgccaccggccggacgctcccaggcgtcctcggcgaagcgggccttgccgtcctccgcctcgagggcggcgcagatgcggtcttgcaggtcgagcaggtaggttttga

SEQ ID NO: 5203 - DNA, 624 bp, Pseudomonas aeruginosa
tcgagcgcggcgacatccgcatcgagatcaaccagcgcttcgccctggccgaagcagccagggcgcataccgaactggccgcacggcgaaccacgggctcgaccgtactgttgccctgaagcgcgtactcaggccgggcggatgacctgtccggtcaccaggtcgcggatcaggctggggttgcggcgcccgccaagggcgccgccgaggatagcgtccagctcgtcgtggaagtattgctccacccgcagccgcgtgcgcgccgccgggcgcccggccggattggccgaggtggagatcagcggaccggtgagatggcacagttcctgtaccaggggatggtcggtgacccgcacggcgacgctgtcatggacgccggtgacccactccggcagacgctcctggtgcggcaccagccaggtgttcggccccggccaggtaccggccaggcggtccagccagacgtccggcaggtcttcgagaaggaagtcgagctggtggatattcgccgccaccacgatcaggcccttttccaccggccgcgccttcagcgccagcaggcgatacaccgcatcctcgttccacgggtcgcagccgagcccccataccgcctcggtgggatag

SEQ ID NO: 5204 - DNA, 1227 bp, Pseudomonas aeruginosa
gcgatcacgccgccctcgcggacgacccgggcggcgcattgcgcacgaaagctgctgatcatcgactcactccagcggacagggtgcgcgaagtgtacggtttcagccggagcgatgcacccaggtgccggcctcgcaggcgacccggccgtcgagttccagttcgctgagcgtcgccagcacatcgggcagcgtcatgccgctggcggcggccaggccttcgctggtgtagggcgcggcgcgcagcagcgccagcaaagggtggggcaggggctgcgccggcgcttccgctggctccgcctgcgcccagccgcgcagtgcttcgagcacgtgcccgacgctttccaccagcagcgcgccatcgcgaatcagttggtggcagccacgtgcgccgggatggtggatggaacccggaatggcgtacacctcgcgcccctgttccgccgccagccgcgcggtgatcagcgagccgctggcgggacttgcctcgaccaccagcacacccagcgagagtccgctgatgatgcggttgcgccggggaaagtttgccggcagcggcgggctgtccagcggcagctccgaaaccagcgcgccgccaccctcgacgatgcgccgcgccagcgcctcgtggcgccgcggatagagcctgcgcaggccggtgccgaggactgccacggtcgcgccgccagcctccagcgcgccctcgtgggcggcgccatcgatgcccagggccagcccgctggtgatggcgaagccgccctgcgccaggctgcgcgcaaagctccgggcggtgccccagcccggcggggctggcgcggcggctgccgaccatcgccagttgcggccgttccagagtctccggagcgccttcgacgtacagcagcggcggggcatcggcgacttcggcgagcagtgccgggtatcccgggtcgtcccacatcagcaggtgcctgcgcggaccttccagccagcgcagggcttcacccgccgcttcccgcaccgccgggctgcgccgcgcggcggcggcctcggcaggcactcccagggtgcgccaggcgccggctggcgcggcaagcgcggaagaggccgaaccgaaggcctcgatcaagcgcaggaagcgcatgggtcccagttcgggcaggccatgcaggcgcagccgtgcttccagttcggctggagaatggttcttcattgcgactcatccatagcaggcaggtccatcgctga

SEQ ID NO: 5205 - DNA, 579 bp, Pseudomonas aeruginosa
agccgttttcaagctgcgcgccatcttagcagcggattttcaatcgattccacaagtgcatcacaaacgcatatggccatcctgaacattctcgaattccccgatccgcgcctgcggaccatcgccaaaccggtggaggtggtcgacgacgcggtgcgccagctgatcgacgacatgttcgaaaccatgtacgaagccccgggcatcggcctcgccgcgacccaggtgaacgtgcacaagcgcatcgtggtcatggacctcagcgaagacaagtccgagccgagggtattcatcaaccccgagttcgaaccgctgaccgaggatatggaccagtaccaggaaggctgcctgtcggtacccggcttctacgagaacgtggaccgaccgcagaaggtccggatcaaggccctcgaccgcgatggcaaccccttcgaggaagtcgccgaaggcctgctggcggtatgcatccagcacgaatgcgaccacctcaacggcaagctgttcgtcgactacctgtccaccctcaagcgcgaccgcatccgcaagaagctggaaaagcagcatcgacagcaggcgtga

SEQ ID NO: 5206 - DNA, 999 bp, Pseudomonas aeruginosa
  unsure (613): Identity of nucleotide at the above locations are unknown.
ccccatcccccaaaggcttgccccggcaagcctttttcttttagcgagccccgcatgagccaagcattgcgcatcgtcttcgccggaaccccggaattcgccgccgagcatctcaaggccctgctcgacaccccacatcggatcgtcgccgtctacacccagcctgaccggccggccggccgcgggcagaaactgatgcccagcgcggtgaagagcctggccctggagcatggcctgccggtcatgcagccgcagagcctgcgtaatgccgaggcccaggcggagctggcggccctgcgcgcggacctgatggtggtggtcgcctatggcctgatcctgccccaggcggtactcgatatcccgcgcctgggctgcatcaacagccacgcctcgctgctgccgcgctggcgcggcgccgcgccgatccagcgcgcggtggaagccggcgacgcggagagcggcgtcaccgtgatgcagatggaagcagggctcgacaccggcccgatgctgctcaaggtgagcacgccgatttccgccgcggacaccggcggcagcctgcacgaccggctcgccgcgctcggcccgaaagcggtggtcgaagccatcgccggcntggccgccggcaccctgcatggcgagatccaggacgacgccctggccacctacgcgcacaagctgaacaaggacgaggcacgcctcgactggagccgtccggccgtcgaactggagcgccaggtccgcgccttcaccccctggccggtctgccacaccagcctcgccgatgcgccgctgaaagtcctcggcgccagcctggggcagggcagcggggcgcccggaaccatcctcgaggccagccgcgacggcctgctggtcgcctgcggcgaaggcgccctgcgcctgacccgcctgcaattgcctggcggcaagccactggccttcgccgacctctacaacagccgccgcgagcaattcgccgccggccaggtgctcggccaatga

SEQ ID NO: 5207 - DNA, 1401 bp, Pseudomonas aeruginosa
tcgaaacctgacgagccgtgtcctgccatgaaaatcatcatcctcggtgccggccaggtcggcggcacactggccgagcacctggccagcgaagccaacgacatcaccgtggtcgacaccgacggcgaccgcctgcgcgacctcggcgaccgcctcgacatccgcaccgtgcaaggcaaggcctcgttccccacggtgctgcgccaggccggcgccgacgacgccgacatgctggtggcggtgaccaatagcgacgagaccaacatggtcgcctgccaggtcgcctacaccctgttcaacaccccgaccaagatcgcccgcgtccgcgagccggcctacctgacccgtaccgggctgttcgacaacgaggcgatcccggtggacgtgctgatcagcccggagcaggtggtcaccaactacatcaagcgcctgatcgaacaccccggcgcgctgcaagtcatcgacttcgccgagggcaaggcgcagttggtcgggatcaaggcctactacggcggccctctggtagggcaggagctgcgccagctgcgcgagcacatgccgaacgtggatacccgcgtcgccgcgatctaccgccgcaaccggccgatcattccccagggcgacacggtgatcgaggccgacgacgaagtcttcttcatcgccgccaaggcctatatccgcgcggtaatgggcgagatgcgcaggctcgacgacagctacaagcggatcatcatcgccggcggcggcaatgtcggcgagcgcctggccgaggccatcgagagccgctaccaggtaaagatcatcgagcgcagcccgctgcgctgccggcacctctcggataccctggacagcaccatcgtgctcaacggcaacgcttccgaccgcgacctgctgctggaggaaaacatcggcgagaccgacgtgttcctcgccctgaccaacgacgaccaggccaacatcatgtcctcgctgctggccaagcggctcggcgcgagcaaggtgatgaccctgatcaacaaccctgcctatgtcgacctggtgcaaggcggcgagatcgacatcgccatcagcccgcaactggcgaccatcggcaccctgctggcccacgttcgccgcggcgacatcgagagcgtacactcgctgcgccgcggcgcagccgaagcgatcgaagtggtagcccatggcgacgccaagtcgagcaaggtgatcggtcgctcgatcaacgagatcaagctgccgccgggcaccaccatcggcgcgctggtgcgcgacgaggaagtgctgatcgcccatggcgacacccgcatcgagagcggcgaccacgtgctgctgttcctggtcgacaagaaatacatccgcgacgtcgagcgactgttccaggccggcctgacgttcttctga

SEQ ID NO: 5208 - DNA, 588 bp, Pseudomonas aeruginosa
ggcttcggcctacgaacaccaaggggccgcgtgcctccttcgcaacggccgaatccctctgttccgtgcaaagcctggccggagccgggcacaatggccgacatagttggaagagggcaggatgatgatcgaaggtctggaaaagatgctggccaaaggcgtggacaatgcgctgctgcgcttcggcctgggcaagggctacctggacgcgggcgacgccgaacgcgcggcggaacacctccagcgctgcgtagagcaggacccgaagtattccgccggctggaagctgctgggcaaggcacgccaggctgccggcgatctcgcgggcgcccggcaggcctgggagcagggcctggcaactgccgcgacgcatggcgacaagcaggccgaaaaggaaatgacggtgttcctgcgcaagctcgacagggcgagaacctgagcgtccggccaaggcttgcgcagcgcgttctcgccacccgccggccggagttccggcagacgggtcgggcgtgctcatcgagcgctggcagaacggttcgagcacgccccgacgacacttttacaaagacctgttccacacattcgtag

SEQ ID NO: 5209 - DNA, 2067 bp, Pseudomonas aeruginosa
gcgtcgccgaacagcaggacttcatcgacgaactggagtcgaagatccgcctctacgaaaccttccacaacgacgtcgccaactgggtccggttcggcgacgccgacgccggcgacgcgctgtaccgcgtgccgctgtcgacgctgccatgatcctgcgcctgcacgaggtcgcccgcagccacggcgccggtcgccagcgctaccgcctgcgggtgccggcgctggaattgcgcgcgggtcgccagctggccatcgtcggccccagcggctgcggcaagagcaccctgctcgacctgctggcgctggccctggcgccggacccgggcgggcgcttcgaattcctcgccggggaacgcccgcaggacatcgccgcgctctggcgcgacggccgccaggaccgcttggcggcgctgcgccggcagcactgcggctacgtgctgcaaagcggcgggttgctcgaattcctcgatgtgcggcgcaacatcggactgccctgcgcgttgctcggcgccccatccgccgagcgcgtgcaggcgctggccgatcggctggaaatcggcgaccagctggacaagaaaccggcggcgctgtcggtcggccagcgccagcgggtcgccatcgcccgcgccctggcgcatgcgccgcgcctgttgctggccgacgagccgaccgcggcgctcgacccgctgaacgccgaacgggtgatgcgcctgctggtggagcaggcccgcgagcgcggcgcctgcaccgtggtcgccacccacgacgagcgcctggctcgcgcagccggcctggaagtcctggccatccgctggcaacgcgaggccgacgacagcgtcggcgcctgcctcgaggaagttggctgatgcgcgccggcctgctgctctcgctggcctgggccgactatcgcggcgaggcgcgcctgtcgctctgcgcgatcttcgccctggcggcggtgatcaccccgctgctggtgctgttcggcctcaagtacggcctggtcagcaccctcaccgagcggctggagcgcgcgccttctgtgcgcgagatcattccggtcggcggcgcccgctaccgtgccgaggacatcgccgccctggccgcacgcgcggacgtcgccttcgccgtgccgcgcacccggcagatcgccgccaccgccgacctcagcggcggcggcgagaccgccctgagcgtcgagatgattcccagcgccgccggcgacccgctgctggccggcctgccgcaacccgaccggccgacccgcgtggtgctcagccacggcgccgcggaaaaactcggcgcccagcctggcgagcgcatcgtcgcgcgcatcggccggcgcatggatggccaggcacagagccagcgcctggagctggaagtgctcgcggtgctgccgcaggagcgtttcgcccgcgacgcgctgttcgccccgctggccctgctggaagccgccgaggactatcgcgacggtcgcgcggtggccgcctacggctggccggggaaggccggcgagaccccgcgcgcacgcatctacccgggcttccgcctgtacgcccgagacctcgatgcggtggaagggctgcgccggcacttcgtcgcgagtggcgtggaagtcgccacccaggccgaggccatcgcccaggtgcgcagcctcagccgcaacctcggcctggtgttctggatcgtcgccgcgctggccatcggcggtgccttcgccgccatcgccgccagcagcctggccgccgtcgaacgcaagcgccgcgccctggcggtgctgcgtctgctgggcttcccgaccgccgcgctggtcggcttcgtcatgctcctggcgctgttcagcgccgtcttcggcctgttcctcgccgggctgctgtacgccgccacggccggcgcgctgaaccacctgttcgacaaccagagcggcgagttcgtctgccgcctgctgcccagccactacctgacggcgctgctcgccacgctgctgtgcagcgtcctggccgccgccagcggcggctggcgcgcggcgcggatcgaagccgcagagggattacgcgatgtttga

SEQ ID NO: 5210 - DNA, 1167 bp, Pseudomonas aeruginosa
gaaagccattcttccgctcgccctcggcgcctgcctggcatttgccgcgccggcctgggccgaaggcgactcgccggacaatcccaagccgctggccgacgacgtcgccctgccgctgccgtgtggcggcgagatggtcttccggcatgtctacgtactcgccgaaggcgccctcgacgatcgcgaggtcaacctcggctacgccttcaacgaaggcgaggcgggctaccagcagtcgttcatctccggctaccggcgcgactacgtgaacggccagttcagcctcgccgacctggcaccggcctggcagcagaagctctccgccagcctgccgaagcctgccgccggcaccccgctgaagccgatgctgtacttcatcggcaagtacgaggtgaccgcccgccagtacgccgcggtgatgagccaggcggccgcgctctccggccagggcgaggcgccggcctgcgacgtgccggacgggatggccgcgcggctgcccaaggtcaacctctcgcgcttcgacgccgaacgcttcggcgcggtgtacagcgcctggctgctgaagaaccacccggaactgctgccggtcagcggccgcggcaagaatcccgaggacggcggcatcggcttcgtccgcctgcccaccgaggtcgagtgggagttcgccgcgcgcggcggccaggcggtcagccgccaggaactggaaggccggctgttcccgcgcaaggtcgagggcagcgaccaggaaggcccgctgggcgactgggcggtgtacaaccaggtcgccggcggcaccgggcaggccgcgcgactgttgccggtagggatgaagcggccgaacccgctgggcctgttcgacgtgatcggcaatgccgcggagatggtccaggagtccttccaactggtccacgccggtcgccggcagggcacatatggcggtttcgtggtgaagggcgggaactatctcgaaggcgagatgactctattcaccgggatgcgccgcgaatacccgctgttcgccgccgacggcagcgaacagcgcaacgagaccaccggtttccgtgtcgccatcggcgcgctgtccgcgccgcgctcgcgctatcccgagctgttcgcccaatggcagaaggaaggccgactagcggcattgaccgatgccatcgatga

SEQ ID NO: 5211 - DNA, 501 bp, Pseudomonas aeruginosa
cgtttcgttgatcgcccggcagcgcgaagaggccgccggaaacctgatacagtcggcggcactggtcgccgagacgatcaacaactacaacatacgcctgaccaacctcaagaaggacagggagaaagccgtggcagccagggatcaggcgaccgcccagctctatgccggcgccatcgccaacgggcgcagcgccctcgatggcgcattggccatctacatcgacaacctcgccaccggcacccgttacaccgacgcggtgatccaggcgcagttccagcgcatccaggaagaactcaatcgcaacccggttctgggcaagagcctggtcaagcgcgcgaccctgttcgtcaaacacgtcggagattatcgccagcagcaccgggccgagccggaggcggtattgaaggaattgctcgcgtccagcgggcgttgaaggagttccgtccggcccctctcggcagccgggcggttcatcaaaccaggagtgagatgcaatga

SEQ ID NO: 5212 - DNA, 615 bp, Pseudomonas aeruginosa
ccgccagcggcgtgctgctcagcggctgcgccagcagcggcgtcggctcggtcgcccagaccacccgcgcggaatactacccgtcctgctacgagccggtgtcgcacctgcgcagcaccgataacgcagtgcgcaattcggccatcaccggcgccattaccggcggcctcctgggcggcctggccggcggcctggccagcgacgagaaccgcggccgcaatgccgccctcgctgccgcaggcggcgccctggccggcggcgcggcgggctactacatggagaagcagaagcagatcagcgatgaccgcgcgcgcatcggctcctacggtaccgacgtcgaccgcagcaccgtcgagatcaaccgtagcgtggcctacgccaagtcggcgcaaagctgctaccagagccagttcaaggctctgctcgacggtcgcaagaacaagtcgatcaacgaagccgaagggcgcaagcgcctggccgagatcgtcagcggcctgcaggagaccaacgccttgctggtcgccgccaacggccgtgccggcgagaacatcagcaactacacccaggcctacgagaaagacctgcagcaggtcggcgtaccgcgcgccgaggtga

SEQ ID NO: 5213 - DNA, 513 bp, Pseudomonas aeruginosa
cccgaccggcctgaaggtcgagcgttcgccgggacggctgcttccgacgtttccggcttcccggcggcagcggttcttcccgcagggcggataccgccaccggcacgctccgccgctactccgccctatacgaaatgctgcaccgcggggaaaacgctagaacaacgccatctgcgcccccggcacggcgaaccggctgcaatccagcccgaagccctggcggcggtgccagcccgaggcgcttcatcgccaccgcgaaacgatgcgccagcaggtcggcgaacggtccctggccacgaaagcggtggccgaagcggctgtcgtagacctcgccgccacggcattggcggaccaggctcatcacatgctcggcgcgttgcgggtagtgcgccgccagccattcctcgaacagcggggcgacttcgcgcggcaggcgcaggagcatgtacgcggcgctgcgcgcgccggcgtcccgcgccgcctggagcaggcgctccagctccatgtcgttga

SEQ ID NO: 5214 - DNA, 453 bp, Pseudomonas aeruginosa
agttgcacaccaggtaggccaccgggtcgatcagccggccctgggcgtcgcgccggcggtcgcgggcgccgtccatccaggcaccgccgcgcttgttggcgcgggcatagaggtcgaagtagaagcggccgacgtgctcgccgttctcgaggatctcgaacaggcgtacgtcggcgtgccagcgttcgaaatcgtgcagttcgcggatctggatgccgtagaggcgctcgacgatggcgaacaggccggaaagcaccttgtccaccgggaagtaggcacgcagcgcctcctgggacacgctgtagcgcgcctcgcggagtttctcggcgtagtagccggcgtcccagctctgcaattcggtgcagccctgctcggcggcgtaggcgcgcagctgctccaggtcgcgggcggcgaacggcttgctgcgcaccgccaggtcgcggaggaagctga

SEQ ID NO: 5215 - DNA, 801 bp, Pseudomonas aeruginosa
gttcgtccatcgccagcaccaggcccttccaggtcggctgctcgcgctgggtttccagcaggcgggcgatggcggcgcggttatcggcgaggatccgctcgatggccggcttcacgtgttccgggcgaatggaggagaaaggcggcaggtcgtaggcctgcagaaggggattcgcgctcacgttggcaaccttggctaaggaaatacccgaccatcttaaatacaatcggcggcatccgcagcctgaggaaaactatcgtgaccattcgttcctaccagggcaaaacgccactgctcggcgagcgggtcttcgtcgatccctcggccgtgctcgtcggcgacatcgagatcggcgccgacagctcggtctggccgctggtggtgatccgcggcgacatgcaccgcatccgcatcggccagcgcagcagcatccaggacggcagcgtgctgcacatcacccacgccggccccttcaacccggacggttttccgctgagcatcggcgacgaagtgaccgtcgggcacaaggtcctgctgcacggttgcagcatcggcaaccgggtgctggtggggatgggctcgatcgtcatggacggcgcggtgatcgaggaccaagtgatcctcggcgccggcagcctggtgccgccgggcaaggtgctggagagcggcttcctctacgtcggcagcccggcgaagaaggcccgtccgctgagcgacaaggagcgcggcttcttcacctacaccgccggcaactacgtgaagctcaaggacctgcacatcgccgaggactaccatgcgtga

SEQ ID NO: 5216 - DNA, 1674 bp, Pseudomonas aeruginosa
cgccacgctgcgctacccgaacatcctcttcgatctcgacggcaccctcaccgacccacgcgagggcatcacccgctcggtgcagttcgccctcgcccgcctgggcatcgacgagccggacctggcgcgcctggaacacttcatcggccccccgctgttgcagtgcttcatgcagacctacggcttcgacgaagcgcgcgcctgggaggcggtgaaccactaccgcgagcgcttcagggtcaccggtctctacgagaaccgcgtgttcgacggcattcccgagctgctcgaagccctggtcggacgcggccacacgctctacgtcgcgaccagcaagcccggcgtgttcgcccgcgagatcgcccgccacttcgccttcgaccgtcacttcaaggcgatctacggcagcgagctggacggcacgcgcacgcacaaggacgaactgatccgccatctgctcgacagcgaaggcctggcagcggagcattgcctgatgatcggcgaccgcatgcacgacctgctcggcgccagccgcaacggtgtcgcctgcatcggcgtcggctacggcttcggcagcgaagacgaactgcgcgcgcaccagccgacccattactgcgccgacctcgccgccctgcggcaggtattggaatcccactgacccatgctccgtttcagacaaggacgcctgacatgaccgacaatcccttcgccacccccaccgctccggtgcagccgccggccagagaggtgcccgccaccacccagccctatgcgttcatcgcggtgctggcgctggtcacctgcctgtccttcgccgtaagcctgggcatccagtggtacaacgacatcggcgagatccgccagcgtttctccgagcacctgcaactgatggcgccgcactggttcaccggcctggtgttctacgcggcggccaacctgctggtgctgcatgcctaccgcgagaagcggcagctcatcgagttccgcccgctggcgctgctgctgatcggctacggtctgctcaacctggtctgcggcatgctcgccgggatcggcctggcaccgctgacgctgccgttctaccagtgggtgacggcgcaatccagctacggcgtctggctgatggcgttcaacgaagcgatgagctgggtctacctgctcctgggcagcctgctgccgttggggctggtgctgctcggcagccgggtgaactcgccgcgcctggccgaaggggaagaagcccgcgtcgctgcctggcaggtcgccctgggcgccgcgctgtgtttcgccacgctgtgtttcaagctgatgcagttccttccctacgccctgctgcgctacgacgagccttggctatacggcctgtacctgagcggcgtggcgctgcccgcggcgctgctcttcggcgccgtctgcacgcgcctgccggcgcgcctgcaacgcttcgccgccggccgcgcgctgctgctcgcggtggtcgccatgctgctctggagcgtcgcgctgctggcggtcggcggggggctggcgctgctgatgatcctcggcctggcgcccgctggcatcggctatacgctgctggtggcgctgctcggcgtcggcctgttggcgctgctctggccgatcggccggctggccacgcgctggtgctacgccgaccagctcgccgcctga

SEQ ID NO: 5217 - DNA, 528 bp, Pseudomonas aeruginosa
ccggctgcagcgacagctccggggtggcgaacacgttccataccacgtagggccggccgatatcggcgtacaggcgatagctgcggttgtccggcaggccgaggcgttcgctggcgaattgccgggccttttccgccttcgccaggcgttcgcgcaagcgcgcgtcgcgctgcgggtcggcgatcaccgcggcggccggctcgcgggcgcgcagcagggcgaactggccgctggccagttgcccgtagtaggagacggtcgagcaaccgctcagcgccaacagcgccaggcagggaacccaacggggcagtcgaaggtcagcaagcggatggcgaaggcggcgtggcatgggcggaacatagcacagcacgcggaccgcccgccgccctaccagcaccggtccgcgatccggcgaggcggaggaacgcaaggcgtttttccaaggcgcaacggatggcggccgggttaaaggagcttcggagtcttctatgcgtacgctgctgcttgccggtggcctgctcgtcctga

SEQ ID NO: 5218 - DNA, 900 bp, Pseudomonas aeruginosa
gggttgtccttgagcgcgccgctttcggtggaaagggtgcccttgccgtctttcaggccgccttgccagaccgccgatgccgtcttcttcatgtcgactcctccggagctgtggatggacatccgctcgcgtcggcgagcgggcatgtctacatgggaggacgacgcagccggacaagttcagtccgcctgcgcggcggcgggattcaggcgcaaccgtcgatgcggcagagcggcgccgcggccccgcccacggcatcgctgccgccggcaaggcgcagctgcgtttcgagaagagcccgccagtcgtccggctggccgaggtagcgcccggtgtcgagcacctgcaggcggccgtcgcgctccagggcgaaggtcgggaagccagcggcgccgagacggttcatcagccgccgactgtcggcgaagtgcgcgcgcagcggctcgccggagcaggcgtcgaacgcctcggcgaagccctcgccaagccccagttcggcacccagctcgagcagcaccggacgctcggcgatacgccggccctcgacgtagtgggcacgctggatccgcgccagcatcgccgcgccgaggccgtcgagcgcttcggcggcaagcacggcggcggtcggcggggccgagtcgaataccgcgctggtgtcgcgcagcaggccgtcgaagtagtccttgccgaacggctggccggtcagttgggcgatccgcaggtcatggggcatcacgtagtggcgcaggccggcgccgaccggctggcggttggcatcggtcatcatgccgccgccatgcaggcgtacgtccagacccgtcacctcgcaggcggcggcgagcagcggcgaggcgccgtagcaccagccgcagagcggatcgtagaggtaatgcagggtga

SEQ ID NO: 5219 - DNA, 1011 bp, Pseudomonas aeruginosa
ggtcgttcatctcggtctccacgagacgccccgcaggggacgcctcgatcagcggctatcggcgggcgcggctcagggccactgcatctcgcccttgagcaccttggcgctcagctccaggccttcctcgcccggcaggttcgggtagcggcgcttcatcgcctcgaccagcgcggcggaatccctggccttgggcagttcggcttccagggccttcaggtagtcacgggtgaagcgcacgccgtccaggcccttcggctcctcgccggtgaaatggccgggcaccacgcgccgcggttgcagcgcctcgatccggtcgagcatcgccacccaggcctggcgcgaggcctgggtctgggtatcggcggtccagacgtgcgaaccggattccaccagcacgccaccaaccaccgtcttcagcgacggaatccacagcaccgtgcggtccgggctcggccccttcaggtcgaccaccttcagggcatggccttccagcttcaactggtcgcccttcagcggctccggcaccaccagcgacgtcggcgcgttgtccttgaggatcggcccccagtaggccagcttggcgtccttggtcgcctggatgtgtgcgacggtctgcgccgtcgcgaggatcttcgcctcggggaaggcggccttcagcacgtcgaggccgaagtagaagtccgggtcgccgtggctgatgtagatagtgctgagggtcttgccgctggcctggatacgcttgaccagttgctcggcgtcggcgcgggagaactgcgcgtcgatcagcatcgcctcgcgctggcccaccagcagttccgaggacacggcgaagatcgccttctcgccggggttgtagacctccagccgcagcggttcggcgctggcggcgaagacgccggcggcccccagcagggcggcggcggcgaacagggaacgaagcaatccatggcgcgacatgagcggttctccaggcagtgggatcagaggcttgccatgttagttgcttga

SEQ ID NO: 5220 - DNA, 1341 bp, Pseudomonas aeruginosa
tccgtagcggacgcctggtggcgctgctgccggagtggtcgccgcaggtgctcggcatccacgcggtgtacgcctcgcgccggcagatgccgccggcgctgcgggcgctgctggacttcctggtcgaacggatggcggccgatccgcactgggacgaggcgggccccctggcgctggcgtgaaagccgggtagactgctggacgcgccgccttcgacgcacctttatcccctgtctggagcacgtccatgtccctgtcgatctaccaggcttcgatcccgaccttcctgcgcaccctcggcaacctctcggcgatcctgaagaaagccgccgcccacgccgaagcgaagaacatcgatccgcgcatcttcatcgacgcccggctggcgccggacatgttccccctggcgcgccaggtgcagatcgccagcgacgccgccaagggcgccggcgcgcggctggccgggctggaagtgccgagctacgcggatacggaaaccaccttcgacgaactccaggcacgcatcgctcgcaccgtcgagttcctcgagggcatccgcgaggaacaactggacggcgccgaagagcgcaacgtgaccctcaaggtgcgcggccaggagatcagcttcaacggccgcgacttcctcttcggcttcgccctgcccaacttcttcttccacgtcaccaccgcctacgccatcctccgccacaacggcgtcgaactgggcaagatggacttcctcggcggcgcctgaggttcccgcgccgggatggcacgcacaaggaccatggaatggatcggaaaaccctcgacgacaccagcaagttcctcagctatgtccttcgccaccagcccgaggccatcggcctgacgctggacggcgaaggctgggccgacatcgacgccctgatcgccggcgcggcgcgggacggccgcgccctcgaccgcatgctgctcggcgcggtggtcgagaacaacgacaagaagcgcttcgccctctccgccgatggccagcgcatccgcgccgtgcaaggccactcgcatgccgcggtggccatcgcctacgcccccgcggtcccgcccgcagtgctctaccacggcaccgccagccgcttcctcgactccatccgcgagcgcggcctggttcccggcagccgccaccacgtccatctctccgcccgccgcgccaccgccctggaagtcggccgccgctacggcagcccggttctgctggaaatcgacgcgcgcgacatgcatctggccgggcacctattccaccaggcggagaacggcgtctggctgaccgagcgggtacccgtgcggttcatccgcgaggcttga

SEQ ID NO: 5221 - DNA, 264 bp, Pseudomonas aeruginosa
gcctggccgcccacgaacgcctggactggcaggtccatccgatgcccagcgcgctttacgtgctcaagggcgaactgcgcctggagacccgcgacggtgcccagagcacgcgggtgctggaaggcgaaggcggcgggttgcctgatgaacatcatccatcgcctgatagccggggccgaaccggtggaagccctgctgttccatgccggcgtggaaggcatgccggtggggctcggcgaacgcggcgaaatgcccgacgcctga

SEQ ID NO: 5222 - DNA, 567 bp, Pseudomonas aeruginosa
attcgttggacgcaccgcgccggcgcctccaagaatgccgcacgggtgcgaagtccggccgtgcacccaccgacgccccacaacagcaagaacaacgatcggtgcatccatggcaaaggacctgactttcccagacgcctccgcgtcgtcccgcaaccctccctccgcgcgcctccgtctaccggcgacacgcgccccctagcaccgccctcccgtccgccaccgcagcaacccgcgacgcaccttgcgtcggtcccggcccccgccgccggcgggcgccgctcgcccgcgctccgcccgccgcaccgatcgacccatgaaccgaacaagaacaggagtccacccgatgcgctacgcccctcacgcaagccgatactccctcttcgccctggccgtctcggcagccctgctgcccggcgccggctgggccgccaacggcgacctcgccggcgcccgcaagccgcccagcgtcgcctgctcctggaaccgcgaggcagcgttgtcctacgaggagcgccggctcgacacgccgctgccgttcagcggcgccaacgtcgtcacccatga

SEQ ID NO: 5223 - DNA, 1299 bp, Pseudomonas aeruginosa
  unsure (1213): Identity of nucleotide at the above locations are unknown.
ccgcatgctctactggacgcgcctctacatgacccgcaccctgcgccagtgggcgccatccttccacctcggcaaggcccaggcccaggcgctgcaatggcgcttcgaacgcgcctcgcgcggacagctggacatcgacctgccgcgccgctacgccgccgacggctcgcgctaccggcggatgatcatcagcggcttcgacgtcttcaccctgggcactcccgggacggcgaacaccggcctgcgcaacggcaacccctcgggcgccaccgcccttgcgctggacggccgcgagttcaggctggccgacggcagcctgctgcgtatcgaggcctacctgttgccggtcagctacgacccgttcaaccgcggcatgcaggaagacaccctgggcccctggttccgccccggcccgcgccgggtcgacgcctccatcaccatcagccagggcggcgccaaccagttctggctggaggcctggaacggccgcttccacggctcctccgccggcaacgacggcatcgtctactgccccgccgacagcgctttgcccaactacgtgcttcccctgggcagcgtgaccaatcccggcaccgcgccgatttccctgcggggctccggctgcaatatcaacccgccgcgccgctggctcggctacgacagcgccagccgctggcggcagaacctgccagcacagttctccaaggcctcgctgccggtccgccagttgctcgccgccgatacctggcgcggcatcgagcggccgccgggcgctaccagccaggccgcggaaggcttcgacgtcacctggcacaccaactacgacttcttccccgattgcgccaacccgcgcaccgaaaacgtgccgaccaacggggtgatgaacgccatgcccgatccctccctggtgctcccgccgaaccgacggatctgcgcgcgcaacggcggtggcggcgactacctgtccaacgagagcgcctaccgcaacacggtgctgcgcgacgcgttccgcctggagattcccgccgggcacatccatgtcccggtgatgaacaactactacaccggcgtaccggcgagcggcggcggcgcgcgcaacgacaacgccatcagcgacgcccgctacgaggcctaccgcagcgccatcgtggcgcagacccgggcgctgctggtgggcgtcggcaacgccctggcgcagggggcgcaagcggantagtcctcgccaggcgcaaggccctcgcgtcctatcgcttcgccgcggagccaaactgccgccgacgtaggccaacgggacggtag

SEQ ID NO: 5224 - DNA, 399 bp, Pseudomonas aeruginosa
cttggagagttttccatgagcttcgcgcagaatctcctacgcctacgccagcagaacgccctgacccaacggcagatggccgagcgattgggcgtcaccgtgagccagttgcggcacttcgaaaccaagggcgggcacccgtcgctggtggtgctgcaaaccatcgccggacgtttcgcggtgcccctcgactggctggtctgcgagcgcagcgagcggcaggcactaccggaagacctgcgcctgcagttcgaggccatcggccgcctgcggctggacgagcggcgcgccatccgggcgttgctcgacgacctgatccgccagtacatggccaagcgcaacgcagcggccaagcccctcccggcggcttgcaccgaggccacggagacgtccccgtag

SEQ ID NO: 5225 - DNA, 525 bp, Pseudomonas aeruginosa
catcaatcccggatctgccgaacagggtggttatcgtgccctggcccgcgaagctcctggcaacgctggggtcccgggaggtggagagatagccggcgtcgtggccgacctggccctctttcaccgcctcgaaggcatccctgccctgggtgccgcggaaggtcttcacgacctgttcagccggtccgctcttttcgaacgcggcagacatgccctggtcgatcaacgcctggcccgcatccagctctcgcccctgacgcagggaacgattcaggtgctggtactcgccgttggtatagagaccgagcgccatcacctcggcatcgctgtacggcccgtccgggtgttcgcctaggtactgctccgcctccagcccgaagtgctccaccaggccatccgccagcgccttgtcgacaggctcgccctttacctcgctctctaccgcgtggcgcaacagggcgaccttgtccattaccgcatgcagttggacggcgatttcgcgcagttgctccgggcttgcgctga

SEQ ID NO: 5226 - DNA, 231 bp, Pseudomonas aeruginosa
agaaagcatatgagcaagctgctcaaaaatttcatcttctacatcctcactacacccggaaaaaatgtcataaatatgagtatgattaacaaatctctctacagactggatatcatcttcgaatcttgccatccagccattaaacttttctgcctcatagttcatctccagtattaccgcccccctatccaagataaaatcaggaaaaaccaatttccccaagatcaataa

SEQ ID NO: 5227 - DNA, 4953 bp, Pseudomonas aeruginosa
aggccgccaccctggttgtcgaagtcggcggtgacgatgcggttgtcgccgcccagcgccgagagatggccctgctggttgcgcacgccttgcccggcgcgaatctccagcgactgcgcctgggtgacgccggcgctgttgtcgaacagcccggtgaccagcgtcagccaacccttggcgctgttgagcacgccgccggcgccgttgtcgaggctgccgctctgcaggtcgaggttgccggcccggctgtccaggcggccgccctggttgtccagcgcgccaccgatacgcagccggttgtcgccctgggcctggagcgtgccctggcggttgtccaggctgccggcctgcacctcgagggcgccggcctggctgaagatcaggccgtcctgctggttgcgcagggcgccgccgcccaggcgcaggctcatgtcggcctggctggcgagggtgccggaggcgctgttgtcgaggctgccggtggtgatctccagcagcccctggctgaccagcttgccgccgcggttgtcgacgctggcgctgcgcagcagcaggtcgccgccgctggccaggcgcgccgcgccggcgttgaccagggcgccgccgaggatggcgtcgagccggccctggctgatcaactggccgtcgctgttatccaggctggcgcccttgagcagcaggctgccgccgttgatccggccgccggcgttgttcagcagcgtatcgtcgcgctcgaagctcagcgcgcgctgcgccgagaccaggccgccctggccgttgtccagcttcccggcgatgctcagggtcacgtcgctttcgccggagacgatgccctgggcgttatcccaggctggcggcgtccatccgttgcgcgcccttgctgacccaggcgccctggccgtggttgtccagcgcgccgccgagggtgatggccagctcgccgtcccttgctcgaaagggtgccgccggcgctgttgtccaggctcccgcctggtcaccgtcaggccctggccatccggagagcaggccggcgccggcgttgcccagcgcgtcggcgtccaggcgcagtttcccggcgctgatgatgcgcccctgctggccgttgtcgatgcgcctggccagcagctcgaagccctgctggctggaaatctcgccgccctggcggttgtcgaggacgttcagccgctcgatgctcagcgggccgcgagcactgatcaggccaccctggttgtccaggtcgccgccccgcaggtcgagactgacgccgcgctcgccgaccagccggccctggcgttgcaccaggcgctcgaccgtcaggcgcaggtcgccccgggcggagatttcgccgccgtcggcggagtcgacgcgccctgccgtcagttccagttcgccgtcgctggtcagcaggccgccacggttgtccaggttggcggcgctcaggcgcagcgactgcttgccactgagggcgccgccacggttgtcgaggtcggcgctgctgacgtccagcacgccctggctgatcaactggccaccctcggcgttgtccagcgcgccagtggcgacgctcaggccggcgttgccggagagcaggcccttgccgctgttgtccagggaggcgctggcgagcgtcaggcgggcgccggaaacggtgccttcggcgtggttgtccagcgcgccgtcgacgcgcaggtcgatgccggcgcggctggccagggtgcccttggcgctgttgtccaggcgagcggccgcgatgtccaggccggcggcgccggagatcaccccggccaggctgttgtccagggcctgggcgatgcgcagggtcaggctggcggcgccgatcaggcgcccgccgcggttgtccaggctggcggcggcgagggtgaaggcgcggtcgctggagatttccccgccggcgccgttgtccaccgcgccgagctggcgcagcagcagcgcgccgggcgtggcgatcaggccgccgtcgcggttgaccagcgtgccgccattgaggtcgagggtgacgccggtttcgctgaccaggacgccgcctccgcgctggtcgaggcctttcaggttggcgtcgagcaggcccttggcgctgacccgtccctgctggccgttgtccagccgggcggccaccagggtgatgccggcgttgctgccgatgccgccgttgcggctgttgtccagcacgccggtgcggatatccaccgcacccttggcgctgatcacgccggaacggctgttgtcgaggctggcgccctgcagcgtcacgccggcatcgctgagcagcctgccgccctggttgtccagcgcggcctggctggtcagcgccagcgcaccggcgctggagaaggtcccgccacggttgtccaggcgcgcggcgcgcgccgtcaggctgccttcgctgaccagcgcgccgccctggttgtccagcacgccgccgaggctcacgctcaggctgttctggctgtcgagccgaccgccgtcgccgttgaacagttcgccgccgtccaggctcaggccgtcgcgcccggccagcacccccttggcctggttcagcaggcgctgcacggtgaggcgcaggccgctgtcgccgatgaccttgccgccgcggttgtccagttgctcgcgggcgttcacggcgaccttcgaggtgctggaaatctcgccggcgcggttgtcgacctgccgcgcctcgatagcgatgccgccattcgcggcgatcagccaggactggctgttgtcgatcgtgtcggccgcgaccttcagggtcttttcgctgaccagttcgccaccttgctgggccaggctgccaagcgtcgcctgcaggtcgcccttggcggcgatacgccctccggcgttgccgacggcgttcgctgcgaggtccaggcggccatcgctgaacagcttgccaccctggtcgttgcgcaggctggcgacctccacgcgcacgccagccttgccgctggcgctgccgccgtcgcggttgtcgaaggcgcctcccgtggcgctcaagccggcgtcggccaccagcacgccgccacggttgtccaggctggcgccgtggacgttcaactcgctgcggctcgacagcaggccgccggcgcggttgtccagttgccccaccgtcacgcgctgcgcgccctggctgagcaggttgccttcatcgcggttgtccagcaggccgccgaggctgacctccaggccgccccggctgctcagcgtgcccttgccgctgttgtccaggctgcgcgcccgcaggtcgaggcggttggctgcggagaacaagccgaggcggttgtcgatggcaccgctggcgaccaccagcaggtcgtcgccgatcagcttgccgccgcgattgtcgaggctaccgacgcgggcctcgacgcgcttgccggagacttcgccgtccccccggttgaccagcgcctgggcgctgacgcgggtggactgctggctgccgagcaggccttgctggccgttgtcgagcgtcgccgcgccgacctccaggtcgttcaggccgatcacctggccgccacggttgtcgagatcgccacgggtcttgaccacggcgcggtcccggctctgcaacaggccgtcctggcggttgtccaggctgctcgcctcgacccgcagttcgccctcggcgagcagcttgccgccacggttgtccaggtgtccgccgtcgacccggacggtcgcccccttcaggctgccgccctggttgtccagcgcctggctcgccttcgcttccagcgcgcggctggccaccaggctgccggcgttgcgcagggtgccgctgcgcagctcgaggtcgccgcgggcgttgcgccgctcgtccggctcgacgccggcttcgatcaccccggcgttgtcgaggcgcgcggcgtccagcgcgatgcgttcgcgcgccgccaggctctgccggttgaccagttcctccgcgctgcggatctcggcgctgccaccggcgtaggtcttgccgttcagctccacggcctgggccgcgatcttcaggtcgccctggctggaggcctgggccaggctcagcttgccgctggcgtcgatgcggatgtcgccgccgctggcggccatgtcgccggccagccgcacccccacgccctgctcggtgccgaccaggcggatcgccccggcgtacatcccgcccagcgccgagctgtcgatcgccagctgtggcttctcgctgccatcggcggcgcgcggcgtggcctgcaggctgtcggcctggacgtcgttgcggccggtgacgatgttgaggttcttcgcgtagagcttggcgttgagcttggcgctgcgggtgatcaggtcgaactgttcgaggttgccgacgttcagttcggcgccttcgacgacgatgtcgccgccgtccacctggaagcgctccaggcgctggccgtccatgatcggcttgccggtggtgagggtcgcgcgcggcgtgttgatgaagccgcagccctggcaggtgatgccgtgcgggttggcgacgatcacccgcgccgactgcccggccacctcggtgtagccggccagggtgctgcggttgccgccggtgacctggttgaggatcacctgcgccgcctggcccttgaggttggggttgccgaggatgatcccgccgagctgggtaccctgggtcttgccggtggcgttgttgaggatcagcccgttggcgccgacgttgtagtcgcggaaatggttgttcgacagcccggcgccgttgggcgtggcgatattgacgatgggcacgccgttgcccgcctggcccaggccggtgttgccgccggcggccttgtccagcgccagccccgccgccgcggcgacgatcgggttgaggaacaggatgccggccagggacagggcgatgcactggttcagcgggctgcggatgtccatatcgttactccttggcgggtaggggcccggcgaggttaa

SEQ ID NO: 5228 - DNA, 306 bp, Pseudomonas aeruginosa
acggcggggttcccggcgtgctgcacggcaaccgcaccttcctgctgcaggacgcggatggccagatcatcgacgcacactccatctccgccggcctcgactatcccggcatcggcccggaacacgcctggctgcacgacaccggccgcgtcgagtacacctcgatcaccgacgacgaagccctggaggccttccacacctgctgccgcctcgaaggcatcatcccggcgctggaaagctcccatgccctggccgaggtcttcaagcgtgcgcccagcctgcccaaggagcacatcatggtggtga

SEQ ID NO: 5229 - DNA, 687 bp, Pseudomonas aeruginosa
gacgcccctggtgctgatgggctacttcaacccgatccaccactacggcgtcgaacgcttcatcgccgaggcgaaggaggtgggggtggacggcctgatcgtggtcgacctgccgccggagcacaacgaagacctctgccacccggcccaggccgccggcctcgacttcatccgcctgaccaccccgaccaccggcgaccagcgcctgccgacggtgctcgaaggcagttccgggttcgtctactacgtgtcggtggccggcgtcaccggcgccaacgcggcgaccctggagcacgtcgaggaagcagtggcgcgcctgcgccggcataccgacctgccgatcggtatcggcttcggcatccgcagcgccgaacacgccgccgcggtcgcgcggttggccgacggcgtggtggtcggctcggcgctgatcgaccggatcgccaaggcccgcgacaatgcccaggcggtcaaggatgtcctcgccctgtgcggcgagctggccgaaggcgtgcgcaacgcacgctgacagaccctgacagcggcattctccaggcgcaggcaacccgctgcgcctggccttgcgttgcacgctgccagaaccgtgaggaaaaattcacggtcactttcagaaacgttttattgtccgccgactctgccgaagccttgaatagcgcctcacccaaatag

SEQ ID NO: 5230 - DNA, 648 bp, Pseudomonas aeruginosa
ccaacgcattcaaagaaggttcgcatgagtaaggtgctgatcgtcgatgatcatcccgctatccgcctggccgtgcgcttgctgttcgagcgcgacggtttcaccatcgtcggcgaggccgacaacggtgccgaagccctgcaggtagcccgcaagaagtctcccgacctggccatcctggacatcggcatccccaagatcgacggtctcgaagtgatagcccgcctgaagtccctgaagctggacaccaaggtcctggtcctgacccggcagaatccggcgcagttcgccccgcgctgcctgcaggccggcgccatgggcttcgtcagcaaaagggaaaacctctccgagctgctgctcgccgccaaggccgtgctggccggctacatccacttccccaccggggcgttgcgcagcatcaaccagcagagccgcgacaacgaggcccgcatgctggaaagcctttccgaccgcgagatgaccgtgctgcagtacctggccaacggcaacaccaacaaggccatcgcccagcagctgttcctcagcgagaaaaccgtgagcacctacaagtcacgcatcatgctgaaactcaacgcccattccctggccggcctgatcgatttcgcccgccgccacgagctgatctga

SEQ ID NO: 5231 - DNA, 981 bp, Pseudomonas aeruginosa
ggatcccatgcgaacgttcgacctgaccgccgccctgggcgaccgcgccaaccaaccggagatcagccgcctgctcgtcgcgcagctgatgaccagcaacaacgaagacacccgcaagctgcgacgcgcccaggagcgcgagcagacccaggaactcaacgagctggcgcaccgcctggcgggcatggcctcgctgatccacgcccacgccgtggaacgcgcctgccaccaactggagatcgcctgcggcgaaagctccgtgcgcaagctcgccgatgccgtcgacgacctggtgacggcactgggcgagctgcaatgcgaactgcacgactggatgacgatgaccgcgcctcaaggcacggcgaagtcatagcgttgcgggccttcgtccaggatcgacaggtccagcgggcgaatggctcccatccagatggctcggtcgcgatggtcgagcagatcgttgccggtaaccgggtggatgaacaccaccaggtcctgccgatggatggccagccagggcaccagctcgccgaacacctcgggagcgaacgccagctggcagctccagtccggatgcggccctaccggccgctcatggacccgccccatcttcagcggaaagcgccgcgccgcttcttcgcaaagggcgcgggctcgctcgatgctctgcgcatcgaaatagacgtgagcatggaagccctggatgcggggggtggaatactcgttcatcgtcacctcttcaagcgccgccggcctgcaactcggcctgcagccagtcgacgaaaccgtcgaccagccgctggcgccgcttgcgctccggcaataccgcatagtacccgtatcgcgacaggcagctctcgccaatgggccggcaaagcagcccctgttcgagcaggccgtcgaccaggtggcgccagccgatggccacgccctggccggcgatggccgcctggatcagcaaggtgtagttgtcgaagctga

SEQ ID NO: 5232 - DNA, 483 bp, Pseudomonas aeruginosa
gcaccgccggaatcggctgccgatcgatggccaacgcttcgaacaacgccggccagtcgaaccagcgggcgtgctgcgccggcttcagatgcagcatcggcaggcgcgccaggtgcgccttggccagcggcaactgcaatccctcgaccagccgcgggctacagaccgggaacacctcctcgcgaaacagccggtgcgcttcgccgtgcttggaacgaccgtcgccgaacaggatcgccacgtcgatatcgccgcgctggccggccaggccgcgctcgctggtcaccaggctcacgtccaggtgcggatgggcctgatggaagcgcggaaggcgcggcatcagccagtaggcagcgaaggcgtagtcggtggccacctggagcacctcgtggcgctggcgcgcgcccagcgcggcgatgccggcatcgatcgtctcgaggccggcggccacgtggcggagcagaagctggccggcgtcggtga

SEQ ID NO: 5233 - DNA, 417 bp, Pseudomonas aeruginosa
cgatgtgatcggcgaatacaccgccgagggcaccctcagcccgctgatgatgatccgccgcggcgactacaagttcatctactccgagcaggacccctgcctgctctacgacctgcgcaacgacccgcaggagcgcgagaacctcgccgccagtccggcccatcgcggaacgttcgaggcgttcctcgacgaggcccggcgacgctgggacatccccgcgatcacccgcgccgtactcgacagccagcgccgccgacgcctggtggccgccgcgctggcgcgaggacggctggccagctgggaccaccagccgtgggtcgatgcaagccagcagtacatgcgcaaccatatcgacctggacgatctcgagcgccgcgcgcgcttcccgcaaccctgagcacgagggcacttccatga

SEQ ID NO: 5234 - DNA, 1608 bp, Pseudomonas aeruginosa
ccagccgcgacggcggcgacgccctggccgcggttcgcggccagccatagcgccatgtggacgcgcttgctgccgttcctcgcctggctaccggggctgcaccggggcatgctcgggcgcgaggcttgggtcggcctgaatggcgcaatcctggcactgccgcaatcgatggcctatgcgctgatcgccggcctgccagcggagtacggcctgtacgcggcgatgctgccagtggcgatcgcctgcctgtggggctcgtcgcgctacctggtgagcggtcccaccgcggcgatctcggtgctgctgttcagttcggtggccccgctggcgccgctgggcagcccgcaatacgtccaggccgtgctgctgctgacctttctcgccggcgccttccagtggctgctcggcgtcctgcgcgtcgggtcgctggtcaatttcgtctcgcattcggtgatgctcggcttcacccttggcgcggcgctgctgatcgtcctcggccaactgccctatcttctcggcctggccgcgagcggggagggcgcagcgccgggaaacggctggcggctgctggcgcggttcgccgagttcgatggcccatcgctgctggtgggcggcttcagcttcgcgctcagcctgctggtcaggcgcctgcgaccgcgctggccggccctgctgcttggcttgctgggcggtgccacgctggtctgggcgctacccgggaccttcgcctcggtagcccatgtgcaggccttatcgagcgcactgccgggctggaatccgctggtcttcgattcccgatcgatcctcgacctgctacctgcggcggtggcctgcggcatgctcgggctggtcaccagcctgtcgatcgcccgcgccctggccgcgcgccagggagacgcgttcgatgccaaccaggaggtccgcgcccagggcctgtcgaacctgctcgggccttggctgtcggcgagcctgtcggcgggctccttcacccgctccgggctgaatctggaagccggtgcgcgctccccgctggcgggtgcgttttcggcgctctgggtggcactgctggccgtgctcggtgcgcgcctgatcgagcatgtaccgttgccggcgatggccgcaggcatcctgctgatcgcctggggcctgatcgaccgcccgacgctccgcgcgctctaccgcagcggccgcgccgaatgcctggtggccggcctaaccgccctggccacgctgctgttgccgctgcagaacgccatctacgcgggagtgctggcgtcgctggtcttctacctgcggcgcacctcgacaccacgcgtactgcgccagcgcaacgacgaggaagaagtgctgcgcatcgaaggctcgatcttcttcggcgcctgcgactacctgcaacgcctcatgcgccaatgcgacaggccacggctggtgctggacgcccgccaggtgaacttcatcgacttcgccggcgcagtgctgttgcagcaggaagcccgccgcctgcacgccgagggccgccgcctggtattgcgccacgcccgcccgcaggtccgcgaagcgctgggccggcaggccgacgaaggctgccgcctgcactacgaaggctga

SEQ ID NO: 5235 - DNA, 1968 bp, Pseudomonas aeruginosa
cccggttttgtgattcctacatgtcagatggaagccaatttgagacgtacgtctcaaatgccgcctgacaactcagacagttgccaactgtcggcgcagcgtctccaacactggcgccgaggcaggacgcacgccgcgccagaggaagaatgcctcggcggcctgctccaccagcatgcccaggccatccagggtacgcgccgcaccgcgttcggcggcccagcggttgaaggcagtcggttccttggcatacatcatgtcgtagcagacggtacggccgggctcgatcacgctctgcgccagcggcggcacgtcgccggcaagactggccgaggtgccgttgacgatcaggtcgaaaggcccttcgacctcggcgaaaccgcagccgtgcaccgcgccgaggtcggcgaaccgctcggccaggtccacggccttccgcgccgtgcggttggcgatcagcaactccgccgggcactcgccgaggaagggttcgagcaccccacgcaccgcaccgccggcgccgagcaggagaacccgcttgccgcgcagctcgaccccggcgttcgccgtcaggtcccgcagcaggccggcgccgtcggtgttgtcgccgcgcaggcgaccgtcggcgaggcggatcagggtgttcaccgccccggcccgggtggcccgctcgctcaactcgtccaccaggcgataggcctcttccttgaacggcacggtgacattggcgcccttgccctgctcgaagaagcgccgggcgaacccggggaaatcgtccagcggcgccagttgcgcgtcatagaccagcgcctcgccggtctgctcggcgaacaggcggtggatcagcggcgacttgctgtggccgatggggttgccgaatacgcaatagcggtccatgggtcgttcctttgccggagtgggacgggacgagcggactcgtcccctgcgggcgggtcagggctggccggcgagccaatcgcggtcggcgaggaaatactcggtcaggcgcgcttcctcgctgcccggctcgggtttccagtcatagccccagcgcacctgcggcggcaacgacatcaggatcgattcggtacggccgccggactgcaggccgaacagggtgccacgatcgaagaccaggttgaactccacatagcgaccgcgacgataggcctggaactctcgctgccgttcatcgaacggcgtgtgcttgcggcgctggacgatcggcaggtaggcgtcgatataggcatcgccgatggcgcggatgaaggcgaagcaggtgtcgaagtcccactggttgaggtcgtcgaagaacaggccgccgatgccgcgcggctcgttgcggtgcttgaggtggaagtagcggtcgcaccattccttgtagcgcgggtagacgtccgcgccgaacggcgcgcaggcgtcgcgagcgacccggtgccaatgcacgcagtcttcctcgtgggcgtagtagggggtcagatcgaagccgccgccgaaccaccagaccggctcctcgccttccttctcggcgcagaagaaacgcacgttggcatgggacgtcggcacgtgggggttttccggatggatcaccagcgacacgccgagcgcctggaaaccgcgcccggccagttccggccgatgggcgctggccgagggcggcaggctatcgccgaagacgtgggaaaaattcaccccgcccttctcgatcaatgcgccgtcgccgattacccgcgtccgtccgccgccaccggccggacgctcccaggcgtcctcggcgaagcgggccttgccgtcctccgcctcgagggcggcgcagatgcggtcttgcaggtcgagcaggtaggttttgacagcggcgatacggtcggtcacggagttcaccttggagcggggaggccgcgcggggcgcgggctggcgacgaaacgagggcgcaagcataccaccctggatgggtagccggcgcttga

SEQ ID NO: 5236 - DNA, 411 bp, Pseudomonas aeruginosa
ggcgcggcgcgcagcagcgccagcaaagggtggggcaggggctgcgccggcgcttccgctggctccgcctgcgcccagccgcgcagtgcttcgagcacgtgcccgacgctttccaccagcagcgcgccatcgcgaatcagttggtggcagccacgtgcgccgggatggtggatggaacccggaatggcgtacacctcgcgcccctgttccgccgccagccgcgcggtgatcagcgagccgctggcgggacttgcctcgaccaccagcacacccagcgagagtccgctgatgatgcggttgcgccggggaaagtttgccggcagcggcgggctgtccagcggcagctccgaaaccagcgcgccgccaccctcgacgatgcgccgcgccagcgcctcgtggcgccgcggatag

SEQ ID NO: 5237 - DNA, 1152 bp, Pseudomonas aeruginosa
cccgcctgcaattgcctggcggcaagccactggccttcgccgacctctacaacagccgccgcgagcaattcgccgccggccaggtgctcggccaatgaacccgcgtctcgccgcctgccaggcgctggccgcggtgctcgccggacgcgcctcgctgtctggcgcgttgccgccgcaactggacaaggtcgccccgcgcgatcgcggcctgacccaggagctggccttcggcgcggcgcgctggcaaccgcgcctgcaggccctggccgcgcgcctgttgcagaagccgttcaaggccgccgacaccgatatccacgccctgctgctgatcggcctctaccagttgctctacacgcggattccgccgcacgccgcgatcggcgagaccgtcggctgcgccgacaagctgaagaagggctgggccaagggcgtgctcaacgccgtgctgcgccgcgcgcagcgcgaaggcgagacgctgctggccgaggtcgaccgcgatccctcagcgcgcctgggccatccgcgctggctgctgaaagcgctcaagcaggcctggccggagcagctcgacgcgctctgcgcagcgaacaacgcacacccgccgatgaccttgcgggtcaatcggcgccacggcgagcgcgatgcctacctggccgaactcgccgaagccggaatcaaggcccgcgcctgcgactacagccgcgacggcatccagctcgccgcgccgcgcgacgtgcgcgaactaccgggcttcgcggagggtcgcgtcagcgtccaggacgaagccgcgcaactggccgccgagcagctcgaaagcgcgcccggccagcgtgtcctcgacgcctgctgtgcgcctggcggcaagacctgccacctgctggaaacccagccggaactggccgaagtggtcgccgtcgacctcgaggagagccgcctggtaagggtccgggaaaacctccagcggctcggcctgcaagccagcctggtcgccgccgacgccagggccaccggggagtggtgggacggcaagccgttccagcgcatcctcctcgacgcgccgtgctcggccaccggggtgatccgccgccacccggacatcaagctggcgcgcaagccggaagacatcgccgccctggcgcacctgcagggtga

SEQ ID NO: 5238 - DNA, 333 bp, Pseudomonas aeruginosa
ttggaagagggcaggatgatgatcgaaggtctggaaaagatgctggccaaaggcgtggacaatgcgctgctgcgcttcggcctgggcaagggctacctggacgcgggcgacgccgaacgcgcggcggaacacctccagcgctgcgtagagcaggacccgaagtattccgccggctggaagctgctgggcaaggcacgccaggctgccggcgatctcgcgggcgcccggcaggcctgggagcagggcctggcaactgccgcgacgcatggcgacaagcaggccgaaaaggaaatgacggtgttcctgcgcaagctcgacagggcgagaacctga

SEQ ID NO: 5239 - DNA, 1344 bp, Pseudomonas aeruginosa
cgccgaggctggcggcccgccccgggccggcgcggtgccggccttctcggtgctctacgtgtacgcccgcaagcaggtcggcggcagcccctggctgcgcgtcggcgcctccagcaacggcgagggcgacggctggctgccggccagcgcggtgagcgactggaagcagagcctggtgctgaagttcaccgaacgctccggccgcgcgccggtgatgttcctcaacagcgccgagcaggtcgagcgcctgctcggcgatacccgcgcagcgcgcgacaccctgacccaggcggtggaccacaagggcgatccgcaggtggtcgcggtcgagcccaacgaccgggcgatcccccaggaccagttctacctgctgccgatcttcgactcgaaggaaagcttcgacgccgacggccagccggcgcagttgctggaggtcgcctcgatcgaccccggcggcagcgccgcggcaccccaggcgccgggccaggccgggcatggcggcgccagcggcgcggcgagcgacaccttccgcaccggcatcgtcctggtggtggacacctcggtgtcgatgcagccctacatcgaccgcgtgcgcgaggtgatcgacggcctgcagcggcagatcggcgagcgcggcgacctggacaaggtcagcttcggcctggtcggtttccgcaacaacaccgacaagacccccggcctggaatacgtcagcaagaccctggtgccgctgcaaccgggcaacgacgcgcagcgcttcgccgagttgagcagccaggtgcgcgccaccgacgtctccagccactcgttcaacgaagacgccttcgccgggatcatgcaggcggtcgacgaaatggactggtcgccctacgccgggcgcgtggtgctgctggtcaccgacgccggcgcgctgcgcaagaacgacccgctcgggcgcacccagatgaacgaggccgaggtccgccaggcggcgctgcgcaagggcgtgaagatctatgccctgcacctgcgcaccccggccgggaagaacaaccacggctacgccgagcagcagtaccgcagcctcaccgccgacgccaacccgaagatcgccgacctctacatcccggtggccggcggcgaggtgaacgccttcggcaacacggtgaaggagatcggcacggtgttcgccgacctggtccacgacgccggcaaccgcaagccgcaggcgccgcgcttcgacgccgcgccaagcgtggcgagcaagtcgtcggccatcggctacgccatgcagatggaattcctcggtcgccgcgacccggtgcgcgcgccgcaggtcgtcaccgcctggaccgccgaccgtga

SEQ ID NO: 5240 - DNA, 1164 bp, Pseudomonas aeruginosa
cctgaccaacccggcgctgccggcgttccaggtttgcgtgctgctgagcaagctgcaactcaacgaactgcaacagtcgctgaaactgatcgtcgacgcggccaagcgcacccagacctcgcccaaggacttcttccaggaaatcgccagcgccagcgcctacatgagccgcgacccggcgcaactggtgaagggcagcaacctggcgcagagcggcgtgctcggcgaatacctggaaggcctgccgtaccgcagcaagtcgctgaacatgacccaggacctctggctgtcgctgagcgtcgccgaacagcaggacttcatcgacgaactggagtcgaagatccgcctctacgaaaccttccacaacgacgtcgccaactgggtccggttcggcgacgccgacgccggcgacgcgctgtaccgcgtgccgctgtcgacgctgccatgatcctgcgcctgcacgaggtcgcccgcagccacggcgccggtcgccagcgctaccgcctgcgggtgccggcgctggaattgcgcgcgggtcgccagctggccatcgtcggccccagcggctgcggcaagagcaccctgctcgacctgctggcgctggccctggcgccggacccgggcgggcgcttcgaattcctcgccggggaacgcccgcaggacatcgccgcgctctggcgcgacggccgccaggaccgcttggcggcgctgcgccggcagcactgcggctacgtgctgcaaagcggcgggttgctcgaattcctcgatgtgcggcgcaacatcggactgccctgcgcgttgctcggcgccccatccgccgagcgcgtgcaggcgctggccgatcggctggaaatcggcgaccagctggacaagaaaccggcggcgctgtcggtcggccagcgccagcgggtcgccatcgcccgcgccctggcgcatgcgccgcgcctgttgctggccgacgagccgaccgcggcgctcgacccgctgaacgccgaacgggtgatgcgcctgctggtggagcaggcccgcgagcgcggcgcctgcaccgtggtcgccacccacgacgagcgcctggctcgcgcagccggcctggaagtcctggccatccgctggcaacgcgaggccgacgacagcgtcggcgcctgcctcgaggaagttggctga

SEQ ID NO: 5241 - DNA, 699 bp, Pseudomonas aeruginosa
ttcccagcgccgccggcgacccgctgctggccggcctgccgcaacccgaccggccgacccgcgtggtgctcagccacggcgccgcggaaaaactcggcgcccagcctggcgagcgcatcgtcgcgcgcatcggccggcgcatggatggccaggcacagagccagcgcctggagctggaagtgctcgcggtgctgccgcaggagcgtttcgcccgcgacgcgctgttcgccccgctggccctgctggaagccgccgaggactatcgcgacggtcgcgcggtggccgcctacggctggccggggaaggccggcgagaccccgcgcgcacgcatctacccgggcttccgcctgtacgcccgagacctcgatgcggtggaagggctgcgccggcacttcgtcgcgagtggcgtggaagtcgccacccaggccgaggccatcgcccaggtgcgcagcctcagccgcaacctcggcctggtgttctggatcgtcgccgcgctggccatcggcggtgccttcgccgccatcgccgccagcagcctggccgccgtcgaacgcaagcgccgcgccctggcggtgctgcgtctgctgggcttcccgaccgccgcgctggtcggcttcgtcatgctcctggcgctgttcagcgccgtcttcggcctgttcctcgccgggctgctgtacgccgccacggccggcgcgctga

SEQ ID NO: 5242 - DNA, 1806 bp, Pseudomonas aeruginosa
cggcgctgctcgccacgctgctgtgcagcgtcctggccgccgccagcggcggctggcgcgcggcgcggatcgaagccgcagagggattacgcgatgtttgagaaagccattcttccgctcgccctcggcgcctgcctggcatttgccgcgccggcctgggccgaaggcgactcgccggacaatcccaagccgctggccgacgacgtcgccctgccgctgccgtgtggcggcgagatggtcttccggcatgtctacgtactcgccgaaggcgccctcgacgatcgcgaggtcaacctcggctacgccttcaacgaaggcgaggcgggctaccagcagtcgttcatctccggctaccggcgcgactacgtgaacggccagttcagcctcgccgacctggcaccggcctggcagcagaagctctccgccagcctgccgaagcctgccgccggcaccccgctgaagccgatgctgtacttcatcggcaagtacgaggtgaccgcccgccagtacgccgcggtgatgagccaggcggccgcgctctccggccagggcgaggcgccggcctgcgacgtgccggacgggatggccgcgcggctgcccaaggtcaacctctcgcgcttcgacgccgaacgcttcggcgcggtgtacagcgcctggctgctgaagaaccacccggaactgctgccggtcagcggccgcggcaagaatcccgaggacggcggcatcggcttcgtccgcctgcccaccgaggtcgagtgggagttcgccgcgcgcggcggccaggcggtcagccgccaggaactggaaggccggctgttcccgcgcaaggtcgagggcagcgaccaggaaggcccgctgggcgactgggcggtgtacaaccaggtcgccggcggcaccgggcaggccgcgcgactgttgccggtagggatgaagcggccgaacccgctgggcctgttcgacgtgatcggcaatgccgcggagatggtccaggagtccttccaactggtccacgccggtcgccggcagggcacatatggcggtttcgtggtgaagggcgggaactatctcgaaggcgagatgactctattcaccgggatgcgccgcgaatacccgctgttcgccgccgacggcagcgaacagcgcaacgagaccaccggtttccgtgtcgccatcggcgcgctgtccgcgccgcgctcgcgctatcccgagctgttcgcccaatggcagaaggaaggccgactagcggcattgaccgatgccatcgatgacgctcaagatcccaccaagcaattggacggaatcattgccgccacccgcgacccgcagatgcaggcgcagttggcccagataaacgaggaactcaagcgtaacgtttcgttgatcgcccggcagcgcgaagaggccgccggaaacctgatacagtcggcggcactggtcgccgagacgatcaacaactacaacatacgcctgaccaacctcaagaaggacagggagaaagccgtggcagccagggatcaggcgaccgcccagctctatgccggcgccatcgccaacgggcgcagcgccctcgatggcgcattggccatctacatcgacaacctcgccaccggcacccgttacaccgacgcggtgatccaggcgcagttccagcgcatccaggaagaactcaatcgcaacccggttctgggcaagagcctggtcaagcgcgcgaccctgttcgtcaaacacgtcggagattatcgccagcagcaccgggccgagccggaggcggtattgaaggaattgctcgcgtccagcgggcgttga

SEQ ID NO: 5243 - DNA, 543 bp, Pseudomonas aeruginosa
cgtggcctacgccaagtcggcgcaaagctgctaccagagccagttcaaggctctgctcgacggtcgcaagaacaagtcgatcaacgaagccgaagggcgcaagcgcctggccgagatcgtcagcggcctgcaggagaccaacgccttgctggtcgccgccaacggccgtgccggcgagaacatcagcaactacacccaggcctacgagaaagacctgcagcaggtcggcgtaccgcgcgccgaggtgaccaaggtcgccgaggccgagaaccgcgccagcactacgaaaggcggcagcaagcccaagaccggcagcaatcccaaggtgccgaaggaagcggtcgccaccgagcagaccatccgcaaggcccaggacgcgcaaagcgaaggcaacaaggtggcctcccagggccagggcatgatccgggaagtctgcaacagcccggacatgggcgactgggcgccgccgagctgcgccaaggcctgatcggcctcgttaccggcacgaacgcgacggcgaccttcgggtcgccgtttcgttga

SEQ ID NO: 5244 - DNA, 1236 bp, Pseudomonas aeruginosa
aacaacgccatctgcgcccccggcacggcgaaccggctgcaatccagcccgaagccctggcggcggtgccagcccgaggcgcttcatcgccaccgcgaaacgatgcgccagcaggtcggcgaacggtccctggccacgaaagcggtggccgaagcggctgtcgtagacctcgccgccacggcattggcggaccaggctcatcacatgctcggcgcgttgcgggtagtgcgccgccagccattcctcgaacagcggggcgacttcgcgcggcaggcgcaggagcatgtacgcggcgctgcgcgcgccggcgtcccgcgccgcctggagcaggcgctccagctccatgtcgttgaccatcgggatcatcggcgagcagagcacgcccaccgggatgccgttgccgctgagcgtgcggatcgcccgcagtcgcgccgagggcgccgccgcgcgcggttcgagaatgcgcttcagctcgtcgtcgagggtggtcaggctgatcatcaccgccaccaggttctgctccgccagttcgcgcagcaggtcgaggtcgcgaaggatcagcgagcccttggtgacgatggtcagcgggtgacggaagcgcagcagcacctccagcacctggcgggtcaggcggcgttcgcgctccagcggctggtaggggtcggtattggcgcccaggttgatcggcgcgcagcgatagccgggcttgctcagttcctgctccagcgcgctggcgacgttgctcttggcgatcagccgggtctcgaaatcgatccccggcgagaggtcccaataggcatggctgggccgcgcatagcagtagatgcagccatgctcgcaaccacggtagggattgatcgaacgatcgaaagggaggtccggcgactggttgcgggagatcaccgtgcgggcgatctcctcgcgcacctcggtgagctggatcggcggcacgtcctgctcccagccatcgtcgaaggcctcgctgtgggtcggggcgaagcggttgagggggttgctggcggtaccgcgaccgcgcgggggcaggggagcgctcatgagggaaacccggtgaaatactgtatatggatacagtatcgcaccgggccccggcccacagccatcgccgccggtcggcggcgagcggtcaggcgtcgggcttcttcttcagcttgggattggggaagaactgcaccgactgcaccttcgggttggccggcttcggcgcgttctggttga

SEQ ID NO: 5245 - DNA, 684 bp, Pseudomonas aeruginosa
tcgccgggctcatgcggcctccccgaccagcccggagtgacgcagcagggcgtcgatggacggctcgcgaccgcggaaatcgacgaacaacagcatcggctcgcgggagccgccgcgggccaggatcgcctcgcggaaggcacgcccggtatcggggttgaacacgccttcttcctcgaaacgcgagaaggcatcggcggacagcacctcggcccacttgtaactgtagtaaccggccgcgtatccgccggcgaaaatgtgcgcgaagctgttggcgaagcggttgtacgccggcggacgcatcaccgccacttcgtcgcggatgccctcgagcacctgcagcacgctgcggccgtcgccgtgggtggcgtgcagctcgaagtcgaagagggagaactccagctggcggaccatcatcatcccggactggaagttcttcgccgccagcatcttctccagcaggtcctgcggcagcgcctcgccggtctcgtagtgggcggagatcagcgccaggccttccggttcccagcaccagttctccatgaactggctgggcagctcgacggcgtcccaggccaccccgttgatcccggaggcggcggcatgctcgacgcgggtcagcaggtggtgcaggccatggccgaactcgtggaacagggtagtgacctcgtcgtgggtcagtag

SEQ ID NO: 5246 - DNA, 1389 bp, Pseudomonas aeruginosa
cgccggcttgccgttcaccgccggggtgaagttgcacaccaggtaggccaccgggtcgatcagccggccctgggcgtcgcgccggcggtcgcgggcgccgtccatccaggcaccgccgcgcttgttggcgcgggcatagaggtcgaagtagaagcggccgacgtgctcgccgttctcgaggatctcgaacaggcgtacgtcggcgtgccagcgttcgaaatcgtgcagttcgcggatctggatgccgtagaggcgctcgacgatggcgaacaggccggaaagcaccttgtccaccgggaagtaggcacgcagcgcctcctgggacacgctgtagcgcgcctcgcggagtttctcggcgtagtagccggcgtcccagctctgcaattcggtgcagccctgctcggcggcgtaggcgcgcagctgctccaggtcgcgggcggcgaacggcttgctgcgcaccgccaggtcgcggaggaagctgagcacctggtcgctggactcggccatcttggtcgccagcgacagctcggcgtagttggcgaagccgagcaggccagccagctcctggcgcaggtcgaggatctcttccatcaccggaccgttgtcgttctgcccggcgttcgggccctggtcggaggcgcgggtgcagtaggcggcgtatacctcttcgcgcagggcgcggtcatcggcataggtcatcactgcgtagtagctggggaactccaggctgatcagccagccgtccaggcccttggcctcggcggcctgcttcatctgggccttggccgaatcggtcaggccggccagcgcggcttcgtcggtgacatgcttggtccaggcctgggtggcgtcgagcagctggttggagaaacggctacccagctcggacaggcgcgactgcacctcggcatagcgcttctgcttgtccgccggcaagtcgatgccggacaggcggaagtcgcgcagggcgtgttcgaggatggttttctgggccacgtcgaagccggccgcctcggggctcttcgccagcgcctcgtaggcctcgaacagggcgcggttctgccccagctcggtggagtaggccgacagctccggcaggcaggcctcgtaggcctcgcgcagctcggcgctgttgcacaccgcgttgaggtggctgaccggactccaggcggcgcccagacggtcgttgagttcgtccatcgccagcaccaggcccttccaggtcggctgctcgcgctgggtttccagcaggcgggcgatggcggcgcggttatcggcgaggatccgctcgatggccggcttcacgtgttccgggcgaatggaggagaaaggcggcaggtcgtaggcctgcagaaggggattcgcgctcacgttggcaaccttggctaa

SEQ ID NO: 5247 - DNA, 699 bp, Pseudomonas aeruginosa
agctcaaggacctgcacatcgccgaggactaccatgcgtgacgccacgctgcgctacccgaacatcctcttcgatctcgacggcaccctcaccgacccacgcgagggcatcacccgctcggtgcagttcgccctcgcccgcctgggcatcgacgagccggacctggcgcgcctggaacacttcatcggccccccgctgttgcagtgcttcatgcagacctacggcttcgacgaagcgcgcgcctgggaggcggtgaaccactaccgcgagcgcttcagggtcaccggtctctacgagaaccgcgtgttcgacggcattcccgagctgctcgaagccctggtcggacgcggccacacgctctacgtcgcgaccagcaagcccggcgtgttcgcccgcgagatcgcccgccacttcgccttcgaccgtcacttcaaggcgatctacggcagcgagctggacggcacgcgcacgcacaaggacgaactgatccgccatctgctcgacagcgaaggcctggcagcggagcattgcctgatgatcggcgaccgcatgcacgacctgctcggcgccagccgcaacggtgtcgcctgcatcggcgtcggctacggcttcggcagcgaagacgaactgcgcgcgcaccagccgacccattactgcgccgacctcgccgccctgcggcaggtattggaatcccactga

SEQ ID NO: 5248 - DNA, 1341 bp, Pseudomonas aeruginosa
tcctcggcctggcgcccgctggcatcggctatacgctgctggtggcgctgctcggcgtcggcctgttggcgctgctctggccgatcggccggctggccacgcgctggtgctacgccgaccagctcgccgcctgagcaggcgtcagggcgctgcggcggccagccgctgcaacgccgcctggcgctccgccagggggagctggccaagggcacggacccgcgcatagaacgccggccagttgccgccgacctggcggaacagcacggcgaacgccgccacccattggtcgtagaggccgaagggaagcagcttggcattgttgaacggcgcgtcgatccaggccttgaacggcgactcgccaccccattcgcgctggctcagcgccgcgtactcgcggcgcaggcgctggaattcggcagccttgccggcacgcttggcggcatcgtccaacggcccggcataaagtgcttcgaggcgcgcacgactggccaggaccagcgcggtgaactgctcgcggcgcttctcctcgcggccgtccgccggcggcagtccacgatattcgcgccactggcgggtaccttcctgttcgacgaaggtggcgaaggattcgttgaaggcggtgtcgtcgcgcaggtagaacttctggtgcgccagttcgtggaagatcaaggtcgccagccgttcgtcgtcccagcgcagcatgctgctgaggatcggatcgtcgaaccagccgagggtcgagtaggcctgcaccccgccgacgtagacgtcgtcgccgagcgcccgctggcgcgccgcctcggcgcgcgcggcggcctcgctgtagtagccgcggtaggccacgcagccggcgatggggaagcaatgggtgaccggctgcagcgacagctccggggtggcgaacacgttccataccacgtagggccggccgatatcggcgtacaggcgatagctgcggttgtccggcaggccgaggcgttcgctggcgaattgccgggccttttccgccttcgccaggcgttcgcgcaagcgcgcgtcgcgctgcgggtcggcgatcaccgcggcggccggctcgcgggcgcgcagcagggcgaactggccgctggccagttgcccgtagtaggagacggtcgagcaaccgctcagcgccaacagcgccaggcagggaacccaacggggcagtcgaaggtcagcaagcggatggcgaaggcggcgtggcatgggcggaacatagcacagcacgcggaccgcccgccgccctaccagcaccggtccgcgatccggcgaggcggaggaacgcaaggcgtttttccaaggcgcaacggatggcggccgggttaa

SEQ ID NO: 5249 - DNA, 459 bp, Pseudomonas aeruginosa
acgccctccggagcccgccccatgcgtccactcacccgtctcgtcccgctcgcgctgctgctcctcgccggctgcgccggaccgctgccgcagccggacccgcagatggcctgggtcgagctgcgcagcgcgccggccaacaccctgctggccgagcgcctggacggcgagcggttgagcgacgggcgctacttccaggtcactccgggacgccatgtgctggaggtgcgcttccagtacgaactctatggcggttccggcggcggggggggcggcttcggcgagccggtgcagatcaactgctaccagcaggtggtctatgacggcttcgaggcgggccggcgctatcgcctggaggtgcgcccgcaattgcgcagggcgctggcgctactgagcgacgagcgtggcgaggtggtcgcccgttcgaacttccagaccagccgctgcccgccgtactga

SEQ ID NO: 5250 - DNA, 777 bp, Pseudomonas aeruginosa
tcacagctttgttgcatggatcgagcgaatcatggaccgcctgaccgccactcgcgtcttcgtcgaagtcatcgacagcggcagccagaccgccgccgccgagcgtctggacatgtcccgggcgatggtctcgcgctacctcgccgagttggaggagtgggtcggcgcacgcctgctgcaccgcagcacccgccgcctgagcctgaccgacgccggcgcggagctgttgccgcagtgccgcgagatgctcgccgtggccgacgccatgcaggccaccggccagacccgccgcgacagcccgcgcggcactctgcgcatcaccagcagcctgtccttcgcccaggcctggctgacccgtgccgccgccgccttcgtcgagcgctacccgggcaccgccatcgacctgcaggtcaacagccaggtggtcaacctggtggaggagcgcatcgacctagccctgcgcatcgccaaccagctcgaccccaacctgatcgcccgccgcctcggcgaatgccgctcggtgatctgcgccgcgccggactacctgcgccgccacggcaccccgcggcgcccggaggacctggcgctgcacaactgcctgacctactcctacttcggccgcagtctctggcagttcgagcgcgacggcgagccgaccagcgtgccggtgggtggcagtctcagcgccaacgaatccaccgtgctgctggaggccgccgccgccggtgccgggatcagccagcagccgctgtactcggcagccccgctgatccgtag

SEQ ID NO: 5251 - DNA, 561 bp, Pseudomonas aeruginosa
actgctggacgcgccgccttcgacgcacctttatcccctgtctggagcacgtccatgtccctgtcgatctaccaggcttcgatcccgaccttcctgcgcaccctcggcaacctctcggcgatcctgaagaaagccgccgcccacgccgaagcgaagaacatcgatccgcgcatcttcatcgacgcccggctggcgccggacatgttccccctggcgcgccaggtgcagatcgccagcgacgccgccaagggcgccggcgcgcggctggccgggctggaagtgccgagctacgcggatacggaaaccaccttcgacgaactccaggcacgcatcgctcgcaccgtcgagttcctcgagggcatccgcgaggaacaactggacggcgccgaagagcgcaacgtgaccctcaaggtgcgcggccaggagatcagcttcaacggccgcgacttcctcttcggcttcgccctgcccaacttcttcttccacgtcaccaccgcctacgccatcctccgccacaacggcgtcgaactgggcaagatggacttcctcggcggcgcctga

SEQ ID NO: 5252 - DNA, 345 bp, Pseudomonas aeruginosa
ctgaggaaagataccgacaagcgcaggacgcccgatggaccttcgccccagccacgtgcatgtgttcccacccagccgcgacctcccggccgcaaccagtccgcaccgcgaaaccctgctgcgcagcggctgcgcctggaacggctcgctctacctcggctatcccctcggccagccgcagctcaccgtgcagcgcctgagcctggccgcccacgaacgcctggactggcaggtccatccgatgcccagcgcgctttacgtgctcaagggcgaactgcgcctggagacccgcgacggtgcccagagcacgcgggtgctggaaggcgaaggcggcgggttgcctga

SEQ ID NO: 5253 - DNA, 1806 bp, Pseudomonas aeruginosa
  unsure (1803): Identity of nucleotide at the above locations are unknown.
caccgccctcccgtccgccaccgcagcaacccgcgacgcaccttgcgtcggtcccggcccccgccgccggcgggcgccgctcgcccgcgctccgcccgccgcaccgatcgacccatgaaccgaacaagaacaggagtccacccgatgcgctacgcccctcacgcaagccgatactccctcttcgccctggccgtctcggcagccctgctgcccggcgccggctgggccgccaacggcgacctcgccggcgcccgcaagccgcccagcgtcgcctgctcctggaaccgcgaggcagcgttgtcctacgaggagcgccggctcgacacgccgctgccgttcagcggcgccaacgtcgtcacccatgaccagacgccgctggccgagcgcatcgtcaagggcgccggcttcgacggcttcgaaccggccttcgccaagcgcctgtgcgccgccgacggccgcaccccggtcagcagctacgccaaggcactgaagctggtcaccgaagagggccgcgcgctgtggcgcgccgccgtcgaccgggcccagggtcgccgcgccattcccgccggcgcgctgccggccagcgatgaccgcatgctctactggacgcgcctctacatgacccgcaccctgcgccagtgggcgccatccttccacctcggcaaggcccaggcccaggcgctgcaatggcgcttcgaacgcgcctcgcgcggacagctggacatcgacctgccgcgccgctacgccgccgacggctcgcgctaccggcggatgatcatcagcggcttcgacgtcttcaccctgggcactcccgggacggcgaacaccggcctgcgcaacggcaacccctcgggcgccaccgcccttgcgctggacggccgcgagttcaggctggccgacggcagcctgctgcgtatcgaggcctacctgttgccggtcagctacgacccgttcaaccgcggcatgcaggaagacaccctgggcccctggttccgccccggcccgcgccgggtcgacgcctccatcaccatcagccagggcggcgccaaccagttctggctggaggcctggaacggccgcttccacggctcctccgccggcaacgacggcatcgtctactgccccgccgacagcgctttgcccaactacgtgcttcccctgggcagcgtgaccaatcccggcaccgcgccgatttccctgcggggctccggctgcaatatcaacccgccgcgccgctggctcggctacgacagcgccagccgctggcggcagaacctgccagcacagttctccaaggcctcgctgccggtccgccagttgctcgccgccgatacctggcgcggcatcgagcggccgccgggcgctaccagccaggccgcggaaggcttcgacgtcacctggcacaccaactacgacttcttccccgattgcgccaacccgcgcaccgaaaacgtgccgaccaacggggtgatgaacgccatgcccgatccctccctggtgctcccgccgaaccgacggatctgcgcgcgcaacggcggtggcggcgactacctgtccaacgagagcgcctaccgcaacacggtgctgcgcgacgcgttccgcctggagattcccgccgggcacatccatgtcccggtgatgaacaactactacaccggcgtaccggcgagcggcggcggcgcgcgcaacgacaacgccatcagcgacgcccgctacgaggcctaccgcagcgccatcgtggcgcagacccgggcgctgctggtgggcgtcggcaacgccctggcgcagggggcgcaagcggantag

SEQ ID NO: 5254 - DNA, 1815 bp, Pseudomonas aeruginosa
cgtctcctgatgtttccccgccagtctaggaacgaggcgcccctccgcctatcaggattggccgtggtttttttactgttggcggccgtcggagcacgcggaaagagaaccgtcagcggccgaaaaacagcggactttccctacgccagctcccgtgcgcctacaccggggcggagaacccgatggatatcggcggcagcgacgggctcttggtggacggcgcaccgccgtgcgggcgcctcggggtcgtctgctgctatggtgcgcacaggcacgtcgccatcctctctcccggcgaatggaatcgagcatgacgctttccctggatctgttgttgagcctgtgcacggccctggccatcggcctcctgatcggcgccgagcgcggctggcaggagcgcgaccacgaagatgcgcggcagatcgccggaatccgcaccttcagcctggccggcctgctcggcggcttcgccaccctgctcgcgggcgaactgggcagcgcagtctgggtagccttgctgctggccctcgcggcgctggccgtggccggctacgtgagcgatgtcaggcgtggcggcgaccagggcatgaccaccgagatcgccctgctgatgaccttcctcctcggcagcctcgccctcaccgaacagcgcctgctggctgccgccggcggcatcgtgctgaccctgctgctgagcctcaaggacaagctccacgccctgctgaagcgcctgaccgccgaggagctatcgggcaccctcaagctgctgttcatttccgtggtcctgctgccggtgctgcccaaccagggctatggtccctgggcgttcttcaatccctacctgacctggtggatggtggtgctgatcgccgccctcggtttctccgcctacctggccatccgcctgatcggctcgcgcaagggcctgttgctgaccgcggtgctcggcggcctggtgtcctccacggtgatgaccctgaccctggcgcgcctgcgcgagcgcatgcccgacgccctgttggcgtgcgccctgctggcgacctcggcgctgatgttcccgcgcatcctcgtcgagatcggcgcgatccacccggccttgctgaaggaactggccctgccattcgccgccaccaccctcgtctaccttggcggcacgctgttccacgccctgcgcggcggccgcgccagccaggaggcgcccgacgagccaggcctgcgcaaccccttcgaactgctcccggccatgcgtttcgccgccctgctgagcgcgatcctgctgttggtggaggtcggccggcggctgttcggcgacgccggcatctatgcggtcgcgttgctctccggcctcgccgacgtcgacgcgatcaccctgtccctggcccgcgcggcgcagggcgaactcgatccaggcgtggccagccgcggcatcgcccttgccgccctgagcaacagcctggtcaaggccggcctggtcgtgctggtgggcggcaagcggctggccctgcaaacgctgcccttcagcctggcggggctgctggtaggagcgctgctgatcctgttgtgaggcgccggggaaaccccggagcaccgttggacgaacgcgacggcaaccgcctggcgccccgcatcaacctgcgcggctactggctgcaacggccgggtttcgaggaccggaccaggacccgggtgaggcagggcggcctggcgatcacggcggagcgaggggaggggacgcctccgcgctggactgaggcgtctctgcgaggtcggagacaaggcggtggctggctgagccaatcaccctttgcggcgtga

SEQ ID NO: 5255 - DNA, 495 bp, Pseudomonas aeruginosa
ccccgccctggcggttgcggatcgagtcgccggcgagcaggtcgaggcgcttgccggcctcgatcaggccgctgttgtcgaggttgtcggccgtcgccgagaggtcgttccgcgcgcgcagggtgccgacgttatgcaggtcgccgccgctcaccagcttcacgtcgcggccctggatcagcgcaccgttgggtgccagccgaccctccgcctgggccaggtagaccaccggcgcgaggaccttctcgccgttcacctcgacctcttccagccacacgatgtcgtgggtcagcgccgccatctgctccgcgctcagacccacacccagttgcaggtgcagttggtccttgtaagcgatggcgttgtccatcaggtagcggaacagcgcctcgtcgctgctcagcccatcgatgtagcgctggccggtgcgcgccaccaccgcgtcgcggatcagccgctgctcgtagagaccgtcgccgaggcgcttcttgctag

SEQ ID NO: 5256 - DNA, 3282 bp, Pseudomonas aeruginosa
tccggccgccggcgttgttcagcagcgtatcgtcgcgctcgaagctcagcgcgcgctgcgccgagaccaggccgccctggccgttgtccagcttcccggcgatgctcagggtcacgtcgctttcgccggagacgatgccctgggcgttatcccaggctggcggcgtccatccgttgcgcgcccttgctgacccaggcgccctggccgtggttgtccagcgcgccgccgagggtgatggccagctcgccgtcccttgctcgaaagggtgccgccggcgctgttgtccaggctcccgcctggtcaccgtcaggccctggccatccggagagcaggccggcgccggcgttgcccagcgcgtcggcgtccaggcgcagtttcccggcgctgatgatgcgcccctgctggccgttgtcgatgcgcctggccagcagctcgaagccctgctggctggaaatctcgccgccctggcggttgtcgaggacgttcagccgctcgatgctcagcgggccgcgagcactgatcaggccaccctggttgtccaggtcgccgccccgcaggtcgagactgacgccgcgctcgccgaccagccggccctggcgttgcaccaggcgctcgaccgtcaggcgcaggtcgccccgggcggagatttcgccgccgtcggcggagtcgacgcgccctgccgtcagttccagttcgccgtcgctggtcagcaggccgccacggttgtccaggttggcggcgctcaggcgcagcgactgcttgccactgagggcgccgccacggttgtcgaggtcggcgctgctgacgtccagcacgccctggctgatcaactggccaccctcggcgttgtccagcgcgccagtggcgacgctcaggccggcgttgccggagagcaggcccttgccgctgttgtccagggaggcgctggcgagcgtcaggcgggcgccggaaacggtgccttcggcgtggttgtccagcgcgccgtcgacgcgcaggtcgatgccggcgcggctggccagggtgcccttggcgctgttgtccaggcgagcggccgcgatgtccaggccggcggcgccggagatcaccccggccaggctgttgtccagggcctgggcgatgcgcagggtcaggctggcggcgccgatcaggcgcccgccgcggttgtccaggctggcggcggcgagggtgaaggcgcggtcgctggagatttccccgccggcgccgttgtccaccgcgccgagctggcgcagcagcagcgcgccgggcgtggcgatcaggccgccgtcgcggttgaccagcgtgccgccattgaggtcgagggtgacgccggtttcgctgaccaggacgccgcctccgcgctggtcgaggcctttcaggttggcgtcgagcaggcccttggcgctgacccgtccctgctggccgttgtccagccgggcggccaccagggtgatgccggcgttgctgccgatgccgccgttgcggctgttgtccagcacgccggtgcggatatccaccgcacccttggcgctgatcacgccggaacggctgttgtcgaggctggcgccctgcagcgtcacgccggcatcgctgagcagcctgccgccctggttgtccagcgcggcctggctggtcagcgccagcgcaccggcgctggagaaggtcccgccacggttgtccaggcgcgcggcgcgcgccgtcaggctgccttcgctgaccagcgcgccgccctggttgtccagcacgccgccgaggctcacgctcaggctgttctggctgtcgagccgaccgccgtcgccgttgaacagttcgccgccgtccaggctcaggccgtcgcgcccggccagcacccccttggcctggttcagcaggcgctgcacggtgaggcgcaggccgctgtcgccgatgaccttgccgccgcggttgtccagttgctcgcgggcgttcacggcgaccttcgaggtgctggaaatctcgccggcgcggttgtcgacctgccgcgcctcgatagcgatgccgccattcgcggcgatcagccaggactggctgttgtcgatcgtgtcggccgcgaccttcagggtcttttcgctgaccagttcgccaccttgctgggccaggctgccaagcgtcgcctgcaggtcgcccttggcggcgatacgccctccggcgttgccgacggcgttcgctgcgaggtccaggcggccatcgctgaacagcttgccaccctggtcgttgcgcaggctggcgacctccacgcgcacgccagccttgccgctggcgctgccgccgtcgcggttgtcgaaggcgcctcccgtggcgctcaagccggcgtcggccaccagcacgccgccacggttgtccaggctggcgccgtggacgttcaactcgctgcggctcgacagcaggccgccggcgcggttgtccagttgccccaccgtcacgcgctgcgcgccctggctgagcaggttgccttcatcgcggttgtccagcaggccgccgaggctgacctccaggccgccccggctgctcagcgtgcccttgccgctgttgtccaggctgcgcgcccgcaggtcgaggcggttggctgcggagaacaagccgaggcggttgtcgatggcaccgctggcgaccaccagcaggtcgtcgccgatcagcttgccgccgcgattgtcgaggctaccgacgcgggcctcgacgcgcttgccggagacttcgccgtccccccggttgaccagcgcctgggcgctgacgcgggtggactgctggctgccgagcaggccttgctggccgttgtcgagcgtcgccgcgccgacctccaggtcgttcaggccgatcacctggccgccacggttgtcgagatcgccacgggtcttgaccacggcgcggtcccggctctgcaacaggccgtcctggcggttgtccaggctgctcgcctcgacccgcagttcgccctcggcgagcagcttgccgccacggttgtccaggtgtccgccgtcgacccggacggtcgcccccttcaggctgccgccctggttgtccagcgcctggctcgccttcgcttccagcgcgcggctggccaccaggctgccggcgttgcgcagggtgccgctgcgcagctcgaggtcgccgcgggcgttgcgccgctcgtccggctcgacgccggcttcgatcaccccggcgttgtcgaggcgcgcggcgtccagcgcgatgcgttcgcgcgccgccaggctctgccggttgaccagttcctccgcgctgcggatctcggcgctgccaccggcgtag

SEQ ID NO: 5257 - DNA, 1275 bp, Pseudomonas aeruginosa
ctggaacggctgcaggtagctgagggtcaggctgtacttgtcgtagcgcgcatgcggatcgcccgcctgcgggtggccgcgaccctgcgcgccaagggcgccgatgccctgctgccagccgaggtcgaggttgacgaaaccgctgccgatccgccggccatggttgaagccgagctgggtctcggtgatccgcgtgctctggtcttccaggcgggtgtcttcgacatagttgttggtgcgctggtggctgagccccaggctcatggcggtcttgctcacaccgtcgcggtgcagcacgcgttcggcgcggaactggtggctgcggctgtcgccatcgagcttgaaggggaagccgctggcctcgttgcgcgtgcggtagtcgctctggctgtagccgtaggtgaaggtccaccagccccagggcaggctgtagaacaggctctggctgtcggaatggcgccagcggtcggtcaccgcgtcgcggttggcgcgcaggttgagctggtcggccaggcccagcgggctgtcccagtccagacccaggcccatctgctgctcgccagtgctgacgtcgccgtcgttgttgcgcgtggcggagacccgccagggcttgtcgcgctcgcccttgagacgcacccggctgccgccgacctcgctgccgggcaccagctccagttgcgcctggcgcgacggcaggcgactcaactggtcgaccagttgctccagttcgcgcaggtcgagcaactcgccggtcctgcccggaaagctcatcgtcagttcgcgcgggctggccagcgcggagctgtccaggccctccaggcggccttcgacgacgatgatgcgcagggtcccggaggccaggtcctgctgtggcaggtaggcacgggtggtgacgtagccgcgatccaggtaatggtcggtgacggccttgagcagcgcattgagctggccgacgcccaggcagcgcccctggtagggcgccagcagttggcgacgcgcgctttcgccgaggtgcccggcgccctccagctcgatgcggcggatctcgaagcagcgctcgtcgtcgccggaggcatccgcagcggcgggcgctcccttgccgggcagttgctggagttcctccaggcgcttgcgctgttcgtccagcaggcgctgctggcggtcgcggatcaggtcgcggtcgccgggggaggtgaagggggcggcgctggccatgagcggcaggcacaggaagataaaggccaggcgatggagagccacgatttcattccttga

SEQ ID NO: 5258 - DNA, 2103 bp, Pseudomonas aeruginosa
gttttcctgacaggtttgagcaatcttatcggtttcttttacccggcggggggattagattctgcccatacgtcatttcctggagccctccatgacttcctatcgcaacggccccgacgccaagggcctgttcggccgcttcggcggccagtacgtcgccgagaccctgatgccgctgatcctcgacctcgcccgcgagtacgagaaggccaaggacgacccggcgttccaggaggaactggcctacttccagcgcgactacgtcggccggccgagcccgctttacttcgccgagcgcctgaccgagcactgcggcggggcgaagatctacctcaagcgcgaggagctgaaccataccggcgcgcacaagatcaacaactgcatcggccagatcctcctggcccggcgcatgggcaagaaacgcatcatcgccgagaccggcgccggcatgcacggcgtggccaccgccaccgtcgccgcgcgcttcggcctgcagtgcgtgatctacatgggcactaccgacatcgaccggcagcaggccaacgtcttccgcatgaagctgctgggcgccgaggtgatcccggtgaccgccggcaccggtaccctgaaggacgccatgaacgaggcgctgcgcgactgggtgaccaacgtcgacagcaccttctacctgatcggcacggtcgccggcccgcatccgtacccggcgatggtccgcgatttccaggcggtgatcggcaaggaaacccgcgagcaactggccgagaaggaagggcgcctgcccgattcgctggtcgcctgcatcggcggcggctccaacgccatgggcctgttccacccgttcctcgacgacgccggggtgcagatcgtcggcgtggaagccgccggccacggcatcgacaccggcaagcacgcggccagcctgaacggcggggttcccggcgtgctgcacggcaaccgcaccttcctgctgcaggacgcggatggccagatcatcgacgcacactccatctccgccggcctcgactatcccggcatcggcccggaacacgcctggctgcacgacaccggccgcgtcgagtacacctcgatcaccgacgacgaagccctggaggccttccacacctgctgccgcctcgaaggcatcatcccggcgctggaaagctcccatgccctggccgaggtcttcaagcgtgcgcccagcctgcccaaggagcacatcatggtggtgaacctgtccggtcgcggcgacaaggacatgcagaccgtcatgcaccacatgcaacaggagtcgaaagcatgagccgcctgcagacccgcttcgcccagctcaagcaggaaaaccgcgccgccctggtgaccttcgtcaccgccggcgacccggactacgcgtcttccctggaaatcctcaaaggcctgccggcggccggagccgacgtgatcgaactgggcatgccgttcaccgatccgatggcggacggcccggccatccagttggccaacatccgcgccctcgaaggcggccagaccctggccaggacgttgcagatggtccgcgaattccgcagcggcgacagtgagacgcccctggtgctgatgggctacttcaacccgatccaccactacggcgtcgaacgcttcatcgccgaggcgaaggaggtgggggtggacggcctgatcgtggtcgacctgccgccggagcacaacgaagacctctgccacccggcccaggccgccggcctcgacttcatccgcctgaccaccccgaccaccggcgaccagcgcctgccgacggtgctcgaaggcagttccgggttcgtctactacgtgtcggtggccggcgtcaccggcgccaacgcggcgaccctggagcacgtcgaggaagcagtggcgcgcctgcgccggcataccgacctgccgatcggtatcggcttcggcatccgcagcgccgaacacgccgccgcggtcgcgcggttggccgacggcgtggtggtcggctcggcgctgatcgaccggatcgccaaggcccgcgacaatgcccaggcggtcaaggatgtcctcgccctgtgcggcgagctggccgaaggcgtgcgcaacgcacgctga

SEQ ID NO: 5259 - DNA, 378 bp, Pseudomonas aeruginosa
tctgaggatcccatgcgaacgttcgacctgaccgccgccctgggcgaccgcgccaaccaaccggagatcagccgcctgctcgtcgcgcagctgatgaccagcaacaacgaagacacccgcaagctgcgacgcgcccaggagcgcgagcagacccaggaactcaacgagctggcgcaccgcctggcgggcatggcctcgctgatccacgcccacgccgtggaacgcgcctgccaccaactggagatcgcctgcggcgaaagctccgtgcgcaagctcgccgatgccgtcgacgacctggtgacggcactgggcgagctgcaatgcgaactgcacgactggatgacgatgaccgcgcctcaaggcacggcgaagtcatag

SEQ ID NO: 5260 - DNA, 2592 bp, Pseudomonas aeruginosa
gcatggaagccctggatgcggggggtggaatactcgttcatcgtcacctcttcaagcgccgccggcctgcaactcggcctgcagccagtcgacgaaaccgtcgaccagccgctggcgccgcttgcgctccggcaataccgcatagtacccgtatcgcgacaggcagctctcgccaatgggccggcaaagcagcccctgttcgagcaggccgtcgaccaggtggcgccagccgatggccacgccctggccggcgatggccgcctggatcagcaaggtgtagttgtcgaagctgagcaccgccggaatcggctgccgatcgatggccaacgcttcgaacaacgccggccagtcgaaccagcgggcgtgctgcgccggcttcagatgcagcatcggcaggcgcgccaggtgcgccttggccagcggcaactgcaatccctcgaccagccgcgggctacagaccgggaacacctcctcgcgaaacagccggtgcgcttcgccgtgcttggaacgaccgtcgccgaacaggatcgccacgtcgatatcgccgcgctggccggccaggccgcgctcgctggtcaccaggctcacgtccaggtgcggatgggcctgatggaagcgcggaaggcgcggcatcagccagtaggcagcgaaggcgtagtcggtggccacctggagcacctcgtggcgctggcgcgcgcccagcgcggcgatgccggcatcgatcgtctcgaggccggcggccacgtggcggagcagaagctggccggcgtcggtgagcacgatgcctcgatgaacgcgctggaacagaggggtcgccagctctttctccaggcgtttgatctgctggctgaccgcaggctgggtggtccccagttcctcggcggcagcggtgaagctgagttggcgggcggcggactcgaatacccggagcaggtcgagggatggcggcatgaggtgttctcacataagcccggcttatccaacgcatccagccccatgcggtttaccagggatttcgatgcactgatgatcgacgcagcactatcgcataacccaatcgcatgggataagccgcccgatgaagacctcgccgaacatcctgttcatcatggccgaccagatggccgcgccgctgctgccgcttcacgatccgcgctcggcgctgcgcatgcctcacctctcgcgcctcgccgaacgggccgtggtgttcgactcggcatactgcaacagcccgctctgcgcgccgtcgcgcttcaccctggtcagcggtcgcttgcctacccgcatcggcgcctgggacaacgctgccgatttcgccgccgatacccccacctacgcccactacttgcgcaacctcggctatcgcacggcgctgtcgggcaagatgcacttctgcggtcccgaccagttgcacggctacgaggaacgcctgaccagcgacatctatccggcggactatggctgggcggtgaactgggacgagccggaggtgcgcccgagctggtaccacaacatgtcctcggttttgcaggccggtccctgcgtgcgcaccaaccagctggacttcgacgaggaggtggtgttcaaggcccgccagtacctctacgaccatgttcgccagcacgccggccagccattctgcctgaccgtgtcgatgacccatccgcacgacccctacagcatcccggcgagctactggaatctctaccgcgacgaggacatcccgctgccgcgccagcgcttcgcccaggaggagcaggaccctcattcgcaacgcctgctgaaggtcatcgacctgtgggacaagccgttgcccgaggagcgcatccgcgccgcccggcgtgcctacttcggcgcctgcagctacgtcgacgcacagatcggtgcgctgctggcgaccctggaggaatgcgggctggccgacgacaccatcgtggtgttctccggcgaccatggcgacatgctcggcgagcgcggcctctggtacaagatgcactggttcgagatggccgcgcgcgtaccgctgctggtccatgcgccggcgcgcttcgcgccgcgccgcatcggcgcttcggtatccaccgtggacctgctgccgaccctggtggagctgggccggcgggccagtcgatccacgcctgccgctggaaggccgctcgctgctgccgcacctgcgcgacggcagcggggcatgacgatgtgatcggcgaatacaccgccgagggcaccctcagcccgctgatgatgatccgccgcggcgactacaagttcatctactccgagcaggacccctgcctgctctacgacctgcgcaacgacccgcaggagcgcgagaacctcgccgccagtccggcccatcgcggaacgttcgaggcgttcctcgacgaggcccggcgacgctgggacatccccgcgatcacccgcgccgtactcgacagccagcgccgccgacgcctggtggccgccgcgctggcgcgaggacggctggccagctgggaccaccagccgtgggtcgatgcaagccagcagtacatgcgcaaccatatcgacctggacgatctcgagcgccgcgcgcgcttcccgcaaccctga

SEQ ID NO: 5261 - DNA, 642 bp, Pseudomonas aeruginosa
gcacgagggcacttccatgaaccggcttcccacctgcctgctggccgccaccctgttcctgggcagcgcctcgctatacgccgaagaccccgcctgtgcccgcgtcaggctggccgatccaggctggagcgatatcgcggtaaccaacgccactgccgcgtttctcctggaaagcctcggctaccaggtgaagatcgataccctgtcggtgccgattatctatggcggcctgcgcgacggccaggtggacgccttcctcggcggctggatgcccgcgcaccaggactatcacgacaagttcgtcgccagcggccaggtcgaacgcctcggtcgcaacctcgacggcacccgcttcaccctggcggtgccgcgctacgtctgggacgccggcgtacaccgcttcgaggacctcgccgcgcaagggcaacgcttcaaccgcaagctgtacgggatcggctccggcgcgccggccaatcagtcgatccagaagatgatcgacgccaaccagttcggcctcggcgactggaagctggtggagtccagcgagcaggcgatgctcgccgaactcggccgggccgagaagcgccagcgctggctggtgttcctcggctggacgccgcacccgatgaacatccgccatga

SEQ ID NO: 5262 - DNA, 759 bp, Pseudomonas aeruginosa
gcctgtaccagttcgcgggtctgtcgttcctcgaaggcctggtactgcttcggatcggccagctcctgcgccgtcgcgccctggcgtggttgcaggccgccgagcggcgggctgcgcgggtcgccctcgtcgcgcagcatctgcatgaactggatcgcctgctcgcgatccagttccgccgccggaggctccgcctcgtacgccggtgctgccgcttgcgatcgcaccggcgccggcggcggcggacggtcgtcgaccgcgggcagtgccgcaagcgtcctggctggcgacggagaagacgaggaagcggccatatcggcaggcgccagcaacacgccggcgcaggtcagggcgatcgccagcccgctgcagccgagggcaacgccgagccagcgcttcacaggccttccaccctggcgccggccagcaggttgcgcaggcgcgtctcgaactgcgctgccagttgctcgcgcgccaccgcctggttcacctcgaagcgcacgctgcggtcgtcgaggggcaactggcgatcctcgcggctacgcacccggacgatctcgaacgcgccgtcgatgcgcatcggctgggaaaccgtatcggccttctggatcagcgcagtcttgcgcagcaggtcgagccggccgtcctggggccgtatcaggcctaggtcgccgggcgggtcgcggtccctgtcgtcggccagggaatagcggcgtaccgcctcgtcgaagggccaggccgctgcgcaactcggcgtag

SEQ ID NO: 5263 - DNA, 1341 bp, Pseudomonas aeruginosa
cgcctgccgtatacctgttcgagcaggttgccggcctcgatctccacgctggcgtcgagatcggcgcggctctgcgcggtgagctggtcttccaccgcgcgcgccagcaggcggttttccaccaggccacggcgcaactgctgcgggtcggtgttgaacttgacccgcgacagggcctgctcgagcaagtcgatgcttctccccggcagcacctcgccgtcgatccgcagatcctgcggcgccttggcggggacgccatgggcgctccacgccagcagcccgaggacgatcccgcacagtgcgcgacgccagccccgggcgcgatcagagagcagtcggtgcatcgaagctgttggcgcccttggtcagtacggtgacggtcagggcgatggactcgggaatcagctccttcgccacccgcaggcgcgtctcgtagctggtgtcgtaaagcggctcggggcgcgcgtaggcgacctggccggtctgggtgagcaggtcgcggatgctcttgctcgggtcgtagcgccccaccaggttggccaccgccgccgggtcgttgagcttctcgctggcgtagtggtcgtcgacccagccttcccagctggaatggccgttggccgaggtgatccacacatggtgcggctgggccacgtcgccggtggcatgcagggcatagccgatggtctgcagcgaaggcgcggcgcggaactgctcgaaccagtaggtggcgaggttatcgatcggctggaaggcggcggtctggaagtcgccgtagtgctcctgccagtccgagcgggtgccctggcggtagtgcgcctcggtggtgtcgaagtcctcgcgcttcagctcgcggttgtagagatagaccatggcgtaccagtcgacgtcggcgatgccgccgtcgaccttgtggtagcggtagtcgtagccgccgtgggggttgccatgggagtcgccgtcccgggccaggttgaggaagtgccagtacgaggtgtagttgacgatgcccgaagccgcgccccacagcggcgcgtgttcgtagccgacccaccagccaccgagacgggtgtccttgaagtcgtccacgtcgaaggccgcctggccgaggatctccccggcctgcgcctcgctgccggcggcgctcacgtagaaccggtaggcctggcgcatctcctcggtggcgtaggaggagttcatgaaggccagggcatccttgacgatgttcttgtgggtcggttgcgaccaggcgttggcctggctggcgatggcgcagatgcagagaccggcggccaggcgggcgaaggttttcatcggcagcgctcgagagtgagtgaagcctga

SEQ ID NO: 5264 - DNA, 996 bp, Pseudomonas aeruginosa
cgaagcaggagttccagcatggccaagcgcatccagttcgctgcctacggcggccccgaagtcctcgaataccgcgactaccaacccgccgagccgggcccccgggaagtccgcgtgcgtaatcgcgccatcggcctgaacttcatcgacacctactaccgtagcggcctctatccagcccccggcttcccttcggggctgggtaccgaaggggccggcgaggtcgaggcggtgggcagcgaagtgacccgtttcaaggtcggcgaccgcgtcgcctacgccaccggcccgctgggcgcctacagcgaactgcatgtgctggcggaggagaagctggtccacctgcccgacggcatcgacttcgaacaggccgccgcggtgatgctcaaggggctcaccacccaatacctgctgcgccagacctacgaactgcggggcggcgaaaccattctcttccatgccgccgcgggcggcgtgggcctgttcgcctgccaatgggccaaggcccttggagtgcaactgatcggcaccgtcagctcgccggaaaaggcgcgcctggccaggcagcacggtgcctgggagaccatcgactacagccacgagaacgtggcgcggcgggtgctcgaactgaccgacgggaagaagtgcccggtggtctacgactcggtgggcaaggatacctgggaaacctcgctggactgcgtggcgccgcgcggcttgctggtcagcttcggcaacgcctcggggccggtgaccggggtcaacctcggcatcctctcgcagaagggttcgctgtacgtgacccggccgaccctgggcagctacgccgataccccggaaaaactccaggcgatggccgacgagctgttcggcctgatcgagcgcggcgacatccgcatcgagatcaaccagcgcttcgccctggccgaagcagccagggcgcataccgaactggccgcacggcgaaccacgggctcgaccgtactgttgccctga

SEQ ID NO: 5265 - DNA, 462 bp, Pseudomonas aeruginosa
tggcgaagccgccctgcgccaggctgcgcgcaaagctccgggcggtgccccagcccggcggggctggcgcggcggctgccgaccatcgccagttgcggccgttccagagtctccggagcgccttcgacgtacagcagcggcggggcatcggcgacttcggcgagcagtgccgggtatcccgggtcgtcccacatcagcaggtgcctgcgcggaccttccagccagcgcagggcttcacccgccgcttcccgcaccgccgggctgcgccgcgcggcggcggcctcggcaggcactcccagggtgcgccaggcgccggctggcgcggcaagcgcggaagaggccgaaccgaaggcctcgatcaagcgcaggaagcgcatgggtcccagttcgggcaggccatgcaggcgcagccgtgcttccagttcggctggagaatggttcttcattgcgactcatccatag

SEQ ID NO: 5266 - DNA, 2046 bp, Pseudomonas aeruginosa
  unsure (347): Identity of nucleotide at the above locations are unknown.
tgccgaggcccaggcggagctggcggccctgcgcgcggacctgatggtggtggtcgcctatggcctgatcctgccccaggcggtactcgatatcccgcgcctgggctgcatcaacagccacgcctcgctgctgccgcgctggcgcggcgccgcgccgatccagcgcgcggtggaagccggcgacgcggagagcggcgtcaccgtgatgcagatggaagcagggctcgacaccggcccgatgctgctcaaggtgagcacgccgatttccgccgcggacaccggcggcagcctgcacgaccggctcgccgcgctcggcccgaaagcggtggtcgaagccatcgccggcntggccgccggcaccctgcatggcgagatccaggacgacgccctggccacctacgcgcacaagctgaacaaggacgaggcacgcctcgactggagccgtccggccgtcgaactggagcgccaggtccgcgccttcaccccctggccggtctgccacaccagcctcgccgatgcgccgctgaaagtcctcggcgccagcctggggcagggcagcggggcgcccggaaccatcctcgaggccagccgcgacggcctgctggtcgcctgcggcgaaggcgccctgcgcctgacccgcctgcaattgcctggcggcaagccactggccttcgccgacctctacaacagccgccgcgagcaattcgccgccggccaggtgctcggccaatgaacccgcgtctcgccgcctgccaggcgctggccgcggtgctcgccggacgcgcctcgctgtctggcgcgttgccgccgcaactggacaaggtcgccccgcgcgatcgcggcctgacccaggagctggccttcggcgcggcgcgctggcaaccgcgcctgcaggccctggccgcgcgcctgttgcagaagccgttcaaggccgccgacaccgatatccacgccctgctgctgatcggcctctaccagttgctctacacgcggattccgccgcacgccgcgatcggcgagaccgtcggctgcgccgacaagctgaagaagggctgggccaagggcgtgctcaacgccgtgctgcgccgcgcgcagcgcgaaggcgagacgctgctggccgaggtcgaccgcgatccctcagcgcgcctgggccatccgcgctggctgctgaaagcgctcaagcaggcctggccggagcagctcgacgcgctctgcgcagcgaacaacgcacacccgccgatgaccttgcgggtcaatcggcgccacggcgagcgcgatgcctacctggccgaactcgccgaagccggaatcaaggcccgcgcctgcgactacagccgcgacggcatccagctcgccgcgccgcgcgacgtgcgcgaactaccgggcttcgcggagggtcgcgtcagcgtccaggacgaagccgcgcaactggccgccgagcagctcgaaagcgcgcccggccagcgtgtcctcgacgcctgctgtgcgcctggcggcaagacctgccacctgctggaaacccagccggaactggccgaagtggtcgccgtcgacctcgaggagagccgcctggtaagggtccgggaaaacctccagcggctcggcctgcaagccagcctggtcgccgccgacgccagggccaccggggagtggtgggacggcaagccgttccagcgcatcctcctcgacgcgccgtgctcggccaccggggtgatccgccgccacccggacatcaagctggcgcgcaagccggaagacatcgccgccctggcgcacctgcagggtgaattgctcgacgcgctgtggcctaccctggaagtcggtggcgtactgctctacgccacctgttcggtgatgccggcggaaaacagcgacagcatcgccgccttcctcgcccgcacgcccggcgcccgcgaactggaccttcccggcccctggggcatgaaacagccccacggccgccagttgctgccgcaggtggagggccaccatggcttctactatgccaagctgatcaagatttccgccccgttgatcgaaacctga

SEQ ID NO: 5267 - DNA, 1302 bp, Pseudomonas aeruginosa
cgacgagaccaacatggtcgcctgccaggtcgcctacaccctgttcaacaccccgaccaagatcgcccgcgtccgcgagccggcctacctgacccgtaccgggctgttcgacaacgaggcgatcccggtggacgtgctgatcagcccggagcaggtggtcaccaactacatcaagcgcctgatcgaacaccccggcgcgctgcaagtcatcgacttcgccgagggcaaggcgcagttggtcgggatcaaggcctactacggcggccctctggtagggcaggagctgcgccagctgcgcgagcacatgccgaacgtggatacccgcgtcgccgcgatctaccgccgcaaccggccgatcattccccagggcgacacggtgatcgaggccgacgacgaagtcttcttcatcgccgccaaggcctatatccgcgcggtaatgggcgagatgcgcaggctcgacgacagctacaagcggatcatcatcgccggcggcggcaatgtcggcgagcgcctggccgaggccatcgagagccgctaccaggtaaagatcatcgagcgcagcccgctgcgctgccggcacctctcggataccctggacagcaccatcgtgctcaacggcaacgcttccgaccgcgacctgctgctggaggaaaacatcggcgagaccgacgtgttcctcgccctgaccaacgacgaccaggccaacatcatgtcctcgctgctggccaagcggctcggcgcgagcaaggtgatgaccctgatcaacaaccctgcctatgtcgacctggtgcaaggcggcgagatcgacatcgccatcagcccgcaactggcgaccatcggcaccctgctggcccacgttcgccgcggcgacatcgagagcgtacactcgctgcgccgcggcgcagccgaagcgatcgaagtggtagcccatggcgacgccaagtcgagcaaggtgatcggtcgctcgatcaacgagatcaagctgccgccgggcaccaccatcggcgcgctggtgcgcgacgaggaagtgctgatcgcccatggcgacacccgcatcgagagcggcgaccacgtgctgctgttcctggtcgacaagaaatacatccgcgacgtcgagcgactgttccaggccggcctgacgttcttctgaggcacgccctatcgcgaacggcgatagggcttcggcctacgaacaccaaggggccgcgtgcctccttcgcaacggccgaatccctctgttccgtgcaaagcctggccggagccgggcacaatggccgacatagttggaagagggcaggatga

SEQ ID NO: 5268 - DNA, 363 bp, Pseudomonas aeruginosa
gcgaccactgccggccctctagcttcgactcatcgcttcggtcaaagcccgaacgcgacacctgacttcaactacttttccggagccaacatgtcgaagcaagagcgttcagtcccgtcctatgtcgaatacccatacgagcaagcgattctctacgttcaccggaacgcctccgccaatgagatgctcgaatccgtacaggagcgcctcagggctctcctcggcctcctccatgccttggaaaggatcgaagtgcggacagggcagggcgttcccattcagcgcgtggcgcacatcctggtcacgctcggcggcgatgccctgacgctgctcacggccgcgcaccgggctaccacctcctga

SEQ ID NO: 5269 - DNA, 222 bp, Pseudomonas aeruginosa
  unsure (22),(26),(30),(31),(32): Identity of nucleotide at the above locations are unknown.
atgaagaagggcgcaacggtcnctgncgtnnngtcatttttctttattgtttccctctccctccctctttgttcttgcgggcgcccccgctcgcttcttcccggatcccctggagttctccgcgttcgctattggtgctacctctcctactgctgtagctccagtctgcccgtcggtatcttctttgctgtggtattcctctctctgcctctggcctactga

SEQ ID NO: 5270 - DNA, 1458 bp, Pseudomonas aeruginosa
gccgaagccctatcgccgttcgcgatagggcgtgcctcagaagaacgtcaggccggcctggaacagtcgctcgacgtcgcggatgtatttcttgtcgaccaggaacagcagcacgtggtcgccgctctcgatgcgggtgtcgccatgggcgatcagcacttcctcgtcgcgcaccagcgcgccgatggtggtgcccggcggcagcttgatctcgttgatcgagcgaccgatcaccttgctcgacttggcgtcgccatgggctaccacttcgatcgcttcggctgcgccgcggcgcagcgagtgtacgctctcgatgtcgccgcggcgaacgtgggccagcagggtgccgatggtcgccagttgcgggctgatggcgatgtcgatctcgccgccttgcaccaggtcgacataggcagggttgttgatcagggtcatcaccttgctcgcgccgagccgcttggccagcagcgaggacatgatgttggcctggtcgtcgttggtcagggcgaggaacacgtcggtctcgccgatgttttcctccagcagcaggtcgcggtcggaagcgttgccgttgagcacgatggtgctgtccagggtatccgagaggtgccggcagcgcagcgggctgcgctcgatgatctttacctggtagcggctctcgatggcctcggccaggcgctcgccgacattgccgccgccggcgatgatgatccgcttgtagctgtcgtcgagcctgcgcatctcgcccattaccgcgcggatataggccttggcggcgatgaagaagacttcgtcgtcggcctcgatcaccgtgtcgccctggggaatgatcggccggttgcggcggtagatcgcggcgacgcgggtatccacgttcggcatgtgctcgcgcagctggcgcagctcctgccctaccagagggccgccgtagtaggccttgatcccgaccaactgcgccttgccctcggcgaagtcgatgacttgcagcgcgccggggtgttcgatcaggcgcttgatgtagttggtgaccacctgctccgggctgatcagcacgtccaccgggatcgcctcgttgtcgaacagcccggtacgggtcaggtaggccggctcgcggacgcgggcgatcttggtcggggtgttgaacagggtgtaggcgacctggcaggcgaccatgttggtctcgtcgctattggtcaccgccaccagcatgtcggcgtcgtcggcgccggcctggcgcagcaccgtggggaacgaggccttgccttgcacggtgcggatgtcgaggcggtcgccgaggtcgcgcaggcggtcgccgtcggtgtcgaccacggtgatgtcgttggcttcgctggccaggtgctcggccagtgtgccgccgacctggccggcaccgaggatgatgattttcatggcaggacacggctcgtcaggtttcgatcaacggggcggaaatcttga

SEQ ID NO: 5271 - DNA, 1710 bp, Pseudomonas aeruginosa
  unsure (579): Identity of nucleotide at the above locations are unknown.
acggcttctgcaacaggcgcgcggccagggcctgcaggcgcggttgccagcgcgccgcgccgaaggccagctcctgggtcaggccgcgatcgcgcggggcgaccttgtccagttgcggcggcaacgcgccagacagcgaggcgcgtccggcgagcaccgcggccagcgcctggcaggcggcgagacgcgggttcattggccgagcacctggccggcggcgaattgctcgcggcggctgttgtagaggtcggcgaaggccagtggcttgccgccaggcaattgcaggcgggtcaggcgcagggcgccttcgccgcaggcgaccagcaggccgtcgcggctggcctcgaggatggttccgggcgccccgctgccctgccccaggctggcgccgaggactttcagcggcgcatcggcgaggctggtgtggcagaccggccagggggtgaaggcgcggacctggcgctccagttcgacggccggacggctccagtcgaggcgtgcctcgtccttgttcagcttgtgcgcgtaggtggccagggcgtcgtcctggatctcgccatgcagggtgccggcggccangccggcgatggcttcgaccaccgctttcgggccgagcgcggcgagccggtcgtgcaggctgccgccggtgtccgcggcggaaatcggcgtgctcaccttgagcagcatcgggccggtgtcgagccctgcttccatctgcatcacggtgacgccgctctccgcgtcgccggcttccaccgcgcgctggatcggcgcggcgccgcgccagcgcggcagcagcgaggcgtggctgttgatgcagcccaggcgcgggatatcgagtaccgcctggggcaggatcaggccataggcgaccaccaccatcaggtccgcgcgcagggccgccagctccgcctgggcctcggcattacgcaggctctgcggctgcatgaccggcaggccatgctccagggccaggctcttcaccgcgctgggcatcagtttctgcccgcggccggccggccggtcaggctgggtgtagacggcgacgatccgatgtggggtgtcgagcagggccttgagatgctcggcggcgaattccggggttccggcgaagacgatgcgcaatgcttggctcatgcggggctcgctaaaagaaaaaggcttgccggggcaagcctttgggggatggggtcacgcctgctgtcgatgctgcttttccagcttcttgcggatgcggtcgcgcttgagggtggacaggtagtcgacgaacagcttgccgttgaggtggtcgcattcgtgctggatgcataccgccagcaggccttcggcgacttcctcgaaggggttgccatcgcggtcgagggccttgatccggaccttctgcggtcggtccacgttctcgtagaagccgggtaccgacaggcagccttcctggtactggtccatatcctcggtcagcggttcgaactcggggttgatgaataccctcggctcggacttgtcttcgctgaggtccatgaccacgatgcgcttgtgcacgttcacctgggtcgcggcgaggccgatgcccggggcttcgtacatggtttcgaacatgtcgtcgatcagctggcgcaccgcgtcgtcgaccacctccaccggtttggcgatggtccgcaggcgcggatcggggaattcgagaatgttcaggatggccatatgcgtttgtga

SEQ ID NO: 5272 - DNA, 1131 bp, Pseudomonas aeruginosa
aaatccgctgctaagatggcgcgcagcttgaaaacggcttcagaccgcgattctcgcgggcttcgggcgtttcgcgtatgtcgacatgataaagggattcactgcatgaggaaatcactagtcgcccttctgctccttgccgcgagcggtctggcgcaggcccaggtcgacctcagggaagggcatccggaccgctacacggtggtcaggggcgataccctgtgggacatctcggggaaattcctccgccagccatggaagtggccggaactctggcacgccaacccgcagatccagaatccacatctgatctaccccggcgacaccctcagcctggtctacgtcgatggccagccgcgcctggtgctgaaccgtggcgaatcgcgcgggaccatcaagctgtcgccgaagatccgcagcacgccgatcgccgaggccatcccgaccatcccgctggacaagatcaacagcttcctgctggccaaccgcatcgtcgatgacgagaagaccttcaccagtgcgccgtacatcgtcgccggcaacgccgagcggatcgtcagcggcaccggcgaccgcatctacgctcgcggcaagttcgccgacggccagccggcctatggcatcttccgccagggcaaggtctacatcgatccgaagaccaaggaagtcctcggcatcaacgccgacgacatcggcggcggcgaggtggtggccaccgaaggcgacgtcgcgaccctggcgctgacccgcaccacccaggaagtgcgcctgggcgaccgcctgttccccaccgaggagcgtgcggtgaattccaccttcatgcccggcgagccgagccgcgaggtgaagggcgaaatcatcgacgtaccgcgcggcgtgacccagatcggccagttcgacgtggtcaccctgaaccgtggccagcgcgacgggctggccgagggcaacgtgctggcgatctacaaggtcggcgagacggtgcgcgaccgcgttaccggtgagtcggtgaagattcccgacgaacgcgccggcctgctgatggtgttccgtacctacaagaagctgagctacgccctggttctgatggccagcaggccgctctcggtaaccgacagggtgcagaatccctga

SEQ ID NO: 5273 - DNA, 837 bp, Pseudomonas aeruginosa
tgtgggacgacccgggatacccggcactgctcgccgaagtcgccgatgccccgccgctgctgtacgtcgaaggcgctccggagactctggaacggccgcaactggcgatggtcggcagccgccgcgccagccccgccgggctggggcaccgcccggagctttgcgcgcagcctggcgcagggcggcttcgccatcaccagcgggctggccctgggcatcgatggcgccgcccacgagggcgcgctggaggctggcggcgcgaccgtggcagtcctcggcaccggcctgcgcaggctctatccgcggcgccacgaggcgctggcgcggcgcatcgtcgagggtggcggcgcgctggtttcggagctgccgctggacagcccgccgctgccggcaaactttccccggcgcaaccgcatcatcagcggactctcgctgggtgtgctggtggtcgaggcaagtcccgccagcggctcgctgatcaccgcgcggctggcggcggaacaggggcgcgaggtgtacgccattccgggttccatccaccatcccggcgcacgtggctgccaccaactgattcgcgatggcgcgctgctggtggaaagcgtcgggcacgtgctcgaagcactgcgcggctgggcgcaggcggagccagcggaagcgccggcgcagcccctgccccaccctttgctggcgctgctgcgcgccgcgccctacaccagcgaaggcctggccgccgccagcggcatgacgctgcccgatgtgctggcgacgctcagcgaactggaactcgacggccgggtcgcctgcgaggccggcacctgggtgcatcgctccggctga

SEQ ID NO: 5274 - DNA, 402 bp, Pseudomonas aeruginosa
ccccctactacgcccacgaggaagactgcgtgcattggcaccgggtcgctcgcgacgcctgcgcgccgttcggcgcggacgtctacccgcgctacaaggaatggtgcgaccgctacttccacctcaagcaccgcaacgagccgcgcggcatcggcggcctgttcttcgacgacctcaaccagtgggacttcgacacctgcttcgccttcatccgcgccatcggcgatgcctatatcgacgcctacctgccgatcgtccagcgccgcaagcacacgccgttcgatgaacggcagcgagagttccaggcctatcgtcgcggtcgctatgtggagttcaacctggtcttcgatcgtggcaccctgttcggcctgcagtccggcggccgtaccgaatcgatcctga

SEQ ID NO: 5275 - DNA, 585 bp, Pseudomonas aeruginosa
ggaccctggtgcgggacaagctggtgcgccatcgctatctgcaccagatcggcctctacagtgatttccaccatgagtccgatgcgctgcgggaactcgccggcaaggtcagcgacaaggacgccgaggcctactatcggcgcaacctggagcgttaccgcaacgtcgcgcaggtgcaggcggcgcatatccgcctggccgaccaggcgagcgcggacaaggtctacgccgagttgcgcagcggcctggcccttcgacgaggcggtacgccgctattccctggccgacgacagggaccgcgacccgcccggcgacctaggcctgatacggccccaggacggccggctcgacctgctgcgcaagactgcgctgatccagaaggccgatacggtttcccagccgatgcgcatcgacggcgcgttcgagatcgtccgggtgcgtagccgcgaggatcgccagttgcccctcgacgaccgcagcgtgcgcttcgaggtgaaccaggcggtggcgcgcgagcaactggcagcgcagttcgagacgcgcctgcgcaacctgctggccggcgccagggtggaaggcctgtga

SEQ ID NO: 5276 - DNA, 471 bp, Pseudomonas aeruginosa
cctgcgccggcgtgttgctggcgcctgccgatatggccgcttcctcgtcttctccgtcgccagccaggacgcttgcggcactgcccgcggtcgacgaccgtccgccgccgccggcgccggtgcgatcgcaagcggcagcaccggcgtacgaggcggagcctccggcggcggaactggatcgcgagcaggcgatccagttcatgcagatgctgcgcgacgagggcgacccgcgcagcccgccgctcggcggcctgcaaccacgccagggcgcgacggcgcaggagctggccgatccgaagcagtaccaggccttcgaggaacgacagacccgcgaactggtacaggcctacaccagcggcgtacagcagataccggaaatccgcgcgcggatcgaggcggccgaacagggtggcgagcgcagcgccgaggaaatcgacgaggctcgcgccgcccttggacagttggagatga

SEQ ID NO: 5277 - DNA, 669 bp, Pseudomonas aeruginosa
agcgcgcggagcgtcgggcggtcgatcaggccccaggcgatcagcaggatgcctgcggccatcgccggcaacggtacatgctcgatcaggcgcgcaccgagcacggccagcagtgccacccagagcgccgaaaacgcacccgccagcggggagcgcgcaccggcttccagattcagcccggagcgggtgaaggagcccgccgacaggctcgccgacagccaaggcccgagcaggttcgacaggccctgggcgcggacctcctggttggcatcgaacgcgtctccctggcgcgcggccagggcgcgggcgatcgacaggctggtgaccagcccgagcatgccgcaggccaccgccgcaggtagcaggtcgaggatcgatcgggaatcgaagaccagcggattccagcccggcagtgcgctcgataaggcctgcacatgggctaccgaggcgaaggtcccgggtagcgcccagaccagcgtggcaccgcccagcaagccaagcagcagggccggccagcgcggtcgcaggcgcctgaccagcaggctgagcgcgaagctgaagccgcccaccagcagcgatgggccatcgaactcggcgaaccgcgccagcagccgccagccgtttcccggcgctgcgccctccccgctcgcggccaggccgagaagatag

SEQ ID NO: 5278 - DNA, 1227 bp, Pseudomonas aeruginosa
gggtgccctcggcggtgtattcgccgatcacatcgtcatgccccgctgccgtcgcgcaggtgcggcagcagcgagcggccttccagcggcaggcgtggatcgactggcccgccggcccagctccaccagggtcggcagcaggtccacggtggataccgaagcgccgatgcggcgcggcgcgaagcgcgccggcgcatggaccagcagcggtacgcgcgcggccatctcgaaccagtgcatcttgtaccagaggccgcgctcgccgagcatgtcgccatggtcgccggagaacaccacgatggtgtcgtcggccagcccgcattcctccagggtcgccagcagcgcaccgatctgtgcgtcgacgtagctgcaggcgccgaagtaggcacgccgggcggcgcggatgcgctcctcgggcaacggcttgtcccacaggtcgatgaccttcagcaggcgttgcgaatgagggtcctgctcctcctgggcgaagcgctggcgcggcagcgggatgtcctcgtcgcggtagagattccagtagctcgccgggatgctgtaggggtcgtgcggatgggtcatcgacacggtcaggcagaatggctggccggcgtgctggcgaacatggtcgtagaggtactggcgggccttgaacaccacctcctcgtcgaagtccagctggttggtgcgcacgcagggaccggcctgcaaaaccgaggacatgttgtggtaccagctcgggcgcacctccggctcgtcccagttcaccgcccagccatagtccgccggatagatgtcgctggtcaggcgttcctcgtagccgtgcaactggtcgggaccgcagaagtgcatcttgcccgacagcgccgtgcgatagccgaggttgcgcaagtagtgggcgtaggtgggggtatcggcggcgaaatcggcagcgttgtcccaggcgccgatgcgggtaggcaagcgaccgctgaccagggtgaagcgcgacggcgcgcagagcgggctgttgcagtatgccgagtcgaacaccacggcccgttcggcgaggcgcgagaggtgaggcatgcgcagcgccgagcgcggatcgtgaagcggcagcagcggcgcggccatctggtcggccatgatgaacaggatgttcggcgaggtcttcatcgggcggcttatcccatgcgattgggttatgcgatagtgctgcgtcgatcatcagtgcatcgaaatccctggtaa

SEQ ID NO: 5279 - DNA, 552 bp, Pseudomonas aeruginosa
accgcatggggctggatgcgttggataagccgggcttatgtgagaacacctcatgccgccatccctcgacctgctccgggtattcgagtccgccgcccgccaactcagcttcaccgctgccgccgaggaactggggaccacccagcctgcggtcagccagcagatcaaacgcctggagaaagagctggcgacccctctgttccagcgcgttcatcgaggcatcgtgctcaccgacgccggccagcttctgctccgccacgtggccgccggcctcgagacgatcgatgccggcatcgccgcgctgggcgcgcgccagcgccacgaggtgctccaggtggccaccgactacgccttcgctgcctactggctgatgccgcgccttccgcgcttccatcaggcccatccgcacctggacgtgagcctggtgaccagcgagcgcggcctggccggccagcgcggcgatatcgacgtggcgatcctgttcggcgacggtcgttccaagcacggcgaagcgcaccggctgtttcgcgaggaggtgttcccggtctgtag

SEQ ID NO: 5280 - DNA, 1302 bp, Pseudomonas aeruginosa
gctgggcgaagcgggtctgcaggcggctcatgctttcgactcctgttgcatgtggtgcatgacggtctgcatgtccttgtcgccgcgaccggacaggttcaccaccatgatgtgctccttgggcaggctgggcgcacgcttgaagacctcggccagggcatgggagctttccagcgccgggatgatgccttcgaggcggcagcaggtgtggaaggcctccagggcttcgtcgtcggtgatcgaggtgtactcgacgcggccggtgtcgtgcagccaggcgtgttccgggccgatgccgggatagtcgaggccggcggagatggagtgtgcgtcgatgatctggccatccgcgtcctgcagcaggaaggtgcggttgccgtgcagcacgccgggaaccccgccgttcaggctggccgcgtgcttgccggtgtcgatgccgtggccggcggcttccacgccgacgatctgcaccccggcgtcgtcgaggaacgggtggaacaggcccatggcgttggagccgccgccgatgcaggcgaccagcgaatcgggcaggcgcccttccttctcggccagttgctcgcgggtttccttgccgatcaccgcctggaaatcgcggaccatcgccgggtacggatgcgggccggcgaccgtgccgatcaggtagaaggtgctgtcgacgttggtcacccagtcgcgcagcgcctcgttcatggcgtccttcagggtaccggtgccggcggtcaccgggatcacctcggcgcccagcagcttcatgcggaagacgttggcctgctgccggtcgatgtcggtagtgcccatgtagatcacgcactgcaggccgaagcgcgcggcgacggtggcggtggccacgccgtgcatgccggcgccggtctcggcgatgatgcgtttcttgcccatgcgccgggccaggaggatctggccgatgcagttgttgatcttgtgcgcgccggtatggttcagctcctcgcgcttgaggtagatcttcgccccgccgcagtgctcggtcaggcgctcggcgaagtaaagcgggctcggccggccgacgtagtcgcgctggaagtaggccagttcctcctggaacgccgggtcgtccttggccttctcgtactcgcgggcgaggtcgaggatcagcggcatcagggtctcggcgacgtactggccgccgaagcggccgaacaggcccttggcgtcggggccgttgcgataggaagtcatggagggctccaggaaatgacgtatgggcagaatctaatccccccgccgggtaaaagaaaccgataa

SEQ ID NO: 5281 - DNA, 723 bp, Pseudomonas aeruginosa
cgcctgcggcgatgcgttcgagcgactgcgtggcgtctgtgccgagctgcgccggcagaccgccgaggccccgttcgtcctcggcgtacccggcagcctgctggcgcgctggttcatcccgcggctggaccagctcaaccgtgccctccccgacctgcgcctgcaactgtccaccagcgagggcgagttcgatccgcgtcgtcccggcctggacgccatgctctggttcgccgagccgccctggccggcggacatgcaggtcttcgaactggcgcccgagcgcatgggcccggtggtcagcccgcgcctggcgcaggaaaccggcctggcccaggcgcccgccgcgcggctgttgcaggagccgctgctgcataccgcctcgcgaccccaggcctggccggcctgggccgcgagccaggggctggcggcggaggcgctgcgctatggccaggggttcgagcatctctactacctgctggaagcggcggtggcgggcctcggcgtggccatcgccccggaggcgctggtccgcgacgatctcgccgcgggccgcctggcggcgccctggggcttcatcgagaccgatgcgcgcctggccctgtgggtaccggcacgcctccacgatccgcgtgccgggcgcctggcgcaatggttgcgggagcagttggcaggctgagcgctggcgatttgctgcacttttccggctcggctagtgtccattga

SEQ ID NO: 5282 - DNA, 1770 bp, Pseudomonas aeruginosa
aatcgtggctctccatcgcctggcctttatcttcctgtgcctgccgctcatggccagcgccgcccccttcacctcccccggcgaccgcgacctgatccgcgaccgccagcagcgcctgctggacgaacagcgcaagcgcctggaggaactccagcaactgcccggcaagggagcgcccgccgctgcggatgcctccggcgacgacgagcgctgcttcgagatccgccgcatcgagctggagggcgccgggcacctcggcgaaagcgcgcgtcgccaactgctggcgccctaccaggggcgctgcctgggcgtcggccagctcaatgcgctgctcaaggccgtcaccgaccattacctggatcgcggctacgtcaccacccgtgcctacctgccacagcaggacctggcctccgggaccctgcgcatcatcgtcgtcgaaggccgcctggagggcctggacagctccgcgctggccagcccgcgcgaactgacgatgagctttccgggcaggaccggcgagttgctcgacctgcgcgaactggagcaactggtcgaccagttgagtcgcctgccgtcgcgccaggcgcaactggagctggtgcccggcagcgaggtcggcggcagccgggtgcgtctcaagggcgagcgcgacaagccctggcgggtctccgccacgcgcaacaacgacggcgacgtcagcactggcgagcagcagatgggcctgggtctggactgggacagcccgctgggcctggccgaccagctcaacctgcgcgccaaccgcgacgcggtgaccgaccgctggcgccattccgacagccagagcctgttctacagcctgccctggggctggtggaccttcacctacggctacagccagagcgactaccgcacgcgcaacgaggccagcggcttccccttcaagctcgatggcgacagccgcagccaccagttccgcgccgaacgcgtgctgcaccgcgacggtgtgagcaagaccgccatgagcctggggctcagccaccagcgcaccaacaactatgtcgaagacacccgcctggaagaccagagcacgcggatcaccgagacccagctcggcttcaaccatggccggcggatcggcagcggtttcgtcaacctcgacctcggctggcagcagggcatcggcgcccttggcgcgcagggtcgcggccacccgcaggcgggcgatccgcatgcgcgctacgacaagtacagcctgaccctcagctacctgcagccgttccagctatggggcgagcgcttcagcttcgacagcctggccaccgggcaaaggagcgaggacgtgctgttcagcccgcagcgcatcagcctcggcggcaacagctcggtgcgcggcttcaaggaccagaccctgaccggcgacagcggcggctactggcgcaaccagttgcgctggcggcgcgcggtggaatgggcgccgctgcggccctggctgcaggaatacggcgtggccttcgcctacgacgtcggcgtgatccgccacgaccgctacaacgacggcgccagcgggcgcatgagcggcaacgccatcgaactggatgcccgcggccgctatttcgccgccagcgtcggcttcgcccgctcgctggagcggcccagcgccatcgagcggcgcgagcacccgatctatttccgggtcgacgcgttcttctgaagacgcggcgacctcctgaacgctttaggaaagcgcctacctgcatcgaggccctttccttggaaaaccttgcttaa

SEQ ID NO: 5283 - DNA, 6876 bp, Pseudomonas aeruginosa
acgtcctcgacaaccgccagggcggcgagatttccagccagcagggcttcgagctgctggccaggcgcatcgacaacggccagcaggggcgcatcatcagcgccgggaaactgcgcctggacgccgacgcgctgggcaacgccggcgccggcctgctctccggatggccagggcctgacggtgaccaggcgggagcctggacaacagcgccggcggcaccctttcgagcaagggacggcgagctggccatcaccctcggcggcgcgctggacaaccacggccagggcgcctgggtcagcaagggcgcgcaacggatggacgccgccagcctgggataacgcccagggcatcgtctccggcgaaagcgacgtgaccctgagcatcgccgggaagctggacaacggccagggcggcctggtctcggcgcagcgcgcgctgagcttcgagcgcgacgatacgctgctgaacaacgccggcggccggatcaacggcggcagcctgctgctcaagggcgccagcctggataacagcgacggccagttgatcagccagggccggctcgacgccatcctcggcggcgccctggtcaacgccggcgcggcgcgcctggccagcggcggcgacctgctgctgcgcagcgccagcgtcgacaaccgcggcggcaagctggtcagccaggggctgctggagatcaccaccggcagcctcgacaacagcgcctccggcaccctcgccagccaggccgacatgagcctgcgcctgggcggcggcgccctgcgcaaccagcaggacggcctgatcttcagccaggccggcgccctcgaggtgcaggccggcagcctggacaaccgccagggcacgctccaggcccagggcgacaaccggctgcgtatcggtggcgcgctggacaaccagggcggccgcctggacagccgggccggcaacctcgacctgcagagcggcagcctcgacaacggcgccggcggcgtgctcaacagcgccaagggttggctgacgctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggtggcggcctctacgccagcggcctgctcagcctcgacggccagcgtttcctcaaccagggcgcggcggcgggtcagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagcacgcggctggtcgctggcggcctgaacaacgcctacggcgtgctggaaagcgccaaccaggacctcgacctgcaactgggcagcctggccaacgccggcgggcgcatcctccacaccggcaatggcaccttcggcctggattccgggcaggtgatccgcgccggcggcgaactgaccaccaatggcctgctggacatccgcgccagcgaatggaccaacagcagcgtgctgcaagccggacgcctgaacctggacatcggcaccttccgccagacggccgagggcaagctgctggcggtgcagtccttcactggccgcggcggcgactggagcaacgacggcctgctggccagcgacggcagcttgcgcctcgacctgagcggcggctaccgtggcaacggccgcgccaccagcctcggcgacttcgccctgaacgccgccagcctcgacctcggcaacgccgccagcctcgccggcggcgccaatgtcacgctcggcgccggcaacctgctggtcaaccgtgggcggatcaccgccgccggcgacctcgtggccagcgccgcgagtctgaacaactacggcaccctgggcggcggcggcagcctgcgattgaacgcgcccgccctgctcaacgagcgcgggttgctgttcagtggcgccgacatgaccctgcgcgccggcgacatcaccaacctctacggggatgtgtacagcctcggcaggctggatatcgcccgcgacgatgccggcaaccgtgccgccagcctgcgcaacctttccggggtgatcgagagcggcaaggacttcagcctgcgtgccagcctgatcgagaaccgtcgcgccgtgctggaaagcaagtcgggcctgtacaccgcgaagatggagcagaccgcctgcatcgaaggcgtcaacgcgggcgactgcagcggcaagcgcaacgccatctggaccatcacccagcgcgacaagaccgaggtcaccgccagcagcgccatggggcaactgctggccggaggcgacttcgccatcgacggcggcaccctgaacaacctttccagtctgatcggcagcggcggcaacctcaccgccaacctcgaagtcctcgacaaccagggcctggaaaccggcgagctggaaaccatccgcgtgctgcgtaccgctcgcggcggcgatatcggcggcatcgaccagaagtcgcgcaacttcaccaacctctactggtaccagagcgccaatttcgacccggcgcgcgcgggcgagatccccgccgcgctcaacgcgatcctcagcgactggtccttcgagtacgaattcccgagcaaggggccgaccccgatcagcagtggcgaccagtcctacgcagcggtgatccaggccgccggcgacgtcacggtcaatgccagcacgcgcatcgacaacggcgtcacccgccccggctacaccttcgtcggcagcggccgccaggtgggcgacagcgcggtgggcggcagcggggtttcggtggtcgtgccgctgacctcgcaactgccgcccgacctggcgcggcgccaggtcaacccggttaccctgcccggcttcagcctgccccagggtgacaacggcctgttccgtctcagctcgcgcttcgccgaggacggcaatggcagcgccgcgctcggtgccggcgccgaccgcacccagggcggtagcggcgtctcggtcggccagcaaggcgccggcaacgccgccggtacctggcagggccagggcgtgcgagtcgacggcctggctggcgcggccaacgtccagggtcagggcggcagcacgctcggcggtagcctgccgggcgtcgcccgggtccagggcgtgcccggcaacgccacgccgagcgccagccacaagtacctgatcgagaccaacccggcgctcaccgaactgaagcagttcctcaactcggactacctgctcagcggcctgggcatgaacccggacgctagcaagaagcgcctcggcgacggtctctacgagcagcggctgatccgcgacgcggtggtggcgcgcaccggccagcgctacatcgatgggctgagcagcgacgaggcgctgttccgctacctgatggacaacgccatcgcttacaaggaccaactgcacctgcaactgggtgtgggtctgagcgcggagcagatggcggcgctgacccacgacatcgtgtggctggaagaggtcgaggtgaacggcgagaaggtcctcgcgccggtggtctacctggcccaggcggagggtcggctggcacccaacggtgcgctgatccagggccgcgacgtgaagctggtgagcggcggcgacctgcataacgtcggcaccctgcgcgcgcggaacgacctctcggcgacggccgacaacctcgacaacagcggcctgatcgaggccggcaagcgcctcgacctgctcgccggcgactcgatccgcaaccgccagggcggggtcatcgccgggcgtgacgtgagcctcaccgcgcttaccggcgacgtgatcaacgaacgcagcgtgacccgctacgacagcgcgctcgacggccgcacctgggaacgcagcttcgccgacagcgccgcgcgggtggaggcggcgaacagcctgaacgtccaggccggacgcgacatcgccaacctcggcggggtgctgcagagccgcggcgacctcagcctcgacgccggacgcgacgtcaccgtcgccgccgtcgaggaccgccagggccagacccgctggagcacgtcgcggctccagagcgtgacccagctcggcgccgaagtcagcgccgggcgggacctgaacgtcagcgccggccgcgacttgacggcggtggccagcaccctcgaagcgcgccgcgacatcgccctctccaccgggcgcgacgtgaccctggcggcggcggcgaacgaggagcatgcctacagcaagaccaggaaggtcacctaccaggaagacaaggttgcccagcaaggcacccgcgtggacgccggcggcgacctggcgatcaatgccggacaggacctgcgcctgatcgcgagccaggccagcgccggcgacgaggcctacctggtggccggcgacaagctggaactgctggccgccaacgacagcaactactacctgtacgacaagaagaagaaaggcgacttcggccgcaaggaaacccggcgcgacgaagtcaccgacgtcaaggcggtgggcagccagatcagcagcggcggcgacctcaccctgctcagcggcggcgaccagacctaccagggcgcgaagctggaatcgggcaacgacctggccatcgtcagcggcggcgcggtgaccttcgaggcggtgaaggacctgcaccaggagagccacgagaagagcaagggcgacctggcgtggcagtcgtcgaagggcaagggccagaccgacgaaaccgtgcgccagagccagatcgtggcccaggggaatctggcgatcaaggccgtggaagggctgaagatcgacctcaagcatatcgaccagaagaccgtgagccagaccatcgacgcgatggtgcaggcggatccgcaactggcgtggctgaaggaggccgagcagcgcggggatgtggactggcgcatggtgcaggaggtgcacgatagctggaagtacagcaactcgggcatggggccggcgacgcagatcgctgtcgccatcgcggcggcagccatcggtggcatggcggcagcgggagcgctcagtggtgcaggagtgggtgccagtagcttcgccatgggcgcaggagttggtgcggcaggaagcctgtcgggcacggcagcggtcagcctgatcaacaacaagggcgatctcgggaaggtgctgaaagacagcttcagtagtgacagtctgaagcagattgctattgcgagcctgaccggggggctgacggctgagtacttcgacgggattcttcagaccaagactgatccgcttactggaaaggtcacggtagacctcagcagcctatctggtgttggtcgcttcgctgccaatcaggcgatgcagaacgctacatccactgtactgagccaggccttgggccagggcgggagcctgaacgaggcgctgaagagcgcgctctacaacagtttcgcggcggcaggtttcaacttcgtcggcgatatcggccaggaatacagcctgaagccaggcgatccttcgatggtgaccatgcacgccctgatgggtggcctggcggcgcaggtcagcggtggcgatttcgccacgggcgccgcggcggctggcgccaatgaagcgctggtggccaagctagaccaggccttcaagagcttgagccctgagaaccgtgaagccatggtcactatggggtcgcaattggttggtgttctggctgcggcggtacgcgatcccgatgcgacaggcaaagctctggaaagcgctgcttgggtagcgaagaactcgacgcaatacaacttcctcaaccatcaggatgtggccgatctggataatgccttgcagaaatgcaagtcccagggaaattgccgtcaggtagaggaagagttcaaggcgcgtagcgacgagaaccggcggaggttgaatggctgcgtggctgtgggtaattgcgcggagattcgtgcggagatcgatgcggggtctacggctctcaacgagctggtggcccggcaggaaacagctaatccgggaggaagtgacagcgatatagcctacggtttcctgatgggccgaaatgttgtcgactggacgacggctggtcagttgcacctggagcagaccgccaacctctggtggaacggtaatccacagtggcagaaggaagtcggtgcatacctggaccagacggggttcaatccgttcggaatcggcgttccggcaatgggcggtgccgctggcaaggtaacggccaaggcgctcatgaatgcgctgaaggcgggagagttgcccaaaggagaggtggccccaggaaaggctaatctgcctaccattggggcgttggcggatgctgaggcgggaatgccttatacccatccagttaagctcgccgcaaaagcgactgggacagcagggaagattaagattgaagccggcgcaatacctgacgcaaatgaagtacgtgcaggacaagggttatctggtcttgggtacgatgttacgcaccaaaccactgcgtcagctaaaggtattcaagggcagcgaactgcggacttgcatgttgatggactcggttccattgatgtgtatacgccgaagaatcttgatccgacaaagatagttcgagcgatagagaagaagtcgaatcaagccggcggagtcttggtgcaggcggacttgccaagcactgacatgtcgtccattgctgctcgtatgtgggggaagactaacgcgcagagtataaaaactatatttttccagaaaccagacggatcattggtccgatttgatcgacctgctggaggaggctga

SEQ ID NO: 5284 - DNA, 183 bp, Pseudomonas aeruginosa
ttggtgcaaaagcgacaggtggagccgatcaaactgcgggctcaatcaagaatgttaatccgggttatccagaagctggtcgaactcataactgtgtcaattgctctattgctactgatgcaacactggcaggaaatcctgcatcggccttgccaatcaaccatacgaagggtgttccgttga

SEQ ID NO: 5285 - DNA, 522 bp, Pseudomonas aeruginosa
tacaccggaaaccgccgtctcccgttgaacgggcgggccccggccccctaccattcgcagcacaccgacccgcgcaaagggagcgggatgccgcgtaggcaggccgccatggaaggagaagcacatatgccggtactggctctgagactcaccgccctggcggcccttgtgatcagcgtgtcggggtgcgtcatggaggcctatggcagtcgcgcgcgtagcgatgcgcaatcctggatcggcttgccgatccaggacgtgatcaagcgcttcggcgagccggaacgcgtgacgggggatgccgccaggcagaaatacgtgtggaaggagtacgagaactatagccacgactacgactacacctactacgagcagggccatggcaatacgcccaacagctcggtcctgaaccagaagaccggcacggccaaccagagcggctattacacctgcatctacgagttctttgccgacgcctcgggcagggtggtcgatgcgaccgcgcggggtgagtgccgctag

SEQ ID NO: 5286 - DNA, 900 bp, Pseudomonas aeruginosa
gttgagccaggccgtggccgggcgcctgggacaggtcgaggcccgccaggtggccactccccgggaggcgcaacaactggcccagcgccaggaagcaccgaagggcgagggcctgctctcccgcctgggggccgccctcgcgcgtcccttcgtggcgatcatcgagtggctgggcaaactgctggggagccgtgcccacgcctccacccaggcgccgctctcccgtcaggacgcgccgcctgccgccagtctctcggccgccgagatcaagcagatgatgctgcaaaaggcactgcccctgaccttgggcggacttggcaaggcgagcgagctggcgactttgacagcggagaggctggcgaaggatcacacgcgcctggccagcggcgacggcgccctgcgctcgctggccaccgccctggtcgggattcgcgatggcagccggatcgaggcttcccgtacccaggctgcccgcctgctcgaacagagcgttggggggatcgcgctgcaacagtgggggaccgcgggcggtgccgccagccagcatgtactcagcgcaagcccggagcaactgcgcgaaatcgccgtccaactgcatgcggtaatggacaaggtcgccctgttgcgccacgcggtagagagcgaggtaaagggcgagcctgtcgacaaggcgctggcggatggcctggtggagcacttcgggctggaggcggagcagtacctaggcgaacacccggacgggccgtacagcgatgccgaggtgatggcgctcggtctctataccaacggcgagtaccagcacctgaatcgttccctgcgtcaggggcgagagctggatgcgggccaggcgttgatcgaccagggcatgtctgccgcgttcgaaaagagcggaccggctga

SEQ ID NO: 5287 - DNA, 438 bp, Pseudomonas aeruginosa
  unsure (435),(438): Identity of nucleotide at the above locations are unknown.
atccaaggaggcccaggcgcaggcgctggaagccgacctcgagaagatccgggcgaagaacggcgcggtgccgccgggctaccacgcccagctggggctgctctattccagcatcggcaaggacgaccagatggtccgcgagttcgagaccgagaaggcgctgtttcccgagtcggcgacctacatggacttcctcctgaacaacgcccgtggaggtgcccgttgaaactcgcccgactgtccggcctggtggccggtttcaccctgctggccctgctcggcggctgcgcgccgaccaagagcgtcgactactcggcgttcaagcaggccaagccgcgctcgatcctggtcctgccgccgctgaacgagtcgcccgacgtgaaggcgacctacagcatgctctcgcaggtcaccttcccgctggccgaggccggntan

SEQ ID NO: 5288 - DNA, 450 bp, Pseudomonas aeruginosa
tacgtagtgccggtggcgctggccgacgagaccttccgccagaacggcctgaccagcgccggcgacgtgcaccaggtgtccccggccaagctgcgcgagatctatggcgccgacgcggcgctgtacgtcacggtgagcgactacggcacgcgctacatggtgatcagcagcgcgaccatcgtcaccgccagcgccaagctggtcgacctgcgatccggcaccaccctgtggaccggctcggcgaccgcctccagcgaggaaggcaacggcggcaacaacggcggcctggtgggcatgctgatcaccgcggcggtcaagcagatcatcaacagttcggtggaggacgccggttatccgatcgccgggatgaccagtgcgcgcctgctctcggccggccagccgggcggactgttgtacggcccgcgctcgccgaggtacggcagcgactga

SEQ ID NO: 5289 - DNA, 504 bp, Pseudomonas aeruginosa
gtcgatgcgctcctccaccaggttgaccacctggctgttgacctgcaggtcgatggcggtgcccgggtagcgctcgacgaaggcggcggcggcacgggtcagccaggcctgggcgaaggacaggctgctggtgatgcgcagagtgccgcgcgggctgtcgcggcgggtctggccggtggcctgcatggcgtcggccacggcgagcatctcgcggcactgcggcaacagctccgcgccggcgtcggtcaggctcaggcggcgggtgctgcggtgcagcaggcgtgcgccgacccactcctccaactcggcgaggtagcgcgagaccatcgcccgggacatgtccagacgctcggcggcggcggtctggctgccgctgtcgatgacttcgacgaagacgcgagtggcggtcaggcggtccatgattcgctcgatccatgcaacaaagctgtgattattgcggggctttttgcgcgctttcaagcaactaacatggcaagcctctga

SEQ ID NO: 5290 - DNA, 513 bp, Pseudomonas aeruginosa
acttgtccggctgcgtcgtcctcccatgtagacatgcccgctcgccgacgcgagcggatgtccatccacagctccggaggagtcgacatgaagaagacggcatcggcggtctggcaaggcggcctgaaagacggcaagggcaccctttccaccgaaagcggcgcgctcaaggacaacccctatggcttcaatacccgcttcgagggcgcaccgggaaccaacccggaagagctgatcggcgcggcccacgccggctgcttcagcatggccctgtcgatgatgctcggcgaggccggcctgaccgccgaacgtatcgagacccgcgccgaggtcaccctcgacaagcagtccgacggtttcgccatcactgccgtgcacctggtgctcagggcgcgcgtgccgggggcggacgcgcagaccttcgagcagatcgccaacaaggccaaggccggttgcccggtatccaaggtgctcaacgcgaagatcagcctggacgccagcctcgacggctga

SEQ ID NO: 5291 - DNA, 1629 bp, Pseudomonas aeruginosa
ccgcgccctgcgcgaagaggtatacgccgcctactgcacccgcgcctccgaccagggcccgaacgccgggcagaacgacaacggtccggtgatggaagagatcctcgacctgcgccaggagctggctggcctgctcggcttcgccaactacgccgagctgtcgctggcgaccaagatggccgagtccagcgaccaggtgctcagcttcctccgcgacctggcggtgcgcagcaagccgttcgccgcccgcgacctggagcagctgcgcgcctacgccgccgagcagggctgcaccgaattgcagagctgggacgccggctactacgccgagaaactccgcgaggcgcgctacagcgtgtcccaggaggcgctgcgtgcctacttcccggtggacaaggtgctttccggcctgttcgccatcgtcgagcgcctctacggcatccagatccgcgaactgcacgatttcgaacgctggcacgccgacgtacgcctgttcgagatcctcgagaacggcgagcacgtcggccgcttctacttcgacctctatgcccgcgccaacaagcgcggcggtgcctggatggacggcgcccgcgaccgccggcgcgacgcccagggccggctgatcgacccggtggcctacctggtgtgcaacttcaccccggcggtgaacggcaagccggcgctactgacccacgacgaggtcactaccctgttccacgagttcggccatggcctgcaccacctgctgacccgcgtcgagcatgccgccgcctccgggatcaacggggtggcctgggacgccgtcgagctgcccagccagttcatggagaactggtgctgggaaccggaaggcctggcgctgatctccgcccactacgagaccggcgaggcgctgccgcaggacctgctggagaagatgctggcggcgaagaacttccagtccgggatgatgatggtccgccagctggagttctccctcttcgacttcgagctgcacgccacccacggcgacggccgcagcgtgctgcaggtgctcgagggcatccgcgacgaagtggcggtgatgcgtccgccggcgtacaaccgcttcgccaacagcttcgcgcacattttcgccggcggatacgcggccggttactacagttacaagtgggccgaggtgctgtccgccgatgccttctcgcgtttcgaggaagaaggcgtgttcaaccccgataccgggcgtgccttccgcgaggcgatcctggcccgcggcggctcccgcgagccgatgctgttgttcgtcgatttccgcggtcgcgagccgtccatcgacgccctgctgcgtcactccgggctggtcggggaggccgcatgagcccggcgatcaccaggaagcgcttcatcgccggggcggtctgcccggcgtgcagcgaacaggacaagatccagatgtgggaagaggacggcgtgccgcaccgcgaatgcgtggcctgcggctacgccgacacgctcaacgcccagggccagtcgatcccgaaggagctgggtacgcgggtcaaccagaacgcgccgaagccggccaacccgaaggtgcagtcggtgcagttcttccccaatcccaagctgaagaagaagcccgacgcctga

SEQ ID NO: 5292 - DNA, 1179 bp, Pseudomonas aeruginosa
ccgctcgccgccgaccggcggcgatggctgtgggccggggcccggtgcgatactgtatccatatacagtatttcaccgggtttccctcatgagcgctcccctgcccccgcgcggtcgcggtaccgccagcaaccccctcaaccgcttcgccccgacccacagcgaggccttcgacgatggctgggagcaggacgtgccgccgatccagctcaccgaggtgcgcgaggagatcgcccgcacggtgatctcccgcaaccagtcgccggacctccctttcgatcgttcgatcaatccctaccgtggttgcgagcatggctgcatctactgctatgcgcggcccagccatgcctattgggacctctcgccggggatcgatttcgagacccggctgatcgccaagagcaacgtcgccagcgcgctggagcaggaactgagcaagcccggctatcgctgcgcgccgatcaacctgggcgccaataccgacccctaccagccgctggagcgcgaacgccgcctgacccgccaggtgctggaggtgctgctgcgcttccgtcacccgctgaccatcgtcaccaagggctcgctgatccttcgcgacctcgacctgctgcgcgaactggcggagcagaacctggtggcggtgatgatcagcctgaccaccctcgacgacgagctgaagcgcattctcgaaccgcgcgcggcggcgccctcggcgcgactgcgggcgatccgcacgctcagcggcaacggcatcccggtgggcgtgctctgctcgccgatgatcccgatggtcaacgacatggagctggagcgcctgctccaggcggcgcgggacgccggcgcgcgcagcgccgcgtacatgctcctgcgcctgccgcgcgaagtcgccccgctgttcgaggaatggctggcggcgcactacccgcaacgcgccgagcatgtgatgagcctggtccgccaatgccgtggcggcgaggtctacgacagccgcttcggccaccgctttcgtggccagggaccgttcgccgacctgctggcgcatcgtttcgcggtggcgatgaagcgcctcgggctggcaccgccgccagggcttcgggctggattgcagccggttcgccgtgccgggggcgcagatggcgttgttctagcgttttccccgcggtgcagcatttcgtatag

SEQ ID NO: 5293 - DNA, 945 bp, Pseudomonas aeruginosa
cgaggccgatcaggccttggcgcagctcggcggcgcccagtcgcccatgtccgggctgttgcagacttcccggatcatgccctggccctgggaggccaccttgttgccttcgctttgcgcgtcctgggccttgcggatggtctgctcggtggcgaccgcttccttcggcaccttgggattgctgccggtcttgggcttgctgccgcctttcgtagtgctggcgcggttctcggcctcggcgaccttggtcacctcggcgcgcggtacgccgacctgctgcaggtctttctcgtaggcctgggtgtagttgctgatgttctcgccggcacggccgttggcggcgaccagcaaggcgttggtctcctgcaggccgctgacgatctcggccaggcgcttgcgcccttcggcttcgttgatcgacttgttcttgcgaccgtcgagcagagccttgaactggctctggtagcagctttgcgccgacttggcgtaggccacgctacggttgatctcgacggtgctgcggtcgacgtcggtaccgtaggagccgatgcgcgcgcggtcatcgctgatctgcttctgcttctccatgtagtagcccgccgcgccgccggccagggcgccgcctgcggcagcgagggcggcattgcggccgcggttctcgtcgctggccaggccgccggccaggccgcccaggaggccgccggtaatggcgccggtgatggccgaattgcgcactgcgttatcggtgctgcgcaggtgcgacaccggctcgtagcaggacgggtagtattccgcgcgggtggtctgggcgaccgagccgacgccgctgctggcgcagccgctgagcagcacgccgctggcggtcaacaggcagagcgcgtagcgcgccgaggtgatcaaacggttttcgctgggttggctcattgcatctcactcctggtttga

SEQ ID NO: 5294 - DNA, 2547 bp, Pseudomonas aeruginosa
tcggcccaggccagcgagagcagcaggccggcgcgcatcagccaacttcctcgaggcaggcgccgacgctgtcgtcggcctcgcgttgccagcggatggccaggacttccaggccggctgcgcgagccaggcgctcgtcgtgggtggcgaccacggtgcaggcgccgcgctcgcgggcctgctccaccagcaggcgcatcacccgttcggcgttcagcgggtcgagcgccgcggtcggctcgtcggccagcaacaggcgcggcgcatgcgccagggcgcgggcgatggcgacccgctggcgctggccgaccgacagcgccgccggtttcttgtccagctggtcgccgatttccagccgatcggccagcgcctgcacgcgctcggcggatggggcgccgagcaacgcgcagggcagtccgatgttgcgccgcacatcgaggaattcgagcaacccgccgctttgcagcacgtagccgcagtgctgccggcgcagcgccgccaagcggtcctggcggccgtcgcgccagagcgcggcgatgtcctgcgggcgttccccggcgaggaattcgaagcgcccgcccgggtccggcgccagggccagcgccagcaggtcgagcagggtgctcttgccgcagccgctggggccgacgatggccagctggcgacccgcgcgcaattccagcgccggcacccgcaggcggtagcgctggcgaccggcgccgtggctgcgggcgacctcgtgcaggcgcaggatcatggcagcgtcgacagcggcacgcggtacagcgcgtcgccggcgtcggcgtcgccgaaccggacccagttggcgacgtcgttgtggaaggtttcgtagaggcggatcttcgactccagttcgtcgatgaagtcctgctgttcggcgacgctcagcgacagccagaggtcctgggtcatgttcagcgacttgctgcggtacggcaggccttccaggtattcgccgagcacgccgctctgcgccaggttgctgcccttcaccagttgcgccgggtcgcggctcatgtaggcgctggcgctggcgatttcctggaagaagtccttgggcgaggtctgggtgcgcttggccgcgtcgacgatcagtttcagcgactgttgcagttcgttgagttgcagcttgctcagcagcacgcaaacctggaacgccggcagcgccgggttggtcaggtcacggtcggcggtccaggcggtgacgacctgcggcgcgcgcaccgggtcgcggcgaccgaggaattccatctgcatggcgtagccgatggccgacgacttgctcgccacgcttggcgcggcgtcgaagcgcggcgcctgcggcttgcggttgccggcgtcgtggaccaggtcggcgaacaccgtgccgatctccttcaccgtgttgccgaaggcgttcacctcgccgccggccaccgggatgtagaggtcggcgatcttcgggttggcgtcggcggtgaggctgcggtactgctgctcggcgtagccgtggttgttcttcccggccggggtgcgcaggtgcagggcatagatcttcacgcccttgcgcagcgccgcctggcggacctcggcctcgttcatctgggtgcgcccgagcgggtcgttcttgcgcagcgcgccggcgtcggtgaccagcagcaccacgcgcccggcgtagggcgaccagtccatttcgtcgaccgcctgcatgatcccggcgaaggcgtcttcgttgaacgagtggctggagacgtcggtggcgcgcacctggctgctcaactcggcgaagcgctgcgcgtcgttgcccggttgcagcggcaccagggtcttgctgacgtattccaggccgggggtcttgtcggtgttgttgcggaaaccgaccaggccgaagctgaccttgtccaggtcgccgcgctcgccgatctgccgctgcaggccgtcgatcacctcgcgcacgcggtcgatgtagggctgcatcgacaccgaggtgtccaccaccaggacgatgccggtgcggaaggtgtcgctcgccgcgccgctggcgccgccatgcccggcctggcccggcgcctggggtgccgcggcgctgccgccggggtcgatcgaggcgacctccagcaactgcgccggctggccgtcggcgtcgaagctttccttcgagtcgaagatcggcagcaggtagaactggtcctgggggatcgcccggtcgttgggctcgaccgcgaccacctgcggatcgcccttgtggtccaccgcctgggtcagggtgtcgcgcgctgcgcgggtatcgccgagcaggcgctcgacctgctcggcgctgttgaggaacatcaccggcgcgcggccggagcgttcggtgaacttcagcaccaggctctgcttccagtcgctcaccgcgctggccggcagccagccgtcgccctcgccgttgctggaggcgccgacgcgcagccaggggctgccgccgacctgcttgcgggcgtacacgtagagcaccgagaaggccggcaccgcgccggcccggggcgggccgccagcctcggcgga

SEQ ID NO: 5295 - DNA, 288 bp, Pseudomonas aeruginosa
  unsure (2),(3),(4),(8),(12): Identity of nucleotide at the above locations are unknown.
cnnnacgncagngaccgttgcgcccttcttcattcaggaggtggtagcccggtgcgcggccgtgagcagcgtcagggcatcgccgccgagcgtgaccaggatgtgcgccacgcgctgaatgggaacgccctgccctgtccgcacttcgatcctttccaaggcatggaggaggccgaggagagccctgaggcgctcctgtacggattcgagcatctcattggcggaggcgttccggtgaacgtagagaatcgcttgctcgtatgggtattcgacataggacgggactga

SEQ ID NO: 5296 - DNA, 942 bp, Pseudomonas aeruginosa
gcgacctggcaggcgaccatgttggtctcgtcgctattggtcaccgccaccagcatgtcggcgtcgtcggcgccggcctggcgcagcaccgtggggaacgaggccttgccttgcacggtgcggatgtcgaggcggtcgccgaggtcgcgcaggcggtcgccgtcggtgtcgaccacggtgatgtcgttggcttcgctggccaggtgctcggccagtgtgccgccgacctggccggcaccgaggatgatgattttcatggcaggacacggctcgtcaggtttcgatcaacggggcggaaatcttgatcagcttggcatagtagaagccatggtggccctccacctgcggcagcaactggcggccgtggggctgtttcatgccccaggggccgggaaggtccagttcgcgggcgccgggcgtgcgggcgaggaaggcggcgatgctgtcgctgttttccgccggcatcaccgaacaggtggcgtagagcagtacgccaccgacttccagggtaggccacagcgcgtcgagcaattcaccctgcaggtgcgccagggcggcgatgtcttccggcttgcgcgccagcttgatgtccgggtggcggcggatcaccccggtggccgagcacggcgcgtcgaggaggatgcgctggaacggcttgccgtcccaccactccccggtggccctggcgtcggcggcgaccaggctggcttgcaggccgagccgctggaggttttcccggacccttaccaggcggctctcctcgaggtcgacggcgaccacttcggccagttccggctgggtttccagcaggtggcaggtcttgccgccaggcgcacagcaggcgtcgaggacacgctggccgggcgcgctttcgagctgctcggcggccagttgcgcggcttcgtcctggacgctgacgcgaccctccgcgaagcccggtag

SEQ ID NO: 5297 - DNA, 690 bp, Pseudomonas aeruginosa
cgctgcccgatgtgctggcgacgctcagcgaactggaactcgacggccgggtcgcctgcgaggccggcacctgggtgcatcgctccggctgaaaccgtacacttcgcgcaccctgtccgctggagtgagtcgatgatcagcagctttcgtgcgcaatgcgccgcccgggtcgtccgcgagggcggcgtgatcgcctatcccaccgaggcggtatgggggctcggctgcgacccgtggaacgaggatgcggtgtatcgcctgctggcgctgaaggcgcggccggtggaaaagggcctgatcgtggtggcggcgaatatccaccagctcgacttccttctcgaagacctgccggacgtctggctggaccgcctggccggtacctggccggggccgaacacctggctggtgccgcaccaggagcgtctgccggagtgggtcaccggcgtccatgacagcgtcgccgtgcgggtcaccgaccatcccctggtacaggaactgtgccatctcaccggtccgctgatctccacctcggccaatccggccgggcgcccggcggcgcgcacgcggctgcgggtggagcaatacttccacgacgagctggacgctatcctcggcggcgcccttggcgggcgccgcaaccccagcctgatccgcgacctggtgaccggacaggtcatccgcccggcctga

SEQ ID NO: 5298 - DNA, 1386 bp, Pseudomonas aeruginosa
gtacgcgcttcagggcaacagtacggtcgagcccgtggttcgccgtgcggccagttcggtatgcgccctggctgcttcggccagggcgaagcgctggttgatctcgatgcggatgtcgccgcgctcgatcaggccgaacagctcgtcggccatcgcctggagtttttccggggtatcggcgtagctgcccagggtcggccgggtcacgtacagcgaacccttctgcgagaggatgccgaggttgaccccggtcaccggccccgaggcgttgccgaagctgaccagcaagccgcgcggcgccacgcagtccagcgaggtttcccaggtatccttgcccaccgagtcgtagaccaccgggcacttcttcccgtcggtcagttcgagcacccgccgcgccacgttctcgtggctgtagtcgatggtctcccaggcaccgtgctgcctggccaggcgcgccttttccggcgagctgacggtgccgatcagttgcactccaagggccttggcccattggcaggcgaacaggcccacgccgcccgcggcggcatggaagagaatggtttcgccgccccgcagttcgtaggtctggcgcagcaggtattgggtggtgagccccttgagcatcaccgcggcggcctgttcgaagtcgatgccgtcgggcaggtggaccagcttctcctccgccagcacatgcagttcgctgtaggcgcccagcgggccggtggcgtaggcgacgcggtcgccgaccttgaaacgggtcacttcgctgcccaccgcctcgacctcgccggccccttcggtacccagccccgaagggaagccgggggctggatagaggccgctacggtagtaggtgtcgatgaagttcaggccgatggcgcgattacgcacgcggacttcccgggggcccggctcggcgggttggtagtcgcggtattcgaggacttcggggccgccgtaggcagcgaactggatgcgcttggccatgctggaactcctgcttcgtcagggtttcggacggtcgcgccgggtgggcgaccctgggtaaaggccttcatccaagccttccccttgacggccgtcaagcgccggctacccatccagggtggtatgcttgcgccctcgtttcgtcgccagcccgcgccccgcgcggcctccccgctccaaggtgaactccgtgaccgaccgtatcgccgctgtcaaaacctacctgctcgacctgcaagaccgcatctgcgccgccctcgaggcggaggacggcaaggcccgcttcgccgaggacgcctgggagcgtccggccggtggcggcggacggacgcgggtaatcggcgacggcgcattgatcgagaagggcggggtgaatttttcccacgtcttcggcgatag

SEQ ID NO: 5299 - DNA, 780 bp, Pseudomonas aeruginosa
cgcgcaactggcgccgctggacgatttccccgggttcgcccggcgcttcttcgagcagggcaagggcgccaatgtcaccgtgccgttcaaggaagaggcctatcgcctggtggacgagttgagcgagcgggccacccgggccggggcggtgaacaccctgatccgcctcgccgacggtcgcctgcgcggcgacaacaccgacggcgccggcctgctgcgggacctgacggcgaacgccggggtcgagctgcgcggcaagcgggttctcctgctcggcgccggcggtgcggtgcgtggggtgctcgaacccttcctcggcgagtgcccggcggagttgctgatcgccaaccgcacggcgcggaaggccgtggacctggccgagcggttcgccgacctcggcgcggtgcacggctgcggtttcgccgaggtcgaagggcctttcgacctgatcgtcaacggcacctcggccagtcttgccggcgacgtgccgccgctggcgcagagcgtgatcgagcccggccgtaccgtctgctacgacatgatgtatgccaaggaaccgactgccttcaaccgctgggccgccgaacgcggtgcggcgcgtaccctggatggcctgggcatgctggtggagcaggccgccgaggcattcttcctctggcgcggcgtgcgtcctgcctcggcgccagtgttggagacgctgcgccgacagttggcaactgtctgagttgtcaggcggcatttgagacgtacgtctcaaattggcttccatctgacatgtag

SEQ ID NO: 5300 - DNA, 1041 bp, Pseudomonas aeruginosa
gaatcacaaaaccgggttaagacttcaggcttcactcactctcgagcgctgccgatgaaaaccttcgcccgcctggccgccggtctctgcatctgcgccatcgccagccaggccaacgcctggtcgcaaccgacccacaagaacatcgtcaaggatgccctggccttcatgaactcctcctacgccaccgaggagatgcgccaggcctaccggttctacgtgagcgccgccggcagcgaggcgcaggccggggagatcctcggccaggcggccttcgacgtggacgacttcaaggacacccgtctcggtggctggtgggtcggctacgaacacgcgccgctgtggggcgcggcttcgggcatcgtcaactacacctcgtactggcacttcctcaacctggcccgggacggcgactcccatggcaacccccacggcggctacgactaccgctaccacaaggtcgacggcggcatcgccgacgtcgactggtacgccatggtctatctctacaaccgcgagctgaagcgcgaggacttcgacaccaccgaggcgcactaccgccagggcacccgctcggactggcaggagcactacggcgacttccagaccgccgccttccagccgatcgataacctcgccacctactggttcgagcagttccgcgccgcgccttcgctgcagaccatcggctatgccctgcatgccaccggcgacgtggcccagccgcaccatgtgtggatcacctcggccaacggccattccagctgggaaggctgggtcgacgaccactacgccagcgagaagctcaacgacccggcggcggtggccaacctggtggggcgctacgacccgagcaagagcatccgcgacctgctcacccagaccggccaggtcgcctacgcgcgccccgagccgctttacgacaccagctacgagacgcgcctgcgggtggcgaaggagctgattcccgagtccatcgccctgaccgtcaccgtactgaccaagggcgccaacagcttcgatgcaccgactgctctctga

SEQ ID NO: 5301 - DNA, 747 bp, Pseudomonas aeruginosa
tcgcgcccggggctggcgtcgcgcactgtgcgggatcgtcctcgggctgctggcgtggagcgcccatggcgtccccgccaaggcgccgcaggatctgcggatcgacggcgaggtgctgccggggagaagcatcgacttgctcgagcaggccctgtcgcgggtcaagttcaacaccgacccgcagcagttgcgccgtggcctggtggaaaaccgcctgctggcgcgcgcggtggaagaccagctcaccgcgcagagccgcgccgatctcgacgccagcgtggagatcgaggccggcaacctgctcgaacaggtatacggcaggcgctaccgcgaggacctcgggccatacctgcgccagccccgggccctgagcgcggagcgtttgcgcgaggtgctggcgccgaggagccgtggcctggtggaaaacagcctgctgctggacgagacgcagcgccgcgaggcggccggggtcgagctgatcggctggcagtttcccggccagccggcacaggtcctcgacctgctatcgctgtacgaaggcgacaacgtccagggccaggtggaattgcaacagggcaacctcgcttacctggcgcgccaggtccagacccgcatccgccgcgactacctctggtaccgcctggcccgggacggcttcggcccggcagagcggcagggcgtgaggaccctggtgcgggacaagctggtgcgccatcgctatctgcaccagatcggcctctacagtga

SEQ ID NO: 5302 - DNA, 846 bp, Pseudomonas aeruginosa
accaggcggtggcgcgcgagcaactggcagcgcagttcgagacgcgcctgcgcaacctgctggccggcgccagggtggaaggcctgtgaagcgctggctcggcgttgccctcggctgcagcgggctggcgatcgccctgacctgcgccggcgtgttgctggcgcctgccgatatggccgcttcctcgtcttctccgtcgccagccaggacgcttgcggcactgcccgcggtcgacgaccgtccgccgccgccggcgccggtgcgatcgcaagcggcagcaccggcgtacgaggcggagcctccggcggcggaactggatcgcgagcaggcgatccagttcatgcagatgctgcgcgacgagggcgacccgcgcagcccgccgctcggcggcctgcaaccacgccagggcgcgacggcgcaggagctggccgatccgaagcagtaccaggccttcgaggaacgacagacccgcgaactggtacaggcctacaccagcggcgtacagcagataccggaaatccgcgcgcggatcgaggcggccgaacagggtggcgagcgcagcgccgaggaaatcgacgaggctcgcgccgcccttggacagttggagatgatgcgcgacaagctgcagcgggaatcgccgcaactgctgcccggcgacagcgcaccgacatcgccggcggcgccctgagcgtcagccttcgtagtgcaggcggcagccttcgtcggcctgccggcccagcgcttcgcggacctgcgggcgggcgtggcgcaataccaggcggcggccctcggcgtgcaggcggcgggcttcctgctgcaacagcactgcgccggcgaagtcgatga

SEQ ID NO: 5303 - DNA, 483 bp, Pseudomonas aeruginosa
acagcagcaccgagatcgccgcggtgggaccgctcaccaggtagcgcgacgagccccacaggcaggcgatcgccactggcagcatcgccgcgtacaggccgtactccgctggcaggccggcgatcagcgcataggccatcgattgcggcagtgccaggattgcgccattcaggccgacccaagcctcgcgcccgagcatgccccggtgcagccccggtagccaggcgaggaacggcagcaagcgcgtccacatggcgctatggctggccgcgaaccgcggccagggcgtcgccgccgtcgcggctggtcaccccttgcagccaggcctcgagcacccgcgggttggccttgagccaggcgcgggtcgccgaggccggagtcgccgtgccttccagcgcgtcgctcatcaggcggttctccatgtccaggtcgaagcgcaggttggccagcagccgcgccgggttcgggcactgcgcggcgtag

SEQ ID NO: 5304 - DNA, 909 bp, Pseudomonas aeruginosa
gaacacctcatgccgccatccctcgacctgctccgggtattcgagtccgccgcccgccaactcagcttcaccgctgccgccgaggaactggggaccacccagcctgcggtcagccagcagatcaaacgcctggagaaagagctggcgacccctctgttccagcgcgttcatcgaggcatcgtgctcaccgacgccggccagcttctgctccgccacgtggccgccggcctcgagacgatcgatgccggcatcgccgcgctgggcgcgcgccagcgccacgaggtgctccaggtggccaccgactacgccttcgctgcctactggctgatgccgcgccttccgcgcttccatcaggcccatccgcacctggacgtgagcctggtgaccagcgagcgcggcctggccggccagcgcggcgatatcgacgtggcgatcctgttcggcgacggtcgttccaagcacggcgaagcgcaccggctgtttcgcgaggaggtgttcccggtctgtagcccgcggctggtcgagggattgcagttgccgctggccaaggcgcacctggcgcgcctgccgatgctgcatctgaagccggcgcagcacgcccgctggttcgactggccggcgttgttcgaagcgttggccatcgatcggcagccgattccggcggtgctcagcttcgacaactacaccttgctgatccaggcggccatcgccggccagggcgtggccatcggctggcgccacctggtcgacggcctgctcgaacaggggctgctttgccggcccattggcgagagctgcctgtcgcgatacgggtactatgcggtattgccggagcgcaagcggcgccagcggctggtcgacggtttcgtcgactggctgcaggccgagttgcaggccggcggcgcttga

SEQ ID NO: 5305 - DNA, 1167 bp, Pseudomonas aeruginosa
atttttcctcacggttctggcagcgtgcaacgcaaggccaggcgcagcgggttgcctgcgcctggagaatgccgctgtcagggtctgtcagcgtgcgttgcgcacgccttcggccagctcgccgcacagggcgaggacatccttgaccgcctgggcattgtcgcgggccttggcgatccggtcgatcagcgccgagccgaccaccacgccgtcggccaaccgcgcgaccgcggcggcgtgttcggcgctgcggatgccgaagccgataccgatcggcaggtcggtatgccggcgcaggcgcgccactgcttcctcgacgtgctccagggtcgccgcgttggcgccggtgacgccggccaccgacacgtagtagacgaacccggaactgccttcgagcaccgtcggcaggcgctggtcgccggtggtcggggtggtcaggcggatgaagtcgaggccggcggcctgggccgggtggcagaggtcttcgttgtgctccggcggcaggtcgaccacgatcaggccgtccacccccacctccttcgcctcggcgatgaagcgttcgacgccgtagtggtggatcgggttgaagtagcccatcagcaccaggggcgtctcactgtcgccgctgcggaattcgcggaccatctgcaacgtcctggccagggtctggccgccttcgagggcgcggatgttggccaactggatggccgggccgtccgccatcggatcggtgaacggcatgcccagttcgatcacgtcggctccggccgccggcaggcctttgaggatttccagggaagacgcgtagtccgggtcgccggcggtgacgaaggtcaccagggcggcgcggttttcctgcttgagctgggcgaagcgggtctgcaggcggctcatgctttcgactcctgttgcatgtggtgcatgacggtctgcatgtccttgtcgccgcgaccggacaggttcaccaccatgatgtgctccttgggcaggctgggcgcacgcttgaagacctcggccagggcatgggagctttccagcgccgggatgatgccttcgaggcggcagcaggtgtggaaggcctccagggcttcgtcgtcggtgatcgaggtgtactcgacgcggccggtgtcgtgcagccaggcgtgttccgggccgatgccgggatag

SEQ ID NO: 5306 - DNA, 360 bp, Pseudomonas aeruginosa
tcgaggccggcggagatggagtgtgcgtcgatgatctggccatccgcgtcctgcagcaggaaggtgcggttgccgtgcagcacgccgggaaccccgccgttcaggctggccgcgtgcttgccggtgtcgatgccgtggccggcggcttccacgccgacgatctgcaccccggcgtcgtcgaggaacgggtggaacaggcccatggcgttggagccgccgccgatgcaggcgaccagcgaatcgggcaggcgcccttccttctcggccagttgctcgcgggtttccttgccgatcaccgcctggaaatcgcggaccatcgccgggtacggatgcgggccggcgaccgtgccgatcaggtag

SEQ ID NO: 5307 - DNA, 954 bp, Pseudomonas aeruginosa
tccccccgccgggtaaaagaaaccgataagattgctcaaacctgtcaggaaaactcacgaatagccatgagccgcgacctcccttccctgaatgccctgcgcgctttcgaagccgctgcccggttgcacagcatcagcctggcggccgaggaactgcacgttacccatggcgccgtgagccggcaggtgcggttgctcgaggacgatctcggggtggccctgttcggcaaggatggacgcggcgtaaaactcaccgattccggcgttcgcctgcgtgacgcctgcggcgatgcgttcgagcgactgcgtggcgtctgtgccgagctgcgccggcagaccgccgaggccccgttcgtcctcggcgtacccggcagcctgctggcgcgctggttcatcccgcggctggaccagctcaaccgtgccctccccgacctgcgcctgcaactgtccaccagcgagggcgagttcgatccgcgtcgtcccggcctggacgccatgctctggttcgccgagccgccctggccggcggacatgcaggtcttcgaactggcgcccgagcgcatgggcccggtggtcagcccgcgcctggcgcaggaaaccggcctggcccaggcgcccgccgcgcggctgttgcaggagccgctgctgcataccgcctcgcgaccccaggcctggccggcctgggccgcgagccaggggctggcggcggaggcgctgcgctatggccaggggttcgagcatctctactacctgctggaagcggcggtggcgggcctcggcgtggccatcgccccggaggcgctggtccgcgacgatctcgccgcgggccgcctggcggcgccctggggcttcatcgagaccgatgcgcgcctggccctgtgggtaccggcacgcctccacgatccgcgtgccgggcgcctggcgcaatggttgcgggagcagttggcaggctga

SEQ ID NO: 5308 - DNA, 1830 bp, Pseudomonas aeruginosa
gtttttcggcgcgcccagatggccttgtgccttactcccggattgtccgactcatggaagacggatttcggaatattcctgcttacccgctgtagccgctgggccaacatcgcgcctttctgtatttcaaggaatgaaatcgtggctctccatcgcctggcctttatcttcctgtgcctgccgctcatggccagcgccgcccccttcacctcccccggcgaccgcgacctgatccgcgaccgccagcagcgcctgctggacgaacagcgcaagcgcctggaggaactccagcaactgcccggcaagggagcgcccgccgctgcggatgcctccggcgacgacgagcgctgcttcgagatccgccgcatcgagctggagggcgccgggcacctcggcgaaagcgcgcgtcgccaactgctggcgccctaccaggggcgctgcctgggcgtcggccagctcaatgcgctgctcaaggccgtcaccgaccattacctggatcgcggctacgtcaccacccgtgcctacctgccacagcaggacctggcctccgggaccctgcgcatcatcgtcgtcgaaggccgcctggagggcctggacagctccgcgctggccagcccgcgcgaactgacgatgagctttccgggcaggaccggcgagttgctcgacctgcgcgaactggagcaactggtcgaccagttgagtcgcctgccgtcgcgccaggcgcaactggagctggtgcccggcagcgaggtcggcggcagccgggtgcgtctcaagggcgagcgcgacaagccctggcgggtctccgccacgcgcaacaacgacggcgacgtcagcactggcgagcagcagatgggcctgggtctggactgggacagcccgctgggcctggccgaccagctcaacctgcgcgccaaccgcgacgcggtgaccgaccgctggcgccattccgacagccagagcctgttctacagcctgccctggggctggtggaccttcacctacggctacagccagagcgactaccgcacgcgcaacgaggccagcggcttccccttcaagctcgatggcgacagccgcagccaccagttccgcgccgaacgcgtgctgcaccgcgacggtgtgagcaagaccgccatgagcctggggctcagccaccagcgcaccaacaactatgtcgaagacacccgcctggaagaccagagcacgcggatcaccgagacccagctcggcttcaaccatggccggcggatcggcagcggtttcgtcaacctcgacctcggctggcagcagggcatcggcgcccttggcgcgcagggtcgcggccacccgcaggcgggcgatccgcatgcgcgctacgacaagtacagcctgaccctcagctacctgcagccgttccagctatggggcgagcgcttcagcttcgacagcctggccaccgggcaaaggagcgaggacgtgctgttcagcccgcagcgcatcagcctcggcggcaacagctcggtgcgcggcttcaaggaccagaccctgaccggcgacagcggcggctactggcgcaaccagttgcgctggcggcgcgcggtggaatgggcgccgctgcggccctggctgcaggaatacggcgtggccttcgcctacgacgtcggcgtgatccgccacgaccgctacaacgacggcgccagcgggcgcatgagcggcaacgccatcgaactggatgcccgcggccgctatttcgccgccagcgtcggcttcgcccgctcgctggagcggcccagcgccatcgagcggcgcgagcacccgatctatttccgggtcgacgcgttcttctga

SEQ ID NO: 5309 - DNA, 1551 bp, Pseudomonas aeruginosa
cgatatggacatccgcagcccgctgaaccagtgcatcgccctgtccctggccggcatcctgttcctcaacccgatcgtcgccgcggcggcggggctggcgctggacaaggccgccggcggcaacaccggcctgggccaggcgggcaacggcgtgcccatcgtcaatatcgccacgcccaacggcgccgggctgtcgaacaaccatttccgcgactacaacgtcggcgccaacgggctgatcctcaacaacgccaccggcaagacccagggtacccagctcggcgggatcatcctcggcaaccccaacctcaagggccaggcggcgcaggtgatcctcaaccaggtcaccggcggcaaccgcagcaccctggccggctacaccgaggtggccgggcagtcggcgcgggtgatcgtcgccaacccgcacggcatcacctgccagggctgcggcttcatcaacacgccgcgcgcgaccctcaccaccggcaagccgatcatggacggccagcgcctggagcgcttccaggtggacggcggcgacatcgtcgtcgaaggcgccgaactgaacgtcggcaacctcgaacagttcgacctgatcacccgcagcgccaagctcaacgccaagctctacgcgaagaacctcaacatcgtcaccggccgcaacgacgtccaggccgacagcctgcaggccacgccgcgcgccgccgatggcagcgagaagccacagctggcgatcgacagctcggcgctgggcgggatgtacgccggggcgatccgcctggtcggcaccgagcagggcgtgggggtgcggctggccggcgacatggccgccagcggcggcgacatccgcatcgacgccagcggcaagctgagcctggcccaggcctccagccagggcgacctgaagatcgcggcccaggccgtggagctgaacggcaagacctacgccggtggcagcgccgagatccgcagcgcggaggaactggtcaaccggcagagcctggcggcgcgcgaacgcatcgcgctggacgccgcgcgcctcgacaacgccggggtgatcgaagccggcgtcgagccggacgagcggcgcaacgcccgcggcgacctcgagctgcgcagcggcaccctgcgcaacgccggcagcctggtggccagccgcgcgctggaagcgaaggcgagccaggcgctggacaaccagggcggcagcctgaagggggcgaccgtccgggtcgacggcggacacctggacaaccgtggcggcaagctgctcgccgagggcgaactgcgggtcgaggcgagcagcctggacaaccgccaggacggcctgttgcagagccgggaccgcgccgtggtcaagacccgtggcgatctcgacaaccgtggcggccaggtgatcggcctgaacgacctggaggtcggcgcggcgacgctcgacaacggccagcaaggcctgctcggcagccagcagtccacccgcgtcagcgcccaggcgctggtcaaccggggggacggcgaagtctccggcaagcgcgtcgaggcccgcgtcggtag

SEQ ID NO: 5310 - DNA, 2163 bp, Pseudomonas aeruginosa
aggcaacctgctcagccagggcgcgcagcgcgtgacggtggggcaactggacaaccgcgccggcggcctgctgtcgagccgcagcgagttgaacgtccacggcgccagcctggacaaccgtggcggcgtgctggtggccgacgccggcttgagcgccacgggaggcgccttcgacaaccgcgacggcggcagcgccagcggcaaggctggcgtgcgcgtggaggtcgccagcctgcgcaacgaccagggtggcaagctgttcagcgatggccgcctggacctcgcagcgaacgccgtcggcaacgccggagggcgtatcgccgccaagggcgacctgcaggcgacgcttggcagcctggcccagcaaggtggcgaactggtcagcgaaaagaccctgaaggtcgcggccgacacgatcgacaacagccagtcctggctgatcgccgcgaatggcggcatcgctatcgaggcgcggcaggtcgacaaccgcgccggcgagatttccagcacctcgaaggtcgccgtgaacgcccgcgagcaactggacaaccgcggcggcaaggtcatcggcgacagcggcctgcgcctcaccgtgcagcgcctgctgaaccaggccaagggggtgctggccgggcgcgacggcctgagcctggacggcggcgaactgttcaacggcgacggcggtcggctcgacagccagaacagcctgagcgtgagcctcggcggcgtgctggacaaccagggcggcgcgctggtcagcgaaggcagcctgacggcgcgcgccgcgcgcctggacaaccgtggcgggaccttctccagcgccggtgcgctggcgctgaccagccaggccgcgctggacaaccagggcggcaggctgctcagcgatgccggcgtgacgctgcagggcgccagcctcgacaacagccgttccggcgtgatcagcgccaagggtgcggtggatatccgcaccggcgtgctggacaacagccgcaacggcggcatcggcagcaacgccggcatcaccctggtggccgcccggctggacaacggccagcagggacgggtcagcgccaagggcctgctcgacgccaacctgaaaggcctcgaccagcgcggaggcggcgtcctggtcagcgaaaccggcgtcaccctcgacctcaatggcggcacgctggtcaaccgcgacggcggcctgatcgccacgcccggcgcgctgctgctgcgccagctcggcgcggtggacaacggcgccggcggggaaatctccagcgaccgcgccttcaccctcgccgccgccagcctggacaaccgcggcgggcgcctgatcggcgccgccagcctgaccctgcgcatcgcccaggccctggacaacagcctggccggggtgatctccggcgccgccggcctggacatcgcggccgctcgcctggacaacagcgccaagggcaccctggccagccgcgccggcatcgacctgcgcgtcgacggcgcgctggacaaccacgccgaaggcaccgtttccggcgcccgcctgacgctcgccagcgcctccctggacaacagcggcaagggcctgctctccggcaacgccggcctgagcgtcgccactggcgcgctggacaacgccgagggtggccagttgatcagccagggcgtgctggacgtcagcagcgccgacctcgacaaccgtggcggcgccctcagtggcaagcagtcgctgcgcctgagcgccgccaacctggacaaccgtggcggcctgctgaccagcgacggcgaactggaactgacggcagggcgcgtcgactccgccgacggcggcgaaatctccgcccggggcgacctgcgcctgacggtcgagcgcctggtgcaacgccagggccggctggtcggcgagcgcggcgtcagtctcgacctgcggggcggcgacctggacaaccagggtggcctgatcagtgctcgcggcccgctgagcatcgagcggctgaacgtcctcgacaaccgccagggcggcgagatttccagccagcagggcttcgagctgctggccaggcgcatcgacaacggccagcaggggcgcatcatcagcgccgggaaactgcgcctggacgccgacgcgctgggcaacgccggcgccggcctgctctccggatggccagggcctga

SEQ ID NO: 5311 - DNA, 411 bp, Pseudomonas aeruginosa
cgctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggtggcggcctctacgccagcggcctgctcagcctcgacggccagcgtttcctcaaccagggcgcggcggcgggtcagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagcacgcggctggtcgctggcggcctga

SEQ ID NO: 5312 - DNA, 345 bp, Pseudomonas aeruginosa
aggcgggagagttgcccaaaggagaggtggccccaggaaaggctaatctgcctaccattggggcgttggcggatgctgaggcgggaatgccttatacccatccagttaagctcgccgcaaaagcgactgggacagcagggaagattaagattgaagccggcgcaatacctgacgcaaatgaagtacgtgcaggacaagggttatctggtcttgggtacgatgttacgcaccaaaccactgcgtcagctaaaggtattcaagggcagcgaactgcggacttgcatgttgatggactcggttccattgatgtgtatacgccgaagaatcttgatccgacaaagatag

SEQ ID NO: 5313 - DNA, 285 bp, Pseudomonas aeruginosa
ttgatgatcacttatgcgtgtgcattgaagaaggcaaaggaacatttaatggattcggaagtccctttgcaaattacatatgagggtgagttttccgaagggtggtatttctgctaccagtcaaaggagtttatggaaaccggtaatttgtcagctcaactcgcagggaatgcgccatttttgattgataggcaatctggtgagcttcatattctcggaacagcaaaacctttagagagttatttggatgactacataaaaaacaaatccgtgaagttggggtga

SEQ ID NO: 5314 - DNA, 432 bp, Pseudomonas aeruginosa
tttagtgctgcaaaaggggctgtaattcccaaagttttctcgaatgccgatgatttcgcacgctttggtacagatgcgcgagagggtttagcgaaagccggctatgggaacgtagagcccattcttcaagggagtgctataacggggcagagtttcaagactggacaagcgtttgatgttggtagggtgagtgacttcgatattgcctcggcaggctctgagttgttgcagcgtgcacagtcgctaggaataggtttgagaagcggcggtactcgtactggtcctctgagcggaagagatttgcaagcacttggattaaaagatctagctagaaagctaagtgcacaagcagggcgtgaagttaactttatgatttatgattctgcggcaacggctgcaagccgcgctccgagcctggtacttccaaaatga

SEQ ID NO: 5315 - DNA, 1431 bp, Pseudomonas aeruginosa
gcggaggggcgcctcgttcctagactggcggggaaacatcaggagacgtcaatcatcatgcatattcaatcatctcagcagaacccgtctttcgtggctgagttgagccaggccgtggccgggcgcctgggacaggtcgaggcccgccaggtggccactccccgggaggcgcaacaactggcccagcgccaggaagcaccgaagggcgagggcctgctctcccgcctgggggccgccctcgcgcgtcccttcgtggcgatcatcgagtggctgggcaaactgctggggagccgtgcccacgcctccacccaggcgccgctctcccgtcaggacgcgccgcctgccgccagtctctcggccgccgagatcaagcagatgatgctgcaaaaggcactgcccctgaccttgggcggacttggcaaggcgagcgagctggcgactttgacagcggagaggctggcgaaggatcacacgcgcctggccagcggcgacggcgccctgcgctcgctggccaccgccctggtcgggattcgcgatggcagccggatcgaggcttcccgtacccaggctgcccgcctgctcgaacagagcgttggggggatcgcgctgcaacagtgggggaccgcgggcggtgccgccagccagcatgtactcagcgcaagcccggagcaactgcgcgaaatcgccgtccaactgcatgcggtaatggacaaggtcgccctgttgcgccacgcggtagagagcgaggtaaagggcgagcctgtcgacaaggcgctggcggatggcctggtggagcacttcgggctggaggcggagcagtacctaggcgaacacccggacgggccgtacagcgatgccgaggtgatggcgctcggtctctataccaacggcgagtaccagcacctgaatcgttccctgcgtcaggggcgagagctggatgcgggccaggcgttgatcgaccagggcatgtctgccgcgttcgaaaagagcggaccggctgaacaggtcgtgaagaccttccgcggcacccagggcagggatgccttcgaggcggtgaaagagggccaggtcggccacgacgccggctatctctccacctcccgggaccccagcgttgccaggagcttcgcgggccagggcacgataaccaccctgttcggcagatccgggattgatgtcagcgagatatcgatcgagggcgatgagcaggagatcctctacgacaaggggaccgacatgcgcgtgcttctcagcgccaaggatgggcagggtgtgacccgtcgggtgctcgaagaagccacgctgggggaacggagcggccacggcgagggactgctcgatgccctggacctggcaaccgggacggatcgttcaggcaagccccaggaacaggacctgcgcctgagaatgcgcggcctcgacctggcctga

SEQ ID NO: 5316 - DNA, 729 bp, Pseudomonas aeruginosa
aagccgctccgcgtcgatagcgtttttttccaggagaaccccatgagtcacagcgccaagaaaacactactgccgctcctcgccgttgccaccctggccggcctggcgggctgcgccaccgagacctccaccgcgttgccggtacagcaggtcgagagcgtcaaccgaccctacagcggcgtgcgttcgccgattgcggtaggcaagttcgacaaccgctccagctacatgcgcgggatcttttccgatggcgtcgaccgcctcggcggccaggccaagaccattctcatcacccacctgcagcagaccaatcgcttcaacgtgctggaccgcgacaacatgagcgagatccagcaggaagcggcgatcaagggccaggcccagcgcctgaagggtgccgactacgtggtgaccggcgacgtcaccgagttcggccgcaaggaagtcggcgaccgccagctgttcggcatcctcggccgcggcaagtcgcagatcgcctacgccaaggtggcgctgaacatcgtcaacatctctacctcggaggtcgtctattcgacccagggcgctggcgagtacgccctgtccaaccgcgaggtgatcggcttcggcggcaccgccagctacgactcgaccctcaacggcaaggttctcgacctggccatgcgcgaggcggtgaacaagttggtcaacgcggtcgatagcggcgcctggaagccacagaaccaataa

SEQ ID NO: 5317 - DNA, 384 bp, Pseudomonas aeruginosa
tccaccagaaaccagggaatcacggcacacatgagcaagacgatcacatggacggcggcgctgctggggagcatggcgctggccgggtgcagcggaccgaagacgctgtaccagtgggagggctaccaggcccaggtccacgaatacttcaagggtgaatccaaggaggcccaggcgcaggcgctggaagccgacctcgagaagatccgggcgaagaacggcgcggtgccgccgggctaccacgcccagctggggctgctctattccagcatcggcaaggacgaccagatggtccgcgagttcgagaccgagaaggcgctgtttcccgagtcggcgacctacatggacttcctcctgaacaacgcccgtggaggtgcccgttga

SEQ ID NO: 5318 - DNA, 1929 bp, Pseudomonas aeruginosa
  unsure (103): Identity of nucleotide at the above locations are unknown.
aggctgaagcgacgggctaccgtcccgttggcctacgtcggcggcagtttggctccgcggcgaagcgataggacgcgagggccttgcgcctggcgaggactantccgcttgcgccccctgcgccagggcgttgccgacgcccaccagcagcgcccgggtctgcgccacgatggcgctgcggtaggcctcgtagcgggcgtcgctgatggcgttgtcgttgcgcgcgccgccgccgctcgccggtacgccggtgtagtagttgttcatcaccgggacatggatgtgcccggcgggaatctccaggcggaacgcgtcgcgcagcaccgtgttgcggtaggcgctctcgttggacaggtagtcgccgccaccgccgttgcgcgcgcagatccgtcggttcggcgggagcaccagggagggatcgggcatggcgttcatcaccccgttggtcggcacgttttcggtgcgcgggttggcgcaatcggggaagaagtcgtagttggtgtgccaggtgacgtcgaagccttccgcggcctggctggtagcgcccggcggccgctcgatgccgcgccaggtatcggcggcgagcaactggcggaccggcagcgaggccttggagaactgtgctggcaggttctgccgccagcggctggcgctgtcgtagccgagccagcggcgcggcgggttgatattgcagccggagccccgcagggaaatcggcgcggtgccgggattggtcacgctgcccaggggaagcacgtagttgggcaaagcgctgtcggcggggcagtagacgatgccgtcgttgccggcggaggagccgtggaagcggccgttccaggcctccagccagaactggttggcgccgccctggctgatggtgatggaggcgtcgacccggcgcgggccggggcggaaccaggggcccagggtgtcttcctgcatgccgcggttgaacgggtcgtagctgaccggcaacaggtaggcctcgatacgcagcaggctgccgtcggccagcctgaactcgcggccgtccagcgcaagggcggtggcgcccgaggggttgccgttgcgcaggccggtgttcgccgtcccgggagtgcccagggtgaagacgtcgaagccgctgatgatcatccgccggtagcgcgagccgtcggcggcgtagcggcgcggcaggtcgatgtccagctgtccgcgcgaggcgcgttcgaagcgccattgcagcgcctgggcctgggccttgccgaggtggaaggatggcgcccactggcgcagggtgcgggtcatgtagaggcgcgtccagtagagcatgcggtcatcgctggccggcagcgcgccggcgggaatggcgcggcgaccctgggcccggtcgacggcggcgcgccacagcgcgcggccctcttcggtgaccagcttcagtgccttggcgtagctgctgaccggggtgcggccgtcggcggcgcacaggcgcttggcgaaggccggttcgaagccgtcgaagccggcgcccttgacgatgcgctcggccagcggcgtctggtcatgggtgacgacgttggcgccgctgaacggcagcggcgtgtcgagccggcgctcctcgtaggacaacgctgcctcgcggttccaggagcaggcgacgctgggcggcttgcgggcgccggcgaggtcgccgttggcggcccagccggcgccgggcagcagggctgccgagacggccagggcgaagagggagtatcggcttgcgtgaggggcgtagcgcatcgggtggactcctgttcttgttcggttcatgggtcgatcggtgcggcgggcggagcgcgggcgagcggcgcccgccggcggcgggggccgggaccgacgcaaggtgcgtcgcgggttgctgcggtggcggacgggagggcggtgctagggggcgcgtgtcgccggtag

SEQ ID NO: 5319 - DNA, 687 bp, Pseudomonas aeruginosa
aggcgccgacgagctgttcggtggctacggctggttccgcgatccgcaggcggtggctgcggcgcgcttcccctgggcctccagggtgcgcctgccagccggcttcatcgacgccggtttcaaccgccgctgcgatctcctccagtaccagcaggccagctacgacgatgggctgcgccaggtcgaacacctggccggcgacagcccggaggagcggcggatgcgcgagttcagccacctgcatctgaagcgctggatggtgctgctgctcgacgcaaggatcgcctgagcatgtgcaacggcctggaggtgcgggtgccctacaccgaccatgagctggtggagtacgtctacaacgtgccctggtcgatcaagagccgggacggcgaggagaagtggctgctcaagcgggcctgcgccgactatgtcccggaagccgtgctcaagcgccgcaagagcccttatccgacttctgccaacctcggctacgagcgtttcctgcgcgggagcgtgcggcgtctgctggaggacgcggcgaacccggtgttcggcatcgtttcgcgagagttcctggccgccgaactggagcatccggaggggtacttcaacacccaggtgagccgccacaacctggagaccgcgctggcgctggaaggctggctcatgttgtacgggctctccgcctga

SEQ ID NO: 5320 - DNA, 585 bp, Pseudomonas aeruginosa
ggtcgtgcgcgcgcgcccggccttgggagaacatcagaagcaggtcgagaacgcctttgccctggccttcgaacgctacgaaaaaaccttcgaagagctggccaaggtttaagcatgtcgcaagaccagcaagggatacgctatctctccgttgcagatctcgttcgcctcaatgagttgctcatcctggcccagactccggacgagccgataggcgtcctcaaaccgaacgagttggagtccgcacagcaacggccagccaaccatcgttactatgctcgaaccgacgatatcatcacgctggctgcggtctttgcggaaagcttggcaatgaaccactgctttgccaatggcaacaaacgcacggcggcggcggccgctacggttttcctcctgctcaatggcatagagctgacggggcccgctcaggacttcgtcgacatcatggtcgccctcgtgactcgtgaagcgagcgttcaggacctggaagactggatgttctactggcacagaccattcgacgcttacaacctgccggacagcgacgctttcgagcgaatggtcgcccgcttgggcattggttag

SEQ ID NO: 5321 - DNA, 495 bp, Pseudomonas aeruginosa
accgcacgggtacccgctcggtcagccagacgccgttctccgcctggtggaataggtgcccggccagatgcatgtcgcgcgcgtcgatttccagcagaaccgggctgccgtagcggcggccgacttccagggcggtggcgcggcgggcggagagatggacgtggtggcggctgccgggaaccaggccgcgctcgcggatggagtcgaggaagcggctggcggtgccgtggtagagcactgcgggcgggaccgcgggggcgtaggcgatggccaccgcggcatgcgagtggccttgcacggcgcggatgcgctggccatcggcggagagggcgaagcgcttcttgtcgttgttctcgaccaccgcgccgagcagcatgcggtcgagggcgcggccgtcccgcgccgcgccggcgatcagggcgtcgatgtcggcccagccttcgccgtccagcgtcaggccgatggcctcgggctggtggcgaaggacatagctga

SEQ ID NO: 5322 - DNA, 606 bp, Pseudomonas aeruginosa
ggaacttgctggtgtcgtcgagggttttccgatccattccatggtccttgtgcgtgccatcccggcgcgggaacctcaggcgccgccgaggaagtccatcttgcccagttcgacgccgttgtggcggaggatggcgtaggcggtggtgacgtggaagaagaagttgggcagggcgaagccgaagaggaagtcgcggccgttgaagctgatctcctggccgcgcaccttgagggtcacgttgcgctcttcggcgccgtccagttgttcctcgcggatgccctcgaggaactcgacggtgcgagcgatgcgtgcctggagttcgtcgaaggtggtttccgtatccgcgtagctcggcacttccagcccggccagccgcgcgccggcgcccttggcggcgtcgctggcgatctgcacctggcgcgccagggggaacatgtccggcgccagccgggcgtcgatgaagatgcgcggatcgatgttcttcgcttcggcgtgggcggcggctttcttcaggatcgccgagaggttgccgagggtgcgcaggaaggtcgggatcgaagcctggtagatcgacagggacatggacgtgctccagacaggggataa

SEQ ID NO: 5323 - DNA, 750 bp, Pseudomonas aeruginosa
ccgctgatcgaggcgtcccctgcggggcgtctcgtggagaccgagatgaacgacctcaccctgcattacctctacgatccgctctgcggctggtgctacggcgcctcgccgctgctcgccgccgcctgcgaggtgacgggtctggacgtacgcctgcatggcggcggcatgatgaccgatgccaaccgccagccggtcggcgccggcctgcgccactacgtgatgccccatgacctgcggatcgcccaactgaccggccagccgttcggcaaggactacttcgacggcctgctgcgcgacaccagcgcggtattcgactcggccccgccgaccgccgccgtgcttgccgccgaagcgctcgacggcctcggcgcggcgatgctggcgcggatccagcgtgcccactacgtcgagggccggcgtatcgccgagcgtccggtgctgctcgagctgggtgccgaactggggcttggcgagggcttcgccgaggcgttcgacgcctgctccggcgagccgctgcgcgcgcacttcgccgacagtcggcggctgatgaaccgtctcggcgccgctggcttcccgaccttcgccctggagcgcgacggccgcctgcaggtgctcgacaccgggcgctacctcggccagccggacgactggcgggctcttctcgaaacgcagctgcgccttgccggcggcagcgatgccgtgggcggggccgcggcgccgctctgccgcatcgacggttgcgcctga

SEQ ID NO: 5324 - DNA, 639 bp, Pseudomonas aeruginosa
ccgccgaacgtatcgagacccgcgccgaggtcaccctcgacaagcagtccgacggtttcgccatcactgccgtgcacctggtgctcagggcgcgcgtgccgggggcggacgcgcagaccttcgagcagatcgccaacaaggccaaggccggttgcccggtatccaaggtgctcaacgcgaagatcagcctggacgccagcctcgacggctgagcggaacgcttccccagcccggcgaactggccctggcctgccgcagtcgaatgcggcaggatgcgctgcgcagcactcggctgccaggcatcgacgaggagtgacgggtcatgaaaaccatcgggctggggattgccaccttgctgttcagcgccacggcgctggccgcgccgaagccgtgcgaggaactcaaggcggagatcgagaccaagatccagtcggccggggtgacctcctacaccctggagatcgtgcgcaacgacgaagtcagcgacccgaacatggtggtcggcagttgcgagaacggcaccaagaagatcatctaccagaagaacgacgactgagccgctgcgtttcagtacggcgggcagcggctggtctggaagttcgaacgggcgaccacctcgccacgctcgtcgctcagtag

SEQ ID NO: 5325 - DNA, 1380 bp, Pseudomonas aeruginosa
cgcgtgcggtcccagctcttgtcgtcgacttccacggcggcgagatcggcgtcgggctgggtatcgaggtcgacccaggcgcggttcgggtcgggggtgggcatcagcagtgagcagccgctcaggacgagcaggccaccggcaagcagcagcgtacgcatagaagactccgaagctcctttaacccggccgccatccgttgcgccttggaaaaacgccttgcgttcctccgcctcgccggatcgcggaccggtgctggtagggcggcgggcggtccgcgtgctgtgctatgttccgcccatgccacgccgccttcgccatccgcttgctgaccttcgactgccccgttgggttccctgcctggcgctgttggcgctgagcggttgctcgaccgtctcctactacgggcaactggccagcggccagttcgccctgctgcgcgcccgcgagccggccgccgcggtgatcgccgacccgcagcgcgacgcgcgcttgcgcgaacgcctggcgaaggcggaaaaggcccggcaattcgccagcgaacgcctcggcctgccggacaaccgcagctatcgcctgtacgccgatatcggccggccctacgtggtatggaacgtgttcgccaccccggagctgtcgctgcagccggtcacccattgcttccccatcgccggctgcgtggcctaccgcggctactacagcgaggccgccgcgcgcgccgaggcggcgcgccagcgggcgctcggcgacgacgtctacgtcggcggggtgcaggcctactcgaccctcggctggttcgacgatccgatcctcagcagcatgctgcgctgggacgacgaacggctggcgaccttgatcttccacgaactggcgcaccagaagttctacctgcgcgacgacaccgccttcaacgaatccttcgccaccttcgtcgaacaggaaggtacccgccagtggcgcgaatatcgtggactgccgccggcggacggccgcgaggagaagcgccgcgagcagttcaccgcgctggtcctggccagtcgtgcgcgcctcgaagcactttatgccgggccgttggacgatgccgccaagcgtgccggcaaggctgccgaattccagcgcctgcgccgcgagtacgcggcgctgagccagcgcgaatggggtggcgagtcgccgttcaaggcctggatcgacgcgccgttcaacaatgccaagctgcttcccttcggcctctacgaccaatgggtggcggcgttcgccgtgctgttccgccaggtcggcggcaactggccggcgttctatgcgcgggtccgtgcccttggccagctccccctggcggagcgccaggcggcgttgcagcggctggccgccgcagcgccctga

SEQ ID NO: 5326 - DNA, 2118 bp, Pseudomonas aeruginosa
ttttcctcaggctgcggatgccgccgattgtatttaagatggtcgggtatttccttagccaaggttgccaacgtgagcgcgaatccccttctgcaggcctacgacctgccgcctttctcctccattcgcccggaacacgtgaagccggccatcgagcggatcctcgccgataaccgcgccgccatcgcccgcctgctggaaacccagcgcgagcagccgacctggaagggcctggtgctggcgatggacgaactcaacgaccgtctgggcgccgcctggagtccggtcagccacctcaacgcggtgtgcaacagcgccgagctgcgcgaggcctacgaggcctgcctgccggagctgtcggcctactccaccgagctggggcagaaccgcgccctgttcgaggcctacgaggcgctggcgaagagccccgaggcggccggcttcgacgtggcccagaaaaccatcctcgaacacgccctgcgcgacttccgcctgtccggcatcgacttgccggcggacaagcagaagcgctatgccgaggtgcagtcgcgcctgtccgagctgggtagccgtttctccaaccagctgctcgacgccacccaggcctggaccaagcatgtcaccgacgaagccgcgctggccggcctgaccgattcggccaaggcccagatgaagcaggccgccgaggccaagggcctggacggctggctgatcagcctggagttccccagctactacgcagtgatgacctatgccgatgaccgcgccctgcgcgaagaggtatacgccgcctactgcacccgcgcctccgaccagggcccgaacgccgggcagaacgacaacggtccggtgatggaagagatcctcgacctgcgccaggagctggctggcctgctcggcttcgccaactacgccgagctgtcgctggcgaccaagatggccgagtccagcgaccaggtgctcagcttcctccgcgacctggcggtgcgcagcaagccgttcgccgcccgcgacctggagcagctgcgcgcctacgccgccgagcagggctgcaccgaattgcagagctgggacgccggctactacgccgagaaactccgcgaggcgcgctacagcgtgtcccaggaggcgctgcgtgcctacttcccggtggacaaggtgctttccggcctgttcgccatcgtcgagcgcctctacggcatccagatccgcgaactgcacgatttcgaacgctggcacgccgacgtacgcctgttcgagatcctcgagaacggcgagcacgtcggccgcttctacttcgacctctatgcccgcgccaacaagcgcggcggtgcctggatggacggcgcccgcgaccgccggcgcgacgcccagggccggctgatcgacccggtggcctacctggtgtgcaacttcaccccggcggtgaacggcaagccggcgctactgacccacgacgaggtcactaccctgttccacgagttcggccatggcctgcaccacctgctgacccgcgtcgagcatgccgccgcctccgggatcaacggggtggcctgggacgccgtcgagctgcccagccagttcatggagaactggtgctgggaaccggaaggcctggcgctgatctccgcccactacgagaccggcgaggcgctgccgcaggacctgctggagaagatgctggcggcgaagaacttccagtccgggatgatgatggtccgccagctggagttctccctcttcgacttcgagctgcacgccacccacggcgacggccgcagcgtgctgcaggtgctcgagggcatccgcgacgaagtggcggtgatgcgtccgccggcgtacaaccgcttcgccaacagcttcgcgcacattttcgccggcggatacgcggccggttactacagttacaagtgggccgaggtgctgtccgccgatgccttctcgcgtttcgaggaagaaggcgtgttcaaccccgataccgggcgtgccttccgcgaggcgatcctggcccgcggcggctcccgcgagccgatgctgttgttcgtcgatttccgcggtcgcgagccgtccatcgacgccctgctgcgtcactccgggctggtcggggaggccgcatga

SEQ ID NO: 5327 - DNA, 1209 bp, Pseudomonas aeruginosa
agaagaagcccgacgcctgaccgctcgccgccgaccggcggcgatggctgtgggccggggcccggtgcgatactgtatccatatacagtatttcaccgggtttccctcatgagcgctcccctgcccccgcgcggtcgcggtaccgccagcaaccccctcaaccgcttcgccccgacccacagcgaggccttcgacgatggctgggagcaggacgtgccgccgatccagctcaccgaggtgcgcgaggagatcgcccgcacggtgatctcccgcaaccagtcgccggacctccctttcgatcgttcgatcaatccctaccgtggttgcgagcatggctgcatctactgctatgcgcggcccagccatgcctattgggacctctcgccggggatcgatttcgagacccggctgatcgccaagagcaacgtcgccagcgcgctggagcaggaactgagcaagcccggctatcgctgcgcgccgatcaacctgggcgccaataccgacccctaccagccgctggagcgcgaacgccgcctgacccgccaggtgctggaggtgctgctgcgcttccgtcacccgctgaccatcgtcaccaagggctcgctgatccttcgcgacctcgacctgctgcgcgaactggcggagcagaacctggtggcggtgatgatcagcctgaccaccctcgacgacgagctgaagcgcattctcgaaccgcgcgcggcggcgccctcggcgcgactgcgggcgatccgcacgctcagcggcaacggcatcccggtgggcgtgctctgctcgccgatgatcccgatggtcaacgacatggagctggagcgcctgctccaggcggcgcgggacgccggcgcgcgcagcgccgcgtacatgctcctgcgcctgccgcgcgaagtcgccccgctgttcgaggaatggctggcggcgcactacccgcaacgcgccgagcatgtgatgagcctggtccgccaatgccgtggcggcgaggtctacgacagccgcttcggccaccgctttcgtggccagggaccgttcgccgacctgctggcgcatcgtttcgcggtggcgatgaagcgcctcgggctggcaccgccgccagggcttcgggctggattgcagccggttcgccgtgccgggggcgcagatggcgttgttctagcgttttccccgcggtgcagcatttcgtatagggcggagtag

SEQ ID NO: 5328 - DNA, 1209 bp, Pseudomonas aeruginosa
agtcatctcgccttcgagatagttcccgcccttcaccacgaaaccgccatatgtgccctgccggcgaccggcgtggaccagttggaaggactcctggaccatctccgcggcattgccgatcacgtcgaacaggcccagcgggttcggccgcttcatccctaccggcaacagtcgcgcggcctgcccggtgccgccggcgacctggttgtacaccgcccagtcgcccagcgggccttcctggtcgctgccctcgaccttgcgcgggaacagccggccttccagttcctggcggctgaccgcctggccgccgcgcgcggcgaactcccactcgacctcggtgggcaggcggacgaagccgatgccgccgtcctcgggattcttgccgcggccgctgaccggcagcagttccgggtggttcttcagcagccaggcgctgtacaccgcgccgaagcgttcggcgtcgaagcgcgagaggttgaccttgggcagccgcgcggccatcccgtccggcacgtcgcaggccggcgcctcgccctggccggagagcgcggccgcctggctcatcaccgcggcgtactggcgggcggtcacctcgtacttgccgatgaagtacagcatcggcttcagcggggtgccggcggcaggcttcggcaggctggcggagagcttctgctgccaggccggtgccaggtcggcgaggctgaactggccgttcacgtagtcgcgccggtagccggagatgaacgactgctggtagcccgcctcgccttcgttgaaggcgtagccgaggttgacctcgcgatcgtcgagggcgccttcggcgagtacgtagacatgccggaagaccatctcgccgccacacggcagcggcagggcgacgtcgtcggccagcggcttgggattgtccggcgagtcgccttcggcccaggccggcgcggcaaatgccaggcaggcgccgagggcgagcggaagaatggctttctcaaacatcgcgtaatccctctgcggcttcgatccgcgccgcgcgccagccgccgctggcggcggccaggacgctgcacagcagcgtggcgagcagcgccgtcaggtagtggctgggcagcaggcggcagacgaactcgccgctctggttgtcgaacaggtggttcagcgcgccggccgtggcggcgtacagcagcccggcgaggaacaggccgaagacggcgctga

SEQ ID NO: 5329 - DNA, 909 bp, Pseudomonas aeruginosa
tcaccgccgccagggcgaagatcgcgcagagcgacaggcgcgcctcgccgcgatagtcggcccaggccagcgagagcagcaggccggcgcgcatcagccaacttcctcgaggcaggcgccgacgctgtcgtcggcctcgcgttgccagcggatggccaggacttccaggccggctgcgcgagccaggcgctcgtcgtgggtggcgaccacggtgcaggcgccgcgctcgcgggcctgctccaccagcaggcgcatcacccgttcggcgttcagcgggtcgagcgccgcggtcggctcgtcggccagcaacaggcgcggcgcatgcgccagggcgcgggcgatggcgacccgctggcgctggccgaccgacagcgccgccggtttcttgtccagctggtcgccgatttccagccgatcggccagcgcctgcacgcgctcggcggatggggcgccgagcaacgcgcagggcagtccgatgttgcgccgcacatcgaggaattcgagcaacccgccgctttgcagcacgtagccgcagtgctgccggcgcagcgccgccaagcggtcctggcggccgtcgcgccagagcgcggcgatgtcctgcgggcgttccccggcgaggaattcgaagcgcccgcccgggtccggcgccagggccagcgccagcaggtcgagcagggtgctcttgccgcagccgctggggccgacgatggccagctggcgacccgcgcgcaattccagcgccggcacccgcaggcggtagcgctggcgaccggcgccgtggctgcgggcgacctcgtgcaggcgcaggatcatggcagcgtcgacagcggcacgcggtacagcgcgtcgccggcgtcggcgtcgccgaaccggacccagttggcgacgtcgttgtggaaggtttcgtag

SEQ ID NO: 5330 - DNA, 507 bp, Pseudomonas aeruginosa
agcagtacgccaccgacttccagggtaggccacagcgcgtcgagcaattcaccctgcaggtgcgccagggcggcgatgtcttccggcttgcgcgccagcttgatgtccgggtggcggcggatcaccccggtggccgagcacggcgcgtcgaggaggatgcgctggaacggcttgccgtcccaccactccccggtggccctggcgtcggcggcgaccaggctggcttgcaggccgagccgctggaggttttcccggacccttaccaggcggctctcctcgaggtcgacggcgaccacttcggccagttccggctgggtttccagcaggtggcaggtcttgccgccaggcgcacagcaggcgtcgaggacacgctggccgggcgcgctttcgagctgctcggcggccagttgcgcggcttcgtcctggacgctgacgcgaccctccgcgaagcccggtagttcgcgcacgtcgcgcggcgcggcgagctggatgccgtcgcggctgtag

SEQ ID NO: 5331 - DNA, 501 bp, Pseudomonas aeruginosa
cgagaagaccttcaccagtgcgccgtacatcgtcgccggcaacgccgagcggatcgtcagcggcaccggcgaccgcatctacgctcgcggcaagttcgccgacggccagccggcctatggcatcttccgccagggcaaggtctacatcgatccgaagaccaaggaagtcctcggcatcaacgccgacgacatcggcggcggcgaggtggtggccaccgaaggcgacgtcgcgaccctggcgctgacccgcaccacccaggaagtgcgcctgggcgaccgcctgttccccaccgaggagcgtgcggtgaattccaccttcatgcccggcgagccgagccgcgaggtgaagggcgaaatcatcgacgtaccgcgcggcgtgacccagatcggccagttcgacgtggtcaccctgaaccgtggccagcgcgacgggctggccgagggcaacgtgctggcgatctacaaggtcggcgagacggtgcgcgaccgcgttaccggtga

SEQ ID NO: 5332 - DNA, 1140 bp, Pseudomonas aeruginosa
gtcgcaatgaagaaccattctccagccgaactggaagcacggctgcgcctgcatggcctgcccgaactgggacccatgcgcttcctgcgcttgatcgaggccttcggttcggcctcttccgcgcttgccgcgccagccggcgcctggcgcaccctgggagtgcctgccgaggccgccgccgcgcggcgcagcccggcggtgcgggaagcggcgggtgaagccctgcgctggctggaaggtccgcgcaggcacctgctgatgtgggacgacccgggatacccggcactgctcgccgaagtcgccgatgccccgccgctgctgtacgtcgaaggcgctccggagactctggaacggccgcaactggcgatggtcggcagccgccgcgccagccccgccgggctggggcaccgcccggagctttgcgcgcagcctggcgcagggcggcttcgccatcaccagcgggctggccctgggcatcgatggcgccgcccacgagggcgcgctggaggctggcggcgcgaccgtggcagtcctcggcaccggcctgcgcaggctctatccgcggcgccacgaggcgctggcgcggcgcatcgtcgagggtggcggcgcgctggtttcggagctgccgctggacagcccgccgctgccggcaaactttccccggcgcaaccgcatcatcagcggactctcgctgggtgtgctggtggtcgaggcaagtcccgccagcggctcgctgatcaccgcgcggctggcggcggaacaggggcgcgaggtgtacgccattccgggttccatccaccatcccggcgcacgtggctgccaccaactgattcgcgatggcgcgctgctggtggaaagcgtcgggcacgtgctcgaagcactgcgcggctgggcgcaggcggagccagcggaagcgccggcgcagcccctgccccaccctttgctggcgctgctgcgcgccgcgccctacaccagcgaaggcctggccgccgccagcggcatgacgctgcccgatgtgctggcgacgctcagcgaactggaactcgacggccgggtcgcctgcgaggccggcacctgggtgcatcgctccggctgaaaccgtacacttcgcgcaccctgtccgctggagtgagtcgatga

SEQ ID NO: 5333 - DNA, 1020 bp, Pseudomonas aeruginosa
cggccgtcaagcgccggctacccatccagggtggtatgcttgcgccctcgtttcgtcgccagcccgcgccccgcgcggcctccccgctccaaggtgaactccgtgaccgaccgtatcgccgctgtcaaaacctacctgctcgacctgcaagaccgcatctgcgccgccctcgaggcggaggacggcaaggcccgcttcgccgaggacgcctgggagcgtccggccggtggcggcggacggacgcgggtaatcggcgacggcgcattgatcgagaagggcggggtgaatttttcccacgtcttcggcgatagcctgccgccctcggccagcgcccatcggccggaactggccgggcgcggtttccaggcgctcggcgtgtcgctggtgatccatccggaaaacccccacgtgccgacgtcccatgccaacgtgcgtttcttctgcgccgagaaggaaggcgaggagccggtctggtggttcggcggcggcttcgatctgaccccctactacgcccacgaggaagactgcgtgcattggcaccgggtcgctcgcgacgcctgcgcgccgttcggcgcggacgtctacccgcgctacaaggaatggtgcgaccgctacttccacctcaagcaccgcaacgagccgcgcggcatcggcggcctgttcttcgacgacctcaaccagtgggacttcgacacctgcttcgccttcatccgcgccatcggcgatgcctatatcgacgcctacctgccgatcgtccagcgccgcaagcacacgccgttcgatgaacggcagcgagagttccaggcctatcgtcgcggtcgctatgtggagttcaacctggtcttcgatcgtggcaccctgttcggcctgcagtccggcggccgtaccgaatcgatcctgatgtcgttgccgccgcaggtgcgctggggctatgactggaaacccgagccgggcagcgaggaagcgcgcctgaccgagtatttcctcgccgaccgcgattggctcgccggccagccctga

SEQ ID NO: 5334 - DNA, 882 bp, Pseudomonas aeruginosa
cccgcccgcaggggacgagtccgctcgtcccgtcccactccggcaaaggaacgacccatggaccgctattgcgtattcggcaaccccatcggccacagcaagtcgccgctgatccaccgcctgttcgccgagcagaccggcgaggcgctggtctatgacgcgcaactggcgccgctggacgatttccccgggttcgcccggcgcttcttcgagcagggcaagggcgccaatgtcaccgtgccgttcaaggaagaggcctatcgcctggtggacgagttgagcgagcgggccacccgggccggggcggtgaacaccctgatccgcctcgccgacggtcgcctgcgcggcgacaacaccgacggcgccggcctgctgcgggacctgacggcgaacgccggggtcgagctgcgcggcaagcgggttctcctgctcggcgccggcggtgcggtgcgtggggtgctcgaacccttcctcggcgagtgcccggcggagttgctgatcgccaaccgcacggcgcggaaggccgtggacctggccgagcggttcgccgacctcggcgcggtgcacggctgcggtttcgccgaggtcgaagggcctttcgacctgatcgtcaacggcacctcggccagtcttgccggcgacgtgccgccgctggcgcagagcgtgatcgagcccggccgtaccgtctgctacgacatgatgtatgccaaggaaccgactgccttcaaccgctgggccgccgaacgcggtgcggcgcgtaccctggatggcctgggcatgctggtggagcaggccgccgaggcattcttcctctggcgcggcgtgcgtcctgcctcggcgccagtgttggagacgctgcgccgacagttggcaactgtctga

SEQ ID NO: 5335 - DNA, 441 bp, Pseudomonas aeruginosa
agcgcgaggacttcgacaccaccgaggcgcactaccgccagggcacccgctcggactggcaggagcactacggcgacttccagaccgccgccttccagccgatcgataacctcgccacctactggttcgagcagttccgcgccgcgccttcgctgcagaccatcggctatgccctgcatgccaccggcgacgtggcccagccgcaccatgtgtggatcacctcggccaacggccattccagctgggaaggctgggtcgacgaccactacgccagcgagaagctcaacgacccggcggcggtggccaacctggtggggcgctacgacccgagcaagagcatccgcgacctgctcacccagaccggccaggtcgcctacgcgcgccccgagccgctttacgacaccagctacgagacgcgcctgcgggtggcgaaggagctga

SEQ ID NO: 5336 - DNA, 1167 bp, Pseudomonas aeruginosa
ccaagggcgccaacagcttcgatgcaccgactgctctctgatcgcgcccggggctggcgtcgcgcactgtgcgggatcgtcctcgggctgctggcgtggagcgcccatggcgtccccgccaaggcgccgcaggatctgcggatcgacggcgaggtgctgccggggagaagcatcgacttgctcgagcaggccctgtcgcgggtcaagttcaacaccgacccgcagcagttgcgccgtggcctggtggaaaaccgcctgctggcgcgcgcggtggaagaccagctcaccgcgcagagccgcgccgatctcgacgccagcgtggagatcgaggccggcaacctgctcgaacaggtatacggcaggcgctaccgcgaggacctcgggccatacctgcgccagccccgggccctgagcgcggagcgtttgcgcgaggtgctggcgccgaggagccgtggcctggtggaaaacagcctgctgctggacgagacgcagcgccgcgaggcggccggggtcgagctgatcggctggcagtttcccggccagccggcacaggtcctcgacctgctatcgctgtacgaaggcgacaacgtccagggccaggtggaattgcaacagggcaacctcgcttacctggcgcgccaggtccagacccgcatccgccgcgactacctctggtaccgcctggcccgggacggcttcggcccggcagagcggcagggcgtgaggaccctggtgcgggacaagctggtgcgccatcgctatctgcaccagatcggcctctacagtgatttccaccatgagtccgatgcgctgcgggaactcgccggcaaggtcagcgacaaggacgccgaggcctactatcggcgcaacctggagcgttaccgcaacgtcgcgcaggtgcaggcggcgcatatccgcctggccgaccaggcgagcgcggacaaggtctacgccgagttgcgcagcggcctggcccttcgacgaggcggtacgccgctattccctggccgacgacagggaccgcgacccgcccggcgacctaggcctgatacggccccaggacggccggctcgacctgctgcgcaagactgcgctgatccagaaggccgatacggtttcccagccgatgcgcatcgacggcgcgttcgagatcgtccgggtgcgtag

SEQ ID NO: 5337 - DNA, 741 bp, Pseudomonas aeruginosa
ccgcgaggatcgccagttgcccctcgacgaccgcagcgtgcgcttcgaggtgaaccaggcggtggcgcgcgagcaactggcagcgcagttcgagacgcgcctgcgcaacctgctggccggcgccagggtggaaggcctgtgaagcgctggctcggcgttgccctcggctgcagcgggctggcgatcgccctgacctgcgccggcgtgttgctggcgcctgccgatatggccgcttcctcgtcttctccgtcgccagccaggacgcttgcggcactgcccgcggtcgacgaccgtccgccgccgccggcgccggtgcgatcgcaagcggcagcaccggcgtacgaggcggagcctccggcggcggaactggatcgcgagcaggcgatccagttcatgcagatgctgcgcgacgagggcgacccgcgcagcccgccgctcggcggcctgcaaccacgccagggcgcgacggcgcaggagctggccgatccgaagcagtaccaggccttcgaggaacgacagacccgcgaactggtacaggcctacaccagcggcgtacagcagataccggaaatccgcgcgcggatcgaggcggccgaacagggtggcgagcgcagcgccgaggaaatcgacgaggctcgcgccgcccttggacagttggagatgatgcgcgacaagctgcagcgggaatcgccgcaactgctgcccggcgacagcgcaccgacatcgccggcggcgccctga

SEQ ID NO: 5338 - DNA, 624 bp, Pseudomonas aeruginosa
cgcccagaccagcgtggcaccgcccagcaagccaagcagcagggccggccagcgcggtcgcaggcgcctgaccagcaggctgagcgcgaagctgaagccgcccaccagcagcgatgggccatcgaactcggcgaaccgcgccagcagccgccagccgtttcccggcgctgcgccctccccgctcgcggccaggccgagaagatagggcagttggccgaggacgatcagcagcgccgcgccaagggtgaagccgagcatcaccgaatgcgagacgaaattgaccagcgacccgacgcgcaggacgccgagcagccactggaaggcgccggcgagaaaggtcagcagcagcacggcctggacgtattgcgggctgcccagcggcgccagcggggccaccgaactgaacagcagcaccgagatcgccgcggtgggaccgctcaccaggtagcgcgacgagccccacaggcaggcgatcgccactggcagcatcgccgcgtacaggccgtactccgctggcaggccggcgatcagcgcataggccatcgattgcggcagtgccaggattgcgccattcaggccgacccaagcctcgcgcccgagcatgccccggtgcagccccggtag

SEQ ID NO: 5339 - DNA, 414 bp, Pseudomonas aeruginosa
gccaggcgcgggtcgccgaggccggagtcgccgtgccttccagcgcgtcgctcatcaggcggttctccatgtccaggtcgaagcgcaggttggccagcagccgcgccgggttcgggcactgcgcggcgtagcccttgcgtgccagggtgtagacctggccgcggtcgccgaagtactgctcgccgccttccaggtagcgcaggtcatggcggatgttcatcgggtgcggcgtccagccgaggaacaccagccagcgctggcgcttctcggcccggccgagttcggcgagcatcgcctgctcgctggactccaccagcttccagtcgccgaggccgaactggttggcgtcgatcatcttctggatcgactgattggccggcgcgccggagccgatcccgtacagcttgcggttga

SEQ ID NO: 5340 - DNA, 306 bp, Pseudomonas aeruginosa
acaccacctcctcgtcgaagtccagctggttggtgcgcacgcagggaccggcctgcaaaaccgaggacatgttgtggtaccagctcgggcgcacctccggctcgtcccagttcaccgcccagccatagtccgccggatagatgtcgctggtcaggcgttcctcgtagccgtgcaactggtcgggaccgcagaagtgcatcttgcccgacagcgccgtgcgatagccgaggttgcgcaagtagtgggcgtaggtgggggtatcggcggcgaaatcggcagcgttgtcccaggcgccgatgcgggtag

SEQ ID NO: 5341 - DNA, 471 bp, Pseudomonas aeruginosa
acaggatgttcggcgaggtcttcatcgggcggcttatcccatgcgattgggttatgcgatagtgctgcgtcgatcatcagtgcatcgaaatccctggtaaaccgcatggggctggatgcgttggataagccgggcttatgtgagaacacctcatgccgccatccctcgacctgctccgggtattcgagtccgccgcccgccaactcagcttcaccgctgccgccgaggaactggggaccacccagcctgcggtcagccagcagatcaaacgcctggagaaagagctggcgacccctctgttccagcgcgttcatcgaggcatcgtgctcaccgacgccggccagcttctgctccgccacgtggccgccggcctcgagacgatcgatgccggcatcgccgcgctgggcgcgcgccagcgccacgaggtgctccaggtggccaccgactacgccttcgctgcctactggctga

SEQ ID NO: 5342 - DNA, 603 bp, Pseudomonas aeruginosa
tccaggcggccatcgccggccagggcgtggccatcggctggcgccacctggtcgacggcctgctcgaacaggggctgctttgccggcccattggcgagagctgcctgtcgcgatacgggtactatgcggtattgccggagcgcaagcggcgccagcggctggtcgacggtttcgtcgactggctgcaggccgagttgcaggccggcggcgcttgaagaggtgacgatgaacgagtattccaccccccgcatccagggcttccatgctcacgtctatttcgatgcgcagagcatcgagcgagcccgcgccctttgcgaagaagcggcgcggcgctttccgctgaagatggggcgggtccatgagcggccggtagggccgcatccggactggagctgccagctggcgttcgctcccgaggtgttcggcgagctggtgccctggctggccatccatcggcaggacctggtggtgttcatccacccggttaccggcaacgatctgctcgaccatcgcgaccgagccatctggatgggagccattcgcccgctggacctgtcgatcctggacgaaggcccgcaacgctatgacttcgccgtgccttga

SEQ ID NO: 5343 - DNA, 561 bp, Pseudomonas aeruginosa
cttgtaggtgctcacggttttctcgctgaggaacagctgctgggcgatggccttgttggtgttgccgttggccaggtactgcagcacggtcatctcgcggtcggaaaggctttccagcatgcgggcctcgttgtcgcggctctgctggttgatgctgcgcaacgccccggtggggaagtggatgtagccggccagcacggccttggcggcgagcagcagctcggagaggttttcccttttgctgacgaagcccatggcgccggcctgcaggcagcgcggggcgaactgcgccggattctgccgggtcaggaccaggaccttggtgtccagcttcagggacttcaggcgggctatcacttcgagaccgtcgatcttggggatgccgatgtccaggatggccaggtcgggagacttcttgcgggctacctgcagggcttcggcaccgttgtcggcctcgccgacgatggtgaaaccgtcgcgctcgaacagcaagcgcacggccaggcggatagcgggatgatcatcgacgatcagcaccttactcatgcgaaccttctttga

SEQ ID NO: 5344 - DNA, 474 bp, Pseudomonas aeruginosa
tctggccatccgcgtcctgcagcaggaaggtgcggttgccgtgcagcacgccgggaaccccgccgttcaggctggccgcgtgcttgccggtgtcgatgccgtggccggcggcttccacgccgacgatctgcaccccggcgtcgtcgaggaacgggtggaacaggcccatggcgttggagccgccgccgatgcaggcgaccagcgaatcgggcaggcgcccttccttctcggccagttgctcgcgggtttccttgccgatcaccgcctggaaatcgcggaccatcgccgggtacggatgcgggccggcgaccgtgccgatcaggtagaaggtgctgtcgacgttggtcacccagtcgcgcagcgcctcgttcatggcgtccttcagggtaccggtgccggcggtcaccgggatcacctcggcgcccagcagcttcatgcggaagacgttggcctgctgccggtcgatgtcggtag

SEQ ID NO: 5345 - DNA, 744 bp, Pseudomonas aeruginosa
aactcaccgattccggcgttcgcctgcgtgacgcctgcggcgatgcgttcgagcgactgcgtggcgtctgtgccgagctgcgccggcagaccgccgaggccccgttcgtcctcggcgtacccggcagcctgctggcgcgctggttcatcccgcggctggaccagctcaaccgtgccctccccgacctgcgcctgcaactgtccaccagcgagggcgagttcgatccgcgtcgtcccggcctggacgccatgctctggttcgccgagccgccctggccggcggacatgcaggtcttcgaactggcgcccgagcgcatgggcccggtggtcagcccgcgcctggcgcaggaaaccggcctggcccaggcgcccgccgcgcggctgttgcaggagccgctgctgcataccgcctcgcgaccccaggcctggccggcctgggccgcgagccaggggctggcggcggaggcgctgcgctatggccaggggttcgagcatctctactacctgctggaagcggcggtggcgggcctcggcgtggccatcgccccggaggcgctggtccgcgacgatctcgccgcgggccgcctggcggcgccctggggcttcatcgagaccgatgcgcgcctggccctgtgggtaccggcacgcctccacgatccgcgtgccgggcgcctggcgcaatggttgcgggagcagttggcaggctgagcgctggcgatttgctgcacttttccggctcggctag

SEQ ID NO: 5346 - DNA, 279 bp, Pseudomonas aeruginosa
tgtccattgaacagaggcgcccgtcgggcgcgaagaaccaggcatcgtccggggagagagttcatgtccaatcaccacacctacaagaagatcgaactggtcggctcgtccaagaccagcatcgaggacgccatcaacaacgccctcgccgaagcggcgaagagcatccagcatctggaatggttcgaggtggtggatacccgcgggcacatcgagaacggcgccgtcggccattaccaggtgaccctgaaagtagggttccgtatcgccaatagctga

SEQ ID NO: 5347 - DNA, 411 bp, Pseudomonas aeruginosa
tggcaccctggaaacctgtccacgatcgccagcgccctgggaaggccgccgcgtctttccgcttcgccggatcatgcacaggctatgagggcggcgtgcctccatgggcggcgcgctcgtctcaaccttgccgcatttggcaagcctgacccgttcgggtcttcatccatgcaacgagggaatgtgttcatgaagaagttgatgttggcagtcggcctgtttgccgtggcgggcagcgcattcgccgccaagccctgtgaggaactgaaagccgagatcgatgcgaagatcaaggccaacggcgttcctgcctacaccctggaaatcgtcgacaagggcagcgtcaccgacaagaaggtagtcggcacctgcgacggcggcaccaaggaaatcgtctaccagcgcggctga

SEQ ID NO: 5348 - DNA, 4158 bp, Pseudomonas aeruginosa
gaaagcgcctacctgcatcgaggccctttccttggaaaaccttgcttaacctcgccgggcccctacccgccaaggagtaacgatatggacatccgcagcccgctgaaccagtgcatcgccctgtccctggccggcatcctgttcctcaacccgatcgtcgccgcggcggcggggctggcgctggacaaggccgccggcggcaacaccggcctgggccaggcgggcaacggcgtgcccatcgtcaatatcgccacgcccaacggcgccgggctgtcgaacaaccatttccgcgactacaacgtcggcgccaacgggctgatcctcaacaacgccaccggcaagacccagggtacccagctcggcgggatcatcctcggcaaccccaacctcaagggccaggcggcgcaggtgatcctcaaccaggtcaccggcggcaaccgcagcaccctggccggctacaccgaggtggccgggcagtcggcgcgggtgatcgtcgccaacccgcacggcatcacctgccagggctgcggcttcatcaacacgccgcgcgcgaccctcaccaccggcaagccgatcatggacggccagcgcctggagcgcttccaggtggacggcggcgacatcgtcgtcgaaggcgccgaactgaacgtcggcaacctcgaacagttcgacctgatcacccgcagcgccaagctcaacgccaagctctacgcgaagaacctcaacatcgtcaccggccgcaacgacgtccaggccgacagcctgcaggccacgccgcgcgccgccgatggcagcgagaagccacagctggcgatcgacagctcggcgctgggcgggatgtacgccggggcgatccgcctggtcggcaccgagcagggcgtgggggtgcggctggccggcgacatggccgccagcggcggcgacatccgcatcgacgccagcggcaagctgagcctggcccaggcctccagccagggcgacctgaagatcgcggcccaggccgtggagctgaacggcaagacctacgccggtggcagcgccgagatccgcagcgcggaggaactggtcaaccggcagagcctggcggcgcgcgaacgcatcgcgctggacgccgcgcgcctcgacaacgccggggtgatcgaagccggcgtcgagccggacgagcggcgcaacgcccgcggcgacctcgagctgcgcagcggcaccctgcgcaacgccggcagcctggtggccagccgcgcgctggaagcgaaggcgagccaggcgctggacaaccagggcggcagcctgaagggggcgaccgtccgggtcgacggcggacacctggacaaccgtggcggcaagctgctcgccgagggcgaactgcgggtcgaggcgagcagcctggacaaccgccaggacggcctgttgcagagccgggaccgcgccgtggtcaagacccgtggcgatctcgacaaccgtggcggccaggtgatcggcctgaacgacctggaggtcggcgcggcgacgctcgacaacggccagcaaggcctgctcggcagccagcagtccacccgcgtcagcgcccaggcgctggtcaaccggggggacggcgaagtctccggcaagcgcgtcgaggcccgcgtcggtagcctcgacaatcgcggcggcaagctgatcggcgacgacctgctggtggtcgccagcggtgccatcgacaaccgcctcggcttgttctccgcagccaaccgcctcgacctgcgggcgcgcagcctggacaacagcggcaagggcacgctgagcagccggggcggcctggaggtcagcctcggcggcctgctggacaaccgcgatgaaggcaacctgctcagccagggcgcgcagcgcgtgacggtggggcaactggacaaccgcgccggcggcctgctgtcgagccgcagcgagttgaacgtccacggcgccagcctggacaaccgtggcggcgtgctggtggccgacgccggcttgagcgccacgggaggcgccttcgacaaccgcgacggcggcagcgccagcggcaaggctggcgtgcgcgtggaggtcgccagcctgcgcaacgaccagggtggcaagctgttcagcgatggccgcctggacctcgcagcgaacgccgtcggcaacgccggagggcgtatcgccgccaagggcgacctgcaggcgacgcttggcagcctggcccagcaaggtggcgaactggtcagcgaaaagaccctgaaggtcgcggccgacacgatcgacaacagccagtcctggctgatcgccgcgaatggcggcatcgctatcgaggcgcggcaggtcgacaaccgcgccggcgagatttccagcacctcgaaggtcgccgtgaacgcccgcgagcaactggacaaccgcggcggcaaggtcatcggcgacagcggcctgcgcctcaccgtgcagcgcctgctgaaccaggccaagggggtgctggccgggcgcgacggcctgagcctggacggcggcgaactgttcaacggcgacggcggtcggctcgacagccagaacagcctgagcgtgagcctcggcggcgtgctggacaaccagggcggcgcgctggtcagcgaaggcagcctgacggcgcgcgccgcgcgcctggacaaccgtggcgggaccttctccagcgccggtgcgctggcgctgaccagccaggccgcgctggacaaccagggcggcaggctgctcagcgatgccggcgtgacgctgcagggcgccagcctcgacaacagccgttccggcgtgatcagcgccaagggtgcggtggatatccgcaccggcgtgctggacaacagccgcaacggcggcatcggcagcaacgccggcatcaccctggtggccgcccggctggacaacggccagcagggacgggtcagcgccaagggcctgctcgacgccaacctgaaaggcctcgaccagcgcggaggcggcgtcctggtcagcgaaaccggcgtcaccctcgacctcaatggcggcacgctggtcaaccgcgacggcggcctgatcgccacgcccggcgcgctgctgctgcgccagctcggcgcggtggacaacggcgccggcggggaaatctccagcgaccgcgccttcaccctcgccgccgccagcctggacaaccgcggcgggcgcctgatcggcgccgccagcctgaccctgcgcatcgcccaggccctggacaacagcctggccggggtgatctccggcgccgccggcctggacatcgcggccgctcgcctggacaacagcgccaagggcaccctggccagccgcgccggcatcgacctgcgcgtcgacggcgcgctggacaaccacgccgaaggcaccgtttccggcgcccgcctgacgctcgccagcgcctccctggacaacagcggcaagggcctgctctccggcaacgccggcctgagcgtcgccactggcgcgctggacaacgccgagggtggccagttgatcagccagggcgtgctggacgtcagcagcgccgacctcgacaaccgtggcggcgccctcagtggcaagcagtcgctgcgcctgagcgccgccaacctggacaaccgtggcggcctgctgaccagcgacggcgaactggaactgacggcagggcgcgtcgactccgccgacggcggcgaaatctccgcccggggcgacctgcgcctgacggtcgagcgcctggtgcaacgccagggccggctggtcggcgagcgcggcgtcagtctcgacctgcggggcggcgacctggacaaccagggtggcctgatcagtgctcgcggcccgctgagcatcgagcggctgaacgtcctcgacaaccgccagggcggcgagatttccagccagcagggcttcgagctgctggccaggcgcatcgacaacggccagcaggggcgcatcatcagcgccgggaaactgcgcctggacgccgacgcgctgggcaacgccggcgccggcctgctctccggatggccagggcctgacggtgaccaggcgggagcctggacaacagcgccggcggcaccctttcgagcaagggacggcgagctggccatcaccctcggcggcgcgctggacaaccacggccagggcgcctgggtcagcaagggcgcgcaacggatggacgccgccagcctgggataa

SEQ ID NO: 5349 - DNA, 2469 bp, Pseudomonas aeruginosa
cagcgacggccagttgatcagccagggccggctcgacgccatcctcggcggcgccctggtcaacgccggcgcggcgcgcctggccagcggcggcgacctgctgctgcgcagcgccagcgtcgacaaccgcggcggcaagctggtcagccaggggctgctggagatcaccaccggcagcctcgacaacagcgcctccggcaccctcgccagccaggccgacatgagcctgcgcctgggcggcggcgccctgcgcaaccagcaggacggcctgatcttcagccaggccggcgccctcgaggtgcaggccggcagcctggacaaccgccagggcacgctccaggcccagggcgacaaccggctgcgtatcggtggcgcgctggacaaccagggcggccgcctggacagccgggccggcaacctcgacctgcagagcggcagcctcgacaacggcgccggcggcgtgctcaacagcgccaagggttggctgacgctggtcaccgggctgttcgacaacagcgccggcgtcacccaggcgcagtcgctggagattcgcgccgggcaaggcgtgcgcaaccagcagggccatctctcggcgctgggcggcgacaaccgcatcgtcaccgccgacttcgacaaccagggtggcggcctctacgccagcggcctgctcagcctcgacggccagcgtttcctcaaccagggcgcggcggcgggtcagggcggcaaggtcggcgccgggcgcatcgacttcagcctggccggcgcgctggccaaccgcttcggccagttggaaagcgaaagcgagctgcacctgcgcgccgccgcgatcgacaacagcggcggcagcctgcgcgccctcggccgcagcggcagcacgcggctggtcgctggcggcctgaacaacgcctacggcgtgctggaaagcgccaaccaggacctcgacctgcaactgggcagcctggccaacgccggcgggcgcatcctccacaccggcaatggcaccttcggcctggattccgggcaggtgatccgcgccggcggcgaactgaccaccaatggcctgctggacatccgcgccagcgaatggaccaacagcagcgtgctgcaagccggacgcctgaacctggacatcggcaccttccgccagacggccgagggcaagctgctggcggtgcagtccttcactggccgcggcggcgactggagcaacgacggcctgctggccagcgacggcagcttgcgcctcgacctgagcggcggctaccgtggcaacggccgcgccaccagcctcggcgacttcgccctgaacgccgccagcctcgacctcggcaacgccgccagcctcgccggcggcgccaatgtcacgctcggcgccggcaacctgctggtcaaccgtgggcggatcaccgccgccggcgacctcgtggccagcgccgcgagtctgaacaactacggcaccctgggcggcggcggcagcctgcgattgaacgcgcccgccctgctcaacgagcgcgggttgctgttcagtggcgccgacatgaccctgcgcgccggcgacatcaccaacctctacggggatgtgtacagcctcggcaggctggatatcgcccgcgacgatgccggcaaccgtgccgccagcctgcgcaacctttccggggtgatcgagagcggcaaggacttcagcctgcgtgccagcctgatcgagaaccgtcgcgccgtgctggaaagcaagtcgggcctgtacaccgcgaagatggagcagaccgcctgcatcgaaggcgtcaacgcgggcgactgcagcggcaagcgcaacgccatctggaccatcacccagcgcgacaagaccgaggtcaccgccagcagcgccatggggcaactgctggccggaggcgacttcgccatcgacggcggcaccctgaacaacctttccagtctgatcggcagcggcggcaacctcaccgccaacctcgaagtcctcgacaaccagggcctggaaaccggcgagctggaaaccatccgcgtgctgcgtaccgctcgcggcggcgatatcggcggcatcgaccagaagtcgcgcaacttcaccaacctctactggtaccagagcgccaatttcgacccggcgcgcgcgggcgagatccccgccgcgctcaacgcgatcctcagcgactggtccttcgagtacgaattcccgagcaaggggccgaccccgatcagcagtggcgaccagtcctacgcagcggtgatccaggccgccggcgacgtcacggtcaatgccagcacgcgcatcgacaacggcgtcacccgccccggctacaccttcgtcggcagcggccgccaggtgggcgacagcgcggtgggcggcagcggggtttcggtggtcgtgccgctgacctcgcaactgccgcccgacctggcgcggcgccaggtcaacccggttaccctgcccggcttcagcctgccccagggtga

SEQ ID NO: 5350 - DNA, 1152 bp, Pseudomonas aeruginosa
cgtgagcctcaccgcgcttaccggcgacgtgatcaacgaacgcagcgtgacccgctacgacagcgcgctcgacggccgcacctgggaacgcagcttcgccgacagcgccgcgcgggtggaggcggcgaacagcctgaacgtccaggccggacgcgacatcgccaacctcggcggggtgctgcagagccgcggcgacctcagcctcgacgccggacgcgacgtcaccgtcgccgccgtcgaggaccgccagggccagacccgctggagcacgtcgcggctccagagcgtgacccagctcggcgccgaagtcagcgccgggcgggacctgaacgtcagcgccggccgcgacttgacggcggtggccagcaccctcgaagcgcgccgcgacatcgccctctccaccgggcgcgacgtgaccctggcggcggcggcgaacgaggagcatgcctacagcaagaccaggaaggtcacctaccaggaagacaaggttgcccagcaaggcacccgcgtggacgccggcggcgacctggcgatcaatgccggacaggacctgcgcctgatcgcgagccaggccagcgccggcgacgaggcctacctggtggccggcgacaagctggaactgctggccgccaacgacagcaactactacctgtacgacaagaagaagaaaggcgacttcggccgcaaggaaacccggcgcgacgaagtcaccgacgtcaaggcggtgggcagccagatcagcagcggcggcgacctcaccctgctcagcggcggcgaccagacctaccagggcgcgaagctggaatcgggcaacgacctggccatcgtcagcggcggcgcggtgaccttcgaggcggtgaaggacctgcaccaggagagccacgagaagagcaagggcgacctggcgtggcagtcgtcgaagggcaagggccagaccgacgaaaccgtgcgccagagccagatcgtggcccaggggaatctggcgatcaaggccgtggaagggctgaagatcgacctcaagcatatcgaccagaagaccgtgagccagaccatcgacgcgatggtgcaggcggatccgcaactggcgtggctgaaggaggccgagcagcgcggggatgtggactggcgcatggtgcaggaggtgcacgatag

SEQ ID NO: 5351 - DNA, 477 bp, Pseudomonas aeruginosa
gataccatgaagaaaatagtatcttttaaagatttaaagtgtttgagtaattatgaattatggaagtccggttgggagaataagaatgagattgatattttttcatatatttcctatgaaatcaggccagaagatttattgatcttggggaaattggtttttcctgattttatcttggataggggggcggtaatactggagatgaactatgaggcagaaaagtttaatggctggatggcaagattcgaagatgatatccagtctgtagagagatttgttaatcatactcatatttatgacattttttccgggtgtagtgaggatgtagaagatgaaatttttgagcagcttgctcatatgctttctctatcatggcgcttaattttaaaagagaaatttccagatagagatttttcggttttgctatcttgctcagatcaagattatggccctactattacttttttccagaaataa

SEQ ID NO: 5352 - DNA, 534 bp, Pseudomonas aeruginosa
tcgcgtcgacgtcggcgaggccggagagcaacgcgaccgcatagatgccggcgtcgccgaacagccgccggccgacctccaccaacagcaggatcgcgctcagcagggcggcgaaacgcatggccgggagcagttcgaaggggttgcgcaggcctggctcgtcgggcgcctcctggctggcgcggccgccgcgcagggcgtggaacagcgtgccgccaaggtagacgagggtggtggcggcgaatggcagggccagttccttcagcaaggccgggtggatcgcgccgatctcgacgaggatgcgcgggaacatcagcgccgaggtcgccagcagggcgcacgccaacagggcgtcgggcatgcgctcgcgcaggcgcgccagggtcagggtcatcaccgtggaggacaccaggccgccgagcaccgcggtcagcaacaggcccttgcgcgagccgatcaggcggatggccaggtaggcggagaaaccgagggcggcgatcagcaccaccatccaccaggtcaggtagggattga

SEQ ID NO: 5353 - DNA, 876 bp, Pseudomonas aeruginosa
  unsure (235),(238): Identity of nucleotide at the above locations are unknown.
acaacgcccgtggaggtgcccgttgaaactcgcccgactgtccggcctggtggccggtttcaccctgctggccctgctcggcggctgcgcgccgaccaagagcgtcgactactcggcgttcaagcaggccaagccgcgctcgatcctggtcctgccgccgctgaacgagtcgcccgacgtgaaggcgacctacagcatgctctcgcaggtcaccttcccgctggccgaggccggntantacgtagtgccggtggcgctggccgacgagaccttccgccagaacggcctgaccagcgccggcgacgtgcaccaggtgtccccggccaagctgcgcgagatctatggcgccgacgcggcgctgtacgtcacggtgagcgactacggcacgcgctacatggtgatcagcagcgcgaccatcgtcaccgccagcgccaagctggtcgacctgcgatccggcaccaccctgtggaccggctcggcgaccgcctccagcgaggaaggcaacggcggcaacaacggcggcctggtgggcatgctgatcaccgcggcggtcaagcagatcatcaacagttcggtggaggacgccggttatccgatcgccgggatgaccagtgcgcgcctgctctcggccggccagccgggcggactgttgtacggcccgcgctcgccgaggtacggcagcgactgagccgtgcgccggggctacggggacgtctccgtggcctcggtgcaagccgccgggaggggcttggccgctgcgttgcgcttggccatgtactggcggatcaggtcgtcgagcaacgcccggatggcgcgccgctcgtccagccgcaggcggccgatggcctcgaactgcaggcgcaggtcttccggtag

SEQ ID NO: 5354 - DNA, 195 bp, Pseudomonas aeruginosa
ttctccattccccgcgccgccctacttttcccgctcgtccatcgtcgcgtcgaacgttgccacgaaatcagcgtcgatggacaactcttatattcaatagttgtacgatctgagtttgttgtagtcatttgcttagttggctattcatatgattgccgtaaagcaattataagtttaattggattagccttctaa

SEQ ID NO: 5355 - DNA, 1446 bp, Pseudomonas aeruginosa
aggagtttccctatgtgcggtctcgcgggttgggtggattacacgcgcaagctcgacgacgaatttccggcgatcttcgccatgaccgatacgctcgccttgcgcgggccggatgccgagggcatctggaagcaccgcaacgccctgctgggtcaccggcggctggcggtcatcgacctcagcggcggcgtgcagccgatgtcctatcgctttcccaccggccaggaggtcaccctcgtctacaccggcgaggtgtacaaccacgatgccctgcgcgagcggttgcgccgggccggacatgagttccgcacccgcagcgataccgaggtggtcctgcacgcctatctgcaatggggcgagcgttgttgcgagtacctgaccgggatgttcgccttcgccgtcttcgatggccgcgacggccacctgctgctggtgcgcgaccgcctgggcatcaagccgctgtattacgcgcggcaccgcgagggactgctgttcggctcggagatcaagtccatcctggcgcatccggaattcgccgccaggctcgacgcggtcggcctggtcgacctcctgacgctgtcccggggcacttcgcagacgccgttccgcgaggtccaggaactgctgcccggccacctgctgtcctggcgtcccaattcccaggcgaagttgcgccgctattgggaggtacgccgccaggagcatgccgacgacctgcagagcaccgtgcagcgcacccgcgaactggtcacccgcgccctgggggcgcaattgcacgccgacgttccggtgtgttcgctgctatcgggtgggctcgattcgaccgccctgaccggcatcgcccagcgcatcgcgaaggcggagcacggcggcgacatcaattcattctcggtggacttcgtcggccaggccgagcagttccgcagcgacgacctgcgtcccgaccaggaccagccgttcgccctgctggccgcgcagtacatcggcagccgtcatcgcaccgtgctcatcgacaatgccgaactggtctgcgaacgagcgcgcgaagaggtattccgggccaaggacgtacctttcaccttcggcgacatggatacctcgctgcacctgatgttcggcgagatccgccggcattccacggtggccatctccggtgaaggcgccgacgagctgttcggtggctacggctggttccgcgatccgcaggcggtggctgcggcgcgcttcccctgggcctccagggtgcgcctgccagccggcttcatcgacgccggtttcaaccgccgctgcgatctcctccagtaccagcaggccagctacgacgatgggctgcgccaggtcgaacacctggccggcgacagcccggaggagcggcggatgcgcgagttcagccacctgcatctgaagcgctggatggtgctgctgctcgacgcaaggatcgcctga

SEQ ID NO: 5356 - DNA, 228 bp, Pseudomonas aeruginosa
atattcgtcccctgcccggggcaggcaggtccgggaagtggatccttggaggtacatatgtcgcgatcgctgcgcaaatcgaagaaactcgtcattcctccccgtcctcgcgatgaggtcgtgcgcgcgcgcccggccttgggagaacatcagaagcaggtcgagaacgcctttgccctggccttcgaacgctacgaaaaaaccttcgaagagctggccaaggtttaa

SEQ ID NO: 5357 - DNA, 297 bp, Pseudomonas aeruginosa
atcgacagggacatggacgtgctccagacaggggataaaggtgcgtcgaaggcggcgcgtccagcagtctacccggctttcacgccagcgccagggggcccgcctcgtcccagtgcggatcggccgccatccgttcgaccaggaagtccagcagcgcccgcagcgccggcggcatctgccggcgcgaggcgtacaccgcgtggatgccgagcacctgcggcgaccactccggcagcagcgccaccaggcgtccgctacggatcagcggggctgccgagtacagcggctgctggctga

SEQ ID NO: 5358 - DNA, 927 bp, Pseudomonas aeruginosa
catggcaagcctctgatcccactgcctggagaaccgctcatgtcgcgccatggattgcttcgttccctgttcgccgccgccgccctgctgggggccgccggcgtcttcgccgccagcgccgaaccgctgcggctggaggtctacaaccccggcgagaaggcgatcttcgccgtgtcctcggaactgctggtgggccagcgcgaggcgatgctgatcgacgcgcagttctcccgcgccgacgccgagcaactggtcaagcgtatccaggccagcggcaagaccctcagcactatctacatcagccacggcgacccggacttctacttcggcctcgacgtgctgaaggccgccttccccgaggcgaagatcctcgcgacggcgcagaccgtcgcacacatccaggcgaccaaggacgccaagctggcctactgggggccgatcctcaaggacaacgcgccgacgtcgctggtggtgccggagccgctgaagggcgaccagttgaagctggaaggccatgccctgaaggtggtcgacctgaaggggccgagcccggaccgcacggtgctgtggattccgtcgctgaagacggtggttggtggcgtgctggtggaatccggttcgcacgtctggaccgccgatacccagacccaggcctcgcgccaggcctgggtggcgatgctcgaccggatcgaggcgctgcaaccgcggcgcgtggtgcccggccatttcaccggcgaggagccgaagggcctggacggcgtgcgcttcacccgtgactacctgaaggccctggaagccgaactgcccaaggccagggattccgccgcgctggtcgaggcgatgaagcgccgctacccgaacctgccgggcgaggaaggcctggagctgagcgccaaggtgctcaagggcgagatgcagtggccctga

SEQ ID NO: 5359 - DNA, 240 bp, Pseudomonas aeruginosa
cgggtcatgaaaaccatcgggctggggattgccaccttgctgttcagcgccacggcgctggccgcgccgaagccgtgcgaggaactcaaggcggagatcgagaccaagatccagtcggccggggtgacctcctacaccctggagatcgtgcgcaacgacgaagtcagcgacccgaacatggtggtcggcagttgcgagaacggcaccaagaagatcatctaccagaagaacgacgactga

SEQ ID NO: 5360 - DNA, 564 bp, Pseudomonas aeruginosa
gccagcgcgaatggggtggcgagtcgccgttcaaggcctggatcgacgcgccgttcaacaatgccaagctgcttcccttcggcctctacgaccaatgggtggcggcgttcgccgtgctgttccgccaggtcggcggcaactggccggcgttctatgcgcgggtccgtgcccttggccagctccccctggcggagcgccaggcggcgttgcagcggctggccgccgcagcgccctgacgcctgctcaggcggcgagctggtcggcgtagcaccagcgcgtggccagccggccgatcggccagagcagcgccaacaggccgacgccgagcagcgccaccagcagcgtatagccgatgccagcgggcgccaggccgaggatcatcagcagcgccagccccccgccgaccgccagcagcgcgacgctccagagcagcatggcgaccaccgcgagcagcagcgcgcggccggcggcgaagcgttgcaggcgcgccggcaggcgcgtgcagacggcgccgaagagcagcgccgcgggcagcgccacgccgctcaggtacaggccgtatag

SEQ ID NO: 5361 - DNA, 507 bp, Pseudomonas aeruginosa
agccggccatcgagcggatcctcgccgataaccgcgccgccatcgcccgcctgctggaaacccagcgcgagcagccgacctggaagggcctggtgctggcgatggacgaactcaacgaccgtctgggcgccgcctggagtccggtcagccacctcaacgcggtgtgcaacagcgccgagctgcgcgaggcctacgaggcctgcctgccggagctgtcggcctactccaccgagctggggcagaaccgcgccctgttcgaggcctacgaggcgctggcgaagagccccgaggcggccggcttcgacgtggcccagaaaaccatcctcgaacacgccctgcgcgacttccgcctgtccggcatcgacttgccggcggacaagcagaagcgctatgccgaggtgcagtcgcgcctgtccgagctgggtagccgtttctccaaccagctgctcgacgccacccaggcctggaccaagcatgtcaccgacgaagccgcgctggccggcctga

SEQ ID NO: 5362 - DNA, 531 bp, Pseudomonas aeruginosa
tggaagagatcctcgacctgcgccaggagctggctggcctgctcggcttcgccaactacgccgagctgtcgctggcgaccaagatggccgagtccagcgaccaggtgctcagcttcctccgcgacctggcggtgcgcagcaagccgttcgccgcccgcgacctggagcagctgcgcgcctacgccgccgagcagggctgcaccgaattgcagagctgggacgccggctactacgccgagaaactccgcgaggcgcgctacagcgtgtcccaggaggcgctgcgtgcctacttcccggtggacaaggtgctttccggcctgttcgccatcgtcgagcgcctctacggcatccagatccgcgaactgcacgatttcgaacgctggcacgccgacgtacgcctgttcgagatcctcgagaacggcgagcacgtcggccgcttctacttcgacctctatgcccgcgccaacaagcgcggcggtgcctggatggacggcgcccgcgaccgccggcgcgacgcccagggccggctga

SEQ ID NO: 5363 - DNA, 657 bp, Pseudomonas aeruginosa
tgcgtccgccggcgtacaaccgcttcgccaacagcttcgcgcacattttcgccggcggatacgcggccggttactacagttacaagtgggccgaggtgctgtccgccgatgccttctcgcgtttcgaggaagaaggcgtgttcaaccccgataccgggcgtgccttccgcgaggcgatcctggcccgcggcggctcccgcgagccgatgctgttgttcgtcgatttccgcggtcgcgagccgtccatcgacgccctgctgcgtcactccgggctggtcggggaggccgcatgagcccggcgatcaccaggaagcgcttcatcgccggggcggtctgcccggcgtgcagcgaacaggacaagatccagatgtgggaagaggacggcgtgccgcaccgcgaatgcgtggcctgcggctacgccgacacgctcaacgcccagggccagtcgatcccgaaggagctgggtacgcgggtcaaccagaacgcgccgaagccggccaacccgaaggtgcagtcggtgcagttcttccccaatcccaagctgaagaagaagcccgacgcctgaccgctcgccgccgaccggcggcgatggctgtgggccggggcccggtgcgatactgtatccatatacagtatttcaccgggtttccctcatga

SEQ ID NO: 5364 - DNA, 1620 bp, Pseudomonas aeruginosa
tccctctgcggcttcgatccgcgccgcgcgccagccgccgctggcggcggccaggacgctgcacagcagcgtggcgagcagcgccgtcaggtagtggctgggcagcaggcggcagacgaactcgccgctctggttgtcgaacaggtggttcagcgcgccggccgtggcggcgtacagcagcccggcgaggaacaggccgaagacggcgctgaacagcgccaggagcatgacgaagccgaccagcgcggcggtcgggaagcccagcagacgcagcaccgccagggcgcggcgcttgcgttcgacggcggccaggctgctggcggcgatggcggcgaaggcaccgccgatggccagcgcggcgacgatccagaacaccaggccgaggttgcggctgaggctgcgcacctgggcgatggcctcggcctgggtggcgacttccacgccactcgcgacgaagtgccggcgcagcccttccaccgcatcgaggtctcgggcgtacaggcggaagcccgggtagatgcgtgcgcgcggggtctcgccggccttccccggccagccgtaggcggccaccgcgcgaccgtcgcgatagtcctcggcggcttccagcagggccagcggggcgaacagcgcgtcgcgggcgaaacgctcctgcggcagcaccgcgagcacttccagctccaggcgctggctctgtgcctggccatccatgcgccggccgatgcgcgcgacgatgcgctcgccaggctgggcgccgagtttttccgcggcgccgtggctgagcaccacgcgggtcggccggtcgggttgcggcaggccggccagcagcgggtcgccggcggcgctgggaatcatctcgacgctcagggcggtctcgccgccgccgctgaggtcggcggtggcggcgatctgccgggtgcgcggcacggcgaaggcgacgtccgcgcgtgcggccagggcggcgatgtcctcggcacggtagcgggcgccgccgaccggaatgatctcgcgcacagaaggcgcgcgctccagccgctcggtgagggtgctgaccaggccgtacttgaggccgaacagcaccagcagcggggtgatcaccgccgccagggcgaagatcgcgcagagcgacaggcgcgcctcgccgcgatagtcggcccaggccagcgagagcagcaggccggcgcgcatcagccaacttcctcgaggcaggcgccgacgctgtcgtcggcctcgcgttgccagcggatggccaggacttccaggccggctgcgcgagccaggcgctcgtcgtgggtggcgaccacggtgcaggcgccgcgctcgcgggcctgctccaccagcaggcgcatcacccgttcggcgttcagcgggtcgagcgccgcggtcggctcgtcggccagcaacaggcgcggcgcatgcgccagggcgcgggcgatggcgacccgctggcgctggccgaccgacagcgccgccggtttcttgtccagctggtcgccgatttccagccgatcggccagcgcctgcacgcgctcggcggatggggcgccgagcaacgcgcagggcagtccgatgttgcgccgcacatcgaggaattcgagcaacccgccgctttgcagcacgtag

SEQ ID NO: 5365 - DNA, 429 bp, Pseudomonas aeruginosa
ccttgtccaggtcgccgcgctcgccgatctgccgctgcaggccgtcgatcacctcgcgcacgcggtcgatgtagggctgcatcgacaccgaggtgtccaccaccaggacgatgccggtgcggaaggtgtcgctcgccgcgccgctggcgccgccatgcccggcctggcccggcgcctggggtgccgcggcgctgccgccggggtcgatcgaggcgacctccagcaactgcgccggctggccgtcggcgtcgaagctttccttcgagtcgaagatcggcagcaggtagaactggtcctgggggatcgcccggtcgttgggctcgaccgcgaccacctgcggatcgcccttgtggtccaccgcctgggtcagggtgtcgcgcgctgcgcgggtatcgccgagcaggcgctcgacctgctcggcgctgttga

SEQ ID NO: 5366 - DNA, 735 bp, Pseudomonas aeruginosa
tccagggccagcttggggggcaaacgttgggcaaccgatgtggcggccgcgctgagcctggtcctggtggtggcgatgaccgtcgcctggctgtacctacaggacctcgaccagggcctgatgacgttggtccaggagcatcgcaacgccgacatgaacccggtgatggtggtggtcacccggctcggcgatttccgcacccagttcatcgccggcgcgctgctcggcggtatcctcctgctgacccggcaatggcgtccggccattttcgccatcggcaccctggtgggtaccgcgctggccaaccagaccttgaagaccctgttcgcccgcgcccgcccggaagtgctggccgaaccgctgagcagcttcagcttccccagcggacacagctcggcgtccttcgccttcttcctcaccctgggcgtcctcgccagccgccagcaaccgccgcgctggcgcctgacctgggtactgctggcggtgatcccgtcgctgagcatcgccctgtcgcgggtctaccttggcgtgcactggccgtcggacatcgtcgccggcgccctgctcgccactacggtctgcgccgccagcctgtggctgagccagcgccgcgagtcgctgccggcgctgccgcaacgggtctggtggctgctgttgccggtctgcgtggcgaccctggcgatcgccgccggctgggccctgccggaagccattgcgcgctaccggccgctgtga

SEQ ID NO: 5367 - DNA, 573 bp, Pseudomonas aeruginosa
ggggaaacaacggcaacttcatcgcgactcctcgggcatcgtcaggcaaccagcgctaccgccaacggtagcagcactgcggtggcaacgcccatcaggctcatcgccagggcggcgaaggcgccgcactcctcgccttcctgcaaggcccgcgaagtgcctaccgcgtgggccgtcatgcccagcgccatgccctgcgcggcggggtgccggacgccgatggcgcgcagcagctccggcccgaggatcgccccgagtaccccggtgatcagtacgaacacggcggccagcgccgccacgccgccgatctggctggccaccagcatggcgatcggcgaggtcaccgacttcggcgccatgctcatcagcatccgcggctcggcaccgaacaaccagccgaatgcgatgcccagcaccgtcgccagcgtaccggcgaccaccagggtcagcagggtcggccagaacaattggcggatacgccgcaggttgaggaacagcggcaccgccagggccaccgtggcggggccgaggagaatggtcaggaccttggcgctggcactgtattcgtcgtag

SEQ ID NO: 5368 - DNA, 831 bp, Pseudomonas aeruginosa
tcaaggcgcgcgccaccctggagatcgaaggccaggagaaacccgcctacatcgccgagaccctcagcctttgcttcgtctgagcccgccccagcgagcgctgccgttcgcttgacggccaggcgccttcgcgcccctatcccccttccaaaagcccccgctcgcgggggcgctctgggccggcagggaaataccctactgccaggcaacgatttttccgccacactgtctcccctccaccctcggaccgaaccactcatcgggaacgccgcatgcttcgccccgccaggtctctctcgctctgctccgccctggtcatcctgctcgccgcctgtggcgagggcgaaccgctgctcccggccgatgcgcgcctgccggacggcgcgcgctatcgcggcgagctggtggacgggcgcctggaaggccagggccggctggactacgacaacggcgcctggtacgccggccgcttcgagcatggcctgctgcacggccatggcacctggcagggcgccgacggcagccgctacagcggtggcttcgcggccggcctgttcgacggtcagggacgcctggcgatggccgatggcagcgtctaccagggcggtttccgccagggcctgttcgatggcgaaggcagcctggaacaacagggcactcgctaccgcggcggtttccgcaagggcctgtacagcggccagggcacgctggacggcagcgatggcagccgctaccagggcagcttccgccagggccgcctggaaggcgaaggcagcttcagcgacagccagggcaaccagtacgccggtaccttccgcgacgggcaactga

SEQ ID NO: 5369 - DNA, 489 bp, Pseudomonas aeruginosa
ccagccacggctccagcgaccaccagttggcccctggacatgcccggcctgaacctcggcgacctgccggccgcggaactggccgaactgctcgcgccgctgcgccagcgcgacaaggtgctggtggtatcggcctgctacagcgggggcttcatcccgccgctgaaagacgaacgtaccctgatcctgaccgccgcgcgtgccgaccgggtctcgttcggctgttccgacgacgccgacttcacctatttcggccgcgccttgctggccaatgcgctgaaccgcaccgacgatctgtccaaagcgttcgaactggcgaaagaggaagtgcgtcaaagggagaaggaggaaggtttcgaagcttcggaaccgcaagcctggttaccggaacgcgtgctcgcgcactggcggacgctgcgggggcagcaagccgagcgcgcgctcgcgtcccgggaaggaaaaaccggcgagggcgcggcgggcaaatag

SEQ ID NO: 5370 - DNA, 975 bp, Pseudomonas aeruginosa
accaccggcgcccctggcttggccgcatccagggtgcgcacggtggcgcaaccgctcatctgcaccgccaggaccagcagcagcaccctactcgtcgctgacaaggtgctgttccccccagcgcggcagcatatcctggggaatccccagggtgttgaggattcgcgcgacgacgaagtccaccaggtcctccaccgattgcggctggtggtagaagcccggcgccgccggcaggatcaccgcgccgaggttggacagcttgagcatgttttccaggtggatactggagaacggcgcctcgcgcggcaccagcaccagcggccggcgctccttcagggcgacatcggcggcgcgctcgatgaggttgttgcaggcccccgtggcgaccgccgacagggtgccggtggaacacgggcagatcaccatggcattgggcgcgctggagccggaggccggcggcgccatccagtcgttctggccgaacacgcggatctgtccggcggcggcaccgcaatattcggtgaggaaggcctgcatcgcctgcggcttggccggcaaggccacgtcggtctcggtggccatcaccagttgcgcggccttggagatcaggaagtgcacctcgcgctcttcctgcaccaggcaatcgagcaagcgcaggccgtactgggcgccggaggcgccggtcatcgccagggtaatgcgttccggaccgctcatcgcgcccctcactcggccagcgccgcggccagcttgccgtgcaagccgccgaagccgccgttgctcatgatcaccacttgcgcgccgggcctggcctgctggcgcacctgctcgatgatcgcctccagggtatcgcagacctgcgacggtatcgcgcattgcgcggcggtggcggccaggtcccagcccaggttcggcggcgcgtaccagagcacctggtcggcctggcgcacgctgtccggcaggccgtcgcgatga

SEQ ID NO: 5371 - DNA, 720 bp, Pseudomonas aeruginosa
ggaacagcggcaccgccagggccaccgtggcggggccgaggagaatggtcaggaccttggcgctggcactgtattcgtcgtagtcgatgccgcaaagcagcagcacgccgatcaccaccagcatcgataccagcaccggctgcaggaacacccagcgggtccgttcataggcggccagggccaactggtaggcgcccagggtcacgccgacgccgaacagcggatggtggatcaccgcctcgagggcggcctgccaggccatcaggactcctcccggcgacgttgctggcgatcgatgagcttctgcatcatccagccggcgaacaggaacgacagcaccagcgacagtaccagcgcgccgacgatggcccagaagtcggcggcgatctcccgcgcataggccatcaccccgaccgccgccggcaccagcagcagcggcaggtagcgcagcaacgagccggccgcctcgttgaccggcttgccgacctcgccacgcgccaggaaataaccgaacagcagcaccaggccgatgatcggaccgggcagcatgggcaacaacagaacgttcagacctgtgccgagcaactggaacagcaccagccaggtcagaccacgaagcaacatgggcacctccagcaagggccgaccattatgcccagcccgccgggacattggcacgctcctcgcctatccatcagtcgcagtcgcggcaccgcatga

SEQ ID NO: 5372 - DNA, 1461 bp, Pseudomonas aeruginosa
cggccaggcgccttcgcgcccctatcccccttccaaaagcccccgctcgcgggggcgctctgggccggcagggaaataccctactgccaggcaacgatttttccgccacactgtctcccctccaccctcggaccgaaccactcatcgggaacgccgcatgcttcgccccgccaggtctctctcgctctgctccgccctggtcatcctgctcgccgcctgtggcgagggcgaaccgctgctcccggccgatgcgcgcctgccggacggcgcgcgctatcgcggcgagctggtggacgggcgcctggaaggccagggccggctggactacgacaacggcgcctggtacgccggccgcttcgagcatggcctgctgcacggccatggcacctggcagggcgccgacggcagccgctacagcggtggcttcgcggccggcctgttcgacggtcagggacgcctggcgatggccgatggcagcgtctaccagggcggtttccgccagggcctgttcgatggcgaaggcagcctggaacaacagggcactcgctaccgcggcggtttccgcaagggcctgtacagcggccagggcacgctggacggcagcgatggcagccgctaccagggcagcttccgccagggccgcctggaaggcgaaggcagcttcagcgacagccagggcaaccagtacgccggtaccttccgcgacgggcaactgaacggcaagggcgctggagcgggcccgatgggcgaccgctacatcggccagttcaaggacaaccagttccattgccaggggcgctacgaaagcgcagcggcgatgtctggatcggccgcttcagcgaaggcgcgctgaacggccccggcgagcttctcggcgccgacggcagccgctaccgcggcggtttccagttctggcgcttccatggccagggcctgctcgaacaactggacggcacccgctacgaaggcggcttcgccgccggcgcctatgccggccaaggcaccctggaccgcgccgacggcagccgtgagcagggactctgggccgacggcaagcgcatccgcgacgccgccggcaaggccctgcccgacaccctggaaatcggcctgttggcccagggtcgcctgctcgacgaagaactgcgcaagatcccggcctcgacgccggccagcgaactctatgccctgagcctgggcggcgatggccgccagggcgtgttcctgcgcgaggccgattacgccggcgacctgctcggccagcgtttcgccgctcgtggcgtgattcgcctggtcaaccaccgcgaccacttcggcgaccgcccgctggctacccgggaaagcctgtcccgcgccgtgcgcaccctggccgaacgcagcgggccggaagacctggtcttcatcttacctgaccagccacggctccagcgaccaccagttggcccctggacatgcccggcctga

SEQ ID NO: 5373 - DNA, 897 bp, Pseudomonas aeruginosa
accgcaccgacgatctgtccaaagcgttcgaactggcgaaagaggaagtgcgtcaaagggagaaggaggaaggtttcgaagcttcggaaccgcaagcctggttaccggaacgcgtgctcgcgcactggcggacgctgcgggggcagcaagccgagcgcgcgctcgcgtcccgggaaggaaaaaccggcgagggcgcggcgggcaaatagatacgccgcgcactacgctcattggtgtggaaggggagaaacacacatgcactcgacgcccaagcgcgttctgctcgccggcgcgaccggtcttaccggcgagcacctgttggatcggatattgagcgagccgaccctggccaaggtcatcgcccctgcccgcaaggcgctggccgagcatccgcggctggacaacccggtcggcccgctggccgagctgctgccgcaactcgacggcagcatcgataccgccttctgctgcctcggcaccacgatcaaggaagccggctcggaggaggccttccgcgcggtcgatttcgacctgccgctggcggtgggcaagcgcgcgctggaaatgggcgcccggcattacctggtggtcagcgccctgggcgccgacgccaagtcgtcgatcttctacaaccgggtcaagggcgaactggagcaggccctgcaggaacagggctggccacaactgaccatcgcccggccatcgctgctgttcggcccgcgcgaggaattccgcctggccgagatcctcgctgcgccgatcgcccgcatccttcccggcaagtaccacggcatcgaggcctgcgacctggcccgcgcgctctggcgcctggcgctggaggaaggcaagggcgtgcgcttcgtcgagtccgacgaactgcgcaagctggggaaatga

SEQ ID NO: 5374 - DNA, 819 bp, Pseudomonas aeruginosa
cagcactgcggtggcaacgcccatcaggctcatcgccagggcggcgaaggcgccgcactcctcgccttcctgcaaggcccgcgaagtgcctaccgcgtgggccgtcatgcccagcgccatgccctgcgcggcggggtgccggacgccgatggcgcgcagcagctccggcccgaggatcgccccgagtaccccggtgatcagtacgaacacggcggccagcgccgccacgccgccgatctggctggccaccagcatggcgatcggcgaggtcaccgacttcggcgccatgctcatcagcatccgcggctcggcaccgaacaaccagccgaatgcgatgcccagcaccgtcgccagcgtaccggcgaccaccagggtcagcagggtcggccagaacaattggcggatacgccgcaggttgaggaacagcggcaccgccagggccaccgtggcggggccgaggagaatggtcaggaccttggcgctggcactgtattcgtcgtagtcgatgccgcaaagcagcagcacgccgatcaccaccagcatcgataccagcaccggctgcaggaacacccagcgggtccgttcataggcggccagggccaactggtaggcgcccagggtcacgccgacgccgaacagcggatggtggatcaccgcctcgagggcggcctgccaggccatcaggactcctcccggcgacgttgctggcgatcgatgagcttctgcatcatccagccggcgaacaggaacgacagcaccagcgacagtaccagcgcgccgacgatggcccagaagtcggcggcgatctcccgcgcatag

SEQ ID NO: 5375 - DNA, 522 bp, Pseudomonas aeruginosa
cccggtcgccaacgcgtgctgattttcctgcaccatgagaacaacagccatcctcccggaggacttatgccattcgtacccgtagcagcgctcaaggactatgtcggcaaggatctcggccattccgaatggctcaccatcgaccaggagcgggtcgaccagttcgccgaatgcaccggcgaccaccagttcatccacgtcgatccggagaaggcggcgaagacgcccttcggcggcaccatcgcccacggtttcctgtccctgtcgctgatcccgaagctgatggaaggcctgctggtgcttcccgaaggactgaagatggcggtcaactacggcctcgatacggtgcgcttcatccagccggtgcgggtcggctcgcgggtccgcctgggcctgaccctactcgacgtcaacgagaagaatcccggccagtggctgatcaaggcgcgcgccaccctggagatcgaaggccaggagaaacccgcctacatcgccgagaccctcagcctttgcttcgtctga

SEQ ID NO: 5376 - DNA, 885 bp, Pseudomonas aeruginosa
gcccgccccagcgagcgctgccgttcgcttgacggccaggcgccttcgcgcccctatcccccttccaaaagcccccgctcgcgggggcgctctgggccggcagggaaataccctactgccaggcaacgatttttccgccacactgtctcccctccaccctcggaccgaaccactcatcgggaacgccgcatgcttcgccccgccaggtctctctcgctctgctccgccctggtcatcctgctcgccgcctgtggcgagggcgaaccgctgctcccggccgatgcgcgcctgccggacggcgcgcgctatcgcggcgagctggtggacgggcgcctggaaggccagggccggctggactacgacaacggcgcctggtacgccggccgcttcgagcatggcctgctgcacggccatggcacctggcagggcgccgacggcagccgctacagcggtggcttcgcggccggcctgttcgacggtcagggacgcctggcgatggccgatggcagcgtctaccagggcggtttccgccagggcctgttcgatggcgaaggcagcctggaacaacagggcactcgctaccgcggcggtttccgcaagggcctgtacagcggccagggcacgctggacggcagcgatggcagccgctaccagggcagcttccgccagggccgcctggaaggcgaaggcagcttcagcgacagccagggcaaccagtacgccggtaccttccgcgacgggcaactgaacggcaagggcgctggagcgggcccgatgggcgaccgctacatcggccagttcaaggacaaccagttccattgccaggggcgctacgaaagcgcagcggcgatgtctggatcggccgcttcagcgaaggcgcgctga

SEQ ID NO: 5377 - DNA, 879 bp, Pseudomonas aeruginosa
tgcgttccggaccgctcatcgcgcccctcactcggccagcgccgcggccagcttgccgtgcaagccgccgaagccgccgttgctcatgatcaccacttgcgcgccgggcctggcctgctggcgcacctgctcgatgatcgcctccagggtatcgcagacctgcgacggtatcgcgcattgcgcggcggtggcggccaggtcccagcccaggttcggcggcgcgtaccagagcacctggtcggcctggcgcacgctgtccggcaggccgtcgcgatgagcgccgagcttcatcgagttggaacgcggctcgacgatggcgatcacctgggtatccgcgccaacctgcttgcgcaggccgtcgagggtggtggcgatggcggtcggatggtgggcgaagtcgtcgtagagggtcacgccccggacctccgcgaccttctccatgcgccgcttgacgttgcggaactcgctgagcgccgccgcgccctggctgggcaccacaccgacatggcgcgccgccgccaggctggcgagggcgttggcgacgttgtgcaggccggtcagcggccagtccacctcgccctggacgatgccgtcgaacagcacctcgaagcgcgagccgtcctcggcgagcaggcgcgcctgccactggccgccttcgccggtggtctgcaccggggtccagcagcccatcccgagtacgcgctccagggctttctcggcgctcgggcgaatgatcaggccctcgcccggcacggtgcgcaccagatggtggaactgccgctcgatggccgcgaggtcggggaagatgtccgcgtggtcgaattccaggttgttcaggatcgccgtgcgcgggcggtaatggacgaacttcgagcgctt

SEQ ID NO: 5378 - DNA, 1491 bp, Pseudomonas aeruginosa
caagcgctcgaagttcgtccattaccgcccgcgcacggcgatcctgaacaacctggaattcgaccacgcggacatcttccccgacctcgcggccatcgagcggcagttccaccatctggtgcgcaccgtgccgggcgagggcctgatcattcgcccgagcgccgagaaagccctggagcgcgtactcgggatgggctgctggaccccggtgcagaccaccggcgaaggcggccagtggcaggcgcgcctgctcgccgaggacggctcgcgcttcgaggtgctgttcgacggcatcgtccagggcgaggtggactggccgctgaccggcctgcacaacgtcgccaacgccctcgccagcctggcggcggcgcgccatgtcggtgtggtgcccagccagggcgcggcggcgctcagcgagttccgcaacgtcaagcggcgcatggagaaggtcgcggaggtccggggcgtgaccctctacgacgacttcgcccaccatccgaccgccatcgccaccaccctcgacggcctgcgcaagcaggttggcgcggatacccaggtgatcgccatcgtcgagccgcgttccaactcgatgaagctcggcgctcatcgcgacggcctgccggacagcgtgcgccaggccgaccaggtgctctggtacgcgccgccgaacctgggctgggacctggccgccaccgccgcgcaatgcgcgataccgtcgcaggtctgcgataccctggaggcgatcatcgagcaggtgcgccagcaggccaggcccggcgcgcaagtggtgatcatgagcaacggcggcttcggcggcttgcacggcaagctggccgcggcgctggccgagtgaggggcgcgatgagcggtccggaacgcattaccctggcgatgaccggcgcctccggcgcccagtacggcctgcgcttgctcgattgcctggtgcaggaagagcgcgaggtgcacttcctgatctccaaggccgcgcaactggtgatggccaccgagaccgacgtggccttgccggccaagccgcaggcgatgcaggccttcctcaccgaatattgcggtgccgccgccggacagatccgcgtgttcggccagaacgactggatggcgccgccggcctccggctccagcgcgcccaatgccatggtgatctgcccgtgttccaccggcaccctgtcggcggtcgccacgggggcctgcaacaacctcatcgagcgcgccgccgatgtcgccctgaaggagcgccggccgctggtgctggtgccgcgcgaggcgccgttctccagtatccacctggaaaacatgctcaagctgtccaacctcggcgcggtgatcctgccggcggcgccgggcttctaccaccagccgcaatcggtggaggacctggtggacttcgtcgtcgcgcgaatcctcaacaccctggggattccccaggatatgctgccgcgctggggggaacagcaccttgtcagcgacgagtag

SEQ ID NO: 5379 - DNA, 636 bp, Pseudomonas aeruginosa
acggacccgctgggtgttcctgcagccggtgctggtatcgatgctggtggtgatcggcgtgctgctgctttgcggcatcgactacgacgaatacagtgccagcgccaaggtcctgaccattctcctcggccccgccacggtggccctggcggtgccgctgttcctcaacctgcggcgtatccgccaattgttctggccgaccctgctgaccctggtggtcgccggtacgctggcgacggtgctgggcatcgcattcggctggttgttcggtgccgagccgcggatgctgatgagcatggcgccgaagtcggtgacctcgccgatcgccatgctggtggccagccagatcggcggcgtggcggcgctggccgccgtgttcgtactgatcaccggggtactcggggcgatcctcgggccggagctgctgcgcgccatcggcgtccggcaccccgccgcgcagggcatggcgctgggcatgacggcccacgcggtaggcacttcgcgggccttgcaggaaggcgaggagtgcggcgccttcgccgccctggcgatgagcctgatgggcgttgccaccgcagtgctgctaccgttggcggtagcgctggttgcctgacgatgcccgaggagtcgcgatga

SEQ ID NO: 5380 - DNA, 891 bp, Pseudomonas aeruginosa
  unsure (239): Identity of nucleotide at the above locations are unknown.
cgtacgaacacaacgatctcgccgcgttgctcagcgtgctggccgagcatccgatggtggccgcgctggagatgggcggcgagcccggcggccagcaggacctggccaaccagttggcctacctgctgccgttcgataccgaacgcaagctcgaactgctcgccctgcccgacgcgcagatgcaactggcgcggatccaggtgctgctggagcacctgcagggcgagttgggtatcgantgagcgccaaccctcacagcggccggtagcgcgcaatggcttccggcagggcccagccggcggcgatcgccagggtcgccacgcagaccggcaacagcagccaccagacccgttgcggcagcgccggcagcgactcgcggcgctggctcagccacaggctggcggcgcagaccgtagtggcgagcagggcgccggcgacgatgtccgacggccagtgcacgccaaggtagacccgcgacagggcgatgctcagcgacgggatcaccgccagcagtacccaggtcaggcgccagcgcggcggttgctggcggctggcgaggacgcccagggtgaggaagaaggcgaaggacgccgagctgtgtccgctggggaagctgaagctgctcagcggttcggccagcacttccgggcgggcgcgggcgaacagggtcttcaaggtctggttggccagcgcggtacccaccagggtgccgatggcgaaaatggccggacgccattgccgggtcagcaggaggataccgccgagcagcgcgccggcgatgaactgggtgcggaaatcgccgagccgggtgaccaccaccatcaccgggttcatgtcggcgttgcgatgctcctggaccaacgtcatcaggccctggtcgaggtcctgtag

SEQ ID NO: 5381 - DNA, 852 bp, Pseudomonas aeruginosa
aagcgctcgaagttcgtccattaccgcccgcgcacggcgatcctgaacaacctggaattcgaccacgcggacatcttccccgacctcgcggccatcgagcggcagttccaccatctggtgcgcaccgtgccgggcgagggcctgatcattcgcccgagcgccgagaaagccctggagcgcgtactcgggatgggctgctggaccccggtgcagaccaccggcgaaggcggccagtggcaggcgcgcctgctcgccgaggacggctcgcgcttcgaggtgctgttcgacggcatcgtccagggcgaggtggactggccgctgaccggcctgcacaacgtcgccaacgccctcgccagcctggcggcggcgcgccatgtcggtgtggtgcccagccagggcgcggcggcgctcagcgagttccgcaacgtcaagcggcgcatggagaaggtcgcggaggtccggggcgtgaccctctacgacgacttcgcccaccatccgaccgccatcgccaccaccctcgacggcctgcgcaagcaggttggcgcggatacccaggtgatcgccatcgtcgagccgcgttccaactcgatgaagctcggcgctcatcgcgacggcctgccggacagcgtgcgccaggccgaccaggtgctctggtacgcgccgccgaacctgggctgggacctggccgccaccgccgcgcaatgcgcgataccgtcgcaggtctgcgataccctggaggcgatcatcgagcaggtgcgccagcaggccaggcccggcgcgcaagtggtgatcatgagcaacggcggcttcggcggcttgcacggcaagctggccgcggcgctggccgagtga

SEQ ID NO: 5382 - DNA, 426 bp, Pseudomonas aeruginosa
tcctgccggcggcgccgggcttctaccaccagccgcaatcggtggaggacctggtggacttcgtcgtcgcgcgaatcctcaacaccctggggattccccaggatatgctgccgcgctggggggaacagcaccttgtcagcgacgagtagggtgctgctgctggtcctggcggtgcagatgagcggttgcgccaccgtgcgcaccctggatgcggccaagccaggggcgccggtggtctacgccggcacccggctggattggtacagcctgcacggcggctgctgcccgatggaacgcttcggcgcggaggcgccggcccatccggggctcgacctgccgggcagcgcgctgctggacaccctgttgctgccgttctcgctggccaccgccatcggcctcaacctcggcatcagcggcggcatgtag

SEQ ID NO: 5383 - DNA, 990 bp, Pseudomonas aeruginosa
agcggccgatccagacatcgccgctgcgctttcgtagcgcccctggcaatggaactggttgtccttgaactggccgatgtagcggtcgcccatcgggcccgctccagcgcccttgccgttcagttgcccgtcgcggaaggtaccggcgtactggttgccctggctgtcgctgaagctgccttcgccttccaggcggccctggcggaagctgccctggtagcggctgccatcgctgccgtccagcgtgccctggccgctgtacaggcccttgcggaaaccgccgcggtagcgagtgccctgttgttccaggctgccttcgccatcgaacaggccctggcggaaaccgccctggtagacgctgccatcggccatcgccaggcgtccctgaccgtcgaacaggccggccgcgaagccaccgctgtagcggctgccgtcggcgccctgccaggtgccatggccgtgcagcaggccatgctcgaagcggccggcgtaccaggcgccgttgtcgtagtccagccggccctggccttccaggcgcccgtccaccagctcgccgcgatagcgcgcgccgtccggcaggcgcgcatcggccgggagcagcggttcgccctcgccacaggcggcgagcaggatgaccagggcggagcagagcgagagagacctggcggggcgaagcatgcggcgttcccgatgagtggttcggtccgagggtggaggggagacagtgtggcggaaaaatcgttgcctggcagtagggtatttccctgccggcccagagcgcccccgcgagcgggggcttttggaagggggataggggcgcgaaggcgcctggccgtcaagcgaacggcagcgctcgctggggcgggctcagacgaagcaaaggctgagggtctcggcgatgtaggcgggtttctcctggccttcgatctccagggtggcgcgcgccttgatcagccactggccgggattcttctcgttgacgtcgagtag

SEQ ID NO: 5384 - DNA, 1098 bp, Pseudomonas aeruginosa
tggtcggcccttgctggaggtgcccatgttgcttcgtggtctgacctggctggtgctgttccagttgctcggcacaggtctgaacgttctgttgttgcccatgctgcccggtccgatcatcggcctggtgctgctgttcggttatttcctggcgcgtggcgaggtcggcaagccggtcaacgaggcggccggctcgttgctgcgctacctgccgctgctgctggtgccggcggcggtcggggtgatggcctatgcgcgggagatcgccgccgacttctgggccatcgtcggcgcgctggtactgtcgctggtgctgtcgttcctgttcgccggctggatgatgcagaagctcatcgatcgccagcaacgtcgccgggaggagtcctgatggcctggcaggccgccctcgaggcggtgatccaccatccgctgttcggcgtcggcgtgaccctgggcgcctaccagttggccctggccgcctatgaacggacccgctgggtgttcctgcagccggtgctggtatcgatgctggtggtgatcggcgtgctgctgctttgcggcatcgactacgacgaatacagtgccagcgccaaggtcctgaccattctcctcggccccgccacggtggccctggcggtgccgctgttcctcaacctgcggcgtatccgccaattgttctggccgaccctgctgaccctggtggtcgccggtacgctggcgacggtgctgggcatcgcattcggctggttgttcggtgccgagccgcggatgctgatgagcatggcgccgaagtcggtgacctcgccgatcgccatgctggtggccagccagatcggcggcgtggcggcgctggccgccgtgttcgtactgatcaccggggtactcggggcgatcctcgggccggagctgctgcgcgccatcggcgtccggcaccccgccgcgcagggcatggcgctgggcatgacggcccacgcggtaggcacttcgcgggccttgcaggaaggcgaggagtgcggcgccttcgccgccctggcgatgagcctgatgggcgttgccaccgcagtgctgctaccgttggcggtagcgctggttgcctga

SEQ ID NO: 5385 - DNA, 639 bp, Pseudomonas aeruginosa
  unsure (610): Identity of nucleotide at the above locations are unknown.
cgatgcccgaggagtcgcgatgaagttgccgttgtttcccctcaacgccgtgctgttccccggttgccgcctggacctgcagatcttcgaggcgcgctacctggacatgatcagccgctgcatgaagcagggcaccggtttcggcgtggtgaccatcggcgaagggcgggaggtcggcgaagcgccgagccgcctggcgatggtcggctgcgaggcctcggtccgcgactggcagcagcgcccgaacggcctgctgggcatccgcgtggagggcggtcggcgtttccaggtgctgtcggtggaggtccaggccgaccagctcagcgtcggcgagatcgagtggttcgaagacctgccggagcaacccctgacgtacgaacacaacgatctcgccgcgttgctcagcgtgctggccgagcatccgatggtggccgcgctggagatgggcggcgagcccggcggccagcaggacctggccaaccagttggcctacctgctgccgttcgataccgaacgcaagctcgaactgctcgccctgcccgacgcgcagatgcaactggcgcggatccaggtgctgctggagcacctgcagggcgagttgggtatcgantgagcgccaaccctcacagcggccggtag

SEQ ID NO: 5386 - DNA, 1200 bp, Pseudomonas aeruginosa
gcggttgcgccaccgtgcgcaccctggatgcggccaagccaggggcgccggtggtctacgccggcacccggctggattggtacagcctgcacggcggctgctgcccgatggaacgcttcggcgcggaggcgccggcccatccggggctcgacctgccgggcagcgcgctgctggacaccctgttgctgccgttctcgctggccaccgccatcggcctcaacctcggcatcagcggcggcatgtagggcgggacccgccccaggctcatttccccagcttgcgcagttcgtcggactcgacgaagcgcacgcccttgccttcctccagcgccaggcgccagagcgcgcgggccaggtcgcaggcctcgatgccgtggtacttgccgggaaggatgcgggcgatcggcgcagcgaggatctcggccaggcggaattcctcgcgcgggccgaacagcagcgatggccgggcgatggtcagttgtggccagccctgttcctgcagggcctgctccagttcgcccttgacccggttgtagaagatcgacgacttggcgtcggcgcccagggcgctgaccaccaggtaatgccgggcgcccatttccagcgcgcgcttgcccaccgccagcggcaggtcgaaatcgaccgcgcggaaggcctcctccgagccggcttccttgatcgtggtgccgaggcagcagaaggcggtatcgatgctgccgtcgagttgcggcagcagctcggccagcgggccgaccgggttgtccagccgcggatgctcggccagcgccttgcgggcaggggcgatgaccttggccagggtcggctcgctcaatatccgatccaacaggtgctcgccggtaagaccggtcgcgccggcgagcagaacgcgcttgggcgtcgagtgcatgtgtgtttctccccttccacaccaatgagcgtagtgcgcggcgtatctatttgcccgccgcgccctcgccggtttttccttcccgggacgcgagcgcgcgctcggcttgctgcccccgcagcgtccgccagtgcgcgagcacgcgttccggtaaccaggcttgcggttccgaagcttcgaaaccttcctccttctccctttgacgcacttcctctttcgccagttcgaacgctttggacagatcgtcggtgcggttcagcgcattggccagcaaggcgcggccgaaataggtga

SEQ ID NO: 5387 - DNA, 426 bp, Pseudomonas aeruginosa
gcgaggagcgtgccaatgtcccggcgggctgggcataatggtcggcccttgctggaggtgcccatgttgcttcgtggtctgacctggctggtgctgttccagttgctcggcacaggtctgaacgttctgttgttgcccatgctgcccggtccgatcatcggcctggtgctgctgttcggttatttcctggcgcgtggcgaggtcggcaagccggtcaacgaggcggccggctcgttgctgcgctacctgccgctgctgctggtgccggcggcggtcggggtgatggcctatgcgcgggagatcgccgccgacttctgggccatcgtcggcgcgctggtactgtcgctggtgctgtcgttcctgttcgccggctggatgatgcagaagctcatcgatcgccagcaacgtcgccgggaggagtcctga

SEQ ID NO: 5388 - DNA, 627 bp, Pseudomonas aeruginosa
  unsure (624): Identity of nucleotide at the above locations are unknown.
cgctggttgcctgacgatgcccgaggagtcgcgatgaagttgccgttgtttcccctcaacgccgtgctgttccccggttgccgcctggacctgcagatcttcgaggcgcgctacctggacatgatcagccgctgcatgaagcagggcaccggtttcggcgtggtgaccatcggcgaagggcgggaggtcggcgaagcgccgagccgcctggcgatggtcggctgcgaggcctcggtccgcgactggcagcagcgcccgaacggcctgctgggcatccgcgtggagggcggtcggcgtttccaggtgctgtcggtggaggtccaggccgaccagctcagcgtcggcgagatcgagtggttcgaagacctgccggagcaacccctgacgtacgaacacaacgatctcgccgcgttgctcagcgtgctggccgagcatccgatggtggccgcgctggagatgggcggcgagcccggcggccagcaggacctggccaaccagttggcctacctgctgccgttcgataccgaacgcaagctcgaactgctcgccctgcccgacgcgcagatgcaactggcgcggatccaggtgctgctggagcacctgcagggcgagttgggtatcgantga

SEQ ID NO: 5389 - DNA, 393 bp, Pseudomonas aeruginosa
  unsure (279): Identity of nucleotide at the above locations are unknown.
ccaccaccatcaccgggttcatgtcggcgttgcgatgctcctggaccaacgtcatcaggccctggtcgaggtcctgtaggtacagccaggcgacggtcatcgccaccaccaggaccaggctcagcgcggccgccacatcggttgcccaacgtttgccccccaagctggccctggactaccacgccgaccagcacctccaggcatgccgcgacgatccccgcttctctccagaatcccccccggcaaccggaggcgcctggctgcccccggtgggcccanccggccaacaggttagcgaacccccaacccgggggggggaatcaccaaacccccaaaaaaccggccaacgggttttttaactttccggcgaacatcggggcatcggtcccaggg

SEQ ID NO: 5390 - DNA, 399 bp, Pseudomonas aeruginosa
cgacgatcccagacggcacgaccaacgccgcaaagacgaccacggctacacaataagcgagaagacgcaaggaacggtgaagaagaagcggacaggccgagcgacggtagagaaagcgagcaggcagaccagtacacgtggatccaagagacacaggggaaacggaacagcagagaaccacgagagcaggaagacagacggagagcaggcaaggcggcgagagggacacaggcgaggagcgaacggaacagaaaccaggaggccggcaagccagaaagaaggcagaatggagacggacgcgacgaggaggccccaaagcgaggaggccgacggcgcaagacggacaaaacagggaacgcgagtaacagacagagacggccgaaagggagcaaaggctga

SEQ ID NO: 5391 - DNA, 1164 bp, Pseudomonas aeruginosa
  unsure (143): Identity of nucleotide at the above locations are unknown.
cgagatctacgtggtgcaggcgctgagcggcggttgaccaacagaggaggacatccggtgagcgagcgactctatgtcggcacccgcaagggcctgttcgagctgcggcgcaacgcggcgggccagtggctgccgatggccanccacttcctcggcgagccgctgagcatgctcctcgccgacccgcgcgacggcgcgctctacgcggcgctgaatctcggccatttcggcgtcaagctgtggcgtcgcgacgccggcgcgacggactggatggaatgcgcggtgccggtctatccgccgcagccgccagcggccgaaccgctggaaggccaggcggcggagccaccctggtcgctacagcagttgtggatcctcgagccaggcggcgccgaccggcccggcacgctgtgggccggaaccatccccggcggcctgttccgttccgacgaccgtggcgccagctggcgcctcaaccgcgaactctgggaacgacccgaacgcgcccagtggttcggcggcggctacgaccatcccggcatccattccatctgcgtcgacccacgcgacagtcgccacctcaccgtcgcggtgtcttgcggcggcgtctggcagagccacgacgacggccgcagctggacctgcaccaccagaggcatgcgcgccgactacatgccgccggagcagagcgaggaggcggcgatccaggacccgcaccgcctggtgcagtgccaggcgcgcccggagttcctctgggtgcagcaccacaacggcatcttccgttcccgcgacggcggcttgcattggcagggcgtggtcgccgagccgtccagcttcggcttcgccgtcgccgtgcatccgcggcagccggacacggcctggttcgtcccggcgaccaaggacgaatgccgcattcccagggacgcccgtttcgtggtcacccgcacccgcgacggtggccacagcttcgagaccctcgagcgcggcctgcccgatggcccggcctacgacctggtctaccgccacgggctggacatcgaccccagcggcgagcgcctggccatgggctcgaccaccggcggcctgtggctcagcgagaacggcggggaggactggcagcagctctccgccaacctgccgccgatctactgcgtgcgcttcgcctga

SEQ ID NO: 5392 - DNA, 1593 bp, Pseudomonas aeruginosa
agcctagctcaccacgttgcgggtgaaacgcaccacctcgtcgccgtcgttgacgtatgcgtacggctggtcgctggcgaaggcatggaagtcgccggcctcgatgcgccgttcgccgtcggccagttccaggcgcaggcgaccttcgatgaccagaaccatctcccgccagccggctgcgtcgggttccgatacgtagcgctcgcccggtcccagcgaccaggcccagagttccacctcgcgccgcgccggtgcgctggcgaggagggtggcgcggctctcggggtggtggccgacccaggccaccgcattgatccgcgagcggtcggtggccggtgcctggaccaggtcggggaacagcacgccgagggcggcggcgatacggtcgagggtcgacaggctgacattgacgtcgccgctctcgatgcccaccagcatccgccggctgacactggccgcgcgggccagcgcttcctggctgaggccggcttgcaggcgcaggcggcggacgttgccggagacatgttcgaggacgctggggcgttcggtagggttgggcaatatattgctcactgtcgcggttttgcgcattatagtgcacatcccgtttcccgcagtccatcgggctgcttcccactgccggacctcttccatgacctccacctcccgcggcctcgccggaacgctgttgccggtcggcctgctattgatcgccatggcctcgatccagagcggcgcctccctggcgaaaagcatgttccccctggtcggcgcccagggcaccacggccctgcggctgttcttcgccgcgctgatcctgctgctgctcctgcgtccctggcgcaagcgcctgagcctgcaatcgctgcgctcggtggtggtctacggcatcgccctgggcggcatgaacctgctgttctatctctcggtgcgcaccgtgccgctgggcatcgcggtggccctggagttcaccgggccgctgctggtggcgatcctctcctcgcggcgcctgctggacttcctctggatctgcctggcggtgttcggcatctggctgttgctgccgctgggcaacagcgccgagccgctcgacctggtcggcgccgcctatgccctcggtgccggcgtgtgctgggcgctgtacatcctcttcggccagcgcgccggcgccgaccatggcgcccagggcgccgcgctgggggtgctggtggcggcgatcctggttgtgccgatcggcgtcgcccacgccggcgccgacctcctcgacccggcgctgatcccgttggcgctgggcgtcgcggtgctctccacggccttgccctacaccctggaaatggtcgcgctgacccgcctgccggcgcgcaccttcggcaccctgatgagcatcgagccggccttcggcgcgctctccgggctgctgttcctcggcgagcggctgagcccgacccaatggctggccatcggcgcgatcatcctcgcctcggtcggcactaccctcagcgtcaagtcgcgtggcgccgccccggcgctaccggccaaggactgaggcggcctccgcgtcctcccgctgcaggcgctcgtgctggcggatga

SEQ ID NO: 5393 - DNA, 327 bp, Pseudomonas aeruginosa
cccatggctaaggccgatgatacgtcgaatcccgcaataaccgcacagtccccttccaccttcatccccctgcgacgcacctcgcaatgcaaccagcaccccggttgcgccaccctctacctggacagcagcgcagccagcgaagacctgttcgacaccgcccgccgccggctggagtcggcgatcggaacgctgagcgtcctcgacctgctcgacgaaaccgaagagcccggtgaaagcatctgccgcatcaccggttccctgctgtcgttgctcagcgacgccctgtcactgttcgaggcggaatacgcacgcagacaccgataa

SEQ ID NO: 5394 - DNA, 1593 bp, Pseudomonas aeruginosa
ccgacggaggcggtgccccccggcaaggccggggggttgagtaccggggcgaaaaggggatccctctccgccctggctcggcagttgcgcggtcgggcgaaagccacctgcccgctacgcacgccaacccaggcaatccctgacgatgaccggtctttcatctgcgactgtttctcatttacactcgacccccattcttcggagccaggctcctttcctgggtgcatcgtgccgttcgatcccgccaagccgacgctgttgtccacactggttcgtcactacgaggaactggtcgaccatgttcgccggcgcttcggcgaccggggcatggcgcgcgaagtggtgcacgacgtgtgcgtgcagttgctcgaacgcgacgagaaggaggacgtgcacacgcccctggccctgctgcggaaaatctcccacgacgccgccgtgagccgctatcgtagcgaccgtcgtcgaaccgcctgggtggaagccgtcgccgagcttccggaagtcgcctgcatggcggcgacgcccatgggtcgccatgaggccgagcgcgagttccaggcactggtcgacgccatcgccacgcttcctcctcgctgccaggccgttttcgtcatgcacaagatccacgaagttccccagggcgcaagtcgccgaccgcctcggcatctccgtcaagaccgtggaaaagcacctgcgcctcggactggcgggctgccgggaacggctcggccgcggcgaggcacggccatgacccagccctcgaaacggaatgggcaggttccgctggacgacgccctggagcgccatcgcgacgcgctgaaggacctgttcccgctgccgccctcccggccgaaatcgcgcaaggcaagcaaggcggccggcgtcgcgctattgctggcgctggccatcggcgccctggcctggctggacccggcctacaagcgcgagcgcttcgccaccgccatcggtgagcggcgcgacgtgaccctggccgacggcagccagctcctgctcgacagcggcagccagatcgaggtcagttggcacccgctcagccgccgggtcgcgttgcgcgcggggcaggtgcttttcgaggtatccccggcgcgctatcggcgcttcgtggtgtccgtgggttcgaccgacatccgcgtgctcggcacccggttcaacgtgcgccgcctggacgacgacgtccgcgtgaccctggagcgtggccgggtggaggtcggcacctcggctacggcgcaagcgccagtcgtgctcctgccgggccagcaggtcgatgccattggcgggcaactgatgccgctggccaaggtcgatgccgccacggcgatggcctggaaagacgaccgcctggtcttcgagcgcacgcccctgggcgaagccgtcgcgctgctgcgccattatcgcaaggcgcccattctcctggacgaccccagcctggcctccctccggctgaccggcgtcttcgccgcgcacaacgccgaccggctgctcgacctgctgccgagcatccttcccgtggccgtgtcgcggcaggaggacggcagcgtcgagatccaacgcaaatcgacgcgaaaataa

SEQ ID NO: 5395 - DNA, 546 bp, Pseudomonas aeruginosa
cccggctgggcagcgatggcctcggcggccagttccagcaatacttcgccggctccctgggggcgctcgactattcgttcgacttcggcacccgtcacgtcggcgcttcctacgacgcccatggcgaccgcatcgccccggaacccagccagggcgacctgttcgactcgaacgtctacaacatcggcggcaagctcggcctgcgcatcgacgagaaccagcgcgtgcagctcgccctcagccactacgacgcccgccaggacaccgactacgccaccgacccgagggtcgccaggctgccgccgggctcggtcccggccaacgcgatcaagggcctggagctggacgagcagaaccgcatccgcaacaccctggcgaacctcgagtacgagaacctcgacatcctcggcagccggctctccgcgcagctctactaccgtgactatttcacccgcttcactccgttcgacgcccgcgccgtctccacccgcggcggcaacgtcgaccagatcatgcagaacagcgaagtgttcggcagccgcctga

SEQ ID NO: 5396 - DNA, 522 bp, Pseudomonas aeruginosa
gacgatcccagacggcacgaccaacgccgcaaagacgaccacggctacacaataagcgagaagacgcaaggaacggtgaagaagaagcggacaggccgagcgacggtagagaaagcgagcaggcagaccagtacacgtggatccaagagacacaggggaaacggaacagcagagaaccacgagagcaggaagacagacggagagcaggcaaggcggcgagagggacacaggcgaggagcgaacggaacagaaaccaggaggccggcaagccagaaagaaggcagaatggagacggacgcgacgaggaggccccaaagcgaggaggccgacggcgcaagacggacaaaacagggaacgcgagtaacagacagagacggccgaaagggagcaaaggctgagagggggaaacaggggggaagcggaacaggagggcgaccaggaccgcaggaagggcgaggcacgggaagtagcacggaagcacagccccgcgtagcggacgctaccggtcctgctcgcagttga

SEQ ID NO: 5397 - DNA, 534 bp, Pseudomonas aeruginosa
atctcatctgcgttctccttgttgttctgcgcaatgacggcccgttctggcccgcctcccgaactggtcgaacggcaggccggcggatcgacaggcgacggcggttttttcgctggccggggcagtataggaggcccgcgccgagcggccggggtggccgacgagcgtcgctgcggagtgtgccgaccgctgggcgggccgcgccagccgtggcctgcagggcttttacactgttccggcagagccatttccgcgagcctcggcatgccccgtatcgtcttcgccccggccatccagcggcacgtcgccatgcccgcgctggacgtcggcgccgccaccgtcgccgccgccttgcaggcggccttcgcccgcgagccgcgcttgcgcggctacctgctcgacgaccagggcagtctgcgccggcatgtggcgctgttcgtcgatggcgtgcaggtccgcgatcgccggggattgggcgatccgctccaagacgatagcgagatctacgtggtgcaggcgctgagcggcggttga

SEQ ID NO: 5398 - DNA, 987 bp, Pseudomonas aeruginosa
atctcggccatttcggcgtcaagctgtggcgtcgcgacgccggcgcgacggactggatggaatgcgcggtgccggtctatccgccgcagccgccagcggccgaaccgctggaaggccaggcggcggagccaccctggtcgctacagcagttgtggatcctcgagccaggcggcgccgaccggcccggcacgctgtgggccggaaccatccccggcggcctgttccgttccgacgaccgtggcgccagctggcgcctcaaccgcgaactctgggaacgacccgaacgcgcccagtggttcggcggcggctacgaccatcccggcatccattccatctgcgtcgacccacgcgacagtcgccacctcaccgtcgcggtgtcttgcggcggcgtctggcagagccacgacgacggccgcagctggacctgcaccaccagaggcatgcgcgccgactacatgccgccggagcagagcgaggaggcggcgatccaggacccgcaccgcctggtgcagtgccaggcgcgcccggagttcctctgggtgcagcaccacaacggcatcttccgttcccgcgacggcggcttgcattggcagggcgtggtcgccgagccgtccagcttcggcttcgccgtcgccgtgcatccgcggcagccggacacggcctggttcgtcccggcgaccaaggacgaatgccgcattcccagggacgcccgtttcgtggtcacccgcacccgcgacggtggccacagcttcgagaccctcgagcgcggcctgcccgatggcccggcctacgacctggtctaccgccacgggctggacatcgaccccagcggcgagcgcctggccatgggctcgaccaccggcggcctgtggctcagcgagaacggcggggaggactggcagcagctctccgccaacctgccgccgatctactgcgtgcgcttcgcctgagcgcgcggcgctggacagcctcggcgcgcttgcataa

SEQ ID NO: 5399 - DNA, 1347 bp, Pseudomonas aeruginosa
cgctcgcccggtcccagcgaccaggcccagagttccacctcgcgccgcgccggtgcgctggcgaggagggtggcgcggctctcggggtggtggccgacccaggccaccgcattgatccgcgagcggtcggtggccggtgcctggaccaggtcggggaacagcacgccgagggcggcggcgatacggtcgagggtcgacaggctgacattgacgtcgccgctctcgatgcccaccagcatccgccggctgacactggccgcgcgggccagcgcttcctggctgaggccggcttgcaggcgcaggcggcggacgttgccggagacatgttcgaggacgctggggcgttcggtagggttgggcaatatattgctcactgtcgcggttttgcgcattatagtgcacatcccgtttcccgcagtccatcgggctgcttcccactgccggacctcttccatgacctccacctcccgcggcctcgccggaacgctgttgccggtcggcctgctattgatcgccatggcctcgatccagagcggcgcctccctggcgaaaagcatgttccccctggtcggcgcccagggcaccacggccctgcggctgttcttcgccgcgctgatcctgctgctgctcctgcgtccctggcgcaagcgcctgagcctgcaatcgctgcgctcggtggtggtctacggcatcgccctgggcggcatgaacctgctgttctatctctcggtgcgcaccgtgccgctgggcatcgcggtggccctggagttcaccgggccgctgctggtggcgatcctctcctcgcggcgcctgctggacttcctctggatctgcctggcggtgttcggcatctggctgttgctgccgctgggcaacagcgccgagccgctcgacctggtcggcgccgcctatgccctcggtgccggcgtgtgctgggcgctgtacatcctcttcggccagcgcgccggcgccgaccatggcgcccagggcgccgcgctgggggtgctggtggcggcgatcctggttgtgccgatcggcgtcgcccacgccggcgccgacctcctcgacccggcgctgatcccgttggcgctgggcgtcgcggtgctctccacggccttgccctacaccctggaaatggtcgcgctgacccgcctgccggcgcgcaccttcggcaccctgatgagcatcgagccggccttcggcgcgctctccgggctgctgttcctcggcgagcggctgagcccgacccaatggctggccatcggcgcgatcatcctcgcctcggtcggcactaccctcagcgtcaagtcgcgtggcgccgccccggcgctaccggccaaggactga

SEQ ID NO: 5400 - DNA, 1452 bp, Pseudomonas aeruginosa
  unsure (1035),(1254): Identity of nucleotide at the above locations are unknown.
ggcggcctccgcgtcctcccgctgcaggcgctcgtgctggcggatgaagcgccgcgcgctgcgcgccaggcggatgcagagcatgatcgccgcgccggtcaggcccaccaccaggccttgccacaggccgcgcggtccggtgggttcctggaaccagtcggtgaggccgaggctgtagcccaccggcaggccgatgccccagtaggcgaacagggtcatgatcatcgtcacccgggtgtcctggtagccacgcagggccccggcggcggtgacctgcaaggcgtcggagaactggaacaacgcggagaacacgatcagcgaggcggcgatggcgatcaccgccgggtccggcgaatacatcgcggcgatctgctcgcgcagcaacaacatcaggctcgccgagacgcaggcgtagcccagcgccgcggccatccccacgccggcggcgaagcgcgcgtcgcgcggcaggccggcgccgaggttgtggccgacccgcacggtcaccgccatccccagcgaatagggaatcatgaacaccagcgcgctgaagttcagggcgatctggtggccggccaccacgttctcgtcgagcccgccgatcagcagggcgatcaccgagaagatgctcgactcggcgaacaccgcgatgccgatcggcaggccgaccgccaccagcgggccgatggtcgcgcgatccggccactcccagcgcgagaacaactggctggcgcggtagatcgaggccttgttcacccagaacagcatgccgaggaacatgaaccacatcaccgagccggtggcccagccgcagccggggccacccatcttcggcatgccgaagtggccgtagatcagcgcgtagttgatcgggatgttcagcagcagcccgccgatccccagcaccatgctcggccgggtccgtcccaggccgttggtgtagcagcgcagtacgtggtacagcgccgccgccgggaagcccagggcgatgcccttgaggtacagcaggctcggcccagatcagtttccgggcgcatnttcatcaagccggggatcggttcggacaaccaccacagcaccgcccccggacagcgttccgatcagcagcgccagccacagcgcttggcgcaccagcggcccgtgcccgggtggttcgccggcgccatggcgctgggcgactttggccgtggtggcgagcagggtgccgttcatcagcaggcacatcgggatccagatggagttgcccagcgccaccgntgccaggtcgtgcggactggcgcgcccggccatcaccgcatcgacgaagcccatggcggtggtcgccagttgcgcgatcatgatcggcgcggcgagggtcagcagttccttgagttcggcgcggatgcgcaagccacgggaaaggggcagggcggggctgttcacggcagtccttgtctgggcaggggaaccgcgtag

SEQ ID NO: 5401 - DNA, 969 bp, Pseudomonas aeruginosa
cggcctgaaggcgcaggccagggacgaacataccttcatcgtcgttccggccagcgaagccgccgtgcccgctacgcaagcccgcagcgaaccgctggacatggagcagatggaaatcaccgcctcgcgcaccagcagcgacctggtctccgccacgcgccagtccaccgtcatcgagcatgcccaactggaggagctgcgccagggctccgacagcctggccaccgtgctggccaaggcggtgccggggatgtccgattccagccgcaccatcaccgaatacggccagaccctgcgcgggcgcagcatgctggtgatggtcgacggcgtgccgttgaacaccaaccgcgactcctcgcgcaacctggccaacatcgacccggcgctgatcgagcggatcgaggtcatccgtggcagcagcgccatctacggcagcggcgccaccggcgggatcatctccatcaccacccgtccggccggcggcgagaaccgcgcggaaacccgcctcagcgccacctcgccgctgacccggctgggcagcgatggcctcggcggccagttccagcaatacttcgccggctccctgggggcgctcgactattcgttcgacttcggcacccgtcacgtcggcgcttcctacgacgcccatggcgaccgcatcgccccggaacccagccagggcgacctgttcgactcgaacgtctacaacatcggcggcaagctcggcctgcgcatcgacgagaaccagcgcgtgcagctcgccctcagccactacgacgcccgccaggacaccgactacgccaccgacccgagggtcgccaggctgccgccgggctcggtcccggccaacgcgatcaagggcctggagctggacgagcagaaccgcatccgcaacaccctggcgaacctcgagtacgagaacctcgacatcctcggcagccggctctccgcgcagctctactaccgtga

SEQ ID NO: 5402 - DNA, 1497 bp, Pseudomonas aeruginosa
ctatttcacccgcttcactccgttcgacgcccgcgccgtctccacccgcggcggcaacgtcgaccagatcatgcagaacagcgaagtgttcggcagccgcctgaccctgcgcacgccgctgggcgaaagcggcaataccgaactggtctggggcggcgactacaaccaggaacgcagcgacatgccgctcgacgtgttcgacccggcggcctacgacgccagcggcgggctggtcttcgacaagatcggcaagctcacctacatgccgccgctacgcacccgcagcgccggcgcgttcgcccagttgcagcatcgcttcgacgaacactggtcgatcgacggcggcctgcgctacgaatactccaccgccgaattcgacgacttcgtcccgctctccgagtccaaggccgcctcgccggtgaccgtcaagggcggcgacctcgactacgacgcggtgctgtcgaacctcggcatcgtctattcgccggtggctggccaggaaatctatgcctccttcagccagggcttccagctgcccgatgtcggcatccagctgcgcaacgcccgccgtggcttcgatatcggctcctcgaacctcgaaccggtgaagaccaacaactacgaactcggctggcgtggcgccatcggcggcaacaccctgggcagcctggcgctgttctacaccacctccaagctgggcgacgtgcagagcttcaacaacggcctgatcctcacccgcaccaaggagcgcatctacggcgtcgaggccagcgccgactggctcagcgacgacgaagtctggggcgcgggcggcagcgccacctggatgcgcggacgcgagaagccggacggcaaggactggcaggacatgaccggctaccgcgtgccgccgctgaagctgaccgcctacctgcaatacaagccggatgccgactggaacaaccgcctgcaggccaccttcttcgactccaaggactaccgtctcgacggcgtggaaagcttcggccggcgccaggtcagcacctacaccacggtcgacctggtcagccagtaccgcatcacccccgacgaccagttgagcctgggcatccagaacctgttcatccgcgactaacacccgctctacagccagttgctgcgcaacaacaacaacaccagccacctgccggcgccgggcacggtgctgacggcgagctatacgcacaactggtgaggggagggcggagccaccggggctgggcgggcccggtgggcagggagggtgcttccagagggaaggcggccccgttgtcatgggcaggcatttccgtccaatgccggacgccgatccaggtcggccaggtaatggggaaggacagggtacgccgtcccgctcagaacacgacctgccccgacatgcccggctgtacctcaccgccgatccagatatcgccgccgatctgctcgacgcttatccgcccccggcgacccaaggccgtgccctggctcgccgtgtag

SEQ ID NO: 5403 - DNA, 1683 bp, Pseudomonas aeruginosa
  unsure (117): Identity of nucleotide at the above locations are unknown.
gcggcggttgaccaacagaggaggacatccggtgagcgagcgactctatgtcggcacccgcaagggcctgttcgagctgcggcgcaacgcggcgggccagtggctgccgatggccanccacttcctcggcgagccgctgagcatgctcctcgccgacccgcgcgacggcgcgctctacgcggcgctgaatctcggccatttcggcgtcaagctgtggcgtcgcgacgccggcgcgacggactggatggaatgcgcggtgccggtctatccgccgcagccgccagcggccgaaccgctggaaggccaggcggcggagccaccctggtcgctacagcagttgtggatcctcgagccaggcggcgccgaccggcccggcacgctgtgggccggaaccatccccggcggcctgttccgttccgacgaccgtggcgccagctggcgcctcaaccgcgaactctgggaacgacccgaacgcgcccagtggttcggcggcggctacgaccatcccggcatccattccatctgcgtcgacccacgcgacagtcgccacctcaccgtcgcggtgtcttgcggcggcgtctggcagagccacgacgacggccgcagctggacctgcaccaccagaggcatgcgcgccgactacatgccgccggagcagagcgaggaggcggcgatccaggacccgcaccgcctggtgcagtgccaggcgcgcccggagttcctctgggtgcagcaccacaacggcatcttccgttcccgcgacggcggcttgcattggcagggcgtggtcgccgagccgtccagcttcggcttcgccgtcgccgtgcatccgcggcagccggacacggcctggttcgtcccggcgaccaaggacgaatgccgcattcccagggacgcccgtttcgtggtcacccgcacccgcgacggtggccacagcttcgagaccctcgagcgcggcctgcccgatggcccggcctacgacctggtctaccgccacgggctggacatcgaccccagcggcgagcgcctggccatgggctcgaccaccggcggcctgtggctcagcgagaacggcggggaggactggcagcagctctccgccaacctgccgccgatctactgcgtgcgcttcgcctgagcgcgcggcgctggacagcctcggcgcgcttgcataagttcgtgggttttcgccaaggagcccaccccatgagcctcgaatccgtccggcggttcttcgccgagaaagccccggacctgcgcatcatcgagctggaaaccagcaccgccaccgtcgccctggccgccgaggcccatggcgtggagccggggcggatcgccaagaccctgtcgctgcgggtcggcgagcgcaccgtactggtagtggcgcgcggcgacgcgcggctggacaaccgcaagatcaaggccgccttcggcggcaaggcgaagatgctcggcgccgaggacgtggtcgagctgaccgggcacccggtcggcggagtctgcccgttcggcctggcgacgccgctggcggtgtactgcgacgtctcgctgcaagccttcgacgaagtgcttccggccgccggggcggtgcacagcgcggtccgcatcgccccgcaacggatggccgagctggtggatgcgcagtgggtcgatgtgtgccaggaagtcctccaggaagcctga

SEQ ID NO: 5404 - DNA, 2403 bp, Pseudomonas aeruginosa
ggtttcccgcgtgccgtggcggctatccaggaaaagccaacttgcataggaaatcgagacgtgcatttttccctccgcagtcgccacctgcgtccttcattgctcgccagcagcctgctcctggcggtgtcggcccagggccaggaaaagctcgacgtggatctgcccgccgcgccgctcggccaggcgatcaacgccctcgcgcaacaatcctcggtacagatccttttcgccggcgatctcggcgccggccgccaggcgcccgcgctgaaggggcgtttcacccccgaagaggcattgcgccagttgctcagggatagcggcctgaaggcgcaggccagggacgaacataccttcatcgtcgttccggccagcgaagccgccgtgcccgctacgcaagcccgcagcgaaccgctggacatggagcagatggaaatcaccgcctcgcgcaccagcagcgacctggtctccgccacgcgccagtccaccgtcatcgagcatgcccaactggaggagctgcgccagggctccgacagcctggccaccgtgctggccaaggcggtgccggggatgtccgattccagccgcaccatcaccgaatacggccagaccctgcgcgggcgcagcatgctggtgatggtcgacggcgtgccgttgaacaccaaccgcgactcctcgcgcaacctggccaacatcgacccggcgctgatcgagcggatcgaggtcatccgtggcagcagcgccatctacggcagcggcgccaccggcgggatcatctccatcaccacccgtccggccggcggcgagaaccgcgcggaaacccgcctcagcgccacctcgccgctgacccggctgggcagcgatggcctcggcggccagttccagcaatacttcgccggctccctgggggcgctcgactattcgttcgacttcggcacccgtcacgtcggcgcttcctacgacgcccatggcgaccgcatcgccccggaacccagccagggcgacctgttcgactcgaacgtctacaacatcggcggcaagctcggcctgcgcatcgacgagaaccagcgcgtgcagctcgccctcagccactacgacgcccgccaggacaccgactacgccaccgacccgagggtcgccaggctgccgccgggctcggtcccggccaacgcgatcaagggcctggagctggacgagcagaaccgcatccgcaacaccctggcgaacctcgagtacgagaacctcgacatcctcggcagccggctctccgcgcagctctactaccgtgactatttcacccgcttcactccgttcgacgcccgcgccgtctccacccgcggcggcaacgtcgaccagatcatgcagaacagcgaagtgttcggcagccgcctgaccctgcgcacgccgctgggcgaaagcggcaataccgaactggtctggggcggcgactacaaccaggaacgcagcgacatgccgctcgacgtgttcgacccggcggcctacgacgccagcggcgggctggtcttcgacaagatcggcaagctcacctacatgccgccgctacgcacccgcagcgccggcgcgttcgcccagttgcagcatcgcttcgacgaacactggtcgatcgacggcggcctgcgctacgaatactccaccgccgaattcgacgacttcgtcccgctctccgagtccaaggccgcctcgccggtgaccgtcaagggcggcgacctcgactacgacgcggtgctgtcgaacctcggcatcgtctattcgccggtggctggccaggaaatctatgcctccttcagccagggcttccagctgcccgatgtcggcatccagctgcgcaacgcccgccgtggcttcgatatcggctcctcgaacctcgaaccggtgaagaccaacaactacgaactcggctggcgtggcgccatcggcggcaacaccctgggcagcctggcgctgttctacaccacctccaagctgggcgacgtgcagagcttcaacaacggcctgatcctcacccgcaccaaggagcgcatctacggcgtcgaggccagcgccgactggctcagcgacgacgaagtctggggcgcgggcggcagcgccacctggatgcgcggacgcgagaagccggacggcaaggactggcaggacatgaccggctaccgcgtgccgccgctgaagctgaccgcctacctgcaatacaagccggatgccgactggaacaaccgcctgcaggccaccttcttcgactccaaggactaccgtctcgacggcgtggaaagcttcggccggcgccaggtcagcacctacaccacggtcgacctggtcagccagtaccgcatcacccccgacgaccagttgagcctgggcatccagaacctgttcatccgcgactaa

SEQ ID NO: 5405 - DNA, 333 bp, Pseudomonas aeruginosa
tggggaaggacagggtacgccgtcccgctcagaacacgacctgccccgacatgcccggctgtacctcaccgccgatccagatatcgccgccgatctgctcgacgcttatccgcccccggcgacccaaggccgtgccctggctcgccgtgtaggcgcccgggcatgactcccgtgccgatcagccattgcgccaggctcgcgttgaggctgccggtgacggggtcttcattgagctcctcgcccatgaaggcgcgcacttccacatccgcctccgcctggggaccttgccagggcgcgaccacgcccacgttgagcccgtcgagcttcgcgtag

SEQ ID NO: 5406 - DNA, 660 bp, Pseudomonas aeruginosa
cggcacgagttcacgaacgaagggattcgatcgagaccaagttgggccccatggcccaagccgggcgcggagaagcccatggggtgttggagggaattcttcggccggtcggcagacagagggtatttcaaaggggaagaaatcctcgcctgtcatgaggctggaatcactgttttcgtgcccaaaacgctgacttcgggcgcgacagcggcgggccgcttcggcaaaggtgatttcatctatgacgcagcaaagaacgagtaccgatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 5407 - DNA, 879 bp, Pseudomonas aeruginosa
accaccaccgagcgcagcgattgcaggctcaggcgcttgcgccagggacgcaggagcagcagcaggatcagcgcggcgaagaacagccgcagggccgtggtgccctgggcgccgaccagggggaacatgcttttcgccagggaggcgccgctctggatcgaggccatggcgatcaatagcaggccgaccggcaacagcgttccggcgaggccgcgggaggtggaggtcatggaagaggtccggcagtgggaagcagcccgatggactgcgggaaacgggatgtgcactataatgcgcaaaaccgcgacagtgagcaatatattgcccaaccctaccgaacgccccagcgtcctcgaacatgtctccggcaacgtccgccgcctgcgcctgcaagccggcctcagccaggaagcgctggcccgcgcggccagtgtcagccggcggatgctggtgggcatcgagagcggcgacgtcaatgtcagcctgtcgaccctcgaccgtatcgccgccgccctcggcgtgctgttccccgacctggtccaggcaccggccaccgaccgctcgcggatcaatgcggtggcctgggtcggccaccaccccgagagccgcgccaccctcctcgccagcgcaccggcgcggcgcgaggtggaactctgggcctggtcgctgggaccgggcgagcgctacgtatcggaacccgacgcagccggctggcgggagatggttctggtcatcgaaggtcgcctgcgcctggaactggccgacggcgaacggcgcatcgaggccggcgacttccatgccttcgccagcgaccagccgtacgcatacgtcaacgacggcgacgaggtggtgcgtttcacccgcaacgtggtgagctag

SEQ ID NO: 5408 - DNA, 1179 bp, Pseudomonas aeruginosa
gcgtcgagcagatcggcggcgatatctggatcggcggtgaggtacagccgggcatgtcggggcaggtcgtgttctgagcgggacggcgtaccctgtccttccccattacctggccgacctggatcggcgtccggcattggacggaaatgcctgcccatgacaacggggccgccttccctctggaagcaccctccctgcccaccgggcccgcccagccccggtggctccgccctcccctcaccagttgtgcgtatagctcgccgtcagcaccgtgcccggcgccggcaggtggctggtgttgttgttgttgcgcagcaactggctgtagagcgggtgttagtcgcggatgaacaggttctggatgcccaggctcaactggtcgtcgggggtgatgcggtactggctgaccaggtcgaccgtggtgtaggtgctgacctggcgccggccgaagctttccacgccgtcgagacggtagtccttggagtcgaagaaggtggcctgcaggcggttgttccagtcggcatccggcttgtattgcaggtaggcggtcagcttcagcggcggcacgcggtagccggtcatgtcctgccagtccttgccgtccggcttctcgcgtccgcgcatccaggtggcgctgccgcccgcgccccagacttcgtcgtcgctgagccagtcggcgctggcctcgacgccgtagatgcgctccttggtgcgggtgaggatcaggccgttgttgaagctctgcacgtcgcccagcttggaggtggtgtagaacagcgccaggctgcccagggtgttgccgccgatggcgccacgccagccgagttcgtagttgttggtcttcaccggttcgaggttcgaggagccgatatcgaagccacggcgggcgttgcgcagctggatgccgacatcgggcagctggaagccctggctgaaggaggcatagatttcctggccagccaccggcgaatagacgatgccgaggttcgacagcaccgcgtcgtagtcgaggtcgccgcccttgacggtcaccggcgaggcggccttggactcggagagcgggacgaagtcgtcgaattcggcggtggagtattcgtagcgcaggccgccgtcgatcgaccagtgttcgtcgaagcgatgctgcaactgggcgaacgcgccggcgctgcgggtgcgtag

SEQ ID NO: 5409 - DNA, 1464 bp, Pseudomonas aeruginosa
cggcggcatgtaggtgagcttgccgatcttgtcgaagaccagcccgccgctggcgtcgtaggccgccgggtcgaacacgtcgagcggcatgtcgctgcgttcctggttgtagtcgccgccccagaccagttcggtattgccgctttcgcccagcggcgtgcgcagggtcaggcggctgccgaacacttcgctgttctgcatgatctggtcgacgttgccgccgcgggtggagacggcgcgggcgtcgaacggagtgaagcgggtgaaatagtcacggtagtagagctgcgcggagagccggctgccgaggatgtcgaggttctcgtactcgaggttcgccagggtgttgcggatgcggttctgctcgtccagctccaggcccttgatcgcgttggccgggaccgagcccggcggcagcctggcgaccctcgggtcggtggcgtagtcggtgtcctggcgggcgtcgtagtggctgagggcgagctgcacgcgctggttctcgtcgatgcgcaggccgagcttgccgccgatgttgtagacgttcgagtcgaacaggtcgccctggctgggttccggggcgatgcggtcgccatgggcgtcgtaggaagcgccgacgtgacgggtgccgaagtcgaacgaatagtcgagcgcccccagggagccggcgaagtattgctggaactggccgccgaggccatcgctgcccagccgggtcagcggcgaggtggcgctgaggcgggtttccgcgcggttctcgccgccggccggacgggtggtgatggagatgatcccgccggtggcgccgctgccgtagatggcgctgctgccacggatgacctcgatccgctcgatcagcgccgggtcgatgttggccaggttgcgcgaggagtcgcggttggtgttcaacggcacgccgtcgaccatcaccagcatgctgcgcccgcgcagggtctggccgtattcggtgatggtgcggctggaatcggacatccccggcaccgccttggccagcacggtggccaggctgtcggagccctggcgcagctcctccagttgggcatgctcgatgacggtggactggcgcgtggcggagaccaggtcgctgctggtgcgcgaggcggtgatttccatctgctccatgtccagcggttcgctgcgggcttgcgtagcgggcacggcggcttcgctggccggaacgacgatgaaggtatgttcgtccctggcctgcgccttcaggccgctatccctgagcaactggcgcaatgcctcttcgggggtgaaacgccccttcagcgcgggcgcctggcggccggcgccgagatcgccggcgaaaaggatctgtaccgaggattgttgcgcgagggcgttgatcgcctggccgagcggcgcggcgggcagatccacgtcgagcttttcctggccctgggccgacaccgccaggagcaggctgctggcgagcaatga

SEQ ID NO: 5410 - DNA, 501 bp, Pseudomonas aeruginosa
tcgcgccgatggccagccattgggtcgggctcagccgctcgccgaggaacagcagcccggagagcgcgccgaaggccggctcgatgctcatcagggtgccgaaggtgcgcgccggcaggcgggtcagcgcgaccatttccagggtgtagggcaaggccgtggagagcaccgcgacgcccagcgccaacgggatcagcgccgggtcgaggaggtcggcgccggcgtgggcgacgccgatcggcacaaccaggatcgccgccaccagcacccccagcgcggcgccctgggcgccatggtcggcgccggcgcgctggccgaagaggatgtacagcgcccagcacacgccggcaccgagggcataggcggcgccgaccaggtcgagcggctcggcgctgttgcccagcggcagcaacagccagatgccgaacaccgccaggcagatccagaggaagtccagcaggcgccgcgaggagaggatcgccaccagcagcggcccggtga

SEQ ID NO: 5411 - DNA, 561 bp, Pseudomonas aeruginosa
gcaatatattgcccaaccctaccgaacgccccagcgtcctcgaacatgtctccggcaacgtccgccgcctgcgcctgcaagccggcctcagccaggaagcgctggcccgcgcggccagtgtcagccggcggatgctggtgggcatcgagagcggcgacgtcaatgtcagcctgtcgaccctcgaccgtatcgccgccgccctcggcgtgctgttccccgacctggtccaggcaccggccaccgaccgctcgcggatcaatgcggtggcctgggtcggccaccaccccgagagccgcgccaccctcctcgccagcgcaccggcgcggcgcgaggtggaactctgggcctggtcgctgggaccgggcgagcgctacgtatcggaacccgacgcagccggctggcgggagatggttctggtcatcgaaggtcgcctgcgcctggaactggccgacggcgaacggcgcatcgaggccggcgacttccatgccttcgccagcgaccagccgtacgcatacgtcaacgacggcgacgaggtggtgcgtttcacccgcaacgtggtga

SEQ ID NO: 5412 - DNA, 429 bp, Pseudomonas aeruginosa
cctcgagccagccttccagaggagaccgcgatgagcgcacgcgtacgacccttcctgatgttccagggggtccaggccgaggcggccatgaacttctacctgtcactgttcgacgacgccgagatcctccagatccagcgctacggcgccgaggggccgggcccggagggctcggtgatgaaggcgctgttccgcctcggcgaccagagcgtgcattgcatcgacagccatgtgcggcacgccttcgatttcaccccggcgttctccttcttcgtcgactgcgagagcaacgcgcagatcgagcgcctggccgaggccctgagcgacggcggcaaggccctgatgccgctcggcgactacggcttcagccagcgtttcgcctggctggccgaccgcttcggggtgtcctggcagctcaatctggcctga

SEQ ID NO: 5413 - DNA, 987 bp, Pseudomonas aeruginosa
agtcgctcgctcaccggatgtcctcctctgttggtcaaccgccgctcagcgcctgcaccacgtagatctcgctatcgtcttggagcggatcgcccaatccccggcgatcgcggacctgcacgccatcgacgaacagcgccacatgccggcgcagactgccctggtcgtcgagcaggtagccgcgcaagcgcggctcgcgggcgaaggccgcctgcaaggcggcggcgacggtggcggcgccgacgtccagcgcgggcatggcgacgtgccgctggatggccggggcgaagacgatacggggcatgccgaggctcgcggaaatggctctgccggaacagtgtaaaagccctgcaggccacggctggcgcggcccgcccagcggtcggcacactccgcagcgacgctcgtcggccaccccggccgctcggcgcgggcctcctatactgccccggccagcgaaaaaaccgccgtcgcctgtcgatccgccggcctgccgttcgaccagttcgggaggcgggccagaacgggccgtcattgcgcagaacaacaaggagaacgcagatgagattcatggtgatcgtcaaggccacccatgcttccgaagccggcgagatgcccagcgaggaactgctcgcggcgatgggccgctataacgaggaactggtcaaggccggggtgatgctcgccggcgaagggctacagcccagcgccaagggcgcccgggtgcgtttctccggcaacgcgcggacggtgatcgacggccccttcgccgagacccgcgagctgatcgccggtttctggatgttccaggtggcctccctggaagaggccatcgagtgggtcaagcgatgcccgaacccattcgacggcgaatccgagatcgagatccgccaggtcttcgaggccgaggacttcggcgaggagttcaccccggaactgcgcgagcgcgaggagcgcctgcgcgccgagctggaaaaacgcaactga

SEQ ID NO: 5414 - DNA, 450 bp, Pseudomonas aeruginosa
accgccccgcactccgccaagaacgaggaaagcgccatgcaaatcgtcccctacctgatcttcaacggtaattgccgggaggccttcagctgctaccaccagcacctgggcggcaccctggaggccatgctgccgttcggcgacagccccgagtgcggcgacatcccggccgactggaaggacaagatcatgcacgcacggctggtggtcggcagcttcgccctgatggcctcggacaatcacccggcctatccctacgaaggcatcaagggctgttccatcagcctcaacgtcgacagcaaggccgaggccgagcgcctgttcaacgccctcgccgagggcggctcggtccacatgccgctgggcccgaccttctgggcggcgagcttcggcatgttcaccgaccgcttcggcgtggcctggatggtcaactgcgagcaggaccggtag

SEQ ID NO: 5415 - DNA, 996 bp, Pseudomonas aeruginosa
ttgagcctcccacggcctcctgggactaagaaaatcactcagcagttgatcgccatcgcttgctgcgtttttacacggtctgggccgattgcggcccctgacgagagcccccaagccccccccgaaaatccgcaccccggtttcagacatccgccccctaccttatcctcccccgccataatcccaggaggccccatgccggtttcgttacccttcgagcaagtcgatgtcttctccgaacagcccttcaaaggcaacgccgttgccgtggtgattggcgccgaccgcctgagcagccggcagatgctggagttcgccgcctggacccagttgagcgagacgaccttcctgctgcggccgaccgttgccgaagccgactatcgcgtgaggatcttcaccccgttgcgggagttgccctttgccgggcatccgacgctggggagctgccaggtctggctgaaccaggggggcggcaatgctgctgacgagatcgtccaggagtgtctggcgggcctgatccgcatccgccgcaagggcgccttgctgtcgttcgcggcgcctcccctgcttcgtggcggagcggtcgaagacgaggtgttgcgacggatcgagagcgggcttggcctgtccccggggcaggtacgcggcagccaatgggtggacaacggacccggctgggtcgccgttcggctggccacgcgtgacgaggtcctggccattcgcccggactacgcgaagctcgacgggctcaacgtgggcgtggtcgcgccctggcaaggtccccaggcggaggcggatgtggaagtgcgcgccttcatgggcgaggagctcaatgaagaccccgtcaccggcagcctcaacgcgagcctggcgcaatggctgatcggcacgggagtcatgcccgggcgcctacacggcgagccagggcacggccttgggtcgccgggggcggataagcgtcgagcagatcggcggcgatatctggatcggcggtga

SEQ ID NO: 5416 - DNA, 465 bp, Pseudomonas aeruginosa
  unsure (229),(448): Identity of nucleotide at the above locations are unknown.
cccttcctgaccaccccgtcaacccgtaaactacgcggttcccctgcccagacaaggactgccgtgaacagccccgccctgcccctttcccgtggcttgcgcatccgcgccgaactcaaggaactgctgaccctcgccgcgccgatcatgatcgcgcaactggcgaccaccgccatgggcttcgtcgatgcggtgatggccgggcgcgccagtccgcacgacctggcancggtggcgctgggcaactccatctggatcccgatgtgcctgctgatgaacggcaccctgctcgccaccacggccaaagtcgcccagcgccatggcgccggcgaaccacccgggcacgggccgctggtgcgccaagcgctgtggctggcgctgctgatcggaacgctgtccgggggcggtgctgtggtggttgtccgaaccgatccccggcttgatgaanatgcgcccggaaactga

SEQ ID NO: 5417 - DNA, 1035 bp, Pseudomonas aeruginosa
tctgggccgagcctgctgtacctcaagggcatcgccctgggcttcccggcggcggcgctgtaccacgtactgcgctgctacaccaacggcctgggacggacccggccgagcatggtgctggggatcggcgggctgctgctgaacatcccgatcaactacgcgctgatctacggccacttcggcatgccgaagatgggtggccccggctgcggctgggccaccggctcggtgatgtggttcatgttcctcggcatgctgttctgggtgaacaaggcctcgatctaccgcgccagccagttgttctcgcgctgggagtggccggatcgcgcgaccatcggcccgctggtggcggtcggcctgccgatcggcatcgcggtgttcgccgagtcgagcatcttctcggtgatcgccctgctgatcggcgggctcgacgagaacgtggtggccggccaccagatcgccctgaacttcagcgcgctggtgttcatgattccctattcgctggggatggcggtgaccgtgcgggtcggccacaacctcggcgccggcctgccgcgcgacgcgcgcttcgccgccggcgtggggatggccgcggcgctgggctacgcctgcgtctcggcgagcctgatgttgttgctgcgcgagcagatcgccgcgatgtattcgccggacccggcggtgatcgccatcgccgcctcgctgatcgtgttctccgcgttgttccagttctccgacgccttgcaggtcaccgccgccggggccctgcgtggctaccaggacacccgggtgacgatgatcatgaccctgttcgcctactggggcatcggcctgccggtgggctacagcctcggcctcaccgactggttccaggaacccaccggaccgcgcggcctgtggcaaggcctggtggtgggcctgaccggcgcggcgatcatgctctgcatccgcctggcgcgcagcgcgcggcgcttcatccgccagcacgagcgcctgcagcgggaggacgcggaggccgcctcagtccttggccggtag

SEQ ID NO: 5418 - DNA, 825 bp, Pseudomonas aeruginosa
cgccggggcggcgccacgcgacttgacgctgagggtagtgccgaccgaggcgaggatgatcgcgccgatggccagccattgggtcgggctcagccgctcgccgaggaacagcagcccggagagcgcgccgaaggccggctcgatgctcatcagggtgccgaaggtgcgcgccggcaggcgggtcagcgcgaccatttccagggtgtagggcaaggccgtggagagcaccgcgacgcccagcgccaacgggatcagcgccgggtcgaggaggtcggcgccggcgtgggcgacgccgatcggcacaaccaggatcgccgccaccagcacccccagcgcggcgccctgggcgccatggtcggcgccggcgcgctggccgaagaggatgtacagcgcccagcacacgccggcaccgagggcataggcggcgccgaccaggtcgagcggctcggcgctgttgcccagcggcagcaacagccagatgccgaacaccgccaggcagatccagaggaagtccagcaggcgccgcgaggagaggatcgccaccagcagcggcccggtgaactccagggccaccgcgatgcccagcggcacggtgcgcaccgagagatagaacagcaggttcatgccgcccagggcgatgccgtagaccaccaccgagcgcagcgattgcaggctcaggcgcttgcgccagggacgcaggagcagcagcaggatcagcgcggcgaagaacagccgcagggccgtggtgccctgggcgccgaccagggggaacatgcttttcgccagggaggcgccgctctggatcgaggccatggcgatcaatag

SEQ ID NO: 5419 - DNA, 741 bp, Pseudomonas aeruginosa
caggccgaccggcaacagcgttccggcgaggccgcgggaggtggaggtcatggaagaggtccggcagtgggaagcagcccgatggactgcgggaaacgggatgtgcactataatgcgcaaaaccgcgacagtgagcaatatattgcccaaccctaccgaacgccccagcgtcctcgaacatgtctccggcaacgtccgccgcctgcgcctgcaagccggcctcagccaggaagcgctggcccgcgcggccagtgtcagccggcggatgctggtgggcatcgagagcggcgacgtcaatgtcagcctgtcgaccctcgaccgtatcgccgccgccctcggcgtgctgttccccgacctggtccaggcaccggccaccgaccgctcgcggatcaatgcggtggcctgggtcggccaccaccccgagagccgcgccaccctcctcgccagcgcaccggcgcggcgcgaggtggaactctgggcctggtcgctgggaccgggcgagcgctacgtatcggaacccgacgcagccggctggcgggagatggttctggtcatcgaaggtcgcctgcgcctggaactggccgacggcgaacggcgcatcgaggccggcgacttccatgccttcgccagcgaccagccgtacgcatacgtcaacgacggcgacgaggtggtgcgtttcacccgcaacgtggtgagctaggctctagcctcgagccagccttccagaggagaccgcgatga

SEQ ID NO: 5420 - DNA, 723 bp, Pseudomonas aeruginosa
tgccgctcggcgactacggcttcagccagcgtttcgcctggctggccgaccgcttcggggtgtcctggcagctcaatctggcctgagcccggcagttgccgtcaggcttcctggaggacttcctggcacacatcgacccactgcgcatccaccagctcggccatccgttgcggggcgatgcggaccgcgctgtgcaccgccccggcggccggaagcacttcgtcgaaggcttgcagcgagacgtcgcagtacaccgccagcggcgtcgccaggccgaacgggcagactccgccgaccgggtgcccggtcagctcgaccacgtcctcggcgccgagcatcttcgccttgccgccgaaggcggccttgatcttgcggttgtccagccgcgcgtcgccgcgcgccactaccagtacggtgcgctcgccgacccgcagcgacagggtcttggcgatccgccccggctccacgccatgggcctcggcggccagggcgacggtggcggtgctggtttccagctcgatgatgcgcaggtccggggctttctcggcgaagaaccgccggacggattcgaggctcatggggtgggctccttggcgaaaacccacgaacttatgcaagcgcgccgaggctgtccagcgccgcgcgctcaggcgaagcgcacgcagtagatcggcggcaggttggcggagagctgctgccagtcctccccgccgttctcgctga

SEQ ID NO: 5421 - DNA, 909 bp, Pseudomonas aeruginosa
ttatcggcgcggggaacgccaagcatactgtgccgacccctgcatacgaacagcgcgcgtgccgaacagcgccgagaacaacaaggaattccgatgaaagtcgaactcgtccagatcgccggtcgcgatggcgacaccgcgcacaacctggagcgcgccctggcggccatcgccgactgtgcggcggacaccgaactggtggtgttcccggaaacccacctgaccggcttccccagcgaagacaacatcgccgccctcgccgagccgctcgacggcccgacggtcagcgcggtgcagcgcgtcgcccgtgaacgtaacgtttcggtggcgatcggcatcgccgaggcggacgccggccgctattacaacaccaccctgctgatcgctcccgacggcatcgccctgaaataccgcaagacccacctgtgggcctccgaccgcggcatcttcacgcctggcgaccgaaacgccaccgccctgtggaacggcatccgggtcggcctgctggtgtgcttcgacatcgagttcccggaaagcgcgcgggccctcggccaactgggtgcggaactgatcatcgtgaccaatggcaacatggacccctatggcccgacccatcgcactgcgatcatggcccgcgccatggaaaaccaggcctacgcggtgatggtcaaccgcgtcgggcatggcgacggcgggctggtcttcgccggcggtagcgcggtggtcgatccctacggccagttgctctgcgaggccgggcgcgaagaatgccggcagatcgtcgaactggacctcggccggttgcaggatgcgcgtcgggattaccgttacctcgaagagcgtcgcctggtcctgcccggcgagcgccgcgagcacccggacggcctgcgcgagctgctgattccctga

SEQ ID NO: 5422 - DNA, 2130 bp, Pseudomonas aeruginosa
cgccttcgcgcgcctgctgggcgagccgccgtcgcagttgcgcgggcgcgagctgctcaaggcggactggctgcagaccccgctcggcgccatgctcgcggtggccgacgcgcaggccctgcacctgctggagttcttcgaccgcccggcgttgagcggggagctgaaacgcctgcagaagagcagcggatcgagcatcggtttcggccgtttcgcctccatcgacaggatcgaggcggaactcgccgactacttcggcggtactccagtgcgcttccagacccccttggcgctgaacgcctcggccttcacccgcacggtctggcaggcgctgcgcgaggtaccgtgcggcagcacgcagagctacgccgggctggccaggtccatcggctcgccgtcgtcggtgcgcgccgtggcccgcgccaacggagccaaccagatcgccattgtgattccctgccaccgcgtcatcggttcggacggttccctgaccggctatggcggtggcctgtggcgcaagcgctggttgctggagcacgagcggcgcatgggcgctgccggctagccgggatcgccgcccagaagccgggcgggggcgcgcaacaccggttcccgctcgaccgctgcgggccgctgcaagtcctcggcgtcggcgcgctcggcggtcgacaggtcgctggcgtggaacccggtgatccgcaacagggccagggtacaggccagcgagaccagcgcgtagcaggccgaggccagggccacgccgacgatgctaccggtactgttgagaatccactgggccagtaccggtgtaccgccgccgaccagcagcgagcagagctggtaggccagcgacaggccggtgtagcgcacccgcgccgggaaggctcgggcgaggataccgcccaccgcgccgtagaacatcgcgtgcggcaccgtggccaggcacatgccgaccgcggcgatccagtagaccttggtttccacggcgaagaacatcgccggcatcaggataaactccggcagcaccatcaggcatgccgccttgcgcatgtcgatgcgcgaagtgagcagcgcccccagtggctggctgaggaactgcaccaccagcgcgaccacgatgatgctgaggaaggtgccctggctgtagccgagggtcttggtcgcccaggagagggcgaaggtgctcttgaagtaggtgacgtggatgatcggcagcacgccggcgccgagcaggacgatcttccagtgcttgcccagcacctcggcgagcggcagcttcaccgtgcgcttctgcgccagcacgcgcttcatgtcttccgactcctccagcttcaggcggatcaccatgccgacgatgaccagcactgcggagagcaggaacggcgcgcgccagccccagagaatgaagtccgaggcgggcagggcgctgagggcgaagaacgccagggtcgccagcaggttgccggtgggcgagccctgctgggcgaaggcggcgtacaggatgcctttgcccttgggcgcgctttcgctggcgatcaggatcgcgccgccccactcgccgccgaccgcgatgccctggacgatacgcagcgccaccagggagatcggcgcccagatgccgatctgcgtatagaccggcaacaggccgatgcaggtcgtggcgatgcccatcatgatcagggtgatcaccagggtggtcttgcggccgatgcggtcgccgagatggccgaagatgatcccgcccagcgggcgagcgatgaagcccgaccagagggtgacgaaggacagcagggtggccaggcccggatccatgtcggcggggaagaataccttgccgaacaccagggcggcggccagaccgtagatgtagaagtcgtaccactcgatggtggtgccgatgaaggaggcgataccggccctgcgggccttcttgtgcaggtcggcgtcttcgggagagggcgtgcgcggcatgggtcgagtcctgtttattgttgttctcgccgacacgccgcgccctaccgcccttcgctgaaaggcggggcggaaacgctggtttccgtggagggagagcgtgcgtcggtgttgacccgggtgcctcggagtctaggtggcacccccgcaaatcaatag

SEQ ID NO: 5423 - DNA, 285 bp, Pseudomonas aeruginosa
agcatggagttgacgaagccgacgcgcagttggccgacgtcgccctcggcggatagctgggtcaggcgtttcaccttctctgcctgcagcagcaggttgcgcgcttccaccagcaggacctggccggcgccggtgagcttcaccgacttgttgttgcgcagcagcaattgggttccgagctgttcctccagcttcttgatgtcgaagctcagcgccggctgggagatgaacaggcgagccgcggcgcgaccgaaatgcagttcctcggcgaccgcgatgaagtag

SEQ ID NO: 5424 - DNA, 1518 bp, Pseudomonas aeruginosa
cgaagctgtctgagatccatggcaggcacctggttctacgatctgtttttcttatcgtcgatgattttttttgtattggatgcttatcgaagcactcgcctagtctcggcgcaagacaagcaggagccgcgccatgaccgccatgcccgaagtacttcgcgaagatacgctgaacatccccgacagccgtgggctgaatctctacacctgcgatccggccctggagcggctgctggaggtatacctgccgccggcgttgctcgccgaatggcggccgctcctcgaacggctcggcgcccgtgccggcggcgagctggacgtgctggcgctggcggcggacaagaatccgccggtgctggcgccgcgcacccgccgcggcgaggatttgcagagcattcgcaagcatccggactacgtcgccctcgaacaggtggcctatgccgaacttggcctggcttccatgagccatcgcccggacggcccgccgccgctggtgaagtatgcgctcacccacctgttcgtacaggccgagttcggcctttgctgcccggtcagcatgaccgactcgctgacccgcaccctgcgcaggttcggcgcgccagaactggtcgagcgctacctgccgtccctcgcctcgcgggatttcgacgagctgttccagggcgccatgttcatgaccgagcaggccgccggctccgacgtggcgcggacccgtaccgtggcgcgggaggagggcggcgagtggaagctctacggcgacaagtggttctgctccaacccggacgccgacctggcgatggtcctggcccgccccgaaggcgcgccggaaggaatgaagggcgtgaccctgttcctgttgccgaaggtccgcgaggacggtacgcgcaacgcctatcgcatcgtccgcctgaaggacaagctgggcagccgctccatggccagcggcgaagtccgcctggaaggcgccagcgcctacctgatcggcgagatcggccgcggcttccagcagatggccgacatggtcaacatgtcgcgcctgtccaacggcgtgcgcgccgccgggctgatgcgccgggcgctgagcgaggcgctgttcgtcgcccgccatcggcgcgccttcggcaagcacctgatcgacatgccgctgatgcagaagcagttgctgaagatgatgctgcccaccgaacaggcgcgctcgatgttcatgcagatcgccacgctgctgccgcgcgccgatggcggcgaggtcgaggcgcagaaatgcgtgcggatcctcaccccgctgatcaagttccgcgcctgccgcgatgcgcgtcgggtcaccggcgacgccatggaggtgcgcggcggggtcggctacatcgaggagtggagcgacccgcggctggtgcgcgacgcccacctggggtcgatctgggagggcaccagcaacatcgtggcgctggacgtcgcccgtgcggtgagccgcgaacaggcgctcgaatccttgcagcgccacctgcgccggctgctggatga

SEQ ID NO: 5425 - DNA, 1569 bp, Pseudomonas aeruginosa
cagcgacctgccaggggacgcccgcgacctcttcgacgaactgctggtgcgagtggtcgcgaccatggccgacgtcgccgagcgccgccaggacgagcaggtgcgccaggccggcagcgccctctatcacctgtgcacggcgatcttcatggcctgggaggccagccgccaggcacccgaccagcgccgcctggccctggccttcctggtcgcccggcacaagctgctgccgcgcgacccgctgcgcctggagggctggaccgaccaggccgaactgctggccagggtggtcggcgaggtgccgctgagccaggccgaagccatgcaattgctgccggcctgactgcccgcattcccgctcacaacaaccagagagtcgccatgaccaatcagacgggcgccctgcgtggcctgaaaatcatcgatctcagccgggtcctcggcggaccctactgctcccaggcgctggccgaccacggcgccgaggtgatcaagctggaacccctcggcggcgacgagacccgtggctgggggccgcccttcgagggcgacacggcgtcctacttcaagggcgtgaaccgcaacaagaagggcatcgccgtcgacctggcgacggcggagggcatcgagctgctgctgcgcttgctggaggacgctgacgtactgctggagaacttcaagcccggcaccctggcgcgctgggggatcggctacgaggaggtgcttcgccagcgcttcccgcggctggtccactgcgcggtatcgggcttcggcgcccacggcccgctcggcggcctgcccggctacgacgcggcgatccaggcgatggccggactgatgagcgtgaacggcgaggccggcggcgaggcgttgcgcatcggcctgccgatcgtcgacatggtcaccgggctgaacgccatggccggcatcctcctcgccctccacgagcgccaggtcagcgggcgcgggcagtcggtggacatcgccctgtacgactgcggtatctccctgctgcacccgcacctgccgaactacttcgcttccggacgtacgccccggcgtagcggcaacgcccacccgaacatcgcgccctacgacagctaccgcaccggtaccgagccgatcttcctcgccgtcggcaacgaccgccagttcgcccgcctgtgtgagtacctgggagccgatgaactgccgggggacccgcgcttcgccgacaacggcaagcgctcggtcaaccgcgaggcgctgaagcgcgccctggaggactacctggcggcccacgacggccgtgagctggccgagcggctgatccgtctcggcgtgccctgcggagccatcgccacggtggatcgggtggtggagcacccgcacacccgccatcgcgggatggtcgtcgaactcgagggctatcgcggcatcgcctcgccggtgaagctttcgcgcaccccggccagctaccgcgccgcgccgccggtgctgggcggagacactcgggaagtcctggcggaactgggattgagcgccgaggcgatcgacgcgctggtccggcgcggcatcgtccgcgcctga

SEQ ID NO: 5426 - DNA, 1200 bp, Pseudomonas aeruginosa
ggttggtcagcgaggtggcggcggatggccaggcattggatcgcgccctcgaactggctcgccagatcgccggcctgccgccgctggcgctggcgcagatcaaggaagtggtcctggccggcgccgacctgccgctggaccaggccctggcgctggagcgcaaggccttccagttgctgttcgacagccacgaccagaaggagggcatgcgtgccttcctggaaaaacgcacagcggagtacctgggaaaatgagcgagccaccaatcgttctcatcggtatcgtcggtaccggcgccatgggccagggcatcgcccagctcgctgcctgtgccgggctgtcggtgctgctctacgacagccgccagggtgcggcactgcaagcacgcgagcagatcgccacggtccttgcccggcaggtggagcgaggccggctggaggcggaggctgccgcgctcgcgatgggcaatctgcgggtggtcgaggacttgcgggtcttacgcggctgccagttggtgatcgaggcgatcgtcgagaacctggaggccaagcaggcgttgttccgccaattggaagaggtggtcggcgacgaagcgatcctcgccagcaatacctcctcgctgtcggttaccgcgatcgcctcggcctgtcgcgatcccggccgggtcgccggtctgcacttcttcaatccggtgccgctgatgcgtctggtggaggtgatcgagggtctcgccacccgcaccggcatcgccgagcgactgtgcgccctggtggcgaccttcggccaccaggcggtgcgtgccacggacagccccggcttcatcgtcaaccatgccggacgggccttcggcaccgaggcgctgcgtatcctcggcgagggcgtggcgccggtggcggcgatcgacgaagtcctgcgcgagggcgccggcttccgcatgggcccgttcgagctgttcgacctggtcgggttggacgtcagcctgccggtgatggagtcgatctaccggcagtactacgaggagccgcgttatcgtccgcatcccttgctgcgccagatgctcgccgccggccgcctggggcgcaagagcggccagggcttctaccgctacgacggcgctgggcaggtgcccgtcgccgccccggcggttgcgccaggcgcggcgttgccgccggtgtggctgggcgtcgacgacgaacatga

SEQ ID NO: 5427 - DNA, 1320 bp, Pseudomonas aeruginosa
tcgagcgctgccgatgagacaccgttccccctagaaaaagaggcgcccaggcgcccgttcggagtgcgtatgaacaacaacaagaaatgcgcgtttttcctgctgccgatccttgccggcgatagcgttcccgccttggccgagggcttcctcgaagactcgcgggccagcctggccttgcgcaacttctacatgaaccgcgacttccgcgatggcgcggggcgtgcgaaaagcgaggagtgggcccagggctttctcttcgactaccgctcgggctataccgagggcaccctcggcgtgggtctcgacctgctgggcaagctcggcgtccggctcgattccggcgcggggcgtagcggcaccggcctgcttccgcttcgcgacgatggcagcgcggcgggcgactacgcgcggctggacgcgaccgccaagctgcgcctgtcgcgcagcgaactgaaggtcggcggcctggtaccgaagctaccgaccatccagcccaactacgggcggctattcccccaggtgttccagggcgcgctgctgacttccggtgaactgagcggactgagcctgaacctgggacggctgaccgaggtcagccagcgcaacgaggcgggcaccagcgacctggcgctgttcaaccgcaaccggcgtttcgccggcgcggcgcaggcggaccgtttcgacctggccggcctggactaccgtatcgccccggactggaccggcagctaccactatggcgaactggagcaggtctacgcccagcatttcctcggtctcaaggggcgcatcggcatcgctgcggacagcctggagagcgacttgcgcctggcgctcagccgggataccggcggcgctcgcggcgggcgcatcgacaaccgttccttcagcgggtcgctcacctaccgcctgcgcaacggccaggccttcggcctgggctaccagcggatgagcggcgaccacggtttcccctacctggaggggaccgatccgtacctggtcaatttcggccagtacaacgacttcgccgaggctggcgaatcctcctggcaactgcgctacgactgcgacttcgcgccgctcggggtgcccggcctgagcctgatgacgcgctatttcagcggccacggcgcgaaaccgaagggcgccgacggcagtcgcgagtgggaacgcgacagcgacctgcgctacgtgttgcagggcggtgcgctgaagggactggggctggtctggcgcaacgctacctaccgttcggccttcagtcgcgacatcgacgagaaccgcctgtacctgacctatgagctgccgctgttctga

SEQ ID NO: 5428 - DNA, 1269 bp, Pseudomonas aeruginosa
gcaaaacttgatagcggtgcggattcgttgagtttgtctcatacgccaggggctgtcgacaagcgatggcctcgatcccgcagagcgtgcgatcgtggagcgacggggagaagagcccggcacacgggacggcggcacggagcagcggcgcaacgccgcagagccacaacgccacgaccgcctggcggcattcatcaaactgtcacgctactgtggcagcgcgctggacgaaatttaatcagaatcgcgctccactggggttctgcgttctgggttttcttcatgcgtgctttcatcttcctggccgccttgttgtgcagcctctcctcctttgcggcggcgcgttgcgacgcacgcgtacctaccgagacggtcgaactgggcgacgtgcgcctggcctaccagagcatcggccgcgacagcgatccggccctgctgctggtgatgggcctgggcgggcaactgatccactggccggacgaggtggtcagcgccctgtgcgagcaaggcttccgggtgatccgctacgacaaccgcgacgtcggcctgtcggcctggaacgtgccggtgcccagttcgcggctgacctacgaagtggtgcgttatcgcctcggcctgccggtcagcgcgccctataccctcaccgacatggccggcgatgccctgcatctgctcgacgcgctggatatcccccaggcccatgtgctcggcgccagcatgggcgggatgatcgcccagcacatcgccgacatggcgccgcagcgcctgctcagcctgaccctggtgatgaccagctccggcgccgaaggcctgccggcgcccagcgagtcgctgctgcgcctgctggcgcggcgcgaggcggccagccgcgagcaggcggtcgagcagcaggccgacctgctggcggcgctgggcagcccggaagtgcgcgatgatcgccagcagcttctgttgcaggccgcacgttcctacgaccgcgcgttcaacccggaaggcgtgcagcggcaattgctggcgatcctcgccgaacccagccgggtgccgctgctgaaccgtctgcaggtgccgaccctggtgatccatggcaccgccgatccgctgctaccggtgatgcacggcgtgcacgtggcggcgcatatccgtggctcggagctgaagctgatccccggtctcgcccatcgcttccaggaggccttcaaggagccgttgctggcggcggtagtgccttacctgaaggcccatcggcaggccagcgtcgtccagctctga

SEQ ID NO: 5429 - DNA, 1257 bp, Pseudomonas aeruginosa
gcgtcgtcgtcccgcttgccgggagccgcgcagggaagtgccttgcctgccaccgacgcgccccgtgccgagcgatccatgaacctgcgcatcctgctgatactgggagccctgagcgccttcgggccactggccatcgatttctacctgccgagcttcccgaccctggccaaggccttcgccaccgacgtcgagcacgtccagctgagcctggccgcctacttcgccggcctgtccatcggccagttgctctacggcccggtggccgaccgctatggccggcgcctgccgctgctggtgggggtgagtatcttcaccctggcctcggccgcctgcgccctggcgccgagcctggagtggctgatcgccgcgcgcttcgtccaggccctcggcggctgcgccgggatggtcatctcgcgggcagtggtgcgtgacctgtgcgatccgatcggcgccgccaaggcgttttcccagttgatgctggtgatgggcctggcgccgatcctcgcccccgtggccggcggcctgctgctggactggcagggctggcaatcgatcttcgtctgcctgaccctgttcgccgccctggccggcctcggcgtggcgttgtggctgccggaaaccatcccggccgacggcgagcgaccgccgctttccggcgcgctggggcagtaccggcggctgttcgccgaccgcctgtttctcgcctatggcctttccggcggggtggcgatggccgggatgttcgcctacatcgccggttcgccctacgtgttcatccagctctacgggattcccgccgagcactatggctggctgttcggcagcaatgccgcgggcttcatcgtcatggcacaggtcaacgcgcggctgctgcgctatcgcgggccggcgttctggctgcggcggatcatctggggctacctggcgtgcggcctggccctgctgggcatcgcttcgctgcaaccggccacgctgtggccgctgctggttccgctgttcggatgcgtggccagcctcggctgcatcattcccaacgcttccgcctgcgccatggccggacagggacagcacgccggcagcgcctcggcgctgatgggcagcctgcagttcagcgtggcggcgggcgcttcggcgctggtcggcgtgctccacgacggcacggcgatccccatgactctggtgatcgccgtctgcggcgcggtcgcgaccctgctcgcctggcagaccgggcgcctggagcgccaggccgcctga

SEQ ID NO: 5430 - DNA, 573 bp, Pseudomonas aeruginosa
cgaaatggaacttcgacaggttgcagaaggccgccaggcgttccagttcgaggcgcgcatgcaggtgttcgcgcatgtaagcgtgcagcccgtcgaggtccaagctgccctcgcgcagcgggcgcagcagcggtagctggcagagcaggctgcgcaggcggctggcggcgagcaggaagtgctggaagcggtagccgctgtggcgcacctccagcagttgctcgaagccgccgagcagggcgtgttgcaggccccaatggcgcagcggggtgtcgcggtagccggcgctgtgttgcagccaggtggcgctgtcgccgcgcaggtgggtccaaaagatggtccagggttggcggtcgtcgacggcgtagtcgtgggccatgcccggcggcagccagagcaggtcgccgctgccgacccggtattcgcgccaggtctcgccctcgcgcacgcgcaacaggccctggccttcgctgcaatagatcagcaggtgctcgtcatggcgctcgcggctcatgcggtggtcgcgggcgcgccggtagtggcccagggaggtggggtagaggtcgcggctga

SEQ ID NO: 5431 - DNA, 1623 bp, Pseudomonas aeruginosa
acaacacaatttagtcgatctcgcgaccttccgcccagtgatagcttcttggccaaagcgaggtccgaatcgacctcgtaccagtccgccacaacaataaaagccggcctggccggtgcaggagggttcatgtcagtcccagtccgccacctcatcgcgggagccttcgtcgaaggtctcggcgcccagcgcatcccggtcagcaatcccctcgacaacagcaccctggcggagatcgcctgcgccagcgcggagcagatcgagcaggcggtggccagtgcccgcgaaaccttcgccagctggaaggaaaccccggtttccgagcgcgcgcgggtgatgctgcgttaccaggcgttgctcaaggaacaccacgacgaactggcgaagatcgtctccagcgagctgggcaagactttcgaggacgccaagggcgacgtctggcgcggtatcgaggtggtcgagcacgcctgcaacgtgccctcgctgctgatgggcgagacggtggagaacgtcgcccgcaacatcgacacctacagcatcacccagccgctgggcgtgtgcgttggcatcaccccgttcaacttcccggcgatgatcccgctgtggatgttcccgctggccatcgcctgcggcaacgccttcatcctcaaaccttccgagcaggtgccgctgaccagcgtgcggctcgccgagctgttcctcgaggccggtgcgccgaagggcgtgctgcaggtggtgcatggcggcaaggaacaggtcgaccagttgctcaagcacccgcaggtgaaggcggtgtccttcgtcggctcggtcgccgtcggccagtacgtctaccacaccggcaccgcgcacaataagcgcgtgcagagcttcgccggggcgaagaaccacatggtgatcatgcccgacgcggacaaggcacaggtcatcagcaacctggtcggtgcctcggtgggcgcggccgggcagcgctgcatggcgatctcggtggcggtgctggtgggggccgcccgcgagtggattccggaaatccgcgacgcactggccaaggtccgccccggcccatgggacgacagcggcgccagctacggcccggtgatcaacccgcaggccaaggcgcgcatcgagcgtctgatcggccagggcgtggaggagggcgcgcaactgctgctggatggccgcggctacaaggtcgagggatacccggacggcaactgggtcggcccgacgctgttcgccggggtgcgcccggacatggcgatctaccgcgaagaggtgttcggcccggtgctctgcctggccgaggtcgacagcctggagcaggcgatccgcctgatcaacgaaagcccctacggcaacggcacctcgatcttcaccagctccggcgccgcggcgcggaccttccagcaccacatcgaggtcggccaggtgggcatcaacatcccgatcccggtaccgctgccgttcttctccttcaccggttggaagggctcgttctacggcgacctgcacgcctacggcaagcagggcgtgcgcttctacaccgagaccaagaccgtgaccgcgcgctggttcgacagcgatagcgtggccgggaccaacttctcgatccagatgcgctga

SEQ ID NO: 5432 - DNA, 663 bp, Pseudomonas aeruginosa
aagggagacggaccgatgaccgacatcgcattcctcggcctgggcaacatgggtgggccgatggccgccaacctgctcaaggctggccaccgggtgaatgtcttcgacttgcagcccaaggccgtgctgagcctggtcgagcagggcgcgcagggcgccgatagcgccttgcagtgctgcgaaggcgccgaagtggtgatcagcatgctgccggccgggcagcacgtggaaagcctgtatctcggcgacgacggcctgctcgcgcgggtcgccggcaagcccctgctgatcgactgctcgaccatcgccccggagaccgcgcgcaaggtcgccgaggccgccgcggcgaagggcctgaccctgctcgacgcgccggtttccggcggcgtcggcggcgcccgcgccggcaccctgagcttcatcgtcggcggccccgccgaaggcttcgcgcgggcccggccggtcctcgagaacatgggccggaacatattccacgccggcgatcacggcgccggccaggtggcgaagatctgcaacaacatgctcctcggcatcctcatggccggcaccgccgaggccctggcgctgggggtgaagaacggcctcgacccggcggtgctgtccggcggtgatgaagcggcgttcaggtgcccaccacggggt

SEQ ID NO: 5433 - DNA, 2493 bp, Pseudomonas aeruginosa
gcagtaatggccagactcaagcgcaccctgtcgctgggttccgtggtgctgttcggcatcgcctacatgacccccatcatcgtcctcgggactttcggcatcctcgccgagaccacccagggacacgtccccgccgcctacatcgccgcttccctggcgatgctcttcaccgccctcagctacgggcgcatggccgcggccttccccgtggccggctcggcctatacctacgtgcgcaaggccatcgattcccggctcggcttcatcgccggctgggcggtgctgctcgactacctgttcctgccgatggcgatctggctgatcggcgccgcctacctgcactcggcctttcccgcggtacccaacgcggtctgggtgctgggcgttcatcggcgtgaccacgacgatcaacatcgtcggcctgcgcctggcgaagaacgtcaatggcctgctgatgctggtgcagttcctggtcctcggcgccttcgtcgcgctctgcgtgcactacgtgctgggcgacccgggcaagccgctatggtcactgcaaccgttgctcggtggcgacctgcaggtgccgctggtgatgagcggtgcggcgatcgcctgctactcgttcctcggtttcgacgcggtcagtaccctgaccgaggaaacccgcgacccgcggcgcaacatcccgcgagcgatcctgctgatcaccctgctgggcgggttgatcttcatcgtcacctcgtacttcgtgcaactggcgcacccgtcgttcgccttcgacagcgcggactcggcggcctacgagatcgcccgcaacatcggtggcgacctgttcgtgaccttcttcctggtcggcctgatcgtcggccagttcacctccggtctctcggcccaggccagcgcctcgcgcctgctcttcgccatgggccgcgacggcgtccttccgcggccgttcttcggtcgtctcggcaagcgcttcgagacgccggcgaacagcatcgtcctgtgcggtgtggtggccttgctggcgctacagatggacgtgaccacctccacgtcgttcatcaacttcggcgccttcctcgccttcagcctggtcaacctgtcggtggtcttccactactaccttggcgccgagcgccgcggtccacgggaaaccctgttgttcctggtattccctggcatcggcctggtcgccgacctgtggttgatggccagcctcgaccatctggcgatcatcctcggcctctgctggctggcgctgggcgcggtgtacctggcggcgatcacccacggtttccgcgagccgccgccggagatgcgtttcgaggagggctgagaaagaatcgacgcccgtttcgcggcggcaaggcgcaggctcctggcctagagtggctatccatcgcctccctgattccggagccggccatgtccgatgcagcgttgttccttccccttcccgatgacgacaccctgtatgccgcgctgttggcgcgcgaccccgcctacgatggcttcgccttcgtcggggtgaagagcaccggggtgttctgccgcctgacctgcccggcgcgcaagccgaagcgcgagaacaccctgttcttcgattcgatcaagggctgcgtcgaggccggcttccggccctgcctgcgttgccggccgctggaacggctcggcacgcaggggccgctggtcagcgacctgctccagcgcctcggtcggcaaccgcagcggcgctggttcgaagacgacctggcggcgctgggctatgacccgtccaccgtgcgccgtgccttcaagcgcgagttcggcgtgacctttctggaaatggctcgcttgcgccgtcttggccaggtcgccgagcggctgtcctcgggcgcgcgggtgatcgacgcgcaactggatgccagcttcgactccgacagcggcttccgtagcgccttcgcgcgcctgctgggcgagccgccgtcgcagttgcgcgggcgcgagctgctcaaggcggactggctgcagaccccgctcggcgccatgctcgcggtggccgacgcgcaggccctgcacctgctggagttcttcgaccgcccggcgttgagcggggagctgaaacgcctgcagaagagcagcggatcgagcatcggtttcggccgtttcgcctccatcgacaggatcgaggcggaactcgccgactacttcggcggtactccagtgcgcttccagacccccttggcgctgaacgcctcggccttcacccgcacggtctggcaggcgctgcgcgaggtaccgtgcggcagcacgcagagctacgccgggctggccaggtccatcggctcgccgtcgtcggtgcgcgccgtggcccgcgccaacggagccaaccagatcgccattgtgattccctgccaccgcgtcatcggttcggacggttccctgaccggctatggcggtggcctgtggcgcaagcgctggttgctggagcacgagcggcgcatgggcgctgccggctag

SEQ ID NO: 5434 - DNA, 1758 bp, Pseudomonas aeruginosa
tctcggcgcaagacaagcaggagccgcgccatgaccgccatgcccgaagtacttcgcgaagatacgctgaacatccccgacagccgtgggctgaatctctacacctgcgatccggccctggagcggctgctggaggtatacctgccgccggcgttgctcgccgaatggcggccgctcctcgaacggctcggcgcccgtgccggcggcgagctggacgtgctggcgctggcggcggacaagaatccgccggtgctggcgccgcgcacccgccgcggcgaggatttgcagagcattcgcaagcatccggactacgtcgccctcgaacaggtggcctatgccgaacttggcctggcttccatgagccatcgcccggacggcccgccgccgctggtgaagtatgcgctcacccacctgttcgtacaggccgagttcggcctttgctgcccggtcagcatgaccgactcgctgacccgcaccctgcgcaggttcggcgcgccagaactggtcgagcgctacctgccgtccctcgcctcgcgggatttcgacgagctgttccagggcgccatgttcatgaccgagcaggccgccggctccgacgtggcgcggacccgtaccgtggcgcgggaggagggcggcgagtggaagctctacggcgacaagtggttctgctccaacccggacgccgacctggcgatggtcctggcccgccccgaaggcgcgccggaaggaatgaagggcgtgaccctgttcctgttgccgaaggtccgcgaggacggtacgcgcaacgcctatcgcatcgtccgcctgaaggacaagctgggcagccgctccatggccagcggcgaagtccgcctggaaggcgccagcgcctacctgatcggcgagatcggccgcggcttccagcagatggccgacatggtcaacatgtcgcgcctgtccaacggcgtgcgcgccgccgggctgatgcgccgggcgctgagcgaggcgctgttcgtcgcccgccatcggcgcgccttcggcaagcacctgatcgacatgccgctgatgcagaagcagttgctgaagatgatgctgcccaccgaacaggcgcgctcgatgttcatgcagatcgccacgctgctgccgcgcgccgatggcggcgaggtcgaggcgcagaaatgcgtgcggatcctcaccccgctgatcaagttccgcgcctgccgcgatgcgcgtcgggtcaccggcgacgccatggaggtgcgcggcggggtcggctacatcgaggagtggagcgacccgcggctggtgcgcgacgcccacctggggtcgatctgggagggcaccagcaacatcgtggcgctggacgtcgcccgtgcggtgagccgcgaacaggcgctcgaatccttgcagcgccacctgcgccggctgctggatgacagcgacctgccaggggacgcccgcgacctcttcgacgaactgctggtgcgagtggtcgcgaccatggccgacgtcgccgagcgccgccaggacgagcaggtgcgccaggccggcagcgccctctatcacctgtgcacggcgatcttcatggcctgggaggccagccgccaggcacccgaccagcgccgcctggccctggccttcctggtcgcccggcacaagctgctgccgcgcgacccgctgcgcctggagggctggaccgaccaggccgaactgctggccagggtggtcggcgaggtgccgctgagccaggccgaagccatgcaattgctgccggcctga

SEQ ID NO: 5435 - DNA, 2436 bp, Pseudomonas aeruginosa
gcgccgaggcgatcgacgcgctggtccggcgcggcatcgtccgcgcctgaaaccccgcacggcacggcctgcgccgtgcaactcaatccccgggcaattggagatggccatggattcctcccctggggcggtgagccccgaactcgtgctgctggagcggccggagcagggcgtggccctgttgcgactgaaccgcccggcagtactcaacgccctgaacatgcgcctgcgcgaggctctggcggagcacgtacggcgcctcgacgagtgcgccgatacccgggtcatcgtcctcaccggaaatggcacggcgttcgccgccggcgccgatctcaacgaactggcggaggcgtccgcgctggagatccagcagcgcggggtggagcgccactggcaggccctcgccgcctgccgcaagccgctgatcgccgccgtggagggccatgccctgggcggaggctgcgagttggcgatgcactgcgacctgatcgtcgccggtgcctcggcgcgcttcgcccagccggaaatccgtgtcggcgtgatgcccggcgccggcggcacccagcgcctggtgcgagcggtgggcaagttccaggcgctgcgcatgctgtttaccggttgcacggtacgggcgccggaggccctggccatagggttggtcagcgaggtggcggcggatggccaggcattggatcgcgccctcgaactggctcgccagatcgccggcctgccgccgctggcgctggcgcagatcaaggaagtggtcctggccggcgccgacctgccgctggaccaggccctggcgctggagcgcaaggccttccagttgctgttcgacagccacgaccagaaggagggcatgcgtgccttcctggaaaaacgcacagcggagtacctgggaaaatgagcgagccaccaatcgttctcatcggtatcgtcggtaccggcgccatgggccagggcatcgcccagctcgctgcctgtgccgggctgtcggtgctgctctacgacagccgccagggtgcggcactgcaagcacgcgagcagatcgccacggtccttgcccggcaggtggagcgaggccggctggaggcggaggctgccgcgctcgcgatgggcaatctgcgggtggtcgaggacttgcgggtcttacgcggctgccagttggtgatcgaggcgatcgtcgagaacctggaggccaagcaggcgttgttccgccaattggaagaggtggtcggcgacgaagcgatcctcgccagcaatacctcctcgctgtcggttaccgcgatcgcctcggcctgtcgcgatcccggccgggtcgccggtctgcacttcttcaatccggtgccgctgatgcgtctggtggaggtgatcgagggtctcgccacccgcaccggcatcgccgagcgactgtgcgccctggtggcgaccttcggccaccaggcggtgcgtgccacggacagccccggcttcatcgtcaaccatgccggacgggccttcggcaccgaggcgctgcgtatcctcggcgagggcgtggcgccggtggcggcgatcgacgaagtcctgcgcgagggcgccggcttccgcatgggcccgttcgagctgttcgacctggtcgggttggacgtcagcctgccggtgatggagtcgatctaccggcagtactacgaggagccgcgttatcgtccgcatcccttgctgcgccagatgctcgccgccggccgcctggggcgcaagagcggccagggcttctaccgctacgacggcgctgggcaggtgcccgtcgccgccccggcggttgcgccaggcgcggcgttgccgccggtgtggctgggcgtcgacgacgaacatgaccgcgcgccattgctgatgttgctacaacgtctgggcgccgaggtggagagcggcgagcgtccttccggggcggcgttgtgcctgcttgcgccactgggcgccgacgtcagcgccgcagcgcggcggttcgccgtcgatccgacgcgcagcctggccatcgacgtgctgtcggacctggagcgacaccgctgcctgatggcctgcccggcgacccgagcggagctgcagcaggcggctcgcaccctgttcgcacgggacggcgtgggcgtcacgctgattcgcgacagcgccgggttcatcgtccagcgcaccctcgcctcgatcgtcaatctcgcctgcgacatcgcccagcagggtatcgcttcggtggagcacatcgacctggcggtgcgcctcggtctcggctatccgctggggccgctggagtggggcgaccgactgggcgccgggcgcgtgctgcgcatcctcgaacgcctgcatgcgctcagcggcgacccgcgctatcgccccagtccctggctgcgccggcgcgcccaactgggcctttccctgcgccagccggacagcccgttggcctcctga

SEQ ID NO: 5436 - DNA, 366 bp, Pseudomonas aeruginosa
ccgaggtcagccagcgcaacgaggcgggcaccagcgacctggcgctgttcaaccgcaaccggcgtttcgccggcgcggcgcaggcggaccgtttcgacctggccggcctggactaccgtatcgccccggactggaccggcagctaccactatggcgaactggagcaggtctacgcccagcatttcctcggtctcaaggggcgcatcggcatcgctgcggacagcctggagagcgacttgcgcctggcgctcagccgggataccggcggcgctcgcggcgggcgcatcgacaaccgttccttcagcgggtcgctcacctaccgcctgcgcaacggccaggccttcggcctgggctaccagcggatga

SEQ ID NO: 5437 - DNA, 1059 bp, Pseudomonas aeruginosa
tcgattgcgcagttattgaccagcccgattcaccaggctttttcaatttcgaaggggtgcccgggcgctaccggtttgcccgtccgcgcgggaaccgcccctcttccgcatgcgggaaagcggccgccgagggtcgtggcgcatgggcaggggtcggcaggtggcttttctgaaacgaacattcacggcgccgaacggcgccgtggcaggggaaatgcctcagaccaggtccaggtgaaccttgtgctgtgccatcaggcgggcgatggcggcgggcggcgggctgtcgctgatgacccggttgaccagcgagatcggtcccaggcggaccaccgcgttgcgcccgaacttgctcgagtcggcggccaggaacacttgccgcgcgttgtcgatgatcgcctgggatacgcgcacttcctggtagtcgaagtcgagcaggctgccatcctcgtcgatgccgctgatgccgaccagggcgaagtcgacgcggaactgctggatgaaatccaccgcggcctggccgacgatgccgccgtcgctgcgtacggtgccgccggcgaccagcacttcgaagtcttccttggcgctgagggtggcggccacgtgcaggttgttggtgatgatcttcagattgcggtggttgaaccaggcgcgggcgatggcctcggtggtggtgcccatgttgatgaacagcgaggcgttgtccggcaccaggctggccacggcttcggcgatgcgctgcttctcgtcacgcatctggtcggcgcgcatggtgtaggcggtgttctcgatgctcgaatcgtaggccgcaccgccgtggtagcggcgcagcagtccctgttcggcgagctggttgatgtcgcggcggatggtctgcggggtgaccgcgaacatctgcgccatctcctcgatgctcaggtaaccgcgctcgcggacctcctcgatgatgctttgctgtcgggggggcaggttcatgggttgttctcgtgctgccgggccgggaccctggaaagtcgccaagaatgccgcacgcggggggccgttgtcagccgtgcatga

SEQ ID NO: 5438 - DNA, 585 bp, Pseudomonas aeruginosa
ttatggcgggcagccgtgaaaattgttcagtttcgaaaaaatatattcacaaaggaatgctgtcaaagcgcgaagatgaacgtttgtccgaaaaacgaccctccggtttcgttttcgcggccaatcgaatatcgctaccgaggcacgcgggccgcggcatcggcgcccgtgcaacaggggcggcgatggcttaaggtatgcgccggttttcagccaacgttcttctccgggagtgaccatgacccctgccatcgacctgctgaaaaaggcccgcgccgcgcacaaggtgctcagctacagccacgaccccaaggcaccttcctatggcctggaggccgcggaaaagctcggcctggacccgcagcgggtgttcaagacgctgctcgccgccacggagaagggcgagttgctggtggcggtggtgccggtgatcggcagtctcgacctgaaggccctggcccatgcggcgggggcgaagaaggccgacatggccgatccgcaggcggcgcagcgggctaccggctacctggtgggcgggatcagcccgctggggcagaagaagcgcctgcgtaccttcatcgatga

SEQ ID NO: 5439 - DNA, 1158 bp, Pseudomonas aeruginosa
tcccgccggcctagcggtcggcattcgtcttacttttcaatctgtcaggttttccatgtcccactatctcctcgccatcgaccagggcaccaccagctcccgcgccatcgtgttcagtgcccagggcttgccggtggcgagctgccagcaggaattcaagcagtacttcccgaaggacggctgggtggagcacgacggcgaggaaatctggctgaccaccctccaggtctgtcgcgacgcgctcgcccgcaagggcttgcgcgcggccgacatcgccgccatcggcatcaccaaccagcgcgagaccacgctggtctgggacgccgccagcggcgacctgatccacccggccatcgtctggcaggatcgtcgtaccgccgactactgtgccgaactcaaggccgccggccacgaggccaatgtcagcgcgcgcaccgggctgctgatcgatccgtatttctccgccaccaagctgcgctggatcctcgacaacgtgcccggcgcccgccagcgcgccgaacgcggcgagctgcgcttcggcaccgtcgactgcttcctgctctggcgcctgaccggcggccgctcccatcgcaccgacgcgaccaacgcttcgcgcaccctgctgttcaacatccacagccaggactgggacgaggaattgctggcgctgttcgagatcccgcgcagcctgctgccggaggtactcgactgcgcggcggagttcggcgtcagcgagccgtcgctgcttggcgcggcgatcccggtgctgggcatggccggcgaccagcaggccgcgctgatcggccaggcctgcttccagccgggcatggtgaagagcacctacggcaccggctgcttcatgatccagaacaccggcgagcagccggtgacctcgaagaaccgcctgctcaccacggtcggctaccgtctggacggcaaggtcagctacgcggtggagggcagcatcttcgtcgccggcgccgcggtgcaatggctgcgcgacggcatcaagctgatcgaccacgcccacgagagcgaagccctggcgatccaggccggcgactccaacggcgtctacctggtgccggcctttaccggcctcggcgcgccctactgggacccgaaggcgcgcggcgcgatcttcggcctgacccgtga

SEQ ID NO: 5440 - DNA, 318 bp, Pseudomonas aeruginosa
cccatggctaagccgaatgatacgtccaaccccgaggtaacagaatcgtccccccgcttcgtcccactgctacccacctcccaggccgacatgtgtccgcgtagcgccaccctgtacgtggacacccatgcactccccacgcacttgttcgacaacgcgaaagtgcgcttgaggtcggcaatcaacatcctggccatgacccgtttgctcgatgagaaagaagagcccggcggcaccctggcctacatcaacggtgcgttgctgtcactgctcagcgatgccttgtccgaaatcgaggcgggccacccgagcctgtag

SEQ ID NO: 5441 - DNA, 669 bp, Pseudomonas aeruginosa
ccgatcggcgccgggtcgggttgcgcccagccaccgctggccggttgcgggtccgcggcgagcgccgggagggcgcatgccatggcggcggtatggagcagcgggcgaaggatggggaacatggcgggcctcggcggcggggggcgtaaggaaaagcttggccgaagccggggcccgggacaagtcgggacgggcatccgcgtgcccgtccgtcgctggggtcaggcgccgcgttgcggcagcatggcgcgcagtacgtcgtccttctgcacgcggtggtgccagatggccgcggcggcgtggccgaggatcagcgcgaaaagcaggtactggacggtgacgtgggtgccgccggcgaacgccttgaaggcttccggcaggtcgaacgggccgatctgcaccagccagaacaggtccagcggacgcttgccggcgagcatgccggagagcggcatgacgatcagcaccgcgtacagcaggaaatgcccggccttggcggccgcgcgctgccagtccgggttcccctccaaggtatccgggacaccctggacgcggcgcagcgccaggcgtgtcagggtcagcaggagtaccgccacgcccagcgacttgtgcagggtgaagacgttgcccttgccgccgagcaggccggcgaagaagtcggcgccgtag

SEQ ID NO: 5442 - DNA, 1008 bp, Pseudomonas aeruginosa
tcggcgccgcctacctgcactcggcctttcccgcggtacccaacgcggtctgggtgctgggcgttcatcggcgtgaccacgacgatcaacatcgtcggcctgcgcctggcgaagaacgtcaatggcctgctgatgctggtgcagttcctggtcctcggcgccttcgtcgcgctctgcgtgcactacgtgctgggcgacccgggcaagccgctatggtcactgcaaccgttgctcggtggcgacctgcaggtgccgctggtgatgagcggtgcggcgatcgcctgctactcgttcctcggtttcgacgcggtcagtaccctgaccgaggaaacccgcgacccgcggcgcaacatcccgcgagcgatcctgctgatcaccctgctgggcgggttgatcttcatcgtcacctcgtacttcgtgcaactggcgcacccgtcgttcgccttcgacagcgcggactcggcggcctacgagatcgcccgcaacatcggtggcgacctgttcgtgaccttcttcctggtcggcctgatcgtcggccagttcacctccggtctctcggcccaggccagcgcctcgcgcctgctcttcgccatgggccgcgacggcgtccttccgcggccgttcttcggtcgtctcggcaagcgcttcgagacgccggcgaacagcatcgtcctgtgcggtgtggtggccttgctggcgctacagatggacgtgaccacctccacgtcgttcatcaacttcggcgccttcctcgccttcagcctggtcaacctgtcggtggtcttccactactaccttggcgccgagcgccgcggtccacgggaaaccctgttgttcctggtattccctggcatcggcctggtcgccgacctgtggttgatggccagcctcgaccatctggcgatcatcctcggcctctgctggctggcgctgggcgcggtgtacctggcggcgatcacccacggtttccgcgagccgccgccggagatgcgtttcgaggagggctga

SEQ ID NO: 5443 - DNA, 690 bp, Pseudomonas aeruginosa
tcttatggctcgataagggattccatatcgacgttttccgtcagccctcgctcaggcgtcgtccaggccgctcttcagcgtcgccaggaacgcctgcgccgcccgggaaggttcgctggccggaaggatcgcgtggatctccgaacgcgcgccggccggctcgatttccaggtagcgcacctcgttccgccaggccaggcagagggtctccgggatcagcgcgacgcccatgccgagaccgaccatggcggcgacggtctgccacaggcgcgcctcgtggcggatgcgcgggctgaagccggcgtccacgcagcgggcgatgatcaggtcgtggtagtgcggggagacatggcgcgggaagaggatgaagtcttcgtcgcgcagttcggcgaggtccagacgcgcctggccagccaggcggtgcccggcgggcaggcagcagaggaacgggtcgctgatcaagggttcggagacgatttccgccggcagcctgccccagtgcacgaagcccaggtcgatctgcccgcgctgcaacgcctgggcctgctccgcgctgttcatttcgccgagcaccacctccatgttcgggtgctcccgttcgaagcgggacatggccctgggcaggccgcggtagagcatggagttgacgaagccgacgcgcagttggccgacgtcgccctcggcggatag

SEQ ID NO: 5444 - DNA, 363 bp, Pseudomonas aeruginosa
gccgcgaacaggcgctcgaatccttgcagcgccacctgcgccggctgctggatgacagcgacctgccaggggacgcccgcgacctcttcgacgaactgctggtgcgagtggtcgcgaccatggccgacgtcgccgagcgccgccaggacgagcaggtgcgccaggccggcagcgccctctatcacctgtgcacggcgatcttcatggcctgggaggccagccgccaggcacccgaccagcgccgcctggccctggccttcctggtcgcccggcacaagctgctgccgcgcgacccgctgcgcctggagggctggaccgaccaggccgaactgctggccagggtggtcggcgaggtgccgctga

SEQ ID NO: 5445 - DNA, 1134 bp, Pseudomonas aeruginosa
gctggccgagcggctgatccgtctcggcgtgccctgcggagccatcgccacggtggatcgggtggtggagcacccgcacacccgccatcgcgggatggtcgtcgaactcgagggctatcgcggcatcgcctcgccggtgaagctttcgcgcaccccggccagctaccgcgccgcgccgccggtgctgggcggagacactcgggaagtcctggcggaactgggattgagcgccgaggcgatcgacgcgctggtccggcgcggcatcgtccgcgcctgaaaccccgcacggcacggcctgcgccgtgcaactcaatccccgggcaattggagatggccatggattcctcccctggggcggtgagccccgaactcgtgctgctggagcggccggagcagggcgtggccctgttgcgactgaaccgcccggcagtactcaacgccctgaacatgcgcctgcgcgaggctctggcggagcacgtacggcgcctcgacgagtgcgccgatacccgggtcatcgtcctcaccggaaatggcacggcgttcgccgccggcgccgatctcaacgaactggcggaggcgtccgcgctggagatccagcagcgcggggtggagcgccactggcaggccctcgccgcctgccgcaagccgctgatcgccgccgtggagggccatgccctgggcggaggctgcgagttggcgatgcactgcgacctgatcgtcgccggtgcctcggcgcgcttcgcccagccggaaatccgtgtcggcgtgatgcccggcgccggcggcacccagcgcctggtgcgagcggtgggcaagttccaggcgctgcgcatgctgtttaccggttgcacggtacgggcgccggaggccctggccatagggttggtcagcgaggtggcggcggatggccaggcattggatcgcgccctcgaactggctcgccagatcgccggcctgccgccgctggcgctggcgcagatcaaggaagtggtcctggccggcgccgacctgccgctggaccaggccctggcgctggagcgcaaggccttccagttgctgttcgacagccacgaccagaaggagggcatgcgtgccttcctggaaaaacgcacagcggagtacctgggaaaatga

SEQ ID NO: 5446 - DNA, 1533 bp, Pseudomonas aeruginosa
ttcgcgacagcgccgggttcatcgtccagcgcaccctcgcctcgatcgtcaatctcgcctgcgacatcgcccagcagggtatcgcttcggtggagcacatcgacctggcggtgcgcctcggtctcggctatccgctggggccgctggagtggggcgaccgactgggcgccgggcgcgtgctgcgcatcctcgaacgcctgcatgcgctcagcggcgacccgcgctatcgccccagtccctggctgcgccggcgcgcccaactgggcctttccctgcgccagccggacagcccgttggcctcctgatcccttggcggagaaacacaccatgctcgatgcctatatctacgccggcctgcgtacgcctttcggccggcatgccggtgcactctcgacggtgcgtccggacgacctggccggcctgctgctggcgcgtctcgcggaaacctccgggttcgctgtcgacgacctggaggatgtgatcctcggttgtaccaaccaggccggcgaagacagccgcaacctggcgcgcaacgcgctgctcgcagccggcctgccggcgcggctgcccgggcagacggtcaaccgcttgtgtgccagcggactgtcggcggtgatcgacgcggcgcgcgcgatcagttgcggcgagggccggctgtacctggccggcggcgccgaaagcatgtcccgggcgccgttcgtcatggccaaggcggagagcgccttcagccgcacgctggaggtcttcgacagcaccatcggcgcgcgcttcgccaaccccaggctggtcgagcgctatggcaacgacagcatgccggagaccggcgacaacgtggcccgcgccttcggcatcgatcgcgaggatgccgaccgtttcgccgcttcttcccaggcgcgctaccaggctgcgctggaggagggctttttcctcggcgagatccttccggtggaggtgcgcgccggacgcaagggcgagacgcggctggtggagcgcgacgagcatccgcgaccgcaggccgacctggcggccctggcacgcttgccggcgttgttcgccggtggggtagtgaccgccggtaatgcgtcggggatcaacgacggggcggcggtagtgctgctgggcgatcgcgcgatcggcgagcgcgagggcatccggccgctggcgcggatcctcgccagcgccagcgtcggcgtggagccccggttgatgggcatcggcccgcagcaggcgatcctccgcgcgctgcaacgcgccggcatcgacctggacgaggtcggcctgatcgagatcaacgaagccttcgcgccgcaggtcctggcctgcctgaagttgctcggcctggactacgaggacccgcgggtcaatccccatggcggcgccattgccctcggccatccgctcggcgcctccggtgcgcgcctggtgctcaccgccgcccgcgggctgcaacgcatcgagcggcgctacgcggtggtcagcctgtgcgtcgggctcggccagggcgtggcgatggtgatcgagcgctgccgatga

SEQ ID NO: 5447 - DNA, 969 bp, Pseudomonas aeruginosa
gctgccgctgttctgagccgctcagcccttggcggcgctgaccccttcgagggtggcgaaggaggtgtccttggcggtgagcaggaagtcgcgcatgaatggcgcatcgaacatgtccgtgcggatggcggcgaagagcgtgcagtacaggcccttttcaccgaggcgccgggccgtcacgtagccgcgcgagctgtactcgtgcagggcccagttcggcaggcagcagacgccgcgaccggaggccaccagctgcatcatcatcacggtcagctcggctatgcgcacctgcgccggctccacgtcggcggggtcgaggaagcgggtgaagacgtcgagacgatcgcgttccaccggataggtgatcagggtttcccgctccaggtcctccgggacgacgtacggtcgaccagccagggcatgctggttggccaccgccagcagcgcttcgtaggtgaacagtggcacgtaggtgatgccgggcaactcgatcgggtcggcggtcaccaccaggtcgaggtcgccgcgggccagggccggcagcggcgcgaaggagaagcccgaggccaggtccagttcgacttccggccaggcgtcgcggaactggtcgatggtcggcatcagccactggaagcaactgtggcattcgatggccatgtgcaggcgtccggcggtaccgccggcgagccgcgccaggtcgcgctcggcggtgcgcagctggggcagcagcgagtcggccagttgcagcaggcgcagcccggcgctggtgaagcgtaccggcttggtcttgcgcacgaacaactgcatgcccaggcgctcttccagttccttgaactggtgcgacagcgccgactgggtaaggtgcaggcgctcggcggcttccaccaggctgtcggcttcgcgcagcgcgtgcagggtcttgaggtggcgaagttcgagcatggcggcctctgtatgagcaaaacttga

SEQ ID NO: 5448 - DNA, 921 bp, Pseudomonas aeruginosa
cggtgcggattcgttgagtttgtctcatacgccaggggctgtcgacaagcgatggcctcgatcccgcagagcgtgcgatcgtggagcgacggggagaagagcccggcacacgggacggcggcacggagcagcggcgcaacgccgcagagccacaacgccacgaccgcctggcggcattcatcaaactgtcacgctactgtggcagcgcgctggacgaaatttaatcagaatcgcgctccactggggttctgcgttctgggttttcttcatgcgtgctttcatcttcctggccgccttgttgtgcagcctctcctcctttgcggcggcgcgttgcgacgcacgcgtacctaccgagacggtcgaactgggcgacgtgcgcctggcctaccagagcatcggccgcgacagcgatccggccctgctgctggtgatgggcctgggcgggcaactgatccactggccggacgaggtggtcagcgccctgtgcgagcaaggcttccgggtgatccgctacgacaaccgcgacgtcggcctgtcggcctggaacgtgccggtgcccagttcgcggctgacctacgaagtggtgcgttatcgcctcggcctgccggtcagcgcgccctataccctcaccgacatggccggcgatgccctgcatctgctcgacgcgctggatatcccccaggcccatgtgctcggcgccagcatgggcgggatgatcgcccagcacatcgccgacatggcgccgcagcgcctgctcagcctgaccctggtgatgaccagctccggcgccgaaggcctgccggcgcccagcgagtcgctgctgcgcctgctggcgcggcgcgaggcggccagccgcgagcaggcggtcgagcagcaggccgacctgctggcggcgctgggcagcccggaagtgcgcgatga

SEQ ID NO: 5449 - DNA, 1299 bp, Pseudomonas aeruginosa
cggttggccagttgctcggtgagcgcctcgacgctctgcatctgctcgccgcccggcagcggtgccttggcggtccaagccgggcccaagatgggcgaaaaacggctggagctgcgtcagcgccgattcggccagcttgcggtaggtggtcagcttgccgccgaacaccgagagcagcggcggctcgccgttgccggcggagagcgacagggtgtagtcgcgggtgatcgccgaaggctcgtcggactcgtcgtcgcacagcggacgcacgccggcgaagctgtgcaggatgtcggcggccgcgagttgctgcttgaaatgggcgttcaccacttgcagcaggtaggcggtttcctcttcgctgatcgccaccttggccgggtcgccctggtactcgcgatcggtggtgccgatcatggtgaaacggtccagataggggatggcgaagacgatgcggcggtcttcgttctgcaggatgtaggcgtgctcgccttcgtacagcttcggcacgatgatgtggctgccctggatcaggcggataccgtagggcgacttctgtttcaggtcgtcctggatgaagcgcgccacccaggggccggcggcgttcaccagggcgcgggcgcggatcgaatacaggctgccgtcgctgcgctccaggtgcaggtgccagagtcccttgctgcgacgggcgctgacgcagcgggtgcgggtatggacgtgggcgccgtgctcgcgggcggagatcgcgttgagcaccaccaggcgcgcatcgtccaccgcgcagtcggagtactcgaagccacggcggatctcggccttcagcgggctgctgccggtgaagcgcaggccgcgcgaggcgggcagcttctcgcgcttgccgaggtgatcgtagaggaacaggccggcgcggatcatccaggctgggcgcaggtgcggacggtgcggcaggacgaagcgcagcggcttgacgatgtgcggcgccttggccagcaggacctcgcgctcggccagggcttcgcggaccaggcggaattcgtagtgttcgaggtagcgcaggccgccgtggatcagcttgctgctggccgaggaggtgtgctgggccaggtcgtgctgttcgcaaaggaacacggacaggccgcgcccggctgcgtcggcggcgatccctacaccgttgatgccaccgccgaccacggcgacatcgtagacttcggcgagtggagcggagggggtgtgcgcttgactcatgtgaaaggccctgaagtcgaaagtgaacgtagttttgttcgaattcgaaaatag

SEQ ID NO: 5450 - DNA, 2556 bp, Pseudomonas aeruginosa
agggcgccgcggcggcacccggccgccgcgcgcaaacgttacccagggcatgccagagcggcgcccgggaacacgccattcgccgcattgcggcggacgaatggcgccagctcgtcacagttcgccgtcgtcccagccgcgagtgcgctccaccgctttcttccagccggcatagagcttttcgcgccggggctcgtcgcactccggctcgaacacccgctcgatcaccgccttgctcttcagctcgtcgaggctgctccagaagccgcaagccaggccggccaggtaggcggcgccgagggcggtggtctcgcgcatcaccggacgttccacgcgggtgccgaggatgtcggcctggaactgcatgaggaagttgttggccaccgccccgccgtcgacgcgcagggcgcgcaggcgttcgccggcatcgcgctgcatggcgtcgagcacgtcgcgggtctggtaggcgatggattccagggtagcgcggatcaggtggtcggccttgactccacgggtcaggccgaacaccgcgccgcgcgcataggggtcccaatagggcgcgccgagtccggtgaaggccggtaccaggtagacgccgttgctgtccttgaccttggtggcgaagtattcggaatcgaaggagtcgttgatcaccttcagttcgtcgcgcaaccactgcaccgtggagccgccgttgaacaccgcgccctccagggcgtagccgacctcgccgcgcgggccgcaggcgatggtggtgagcaggccatgggtggatttcaccgccttgtcgccggtgtgcatcagcaggaagcagccggtgccgtaggtgttcttcgcctggcccggttccacgcacatctggccgaacagggcggcctgctggtcgccggcgatcccggcgatcggcagttcgccgccgccgaccccgccgatccgggcgttgccgtagacctccgaagagttgcgcacctcgggcagcatcgagcggggaatgtcgagcacctcgagcatccgtgcgtcccagtcgaggctgtggatgttgaacagcatggtccgcgaggcattggtgtagtcggtgacgtggaccttgccttcggtgagcttccagatcagccaggtgtcgatggtgccgaacaacaggtcgccgttgcgcgcgcgttcgcgggcgccttcgacgttgtcgaggatccacttcagcttggtcccggagaagtacggatcggtgaccagcccggtggtttcgcggatgtagtcttccagcccgtcgcgcttgagctgcgcgcagatcgccgcgctgcgccggcactgccagacgatggcgttgtggatcggccgaccgctgtgacggtcccagaccaccgtggtctcgcgctggttggtgataccgatggcggccacctggtcgtgctcgatgctggcctgggcgagggcctcgaccagggtcgaactctgcgtggcccagatttccatcgggtcgtgctcgacccagccggcctgcggatagaactgggcgaactcgcgctgggcctggctgaccacgttggcatcgcggtcgaagacgatggcgcgggagctggtggtgccctggtccagggcgacgacgtatttcttgttgtgcttgtcggtcatggctgtggccttgtggctatggcaggaaagagcgggcggtcaggaagcgcgaaccttctccggctcggcttcggcgggcgccgcggcgctcggcagatggcgcgcgatcagtacacgatagccgccggcgccgaggcaggcaccgaggatcggggcgaagatcggcaccaggaaatagggaatctcgcggccgccggtgaaggcgatgggcccccagccggccaggtaggtcatcagcttggggccgaagtcgcgcgccgggttcatcgcgaaaccggtcagcgggcccatggcgctaccgatcacggcgatcagcaggccgatcagcagcggcgccaacggaccgcgcggcaggccgttgccgtcgtcggtaagggccatgatcaccgccatgaggatggccgtgatcaccacttcgacgaggaacgcctggccgaccgacagcgccgggtgcggataggtggagaacaccgaggccagggccaggctgtcctggctgccgcggacgatgttctgcgcctgttcgaactcgatgaacaggctgctgtagagggtgtagaccagcgctgcggcgcagaacgcaccggccacctgggcggtgatgtagaacggcagcttgcgcccctcgaagccggcgaacagccacagcgcgatgctcaccgccgggttcaggtgggcgccggagacgccggcgctgaggtagatcgccatgctcacgccgaccccccagatgatgctgatttcccacaggccgaagctggcgccggcgaccttcagggccgcgacgcaaccggtgccgaagaagatgaggagggcggtgccgaggaactcggccaggcattggccgaacagggacggggtcggggcggcggtggtcatggggcctctcttgtctgttcttgtaattatggcgggcagccgtga

SEQ ID NO: 5451 - DNA, 630 bp, Pseudomonas aeruginosa
acgtttgtccgaaaaacgaccctccggtttcgttttcgcggccaatcgaatatcgctaccgaggcacgcgggccgcggcatcggcgcccgtgcaacaggggcggcgatggcttaaggtatgcgccggttttcagccaacgttcttctccgggagtgaccatgacccctgccatcgacctgctgaaaaaggcccgcgccgcgcacaaggtgctcagctacagccacgaccccaaggcaccttcctatggcctggaggccgcggaaaagctcggcctggacccgcagcgggtgttcaagacgctgctcgccgccacggagaagggcgagttgctggtggcggtggtgccggtgatcggcagtctcgacctgaaggccctggcccatgcggcgggggcgaagaaggccgacatggccgatccgcaggcggcgcagcgggctaccggctacctggtgggcgggatcagcccgctggggcagaagaagcgcctgcgtaccttcatcgatgaaagcgcgcggcagtacccgagcatccatgtcagcgcaggacggcgcgggctggaagtggagctggcggccgaggtgctggcccagctgacccagggttcgttcgccgccatcggccgtgaatga

SEQ ID NO: 5452 - DNA, 1548 bp, Pseudomonas aeruginosa
gccgctaatcccgccggcctagcggtcggcattcgtcttacttttcaatctgtcaggttttccatgtcccactatctcctcgccatcgaccagggcaccaccagctcccgcgccatcgtgttcagtgcccagggcttgccggtggcgagctgccagcaggaattcaagcagtacttcccgaaggacggctgggtggagcacgacggcgaggaaatctggctgaccaccctccaggtctgtcgcgacgcgctcgcccgcaagggcttgcgcgcggccgacatcgccgccatcggcatcaccaaccagcgcgagaccacgctggtctgggacgccgccagcggcgacctgatccacccggccatcgtctggcaggatcgtcgtaccgccgactactgtgccgaactcaaggccgccggccacgaggccaatgtcagcgcgcgcaccgggctgctgatcgatccgtatttctccgccaccaagctgcgctggatcctcgacaacgtgcccggcgcccgccagcgcgccgaacgcggcgagctgcgcttcggcaccgtcgactgcttcctgctctggcgcctgaccggcggccgctcccatcgcaccgacgcgaccaacgcttcgcgcaccctgctgttcaacatccacagccaggactgggacgaggaattgctggcgctgttcgagatcccgcgcagcctgctgccggaggtactcgactgcgcggcggagttcggcgtcagcgagccgtcgctgcttggcgcggcgatcccggtgctgggcatggccggcgaccagcaggccgcgctgatcggccaggcctgcttccagccgggcatggtgaagagcacctacggcaccggctgcttcatgatccagaacaccggcgagcagccggtgacctcgaagaaccgcctgctcaccacggtcggctaccgtctggacggcaaggtcagctacgcggtggagggcagcatcttcgtcgccggcgccgcggtgcaatggctgcgcgacggcatcaagctgatcgaccacgcccacgagagcgaagccctggcgatccaggccggcgactccaacggcgtctacctggtgccggcctttaccggcctcggcgcgccctactgggacccgaaggcgcgcggcgcgatcttcggcctgacccgtgacaccggaatcaaggagatcgtcaccgccggtctgcaatcggtctgctaccagacccgcgacctgctcgaagcgatgcgccaggacggcacgccgcccagcgcgctgcgggtggacggcgggatggtggtgaacaactgggtgatgcaattcctcaccgacatccttggtgtcaccgtggagcgcccggaagtcaccgagaccaccgccctcggcgtggcctacatggccgggctgaaggccggcttctatcgcgacctggacgacatcgccagccactggcacctgcagcgccgcttcgccgcgcacatggccgaggagcgccgcggcgaactctacgccggctggcagaacgcggtgcgacgggtgcgcagcgaggcctga

SEQ ID NO: 5453 - DNA, 981 bp, Pseudomonas aeruginosa
gcggcgtttcgcggaaaaaggcggcgtttttgccggcggcttcacaacgccggcaggtcgccgcaaacgcccgctcgggcaatgggtcgaaggcagggcgaagtcccactgttacgatcggaaaagatcgcactgtatcgcccatcccggagcctgcggcggcatgctgtggcgatcgttcccaggaggtctgccatgcagctcgagttccaccaggtcgacgcgttttcttcccgcccgttcagtggcaatcccgccgtggtctatcgcctcgacgcctggctggcggacgagctgatgcagatgatcgcgaccgagcacaacctctccgagaccgccttcgtcgttcgcgaaggagaggcctggcggatccgctggttcaccccgagcgtcgagatggcgctctgcggccacgccacactggctgcggcccacgtactgttcgaggtctacgacgagccgggcgagcgcctggaattcatctcgcgctccggtgcgctgcgggtcaaccgcgaggacgagcggctggtcctggatttccccgcgcagtatccgagcgaggtcggtagcaccgtcgagctggagcaggccctgggcctgccgccggtggacgtgctgggctccaccgacaagctgctggtgctgctcgagtccgaagaggcggtgcgcgcctgtcgccccgacttcgcggccctggcgcggctgccctggcgtggagtgatcgtcaccgcgcggggcctgcagaaggatttcgtctcgcgcttcttcgccccggcgatgggcgtcgacgaagacccggtcaccggctccgcgcattgcagcctgattccctactgggcccagcgcttgaacaaactgtcgctgaccgcccagcagtgctcggcgcgcggcggcgagctgtggtgccggttggagggcgagcgggtgagtatcgccgggcatgcggtgctggtggcgagcggaaggattcgattgggctga

SEQ ID NO: 5454 - DNA, 216 bp, Pseudomonas aeruginosa
ccaacaggaggcaataccatgcaagtcttcaaggttcagggcatgacctgcggccactgcgtacgggcgatcacccatgcggtgcaggcgaaggattcggcggcggacgtccaggtggatcttggcgccggcgaagtccgggtcgccagccggctcgacagcacccaggtactcgaggcgatccgcgaggagggctacggcgccgagctggcctga

SEQ ID NO: 5455 - DNA, 813 bp, Pseudomonas aeruginosa
cttcttggccaaagcgaggtccgaatcgacctcgtaccagtccgccacaacaataaaagccggcctggccggtgcaggagggttcatgtcagtcccagtccgccacctcatcgcgggagccttcgtcgaaggtctcggcgcccagcgcatcccggtcagcaatcccctcgacaacagcaccctggcggagatcgcctgcgccagcgcggagcagatcgagcaggcggtggccagtgcccgcgaaaccttcgccagctggaaggaaaccccggtttccgagcgcgcgcgggtgatgctgcgttaccaggcgttgctcaaggaacaccacgacgaactggcgaagatcgtctccagcgagctgggcaagactttcgaggacgccaagggcgacgtctggcgcggtatcgaggtggtcgagcacgcctgcaacgtgccctcgctgctgatgggcgagacggtggagaacgtcgcccgcaacatcgacacctacagcatcacccagccgctgggcgtgtgcgttggcatcaccccgttcaacttcccggcgatgatcccgctgtggatgttcccgctggccatcgcctgcggcaacgccttcatcctcaaaccttccgagcaggtgccgctgaccagcgtgcggctcgccgagctgttcctcgaggccggtgcgccgaagggcgtgctgcaggtggtgcatggcggcaaggaacaggtcgaccagttgctcaagcacccgcaggtgaaggcggtgtccttcgtcggctcggtcgccgtcggccagtacgtctaccacaccggcaccgcgcacaataa

SEQ ID NO: 5456 - DNA, 729 bp, Pseudomonas aeruginosa
gcgcgtgcagagcttcgccggggcgaagaaccacatggtgatcatgcccgacgcggacaaggcacaggtcatcagcaacctggtcggtgcctcggtgggcgcggccgggcagcgctgcatggcgatctcggtggcggtgctggtgggggccgcccgcgagtggattccggaaatccgcgacgcactggccaaggtccgccccggcccatgggacgacagcggcgccagctacggcccggtgatcaacccgcaggccaaggcgcgcatcgagcgtctgatcggccagggcgtggaggagggcgcgcaactgctgctggatggccgcggctacaaggtcgagggatacccggacggcaactgggtcggcccgacgctgttcgccggggtgcgcccggacatggcgatctaccgcgaagaggtgttcggcccggtgctctgcctggccgaggtcgacagcctggagcaggcgatccgcctgatcaacgaaagcccctacggcaacggcacctcgatcttcaccagctccggcgccgcggcgcggaccttccagcaccacatcgaggtcggccaggtgggcatcaacatcccgatcccggtaccgctgccgttcttctccttcaccggttggaagggctcgttctacggcgacctgcacgcctacggcaagcagggcgtgcgcttctacaccgagaccaagaccgtgaccgcgcgctggttcgacagcgatag

SEQ ID NO: 5457 - DNA, 468 bp, Pseudomonas aeruginosa
cgccttgcagtgctgcgaaggcgccgaagtggtgatcagcatgctgccggccgggcagcacgtggaaagcctgtatctcggcgacgacggcctgctcgcgcgggtcgccggcaagcccctgctgatcgactgctcgaccatcgccccggagaccgcgcgcaaggtcgccgaggccgccgcggcgaagggcctgaccctgctcgacgcgccggtttccggcggcgtcggcggcgcccgcgccggcaccctgagcttcatcgtcggcggccccgccgaaggcttcgcgcgggcccggccggtcctcgagaacatgggccggaacatattccacgccggcgatcacggcgccggccaggtggcgaagatctgcaacaacatgctcctcggcatcctcatggccggcaccgccgaggccctggcgctgggggtgaagaacggcctcgacccggcggtgctgtccggcggtga

SEQ ID NO: 5458 - DNA, 2154 bp, Pseudomonas aeruginosa
accccgtggtgggcacctgaacgccgcttcatcaccgccggacagcaccgccgggtcgaggccgttcttcacccccagcgccagggcctcggcggtgccggccatgaggatgccgaggagcatgttgttgcagatcttcgccacctggccggcgccgtgatcgccggcgtggaatatgttccggcccatgttctcgaggaccggccgggcccgcgcgaagccttcggcggggccgccgacgatgaagctcagggtgccggcgcgggcgccgccgacgccgccggaaaccggcgcgtcgagcagggtcaggcccttcgccgcggcggcctcggcgaccttgcgcgcggtctccggggcgatggtcgagcagtcgatcagcaggggcttgccggcgacccgcgcgagcaggccgtcgtcgccgagatacaggctttccacgtgctgcccggccggcagcatgctgatcaccacttcggcgccttcgcagcactgcaaggcgctatcggcgccctgcgcgccctgctcgaccaggctcagcacggccttgggctgcaagtcgaagacattcacccggtggccagccttgagcaggttggcggccatcggcccacccatgttgcccaggccgaggaatgcgatgtcggtcatcggtccgtctccctttcagcgcatctggatcgagaagttggtcccggccacgctatcgctgtcgaaccagcgcgcggtcacggtcttggtctcggtgtagaagcgcacgccctgcttgccgtaggcgtgcaggtcgccgtagaacgagcccttccaaccggtgaaggagaagaacggcagcggtaccgggatcgggatgttgatgcccacctggccgacctcgatgtggtgctggaaggtccgcgccgcggcgccggagctggtgaagatcgaggtgccgttgccgtaggggctttcgttgatcaggcggatcgcctgctccaggctgtcgacctcggccaggcagagcaccgggccgaacacctcttcgcggtagatcgccatgtccgggcgcaccccggcgaacagcgtcgggccgacccagttgccgtccgggtatccctcgaccttgtagccgcggccatccagcagcagttgcgcgccctcctccacgccctggccgatcagacgctcgatgcgcgccttggcctgcgggttgatcaccgggccgtagctggcgccgctgtcgtcccatgggccggggcggaccttggccagtgcgtcgcggatttccggaatccactcgcgggcggcccccaccagcaccgccaccgagatcgccatgcagcgctgcccggccgcgcccaccgaggcaccgaccaggttgctgatgacctgtgccttgtccgcgtcgggcatgatcaccatgtggttcttcgccccggcgaagctctgcacgcgcttattgtgcgcggtgccggtgtggtagacgtactggccgacggcgaccgagccgacgaaggacaccgccttcacctgcgggtgcttgagcaactggtcgacctgttccttgccgccatgcaccacctgcagcacgcccttcggcgcaccggcctcgaggaacagctcggcgagccgcacgctggtcagcggcacctgctcggaaggtttgaggatgaaggcgttgccgcaggcgatggccagcgggaacatccacagcgggatcatcgccgggaagttgaacggggtgatgccaacgcacacgcccagcggctgggtgatgctgtaggtgtcgatgttgcgggcgacgttctccaccgtctcgcccatcagcagcgagggcacgttgcaggcgtgctcgaccacctcgataccgcgccagacgtcgcccttggcgtcctcgaaagtcttgcccagctcgctggagacgatcttcgccagttcgtcgtggtgttccttgagcaacgcctggtaacgcagcatcacccgcgcgcgctcggaaaccggggtttccttccagctggcgaaggtttcgcgggcactggccaccgcctgctcgatctgctccgcgctggcgcaggcgatctccgccagggtgctgttgtcgaggggattgctgaccgggatgcgctgggcgccgagaccttcgacgaaggctcccgcgatgaggtggcggactgggactga

SEQ ID NO: 5459 - DNA, 537 bp, Pseudomonas aeruginosa
tctattgcagcgaaggccagggcctgttgcgcgtgcgcgagggcgagacctggcgcgaataccgggtcggcagcggcgacctgctctggctgccgccgggcatggcccacgactacgccgtcgacgaccgccaaccctggaccatcttttggacccacctgcgcggcgacagcgccacctggctgcaacacagcgccggctaccgcgacaccccgctgcgccattggggcctgcaacacgccctgctcggcggcttcgagcaactgctggaggtgcgccacagcggctaccgcttccagcacttcctgctcgccgccagccgcctgcgcagcctgctctgccagctaccgctgctgcgcccgctgcgcgagggcagcttggacctcgacgggctgcacgcttacatgcgcgaacacctgcatgcgcgcctcgaactggaacgcctggcggccttctgcaacctgtcgaagttccatttcgtcagtcgctacaaggcgatcaccggccgtacgcctatccagcacttcctgcacctga

SEQ ID NO: 5460 - DNA, 1302 bp, Pseudomonas aeruginosa
aacagcgaacggcctgatccgcgctcaggcggcctggcgctccaggcgcccggtctgccaggcgagcagggtcgcgaccgcgccgcagacggcgatcaccagagtcatggggatcgccgtgccgtcgtggagcacgccgaccagcgccgaagcgcccgccgccacgctgaactgcaggctgcccatcagcgccgaggcgctgccggcgtgctgtccctgtccggccatggcgcaggcggaagcgttgggaatgatgcagccgaggctggccacgcatccgaacagcggaaccagcagcggccacagcgtggccggttgcagcgaagcgatgcccagcagggccaggccgcacgccaggtagccccagatgatccgccgcagccagaacgccggcccgcgatagcgcagcagccgcgcgttgacctgtgccatgacgatgaagcccgcggcattgctgccgaacagccagccatagtgctcggcgggaatcccgtagagctggatgaacacgtagggcgaaccggcgatgtaggcgaacatcccggccatcgccaccccgccggaaaggccataggcgagaaacaggcggtcggcgaacagccgccggtactgccccagcgcgccggaaagcggcggtcgctcgccgtcggccgggatggtttccggcagccacaacgccacgccgaggccggccagggcggcgaacagggtcaggcagacgaagatcgattgccagccctgccagtccagcagcaggccgccggccacgggggcgaggatcggcgccaggcccatcaccagcatcaactgggaaaacgccttggcggcgccgatcggatcgcacaggtcacgcaccactgcccgcgagatgaccatcccggcgcagccgccgagggcctggacgaagcgcgcggcgatcagccactccaggctcggcgccagggcgcaggcggccgaggccagggtgaagatactcacccccaccagcagcggcaggcgccggccatagcggtcggccaccgggccgtagagcaactggccgatggacaggccggcgaagtaggcggccaggctcagctggacgtgctcgacgtcggtggcgaaggccttggccagggtcgggaagctcggcaggtagaaatcgatggccagtggcccgaaggcgctcagggctcccagtatcagcaggatgcgcaggttcatggatcgctcggcacggggcgcgtcggtggcaggcaaggcacttccctgcgcggctcccggcaagcgggacgacgacgcctatcattgaatcgtctgtga

SEQ ID NO: 5461 - DNA, 585 bp, Pseudomonas aeruginosa
accctacaaagcacatggttaacatgttcaccttgttcttcacgaggtagaaccatgtccatccgccgctattccccgtcacagatcgccctgcactggctcagcgccgtcgcggtcctgctgatcatcgccctgccctacggcgccgacttcttcgccggcctgctcggcggcaagggcaacgtcttcaccctgcacaagtcgctgggcgtggcggtactcctgctgaccctgacacgcctggcgctgcgccgcgtccagggtgtcccggataccttggaggggaacccggactggcagcgcgcggccgccaaggccgggcatttcctgctgtacgcggtgctgatcgtcatgccgctctccggcatgctcgccggcaagcgtccgctggacctgttctggctggtgcagatcggcccgttcgacctgccggaagccttcaaggcgttcgccggcggcacccacgtcaccgtccagtacctgcttttcgcgctgatcctcggccacgccgccgcggccatctggcaccaccgcgtgcagaaggacgacgtactgcgcgccatgctgccgcaacgcggcgcctga

SEQ ID NO: 5462 - DNA, 522 bp, Pseudomonas aeruginosa
ccccagcgacggacgggcacgcggatgcccgtcccgacttgtcccgggccccggcttcggccaagcttttccttacgccccccgccgccgaggcccgccatgttccccatccttcgcccgctgctccataccgccgccatggcatgcgccctcccggcgctcgccgcggacccgcaaccggccagcggtggctgggcgcaacccgacccggcgccgatcggctatgcggtgctgaacgtttcccgcgagcgggtcgagtccggcactgcctgcgatgtcggcctgtacgtccacgacgaactggtcggcaacctgcaaccgggcgccagcctggccctgaacctgcaacccggcgcggtggacgtgcgtcttgcgccgaacggtcctggcgacgcctgccggaacggcatgaccatcctcgccggacagaccctgaccctgcgcgccggagagatccgcaacgtacgcattaccctcggtgcgggcgggctctacctggcaccggtggcggatgggtactga

SEQ ID NO: 5463 - DNA, 603 bp, Pseudomonas aeruginosa
gtcagtattttcttagctgcctatacggcagtgaacatgagcctcgacgagtacaacgacaagctcaatttcttagctgcctgtacggcagtgaacgtccagcagcagcggagtaagccctggctgcattttcttagctgcctgtacggcagtgaacgcccggagaactcaccggccagcgtgttcttctttcttagctgcctgtacggcagtgaacatggtgatggcggcggaacgggtggtggcacttttcttagctgcctgtacggcagtgaacgttcctgggcgacgtgttcgggtggccgtgattttcttagctgcctgtacggcagtgaacgagcgccgcgtcaaaatgatcatcgagacaaatttcttagctgcctgtacggcagtgaacatggcgagcgtgtgacgttctggacgggccgatttcttagctgcctgtacggcagtgaacgcgaattgatgctgttctccatgcttgttgcgtttcttagctgcctgtacggcagtgaactagccccgaaaacctataaccatttgaaggaaaaggaaataccgagtttttcctgccagaaaccctcttttttcgaggtctcgtaa

SEQ ID NO: 5464 - DNA, 636 bp, Pseudomonas aeruginosa
acaattttcacggctgcccgccataattacaagaacagacaagagaggccccatgaccaccgccgccccgaccccgtccctgttcggccaatgcctggccgagttcctcggcaccgccctcctcatcttcttcggcaccggttgcgtcgcggccctgaaggtcgccggcgccagcttcggcctgtgggaaatcagcatcatctggggggtcggcgtgagcatggcgatctacctcagcgccggcgtctccggcgcccacctgaacccggcggtgagcatcgcgctgtggctgttcgccggcttcgaggggcgcaagctgccgttctacatcaccgcccaggtggccggtgcgttctgcgccgcagcgctggtctacaccctctacagcagcctgttcatcgagttcgaacaggcgcagaacatcgtccgcggcagccaggacagcctggccctggcctcggtgttctccacctatccgcacccggcgctgtcggtcggccaggcgttcctcgtcgaagtggtgatcacggccatcctcatggcggtgatcatggcccttaccgacgacggcaacggcctgccgcgcggtccgttggcgccgctgctgatcggcctgctgatcgccgtgatcggtag

SEQ ID NO: 5465 - DNA, 1743 bp, Pseudomonas aeruginosa
ccacaaggccacagccatgaccgacaagcacaacaagaaatacgtcgtcgccctggaccagggcaccaccagctcccgcgccatcgtcttcgaccgcgatgccaacgtggtcagccaggcccagcgcgagttcgcccagttctatccgcaggccggctgggtcgagcacgacccgatggaaatctgggccacgcagagttcgaccctggtcgaggccctcgcccaggccagcatcgagcacgaccaggtggccgccatcggtatcaccaaccagcgcgagaccacggtggtctgggaccgtcacagcggtcggccgatccacaacgccatcgtctggcagtgccggcgcagcgcggcgatctgcgcgcagctcaagcgcgacgggctggaagactacatccgcgaaaccaccgggctggtcaccgatccgtacttctccgggaccaagctgaagtggatcctcgacaacgtcgaaggcgcccgcgaacgcgcgcgcaacggcgacctgttgttcggcaccatcgacacctggctgatctggaagctcaccgaaggcaaggtccacgtcaccgactacaccaatgcctcgcggaccatgctgttcaacatccacagcctcgactgggacgcacggatgctcgaggtgctcgacattccccgctcgatgctgcccgaggtgcgcaactcttcggaggtctacggcaacgcccggatcggcggggtcggcggcggcgaactgccgatcgccgggatcgccggcgaccagcaggccgccctgttcggccagatgtgcgtggaaccgggccaggcgaagaacacctacggcaccggctgcttcctgctgatgcacaccggcgacaaggcggtgaaatccacccatggcctgctcaccaccatcgcctgcggcccgcgcggcgaggtcggctacgccctggagggcgcggtgttcaacggcggctccacggtgcagtggttgcgcgacgaactgaaggtgatcaacgactccttcgattccgaatacttcgccaccaaggtcaaggacagcaacggcgtctacctggtaccggccttcaccggactcggcgcgccctattgggacccctatgcgcgcggcgcggtgttcggcctgacccgtggagtcaaggccgaccacctgatccgcgctaccctggaatccatcgcctaccagacccgcgacgtgctcgacgccatgcagcgcgatgccggcgaacgcctgcgcgccctgcgcgtcgacggcggggcggtggccaacaacttcctcatgcagttccaggccgacatcctcggcacccgcgtggaacgtccggtgatgcgcgagaccaccgccctcggcgccgcctacctggccggcctggcttgcggcttctggagcagcctcgacgagctgaagagcaaggcggtgatcgagcgggtgttcgagccggagtgcgacgagccccggcgcgaaaagctctatgccggctggaagaaagcggtggagcgcactcgcggctgggacgacggcgaactgtgacgagctggcgccattcgtccgccgcaatgcggcgaatggcgtgttcccgggcgccgctctggcatgccctgggtaacgtttgcgcgcggcggccgggtgccgccgcggcgccctctacgactcatgcacggctgacaacggccccccgcgtgcggcattcttggcgactttccagggtcccggcccggcagcacgagaacaacccatga

SEQ ID NO: 5466 - DNA, 1728 bp, Pseudomonas aeruginosa
gctattttcgaattcgaacaaaactacgttcactttcgacttcagggcctttcacatgagtcaagcgcacaccccctccgctccactcgccgaagtctacgatgtcgccgtggtcggcggtggcatcaacggtgtagggatcgccgccgacgcagccgggcgcggcctgtccgtgttcctttgcgaacagcacgacctggcccagcacacctcctcggccagcagcaagctgatccacggcggcctgcgctacctcgaacactacgaattccgcctggtccgcgaagccctggccgagcgcgaggtcctgctggccaaggcgccgcacatcgtcaagccgctgcgcttcgtcctgccgcaccgtccgcacctgcgcccagcctggatgatccgcgccggcctgttcctctacgatcacctcggcaagcgcgagaagctgcccgcctcgcgcggcctgcgcttcaccggcagcagcccgctgaaggccgagatccgccgtggcttcgagtactccgactgcgcggtggacgatgcgcgcctggtggtgctcaacgcgatctccgcccgcgagcacggcgcccacgtccatacccgcacccgctgcgtcagcgcccgtcgcagcaagggactctggcacctgcacctggagcgcagcgacggcagcctgtattcgatccgcgcccgcgccctggtgaacgccgccggcccctgggtggcgcgcttcatccaggacgacctgaaacagaagtcgccctacggtatccgcctgatccagggcagccacatcatcgtgccgaagctgtacgaaggcgagcacgcctacatcctgcagaacgaagaccgccgcatcgtcttcgccatcccctatctggaccgtttcaccatgatcggcaccaccgatcgcgagtaccagggcgacccggccaaggtggcgatcagcgaagaggaaaccgcctacctgctgcaagtggtgaacgcccatttcaagcagcaactcgcggccgccgacatcctgcacagcttcgccggcgtgcgtccgctgtgcgacgacgagtccgacgagccttcggcgatcacccgcgactacaccctgtcgctctccgccggcaacggcgagccgccgctgctctcggtgttcggcggcaagctgaccacctaccgcaagctggccgaatcggcgctgacgcagctccagccgtttttcgcccatcttgggcccggcttggaccgccaaggcaccgctgccgggcggcgagcagatgcagagcgtcgaggcgctcaccgagcaactggccaaccgctacgcctggctcgaccgcgaaatggcgctgcgctgggcgcgcacgtacggcacccgggtgtggcgcctgctggacggggtcaatggcgaagccgatctcggcgagcacctgggcggcggcctgtatgcccgcgaagtggactacctgtgcaagcacgagtgggcccaggacgccgaggacatcctctggcgccgcagcaagctcggcctgttcctctcgccgagccagcaggtgcgcctcggccagtacctgcagagcgagcatccgcatcgcccgcgggtgcatgcggcctgatcgccagccagaaacgtcgaggcccgcttttgcgggcctcgttcgttatggaagggtacgggacgatccgggcataatgcgcgacgccaccaagccggtggcgccgccgcagtcgagaatcccgtggacctga

SEQ ID NO: 5467 - DNA, 648 bp, Pseudomonas aeruginosa
atcgactccatcaccggcaggctgacgtccaacccgaccaggtcgaacagctcgaacgggcccatgcggaagccggcgccctcgcgcaggacttcgtcgatcgccgccaccggcgccacgccctcgccgaggatacgcagcgcctcggtgccgaaggcccgtccggcatggttgacgatgaagccggggctgtccgtggcacgcaccgcctggtggccgaaggtcgccaccagggcgcacagtcgctcggcgatgccggtgcgggtggcgagaccctcgatcacctccaccagacgcatcagcggcaccggattgaagaagtgcagaccggcgacccggccgggatcgcgacaggccgaggcgatcgcggtaaccgacagcgaggaggtattgctggcgaggatcgcttcgtcgccgaccacctcttccaattggcggaacaacgcctgcttggcctccaggttctcgacgatcgcctcgatcaccaactggcagccgcgtaagacccgcaagtcctcgaccacccgcagattgcccatcgcgagcgcggcagcctccgcctccagccggcctcgctccacctgccgggcaaggaccgtggcgatctgctcgcgtgcttgcagtgccgcaccctggcggctgtcgtag

SEQ ID NO: 5468 - DNA, 1599 bp, Pseudomonas aeruginosa
gtactgccgggcggttcagtcgcaacagggccacgccctgctccggccgctccagcagcacgagttcggggctcaccgccccaggggaggaatccatggccatctccaattgcccggggattgagttgcacggcgcaggccgtgccgtgcggggtttcaggcgcggacgatgccgcgccggaccagcgcgtcgatcgcctcggcgctcaatcccagttccgccaggacttcccgagtgtctccgcccagcaccggcggcgcggcgcggtagctggccggggtgcgcgaaagcttcaccggcgaggcgatgccgcgatagccctcgagttcgacgaccatcccgcgatggcgggtgtgcgggtgctccaccacccgatccaccgtggcgatggctccgcagggcacgccgagacggatcagccgctcggccagctcacggccgtcgtgggccgccaggtagtcctccagggcgcgcttcagcgcctcgcggttgaccgagcgcttgccgttgtcggcgaagcgcgggtcccccggcagttcatcggctcccaggtactcacacaggcgggcgaactggcggtcgttgccgacggcgaggaagatcggctcggtaccggtgcggtagctgtcgtagggcgcgatgttcgggtgggcgttgccgctacgccggggcgtacgtccggaagcgaagtagttcggcaggtgcgggtgcagcagggagataccgcagtcgtacagggcgatgtccaccgactgcccgcgcccgctgacctggcgctcgtggagggcgaggaggatgccggccatggcgttcagcccggtgaccatgtcgacgatcggcaggccgatgcgcaacgcctcgccgccggcctcgccgttcacgctcatcagtccggccatcgcctggatcgccgcgtcgtagccgggcaggccgccgagcgggccgtgggcgccgaagcccgataccgcgcagtggaccagccgcgggaagcgctggcgaagcacctcctcgtagccgatcccccagcgcgccagggtgccgggcttgaagttctccagcagtacgtcagcgtcctccagcaagcgcagcagcagctcgatgccctccgccgtcgccaggtcgacggcgatgcccttcttgttgcggttcacgcccttgaagtaggacgccgtgtcgccctcgaagggcggcccccagccacgggtctcgtcgccgccgaggggttccagcttgatcacctcggcgccgtggtcggccagcgcctgggagcagtagggtccgccgaggacccggctgagatcgatgattttcaggccacgcagggcgcccgtctgattggtcatggcgactctctggttgttgtgagcgggaatgcgggcagtcaggccggcagcaattgcatggcttcggcctggctcagcggcacctcgccgaccaccctggccagcagttcggcctggtcggtccagccctccaggcgcagcgggtcgcgcggcagcagcttgtgccgggcgaccaggaaggccagggccaggcggcgctggtcgggtgcctggcggctggcctcccaggccatgaagatcgccgtgcacaggtga

SEQ ID NO: 5469 - DNA, 1542 bp, Pseudomonas aeruginosa
actccgaggcacccgggtcaacaccgacgcacgctctccctccacggaaaccagcgtttccgccccgcctttcagcgaagggcggtagggcgcggcgtgtcggcgagaacaacaataaacaggactcgacccatgccgcgcacgccctctcccgaagacgccgacctgcacaagaaggcccgcagggccggtatcgcctccttcatcggcaccaccatcgagtggtacgacttctacatctacggtctggccgccgccctggtgttcggcaaggtattcttccccgccgacatggatccgggcctggccaccctgctgtccttcgtcaccctctggtcgggcttcatcgctcgcccgctgggcgggatcatcttcggccatctcggcgaccgcatcggccgcaagaccaccctggtgatcaccctgatcatgatgggcatcgccacgacctgcatcggcctgttgccggtctatacgcagatcggcatctgggcgccgatctccctggtggcgctgcgtatcgtccagggcatcgcggtcggcggcgagtggggcggcgcgatcctgatcgccagcgaaagcgcgcccaagggcaaaggcatcctgtacgccgccttcgcccagcagggctcgcccaccggcaacctgctggcgaccctggcgttcttcgccctcagcgccctgcccgcctcggacttcattctctggggctggcgcgcgccgttcctgctctccgcagtgctggtcatcgtcggcatggtgatccgcctgaagctggaggagtcggaagacatgaagcgcgtgctggcgcagaagcgcacggtgaagctgccgctcgccgaggtgctgggcaagcactggaagatcgtcctgctcggcgccggcgtgctgccgatcatccacgtcacctacttcaagagcaccttcgccctctcctgggcgaccaagaccctcggctacagccagggcaccttcctcagcatcatcgtggtcgcgctggtggtgcagttcctcagccagccactgggggcgctgctcacttcgcgcatcgacatgcgcaaggcggcatgcctgatggtgctgccggagtttatcctgatgccggcgatgttcttcgccgtggaaaccaaggtctactggatcgccgcggtcggcatgtgcctggccacggtgccgcacgcgatgttctacggcgcggtgggcggtatcctcgcccgagccttcccggcgcgggtgcgctacaccggcctgtcgctggcctaccagctctgctcgctgctggtcggcggcggtacaccggtactggcccagtggattctcaacagtaccggtagcatcgtcggcgtggccctggcctcggcctgctacgcgctggtctcgctggcctgtaccctggccctgttgcggatcaccgggttccacgccagcgacctgtcgaccgccgagcgcgccgacgccgaggacttgcagcggcccgcagcggtcgagcgggaaccggtgttgcgcgcccccgcccggcttctgggcggcgatcccggctag

SEQ ID NO: 5470 - DNA, 456 bp, Pseudomonas aeruginosa
aatccagatcaacgtccagctctccggcgaacgcaccctctgcctgtcgctcggctcgcggcgccgcttcacccccgagcaactcgccgtgctcggcctggtgcggccctgggtggccgggctgatgcgccagcgcctggccttcgaggacgaagtgttgaacagccccgcggcgccggagccgggctggcagggttcgctggagaaggtcgcggagcagatgggcacgccgctgacggcgcgcgaactggaggtcggcaggctgatgctcagcggctgctcgagcaaggagatcgcccgcaagctggcgatctcggcggaaaccgtgaaggtccaccgcaagcacatgtacggcaagctcggcatcaagtcgcagtccgagctgttcggcctgttcctccaggcccagggctgacgggacgggcgaccgtcccgtcgccgctcagcggcgcttga

SEQ ID NO: 5471 - DNA, 588 bp, Pseudomonas aeruginosa
tcgccggcgtggaatatgttccggcccatgttctcgaggaccggccgggcccgcgcgaagccttcggcggggccgccgacgatgaagctcagggtgccggcgcgggcgccgccgacgccgccggaaaccggcgcgtcgagcagggtcaggcccttcgccgcggcggcctcggcgaccttgcgcgcggtctccggggcgatggtcgagcagtcgatcagcaggggcttgccggcgacccgcgcgagcaggccgtcgtcgccgagatacaggctttccacgtgctgcccggccggcagcatgctgatcaccacttcggcgccttcgcagcactgcaaggcgctatcggcgccctgcgcgccctgctcgaccaggctcagcacggccttgggctgcaagtcgaagacattcacccggtggccagccttgagcaggttggcggccatcggcccacccatgttgcccaggccgaggaatgcgatgtcggtcatcggtccgtctccctttcagcgcatctggatcgagaagttggtcccggccacgctatcgctgtcgaaccagcgcgcggtcacggtcttggtctcggtgtag

SEQ ID NO: 5472 - DNA, 255 bp, Pseudomonas aeruginosa
ctggcgccgctgtcgtcccatgggccggggcggaccttggccagtgcgtcgcggatttccggaatccactcgcgggcggcccccaccagcaccgccaccgagatcgccatgcagcgctgcccggccgcgcccaccgaggcaccgaccaggttgctgatgacctgtgccttgtccgcgtcgggcatgatcaccatgtggttcttcgccccggcgaagctctgcacgcgcttattgtgcgcggtgccggtgtggtag

SEQ ID NO: 5473 - DNA, 594 bp, Pseudomonas aeruginosa
cgagcacctgctgatctattgcagcgaaggccagggcctgttgcgcgtgcgcgagggcgagacctggcgcgaataccgggtcggcagcggcgacctgctctggctgccgccgggcatggcccacgactacgccgtcgacgaccgccaaccctggaccatcttttggacccacctgcgcggcgacagcgccacctggctgcaacacagcgccggctaccgcgacaccccgctgcgccattggggcctgcaacacgccctgctcggcggcttcgagcaactgctggaggtgcgccacagcggctaccgcttccagcacttcctgctcgccgccagccgcctgcgcagcctgctctgccagctaccgctgctgcgcccgctgcgcgagggcagcttggacctcgacgggctgcacgcttacatgcgcgaacacctgcatgcgcgcctcgaactggaacgcctggcggccttctgcaacctgtcgaagttccatttcgtcagtcgctacaaggcgatcaccggccgtacgcctatccagcacttcctgcacctgaagatcgagtacgcctgccagttgctggacagcagcgaccatag

SEQ ID NO: 5474 - DNA, 435 bp, Pseudomonas aeruginosa
gcgagaaacaggcggtcggcgaacagccgccggtactgccccagcgcgccggaaagcggcggtcgctcgccgtcggccgggatggtttccggcagccacaacgccacgccgaggccggccagggcggcgaacagggtcaggcagacgaagatcgattgccagccctgccagtccagcagcaggccgccggccacgggggcgaggatcggcgccaggcccatcaccagcatcaactgggaaaacgccttggcggcgccgatcggatcgcacaggtcacgcaccactgcccgcgagatgaccatcccggcgcagccgccgagggcctggacgaagcgcgcggcgatcagccactccaggctcggcgccagggcgcaggcggccgaggccagggtgaagatactcacccccaccagcagcggcaggcgccggccatag

SEQ ID NO: 5475 - DNA, 183 bp, Pseudomonas aeruginosa
gtgttccaccacctgcggcccgcgtccttccgccctcaaaaacagagggcagtgccgttcgtcctgtccctgcgggatggatttgccggcccctccatcatcctcctactgggtttttatccaattcccgggcttctgagagagcctacggaaatgtccgggggagctgtccggcgtttctag

SEQ ID NO: 5476 - DNA, 957 bp, Pseudomonas aeruginosa
ccgcgagcggttattcaccctacggatcagggcttcagtatgtggaggtctggcatgcacgaggtcatccccctcctgaagcgcccctcagcccaatcgaatccttccgctcgccaccagcaccgcatgcccggcgatactcacccgctcgccctccaaccggcaccacagctcgccgccgcgcgccgagcactgctgggcggtcagcgacagtttgttcaagcgctgggcccagtagggaatcaggctgcaatgcgcggagccggtgaccgggtcttcgtcgacgcccatcgccggggcgaagaagcgcgagacgaaatccttctgcaggccccgcgcggtgacgatcactccacgccagggcagccgcgccagggccgcgaagtcggggcgacaggcgcgcaccgcctcttcggactcgagcagcaccagcagcttgtcggtggagcccagcacgtccaccggcggcaggcccagggcctgctccagctcgacggtgctaccgacctcgctcggatactgcgcggggaaatccaggaccagccgctcgtcctcgcggttgacccgcagcgcaccggagcgcgagatgaattccaggcgctcgcccggctcgtcgtagacctcgaacagtacgtgggccgcagccagtgtggcgtggccgcagagcgccatctcgacgctcggggtgaaccagcggatccgccaggcctctccttcgcgaacgacgaaggcggtctcggagaggttgtgctcggtcgcgatcatctgcatcagctcgtccgccagccaggcgtcgaggcgatagaccacggcgggattgccactgaacgggcgggaagaaaacgcgtcgacctggtggaactcgagctgcatggcagacctcctgggaacgatcgccacagcatgccgccgcaggctccgggatgggcgatacagtgcgatcttttccgatcgtaa

SEQ ID NO: 5477 - DNA, 1641 bp, Pseudomonas aeruginosa
cagtgggacttcgccctgccttcgacccattgcccgagcgggcgtttgcggcgacctgccggcgttgtgaagccgccggcaaaaacgccgcctttttccgcgaaacgccgctcaggcctcgctgcgcacccgtcgcaccgcgttctgccagccggcgtagagttcgccgcggcgctcctcggccatgtgcgcggcgaagcggcgctgcaggtgccagtggctggcgatgtcgtccaggtcgcgatagaagccggccttcagcccggccatgtaggccacgccgagggcggtggtctcggtgacttccgggcgctccacggtgacaccaaggatgtcggtgaggaattgcatcacccagttgttcaccaccatcccgccgtccacccgcagcgcgctgggcggcgtgccgtcctggcgcatcgcttcgagcaggtcgcgggtctggtagcagaccgattgcagaccggcggtgacgatctccttgattccggtgtcacgggtcaggccgaagatcgcgccgcgcgccttcgggtcccagtagggcgcgccgaggccggtaaaggccggcaccaggtagacgccgttggagtcgccggcctggatcgccagggcttcgctctcgtgggcgtggtcgatcagcttgatgccgtcgcgcagccattgcaccgcggcgccggcgacgaagatgctgccctccaccgcgtagctgaccttgccgtccagacggtagccgaccgtggtgagcaggcggttcttcgaggtcaccggctgctcgccggtgttctggatcatgaagcagccggtgccgtaggtgctcttcaccatgcccggctggaagcaggcctggccgatcagcgcggcctgctggtcgccggccatgcccagcaccgggatcgccgcgccaagcagcgacggctcgctgacgccgaactccgccgcgcagtcgagtacctccggcagcaggctgcgcgggatctcgaacagcgccagcaattcctcgtcccagtcctggctgtggatgttgaacagcagggtgcgcgaagcgttggtcgcgtcggtgcgatgggagcggccgccggtcaggcgccagagcaggaagcagtcgacggtgccgaagcgcagctcgccgcgttcggcgcgctggcgggcgccgggcacgttgtcgaggatccagcgcagcttggtggcggagaaatacggatcgatcagcagcccggtgcgcgcgctgacattggcctcgtggccggcggccttgagttcggcacagtagtcggcggtacgacgatcctgccagacgatggccgggtggatcaggtcgccgctggcggcgtcccagaccagcgtggtctcgcgctggttggtgatgccgatggcggcgatgtcggccgcgcgcaagcccttgcgggcgagcgcgtcgcgacagacctggagggtggtcagccagatttcctcgccgtcgtgctccacccagccgtccttcgggaagtactgcttgaattcctgctggcagctcgccaccggcaagccctgggcactgaacacgatggcgcgggagctggtggtgccctggtcgatggcgaggagatagtgggacatggaaaacctgacagattgaaaagtaagacgaatgccgaccgctag

SEQ ID NO: 5478 - DNA, 537 bp, Pseudomonas aeruginosa
gccggcgggattagcggctcattcacggccgatggcggcgaacgaaccctgggtcagctgggccagcacctcggccgccagctccacttccagcccgcgccgtcctgcgctgacatggatgctcgggtactgccgcgcgctttcatcgatgaaggtacgcaggcgcttcttctgccccagcgggctgatcccgcccaccaggtagccggtagcccgctgcgccgcctgcggatcggccatgtcggccttcttcgcccccgccgcatgggccagggccttcaggtcgagactgccgatcaccggcaccaccgccaccagcaactcgcccttctccgtggcggcgagcagcgtcttgaacacccgctgcgggtccaggccgagcttttccgcggcctccaggccataggaaggtgccttggggtcgtggctgtagctgagcaccttgtgcgcggcgcgggcctttttcagcaggtcgatggcaggggtcatggtcactcccggagaagaacgttggctgaaaaccggcgcataccttaa

SEQ ID NO: 5479 - DNA, 912 bp, Pseudomonas aeruginosa
atatattttttcgaaactgaacaattttcacggctgcccgccataattacaagaacagacaagagaggccccatgaccaccgccgccccgaccccgtccctgttcggccaatgcctggccgagttcctcggcaccgccctcctcatcttcttcggcaccggttgcgtcgcggccctgaaggtcgccggcgccagcttcggcctgtgggaaatcagcatcatctggggggtcggcgtgagcatggcgatctacctcagcgccggcgtctccggcgcccacctgaacccggcggtgagcatcgcgctgtggctgttcgccggcttcgaggggcgcaagctgccgttctacatcaccgcccaggtggccggtgcgttctgcgccgcagcgctggtctacaccctctacagcagcctgttcatcgagttcgaacaggcgcagaacatcgtccgcggcagccaggacagcctggccctggcctcggtgttctccacctatccgcacccggcgctgtcggtcggccaggcgttcctcgtcgaagtggtgatcacggccatcctcatggcggtgatcatggcccttaccgacgacggcaacggcctgccgcgcggtccgttggcgccgctgctgatcggcctgctgatcgccgtgatcggtagcgccatgggcccgctgaccggtttcgcgatgaacccggcgcgcgacttcggccccaagctgatgacctacctggccggctgggggcccatcgccttcaccggcggccgcgagattccctatttcctggtgccgatcttcgccccgatcctcggtgcctgcctcggcgccggcggctatcgtgtactgatcgcgcgccatctgccgagcgccgcggcgcccgccgaagccgagccggagaaggttcgcgcttcctga

SEQ ID NO: 5480 - DNA, 1557 bp, Pseudomonas aeruginosa
ccgcccgctctttcctgccatagccacaaggccacagccatgaccgacaagcacaacaagaaatacgtcgtcgccctggaccagggcaccaccagctcccgcgccatcgtcttcgaccgcgatgccaacgtggtcagccaggcccagcgcgagttcgcccagttctatccgcaggccggctgggtcgagcacgacccgatggaaatctgggccacgcagagttcgaccctggtcgaggccctcgcccaggccagcatcgagcacgaccaggtggccgccatcggtatcaccaaccagcgcgagaccacggtggtctgggaccgtcacagcggtcggccgatccacaacgccatcgtctggcagtgccggcgcagcgcggcgatctgcgcgcagctcaagcgcgacgggctggaagactacatccgcgaaaccaccgggctggtcaccgatccgtacttctccgggaccaagctgaagtggatcctcgacaacgtcgaaggcgcccgcgaacgcgcgcgcaacggcgacctgttgttcggcaccatcgacacctggctgatctggaagctcaccgaaggcaaggtccacgtcaccgactacaccaatgcctcgcggaccatgctgttcaacatccacagcctcgactgggacgcacggatgctcgaggtgctcgacattccccgctcgatgctgcccgaggtgcgcaactcttcggaggtctacggcaacgcccggatcggcggggtcggcggcggcgaactgccgatcgccgggatcgccggcgaccagcaggccgccctgttcggccagatgtgcgtggaaccgggccaggcgaagaacacctacggcaccggctgcttcctgctgatgcacaccggcgacaaggcggtgaaatccacccatggcctgctcaccaccatcgcctgcggcccgcgcggcgaggtcggctacgccctggagggcgcggtgttcaacggcggctccacggtgcagtggttgcgcgacgaactgaaggtgatcaacgactccttcgattccgaatacttcgccaccaaggtcaaggacagcaacggcgtctacctggtaccggccttcaccggactcggcgcgccctattgggacccctatgcgcgcggcgcggtgttcggcctgacccgtggagtcaaggccgaccacctgatccgcgctaccctggaatccatcgcctaccagacccgcgacgtgctcgacgccatgcagcgcgatgccggcgaacgcctgcgcgccctgcgcgtcgacggcggggcggtggccaacaacttcctcatgcagttccaggccgacatcctcggcacccgcgtggaacgtccggtgatgcgcgagaccaccgccctcggcgccgcctacctggccggcctggcttgcggcttctggagcagcctcgacgagctgaagagcaaggcggtgatcgagcgggtgttcgagccggagtgcgacgagccccggcgcgaaaagctctatgccggctggaagaaagcggtggagcgcactcgcggctgggacgacggcgaactgtga

SEQ ID NO: 5481 - DNA, 681 bp, Pseudomonas aeruginosa
cgagaagcagcgcatcgccgaagccgtggccagcctggtgccggacaacgcctcgctgttcatcaacatgggcaccaccaccgaggccatcgcccgcgcctggttcaaccaccgcaatctgaagatcatcaccaacaacctgcacgtggccgccaccctcagcgccaaggaagacttcgaagtgctggtcgccggcggcaccgtacgcagcgacggcggcatcgtcggccaggccgcggtggatttcatccagcagttccgcgtcgacttcgccctggtcggcatcagcggcatcgacgaggatggcagcctgctcgacttcgactaccaggaagtgcgcgtatcccaggcgatcatcgacaacgcgcggcaagtgttcctggccgccgactcgagcaagttcgggcgcaacgcggtggtccgcctgggaccgatctcgctggtcaaccgggtcatcagcgacagcccgccgcccgccgccatcgcccgcctgatggcacagcacaaggttcacctggacctggtctgaggcatttcccctgccacggcgccgttcggcgccgtgaatgttcgtttcagaaaagccacctgccgacccctgcccatgcgccacgaccctcggcggccgctttcccgcatgcggaagaggggcggttcccgcgcggacgggcaaaccggtag

SEQ ID NO: 5482 - DNA, 1743 bp, Pseudomonas aeruginosa
cgcccgggcaccccttcgaaattgaaaaagcctggtgaatcgggctggtcaataactgcgcaatcgactaagctattttcgaattcgaacaaaactacgttcactttcgacttcagggcctttcacatgagtcaagcgcacaccccctccgctccactcgccgaagtctacgatgtcgccgtggtcggcggtggcatcaacggtgtagggatcgccgccgacgcagccgggcgcggcctgtccgtgttcctttgcgaacagcacgacctggcccagcacacctcctcggccagcagcaagctgatccacggcggcctgcgctacctcgaacactacgaattccgcctggtccgcgaagccctggccgagcgcgaggtcctgctggccaaggcgccgcacatcgtcaagccgctgcgcttcgtcctgccgcaccgtccgcacctgcgcccagcctggatgatccgcgccggcctgttcctctacgatcacctcggcaagcgcgagaagctgcccgcctcgcgcggcctgcgcttcaccggcagcagcccgctgaaggccgagatccgccgtggcttcgagtactccgactgcgcggtggacgatgcgcgcctggtggtgctcaacgcgatctccgcccgcgagcacggcgcccacgtccatacccgcacccgctgcgtcagcgcccgtcgcagcaagggactctggcacctgcacctggagcgcagcgacggcagcctgtattcgatccgcgcccgcgccctggtgaacgccgccggcccctgggtggcgcgcttcatccaggacgacctgaaacagaagtcgccctacggtatccgcctgatccagggcagccacatcatcgtgccgaagctgtacgaaggcgagcacgcctacatcctgcagaacgaagaccgccgcatcgtcttcgccatcccctatctggaccgtttcaccatgatcggcaccaccgatcgcgagtaccagggcgacccggccaaggtggcgatcagcgaagaggaaaccgcctacctgctgcaagtggtgaacgcccatttcaagcagcaactcgcggccgccgacatcctgcacagcttcgccggcgtgcgtccgctgtgcgacgacgagtccgacgagccttcggcgatcacccgcgactacaccctgtcgctctccgccggcaacggcgagccgccgctgctctcggtgttcggcggcaagctgaccacctaccgcaagctggccgaatcggcgctgacgcagctccagccgtttttcgcccatcttgggcccggcttggaccgccaaggcaccgctgccgggcggcgagcagatgcagagcgtcgaggcgctcaccgagcaactggccaaccgctacgcctggctcgaccgcgaaatggcgctgcgctgggcgcgcacgtacggcacccgggtgtggcgcctgctggacggggtcaatggcgaagccgatctcggcgagcacctgggcggcggcctgtatgcccgcgaagtggactacctgtgcaagcacgagtgggcccaggacgccgaggacatcctctggcgccgcagcaagctcggcctgttcctctcgccgagccagcaggtgcgcctcggccagtacctgcagagcgagcatccgcatcgcccgcgggtgcatgcggcctgatcgccagccagaaacgtcgaggcccgcttttgcgggcctcgttcgttatggaagggtacgggacgatccgggcataa

SEQ ID NO: 5483 - DNA, 204 bp, Pseudomonas aeruginosa
gccaggcgcacgtcgcccagttcgaccgtctcggtaggtacgcgtgcgtcgcaacgcgccgccgcaaaggaggagaggctgcacaacaaggcggccaggaagatgaaagcacgcatgaagaaaacccagaacgcagaaccccagtggagcgcgattctgattaaatttcgtccagcgcgctgccacagtagcgtgacagtttga

SEQ ID NO: 5484 - DNA, 975 bp, Pseudomonas aeruginosa
gacaaactcaacgaatccgcaccgctatcaagttttgctcatacagaggccgccatgctcgaacttcgccacctcaagaccctgcacgcgctgcgcgaagccgacagcctggtggaagccgccgagcgcctgcaccttacccagtcggcgctgtcgcaccagttcaaggaactggaagagcgcctgggcatgcagttgttcgtgcgcaagaccaagccggtacgcttcaccagcgccgggctgcgcctgctgcaactggccgactcgctgctgccccagctgcgcaccgccgagcgcgacctggcgcggctcgccggcggtaccgccggacgcctgcacatggccatcgaatgccacagttgcttccagtggctgatgccgaccatcgaccagttccgcgacgcctggccggaagtcgaactggacctggcctcgggcttctccttcgcgccgctgccggccctggcccgcggcgacctcgacctggtggtgaccgccgacccgatcgagttgcccggcatcacctacgtgccactgttcacctacgaagcgctgctggcggtggccaaccagcatgccctggctggtcgaccgtacgtcgtcccggaggacctggagcgggaaaccctgatcacctatccggtggaacgcgatcgtctcgacgtcttcacccgcttcctcgaccccgccgacgtggagccggcgcaggtgcgcatagccgagctgaccgtgatgatgatgcagctggtggcctccggtcgcggcgtctgctgcctgccgaactgggccctgcacgagtacagctcgcgcggctacgtgacggcccggcgcctcggtgaaaagggcctgtactgcacgctcttcgccgccatccgcacggacatgttcgatgcgccattcatgcgcgacttcctgctcaccgccaaggacacctccttcgccaccctcgaaggggtcagcgccgccaagggctga

SEQ ID NO: 5485 - DNA, 1497 bp, Pseudomonas aeruginosa
aagttgcgcaaggccaggctggcccgcgagtcttcgaggaagccctcggccaaggcgggaacgctatcgccggcaaggatcggcagcaggaaaaacgcgcatttcttgttgttgttcatacgcactccgaacgggcgcctgggcgcctctttttctagggggaacggtgtctcatcggcagcgctcgatcaccatcgccacgccctggccgagcccgacgcacaggctgaccaccgcgtagcgccgctcgatgcgttgcagcccgcgggcggcggtgagcaccaggcgcgcaccggaggcgccgagcggatggccgagggcaatggcgccgccatggggattgacccgcgggtcctcgtagtccaggccgagcaacttcaggcaggccaggacctgcggcgcgaaggcttcgttgatctcgatcaggccgacctcgtccaggtcgatgccggcgcgttgcagcgcgcggaggatcgcctgctgcgggccgatgcccatcaaccggggctccacgccgacgctggcgctggcgaggatccgcgccagcggccggatgccctcgcgctcgccgatcgcgcgatcgcccagcagcactaccgccgccccgtcgttgatccccgacgcattaccggcggtcactaccccaccggcgaacaacgccggcaagcgtgccagggccgccaggtcggcctgcggtcgcggatgctcgtcgcgctccaccagccgcgtctcgcccttgcgtccggcgcgcacctccaccggaaggatctcgccgaggaaaaagccctcctccagcgcagcctggtagcgcgcctgggaagaagcggcgaaacggtcggcatcctcgcgatcgatgccgaaggcgcgggccacgttgtcgccggtctccggcatgctgtcgttgccatagcgctcgaccagcctggggttggcgaagcgcgcgccgatggtgctgtcgaagacctccagcgtgcggctgaaggcgctctccgccttggccatgacgaacggcgcccgggacatgctttcggcgccgccggccaggtacagccggccctcgccgcaactgatcgcgcgcgccgcgtcgatcaccgccgacagtccgctggcacacaagcggttgaccgtctgcccgggcagccgcgccggcaggccggctgcgagcagcgcgttgcgcgccaggttgcggctgtcttcgccggcctggttggtacaaccgaggatcacatcctccaggtcgtcgacagcgaacccggaggtttccgcgagacgcgccagcagcaggccggccaggtcgtccggacgcaccgtcgagagtgcaccggcatgccggccgaaaggcgtacgcaggccggcgtagatataggcatcgagcatggtgtgtttctccgccaagggatcaggaggccaacgggctgtccggctggcgcagggaaaggcccagttgggcgcgccggcgcagccagggactggggcgatagcgcgggtcgccgctga

SEQ ID NO: 5486 - DNA, 354 bp, Pseudomonas aeruginosa
ccgacagcgaggaggtattgctggcgaggatcgcttcgtcgccgaccacctcttccaattggcggaacaacgcctgcttggcctccaggttctcgacgatcgcctcgatcaccaactggcagccgcgtaagacccgcaagtcctcgaccacccgcagattgcccatcgcgagcgcggcagcctccgcctccagccggcctcgctccacctgccgggcaaggaccgtggcgatctgctcgcgtgcttgcagtgccgcaccctggcggctgtcgtagagcagcaccgacagcccggcacaggcagcgagctgggcgatgccctggcccatggcgccggtaccgacgataccgatga

SEQ ID NO: 5487 - DNA, 843 bp, Pseudomonas aeruginosa
gaacgattggtggctcgctcattttcccaggtactccgctgtgcgtttttccaggaaggcacgcatgccctccttctggtcgtggctgtcgaacagcaactggaaggccttgcgctccagcgccagggcctggtccagcggcaggtcggcgccggccaggaccacttccttgatctgcgccagcgccagcggcggcaggccggcgatctggcgagccagttcgagggcgcgatccaatgcctggccatccgccgccacctcgctgaccaaccctatggccagggcctccggcgcccgtaccgtgcaaccggtaaacagcatgcgcagcgcctggaacttgcccaccgctcgcaccaggcgctgggtgccgccggcgccgggcatcacgccgacacggatttccggctgggcgaagcgcgccgaggcaccggcgacgatcaggtcgcagtgcatcgccaactcgcagcctccgcccagggcatggccctccacggcggcgatcagcggcttgcggcaggcggcgagggcctgccagtggcgctccaccccgcgctgctggatctccagcgcggacgcctccgccagttcgttgagatcggcgccggcggcgaacgccgtgccatttccggtgaggacgatgacccgggtatcggcgcactcgtcgaggcgccgtacgtgctccgccagagcctcgcgcaggcgcatgttcagggcgttgagtactgccgggcggttcagtcgcaacagggccacgccctgctccggccgctccagcagcacgagttcggggctcaccgccccaggggaggaatccatggccatctccaattgcccggggattga

SEQ ID NO: 5488 - DNA, 903 bp, Pseudomonas aeruginosa
aaccaggtgcctgccatggatctcagacagcttcgctacttcatcgcggtcgccgaggaactgcatttcggtcgcgccgcggctcgcctgttcatctcccagccggcgctgagcttcgacatcaagaagctggaggaacagctcggaacccaattgctgctgcgcaacaacaagtcggtgaagctcaccggcgccggccaggtcctgctggtggaagcgcgcaacctgctgctgcaggcagagaaggtgaaacgcctgacccagctatccgccgagggcgacgtcggccaactgcgcgtcggcttcgtcaactccatgctctaccgcggcctgcccagggccatgtcccgcttcgaacgggagcacccgaacatggaggtggtgctcggcgaaatgaacagcgcggagcaggcccaggcgttgcagcgcgggcagatcgacctgggcttcgtgcactggggcaggctgccggcggaaatcgtctccgaacccttgatcagcgacccgttcctctgctgcctgcccgccgggcaccgcctggctggccaggcgcgtctggacctcgccgaactgcgcgacgaagacttcatcctcttcccgcgccatgtctccccgcactaccacgacctgatcatcgcccgctgcgtggacgccggcttcagcccgcgcatccgccacgaggcgcgcctgtggcagaccgtcgccgccatggtcggtctcggcatgggcgtcgcgctgatcccggagaccctctgcctggcctggcggaacgaggtgcgctacctggaaatcgagccggccggcgcgcgttcggagatccacgcgatccttccggccagcgaaccttcccgggcggcgcaggcgttcctggcgacgctgaagagcggcctggacgacgcctga

SEQ ID NO: 5489 - DNA, 483 bp, Pseudomonas aeruginosa
cgccagcaaggccaccacaccgcacaggacgatgctgttcgccggcgtctcgaagcgcttgccgagacgaccgaagaacggccgcggaaggacgccgtcgcggcccatggcgaagagcaggcgcgaggcgctggcctgggccgagagaccggaggtgaactggccgacgatcaggccgaccaggaagaaggtcacgaacaggtcgccaccgatgttgcgggcgatctcgtaggccgccgagtccgcgctgtcgaaggcgaacgacgggtgcgccagttgcacgaagtacgaggtgacgatgaagatcaacccgcccagcagggtgatcagcaggatcgctcgcgggatgttgcgccgcgggtcgcgggtttcctcggtcagggtactgaccgcgtcgaaaccgaggaacgagtagcaggcgatcgccgcaccgctcatcaccagcggcacctgcaggtcgccaccgagcaacggttgcagtga

SEQ ID NO: 5490 - DNA, 789 bp, Pseudomonas aeruginosa
aagatgagtttcaccttgcaggacatcgcctggcaccgctccgtcgggcaactggtcgaggcgctggatgcgccggacttctggattcgcctggtacgcctgctcgaacagtacgttccgttcgacagctgggtggccctgctgttcagccagggccggccacaggtgttcgccgaatgcccgggcgccgacggcgggccggatccgctgttccaggactacctgcgaggcctctacctgctcgacccgttctacatcgccagccgcgagaacccgtgcagcggcctgttccgtctggccgacgtggcaccggaatgcttcgagcagaccgattactaccagcgttacttccgcctcaacgtggtggccgatgaaatccagatcaacgtccagctctccggcgaacgcaccctctgcctgtcgctcggctcgcggcgccgcttcacccccgagcaactcgccgtgctcggcctggtgcggccctgggtggccgggctgatgcgccagcgcctggccttcgaggacgaagtgttgaacagccccgcggcgccggagccgggctggcagggttcgctggagaaggtcgcggagcagatgggcacgccgctgacggcgcgcgaactggaggtcggcaggctgatgctcagcggctgctcgagcaaggagatcgcccgcaagctggcgatctcggcggaaaccgtgaaggtccaccgcaagcacatgtacggcaagctcggcatcaagtcgcagtccgagctgttcggcctgttcctccaggcccagggctga

SEQ ID NO: 5491 - DNA, 936 bp, Pseudomonas aeruginosa
attgtgttgttcatggactatattgcggagccggctaccgacatgtcgcacacctccgactggcccctgccggccgacagcctgcgcttgccgatcccggcggcgctgctggagaaactggcggtccacccgctcagccgcgacctctaccccacctccctgggccactaccggcgcgcccgcgaccaccgcatgagccgcgagcgccatgacgagcacctgctgatctattgcagcgaaggccagggcctgttgcgcgtgcgcgagggcgagacctggcgcgaataccgggtcggcagcggcgacctgctctggctgccgccgggcatggcccacgactacgccgtcgacgaccgccaaccctggaccatcttttggacccacctgcgcggcgacagcgccacctggctgcaacacagcgccggctaccgcgacaccccgctgcgccattggggcctgcaacacgccctgctcggcggcttcgagcaactgctggaggtgcgccacagcggctaccgcttccagcacttcctgctcgccgccagccgcctgcgcagcctgctctgccagctaccgctgctgcgcccgctgcgcgagggcagcttggacctcgacgggctgcacgcttacatgcgcgaacacctgcatgcgcgcctcgaactggaacgcctggcggccttctgcaacctgtcgaagttccatttcgtcagtcgctacaaggcgatcaccggccgtacgcctatccagcacttcctgcacctgaagatcgagtacgcctgccagttgctggacagcagcgaccatagcgtggcccgggtcggccaggcggtcggctacgacgacagctactacttctcgcgcctgttcagcaaggtcatgggtttgtcgccgagcgcctaccggcagcgggtaaggcagggcgagggaggagcctga

SEQ ID NO: 5492 - DNA, 183 bp, Pseudomonas aeruginosa
atcgccatgaacatcctcgtccgcccgtcgcaaaccccgaaaggccaatgctggcaagtctgcctcgaccagcaggccgtcaacttccgtagcgaaagcgaggcccggcgtttcgtcgaccgcctcgaggcgcgcctgcgcgcgccccatgtgctgcccgaactgaaacagcgaacggcctga

SEQ ID NO: 5493 - DNA, 693 bp, Pseudomonas aeruginosa
aatcggtacactccccgccccgttgccgagaccgattcgactacccagcacagcatgcgacgcacaaaggaagattctgaaaaaacccgtacggccatcctcctggccgccgaggaactgttcctggaaaagggcgtgtcccataccagcctggaacagatcgccagggccgccggggtgacccgtggcgccgtctactggcacttccagaacaaggcccacctgttcaacgagatgctcaaccaggtacgcctgccgccggagcaactcaccgagcgcctgtccggctgcgatggcagcgacccgctgcgctcgctctacgacctctgcctggaggccgtgcaatcgttgctgacgcaggagaagaagcgccgcatcctgaccatcctgatgcaacgttgcgaattcaccgaggaactgcgcgaggcgcaggaacgcaacaacgccttcgtgcagatgttcatcgaactctgcgagcagttgttcgcccgcgacgaatgccgtgtgcggctgcatccgggcatgaccccgaggatcgcctcgcgcgccttgcacgcgctgatcctgggcctgttcaacgactggttgcgcgacccgcgcctgttcgacccggatacggacgcggaacacctgctggagccgatgttccgtggcctggtgcgcgactggggtcaggccagctcggcgccgtag

SEQ ID NO: 5494 - DNA, 1152 bp, Pseudomonas aeruginosa
aaccatgtccatccgccgctattccccgtcacagatcgccctgcactggctcagcgccgtcgcggtcctgctgatcatcgccctgccctacggcgccgacttcttcgccggcctgctcggcggcaagggcaacgtcttcaccctgcacaagtcgctgggcgtggcggtactcctgctgaccctgacacgcctggcgctgcgccgcgtccagggtgtcccggataccttggaggggaacccggactggcagcgcgcggccgccaaggccgggcatttcctgctgtacgcggtgctgatcgtcatgccgctctccggcatgctcgccggcaagcgtccgctggacctgttctggctggtgcagatcggcccgttcgacctgccggaagccttcaaggcgttcgccggcggcacccacgtcaccgtccagtacctgcttttcgcgctgatcctcggccacgccgccgcggccatctggcaccaccgcgtgcagaaggacgacgtactgcgcgccatgctgccgcaacgcggcgcctgaccccagcgacggacgggcacgcggatgcccgtcccgacttgtcccgggccccggcttcggccaagcttttccttacgccccccgccgccgaggcccgccatgttccccatccttcgcccgctgctccataccgccgccatggcatgcgccctcccggcgctcgccgcggacccgcaaccggccagcggtggctgggcgcaacccgacccggcgccgatcggctatgcggtgctgaacgtttcccgcgagcgggtcgagtccggcactgcctgcgatgtcggcctgtacgtccacgacgaactggtcggcaacctgcaaccgggcgccagcctggccctgaacctgcaacccggcgcggtggacgtgcgtcttgcgccgaacggtcctggcgacgcctgccggaacggcatgaccatcctcgccggacagaccctgaccctgcgcgccggagagatccgcaacgtacgcattaccctcggtgcgggcgggctctacctggcaccggtggcggatgggtactgaggggtagcgacttgccgtggagcattggccatgacgcagggcacgaaggtggcgtttcggcaccgggtgcacggggactgcctggcgggccgtga

SEQ ID NO: 5495 - DNA, 432 bp, Pseudomonas aeruginosa
ccgacaagcacaacaagaaatacgtcgtcgccctggaccagggcaccaccagctcccgcgccatcgtcttcgaccgcgatgccaacgtggtcagccaggcccagcgcgagttcgcccagttctatccgcaggccggctgggtcgagcacgacccgatggaaatctgggccacgcagagttcgaccctggtcgaggccctcgcccaggccagcatcgagcacgaccaggtggccgccatcggtatcaccaaccagcgcgagaccacggtggtctgggaccgtcacagcggtcggccgatccacaacgccatcgtctggcagtgccggcgcagcgcggcgatctgcgcgcagctcaagcgcgacgggctggaagactacatccgcgaaaccaccgggctggtcaccgatccgtacttctccgggaccaagctga

SEQ ID NO: 5496 - DNA, 309 bp, Pseudomonas aeruginosa
tctggaagctcaccgaaggcaaggtccacgtcaccgactacaccaatgcctcgcggaccatgctgttcaacatccacagcctcgactgggacgcacggatgctcgaggtgctcgacattccccgctcgatgctgcccgaggtgcgcaactcttcggaggtctacggcaacgcccggatcggcggggtcggcggcggcgaactgccgatcgccgggatcgccggcgaccagcaggccgccctgttcggccagatgtgcgtggaaccgggccaggcgaagaacacctacggcaccggctgcttcctgctga

SEQ ID NO: 5497 - DNA, 885 bp, Pseudomonas aeruginosa
cgtttgcgcgcggcggccgggtgccgccgcggcgccctctacgactcatgcacggctgacaacggccccccgcgtgcggcattcttggcgactttccagggtcccggcccggcagcacgagaacaacccatgaacctgcccccccgacagcaaagcatcatcgaggaggtccgcgagcgcggttacctgagcatcgaggagatggcgcagatgttcgcggtcaccccgcagaccatccgccgcgacatcaaccagctcgccgaacagggactgctgcgccgctaccacggcggtgcggcctacgattcgagcatcgagaacaccgcctacaccatgcgcgccgaccagatgcgtgacgagaagcagcgcatcgccgaagccgtggccagcctggtgccggacaacgcctcgctgttcatcaacatgggcaccaccaccgaggccatcgcccgcgcctggttcaaccaccgcaatctgaagatcatcaccaacaacctgcacgtggccgccaccctcagcgccaaggaagacttcgaagtgctggtcgccggcggcaccgtacgcagcgacggcggcatcgtcggccaggccgcggtggatttcatccagcagttccgcgtcgacttcgccctggtcggcatcagcggcatcgacgaggatggcagcctgctcgacttcgactaccaggaagtgcgcgtatcccaggcgatcatcgacaacgcgcggcaagtgttcctggccgccgactcgagcaagttcgggcgcaacgcggtggtccgcctgggaccgatctcgctggtcaaccgggtcatcagcgacagcccgccgcccgccgccatcgcccgcctgatggcacagcacaaggttcacctggacctggtctga

SEQ ID NO: 5498 - DNA, 213 bp, Pseudomonas aeruginosa
aggccgagatccgccgtggcttcgagtactccgactgcgcggtggacgatgcgcgcctggtggtgctcaacgcgatctccgcccgcgagcacggcgcccacgtccatacccgcacccgctgcgtcagcgcccgtcgcagcaagggactctggcacctgcacctggagcgcagcgacggcagcctgtattcgatccgcgcccgcgccctggtga

SEQ ID NO: 5499 - DNA, 411 bp, Pseudomonas aeruginosa
cgcagctccagccgtttttcgcccatcttgggcccggcttggaccgccaaggcaccgctgccgggcggcgagcagatgcagagcgtcgaggcgctcaccgagcaactggccaaccgctacgcctggctcgaccgcgaaatggcgctgcgctgggcgcgcacgtacggcacccgggtgtggcgcctgctggacggggtcaatggcgaagccgatctcggcgagcacctgggcggcggcctgtatgcccgcgaagtggactacctgtgcaagcacgagtgggcccaggacgccgaggacatcctctggcgccgcagcaagctcggcctgttcctctcgccgagccagcaggtgcgcctcggccagtacctgcagagcgagcatccgcatcgcccgcgggtgcatgcggcctga

SEQ ID NO: 5500 - DNA, 462 bp, Pseudomonas aeruginosa
tcgccagccagaaacgtcgaggcccgcttttgcgggcctcgttcgttatggaagggtacgggacgatccgggcataatgcgcgacgccaccaagccggtggcgccgccgcagtcgagaatcccgtggacctgatgttcaaggcgctgatcggcgccgccgtggtcgtgctcctcgccgtcctgtcgaagacccgcaactactacatcgccggcctggtgccgctgtttcccaccttcgccctgattgcccactacatcgtcggcaagggccgttcgctggacgacctgaagaccaccatcgtcttcggcatgtggtcgatcatcccctacttcgtctatctcgccgcgctctacctgctggtcgagcgcttccgcctggagacctcgctggccctggcggcgctggcctggctggtggcggcaagcgtgctggtgggactctgggtacgcctgcacgcctga

SEQ ID NO: 5501 - DNA, 540 bp, Pseudomonas aeruginosa
cagtttgatgaatgccgccaggcggtcgtggcgttgtggctctgcggcgttgcgccgctgctccgtgccgccgtcccgtgtgccgggctcttctccccgtcgctccacgatcgcacgctctgcgggatcgaggccatcgcttgtcgacagcccctggcgtatgagacaaactcaacgaatccgcaccgctatcaagttttgctcatacagaggccgccatgctcgaacttcgccacctcaagaccctgcacgcgctgcgcgaagccgacagcctggtggaagccgccgagcgcctgcaccttacccagtcggcgctgtcgcaccagttcaaggaactggaagagcgcctgggcatgcagttgttcgtgcgcaagaccaagccggtacgcttcaccagcgccgggctgcgcctgctgcaactggccgactcgctgctgccccagctgcgcaccgccgagcgcgacctggcgcggctcgccggcggtaccgccggacgcctgcacatggccatcgaatgccacagttgcttccagtggctga

SEQ ID NO: 5502 - DNA, 648 bp, Pseudomonas aeruginosa
cctcggtcagccgtcccaggttcaggctcagtccgctcagttcaccggaagtcagcagcgcgccctggaacacctgggggaatagccgcccgtagttgggctggatggtcggtagcttcggtaccaggccgccgaccttcagttcgctgcgcgacaggcgcagcttggcggtcgcgtccagccgcgcgtagtcgcccgccgcgctgccatcgtcgcgaagcggaagcaggccggtgccgctacgccccgcgccggaatcgagccggacgccgagcttgcccagcaggtcgagacccacgccgagggtgccctcggtatagcccgagcggtagtcgaagagaaagccctgggcccactcctcgcttttcgcacgccccgcgccatcgcggaagtcgcggttcatgtagaagttgcgcaaggccaggctggcccgcgagtcttcgaggaagccctcggccaaggcgggaacgctatcgccggcaaggatcggcagcaggaaaaacgcgcatttcttgttgttgttcatacgcactccgaacgggcgcctgggcgcctctttttctagggggaacggtgtctcatcggcagcgctcgatcaccatcgccacgccctggccgagcccgacgcacaggctgaccaccgcgtag

SEQ ID NO: 5503 - DNA, 447 bp, Pseudomonas aeruginosa
tccaggccgagcaacttcaggcaggccaggacctgcggcgcgaaggcttcgttgatctcgatcaggccgacctcgtccaggtcgatgccggcgcgttgcagcgcgcggaggatcgcctgctgcgggccgatgcccatcaaccggggctccacgccgacgctggcgctggcgaggatccgcgccagcggccggatgccctcgcgctcgccgatcgcgcgatcgcccagcagcactaccgccgccccgtcgttgatccccgacgcattaccggcggtcactaccccaccggcgaacaacgccggcaagcgtgccagggccgccaggtcggcctgcggtcgcggatgctcgtcgcgctccaccagccgcgtctcgcccttgcgtccggcgcgcacctccaccggaaggatctcgccgaggaaaaagccctcctccagcgcagcctggtag

SEQ ID NO: 5504 - DNA, 450 bp, Pseudomonas aeruginosa
cgctcgaccagcctggggttggcgaagcgcgcgccgatggtgctgtcgaagacctccagcgtgcggctgaaggcgctctccgccttggccatgacgaacggcgcccgggacatgctttcggcgccgccggccaggtacagccggccctcgccgcaactgatcgcgcgcgccgcgtcgatcaccgccgacagtccgctggcacacaagcggttgaccgtctgcccgggcagccgcgccggcaggccggctgcgagcagcgcgttgcgcgccaggttgcggctgtcttcgccggcctggttggtacaaccgaggatcacatcctccaggtcgtcgacagcgaacccggaggtttccgcgagacgcgccagcagcaggccggccaggtcgtccggacgcaccgtcgagagtgcaccggcatgccggccgaaaggcgtacgcaggccggcgtag

SEQ ID NO: 5505 - DNA, 594 bp, Pseudomonas aeruginosa
gcatcgagcatggtgtgtttctccgccaagggatcaggaggccaacgggctgtccggctggcgcagggaaaggcccagttgggcgcgccggcgcagccagggactggggcgatagcgcgggtcgccgctgagcgcatgcaggcgttcgaggatgcgcagcacgcgcccggcgcccagtcggtcgccccactccagcggccccagcggatagccgagaccgaggcgcaccgccaggtcgatgtgctccaccgaagcgataccctgctgggcgatgtcgcaggcgagattgacgatcgaggcgagggtgcgctggacgatgaacccggcgctgtcgcgaatcagcgtgacgcccacgccgtcccgtgcgaacagggtgcgagccgcctgctgcagctccgctcgggtcgccgggcaggccatcaggcagcggtgtcgctccaggtccgacagcacgtcgatggccaggctgcgcgtcggatcgacggcgaaccgccgcgctgcggcgctgacgtcggcgcccagtggcgcaagcaggcacaacgccgccccggaaggacgctcgccgctctccacctcggcgcccagacgttgtag

SEQ ID NO: 5506 - DNA, 726 bp, Pseudomonas aeruginosa
caacatcagcaatggcgcgcggtcatgttcgtcgtcgacgcccagccacaccggcggcaacgccgcgcctggcgcaaccgccggggcggcgacgggcacctgcccagcgccgtcgtagcggtagaagccctggccgctcttgcgccccaggcggccggcggcgagcatctggcgcagcaagggatgcggacgataacgcggctcctcgtagtactgccggtagatcgactccatcaccggcaggctgacgtccaacccgaccaggtcgaacagctcgaacgggcccatgcggaagccggcgccctcgcgcaggacttcgtcgatcgccgccaccggcgccacgccctcgccgaggatacgcagcgcctcggtgccgaaggcccgtccggcatggttgacgatgaagccggggctgtccgtggcacgcaccgcctggtggccgaaggtcgccaccagggcgcacagtcgctcggcgatgccggtgcgggtggcgagaccctcgatcacctccaccagacgcatcagcggcaccggattgaagaagtgcagaccggcgacccggccgggatcgcgacaggccgaggcgatcgcggtaaccgacagcgaggaggtattgctggcgaggatcgcttcgtcgccgaccacctcttccaattggcggaacaacgcctgcttggcctccaggttctcgacgatcgcctcgatcaccaactggcagccgcgtaa

SEQ ID NO: 5507 - DNA, 1437 bp, Pseudomonas aeruginosa
gacccgcaagtcctcgaccacccgcagattgcccatcgcgagcgcggcagcctccgcctccagccggcctcgctccacctgccgggcaaggaccgtggcgatctgctcgcgtgcttgcagtgccgcaccctggcggctgtcgtagagcagcaccgacagcccggcacaggcagcgagctgggcgatgccctggcccatggcgccggtaccgacgataccgatgagaacgattggtggctcgctcattttcccaggtactccgctgtgcgtttttccaggaaggcacgcatgccctccttctggtcgtggctgtcgaacagcaactggaaggccttgcgctccagcgccagggcctggtccagcggcaggtcggcgccggccaggaccacttccttgatctgcgccagcgccagcggcggcaggccggcgatctggcgagccagttcgagggcgcgatccaatgcctggccatccgccgccacctcgctgaccaaccctatggccagggcctccggcgcccgtaccgtgcaaccggtaaacagcatgcgcagcgcctggaacttgcccaccgctcgcaccaggcgctgggtgccgccggcgccgggcatcacgccgacacggatttccggctgggcgaagcgcgccgaggcaccggcgacgatcaggtcgcagtgcatcgccaactcgcagcctccgcccagggcatggccctccacggcggcgatcagcggcttgcggcaggcggcgagggcctgccagtggcgctccaccccgcgctgctggatctccagcgcggacgcctccgccagttcgttgagatcggcgccggcggcgaacgccgtgccatttccggtgaggacgatgacccgggtatcggcgcactcgtcgaggcgccgtacgtgctccgccagagcctcgcgcaggcgcatgttcagggcgttgagtactgccgggcggttcagtcgcaacagggccacgccctgctccggccgctccagcagcacgagttcggggctcaccgccccaggggaggaatccatggccatctccaattgcccggggattgagttgcacggcgcaggccgtgccgtgcggggtttcaggcgcggacgatgccgcgccggaccagcgcgtcgatcgcctcggcgctcaatcccagttccgccaggacttcccgagtgtctccgcccagcaccggcggcgcggcgcggtagctggccggggtgcgcgaaagcttcaccggcgaggcgatgccgcgatagccctcgagttcgacgaccatcccgcgatggcgggtgtgcgggtgctccaccacccgatccaccgtggcgatggctccgcagggcacgccgagacggatcagccgctcggccagctcacggccgtcgtgggccgccaggtagtcctccagggcgcgcttcagcgcctcgcggttga

SEQ ID NO: 5508 - DNA, 2013 bp, Pseudomonas aeruginosa
ttttcaggccacgcagggcgcccgtctgattggtcatggcgactctctggttgttgtgagcgggaatgcgggcagtcaggccggcagcaattgcatggcttcggcctggctcagcggcacctcgccgaccaccctggccagcagttcggcctggtcggtccagccctccaggcgcagcgggtcgcgcggcagcagcttgtgccgggcgaccaggaaggccagggccaggcggcgctggtcgggtgcctggcggctggcctcccaggccatgaagatcgccgtgcacaggtgatagagggcgctgccggcctggcgcacctgctcgtcctggcggcgctcggcgacgtcggccatggtcgcgaccactcgcaccagcagttcgtcgaagaggtcgcgggcgtcccctggcaggtcgctgtcatccagcagccggcgcaggtggcgctgcaaggattcgagcgcctgttcgcggctcaccgcacgggcgacgtccagcgccacgatgttgctggtgccctcccagatcgaccccaggtgggcgtcgcgcaccagccgcgggtcgctccactcctcgatgtagccgaccccgccgcgcacctccatggcgtcgccggtgacccgacgcgcatcgcggcaggcgcggaacttgatcagcggggtgaggatccgcacgcatttctgcgcctcgacctcgccgccatcggcgcgcggcagcagcgtggcgatctgcatgaacatcgagcgcgcctgttcggtgggcagcatcatcttcagcaactgcttctgcatcagcggcatgtcgatcaggtgcttgccgaaggcgcgccgatggcgggcgacgaacagcgcctcgctcagcgcccggcgcatcagcccggcggcgcgcacgccgttggacaggcgcgacatgttgaccatgtcggccatctgctggaagccgcggccgatctcgccgatcaggtaggcgctggcgccttccaggcggacttcgccgctggccatggagcggctgcccagcttgtccttcaggcggacgatgcgataggcgttgcgcgtaccgtcctcgcggaccttcggcaacaggaacagggtcacgcccttcattccttccggcgcgccttcggggcgggccaggaccatcgccaggtcggcgtccgggttggagcagaaccacttgtcgccgtagagcttccactcgccgccctcctcccgcgccacggtacgggtccgcgccacgtcggagccggcggcctgctcggtcatgaacatggcgccctggaacagctcgtcgaaatcccgcgaggcgagggacggcaggtagcgctcgaccagttctggcgcgccgaacctgcgcagggtgcgggtcagcgagtcggtcatgctgaccgggcagcaaaggccgaactcggcctgtacgaacaggtgggtgagcgcatacttcaccagcggcggcgggccgtccgggcgatggctcatggaagccaggccaagttcggcataggccacctgttcgagggcgacgtagtccggatgcttgcgaatgctctgcaaatcctcgccgcggcgggtgcgcggcgccagcaccggcggattcttgtccgccgccagcgccagcacgtccagctcgccgccggcacgggcgccgagccgttcgaggagcggccgccattcggcgagcaacgccggcggcaggtatacctccagcagccgctccagggccggatcgcaggtgtagagattcagcccacggctgtcggggatgttcagcgtatcttcgcgaagtacttcgggcatggcggtcatggcgcggctcctgcttgtcttgcgccgagactaggcgagtgcttcgataagcatccaatacaaaaaaaatcatcgacgataagaaaaacagatcgtagaaccaggtgcctgccatggatctcagacagcttcgctacttcatcgcggtcgccgaggaactgcatttcggtcgcgccgcggctcgcctgttcatctcccagccggcgctga

SEQ ID NO: 5509 - DNA, 1365 bp, Pseudomonas aeruginosa
aagactattgatttgcgggggtgccacctagactccgaggcacccgggtcaacaccgacgcacgctctccctccacggaaaccagcgtttccgccccgcctttcagcgaagggcggtagggcgcggcgtgtcggcgagaacaacaataaacaggactcgacccatgccgcgcacgccctctcccgaagacgccgacctgcacaagaaggcccgcagggccggtatcgcctccttcatcggcaccaccatcgagtggtacgacttctacatctacggtctggccgccgccctggtgttcggcaaggtattcttccccgccgacatggatccgggcctggccaccctgctgtccttcgtcaccctctggtcgggcttcatcgctcgcccgctgggcgggatcatcttcggccatctcggcgaccgcatcggccgcaagaccaccctggtgatcaccctgatcatgatgggcatcgccacgacctgcatcggcctgttgccggtctatacgcagatcggcatctgggcgccgatctccctggtggcgctgcgtatcgtccagggcatcgcggtcggcggcgagtggggcggcgcgatcctgatcgccagcgaaagcgcgcccaagggcaaaggcatcctgtacgccgccttcgcccagcagggctcgcccaccggcaacctgctggcgaccctggcgttcttcgccctcagcgccctgcccgcctcggacttcattctctggggctggcgcgcgccgttcctgctctccgcagtgctggtcatcgtcggcatggtgatccgcctgaagctggaggagtcggaagacatgaagcgcgtgctggcgcagaagcgcacggtgaagctgccgctcgccgaggtgctgggcaagcactggaagatcgtcctgctcggcgccggcgtgctgccgatcatccacgtcacctacttcaagagcaccttcgccctctcctgggcgaccaagaccctcggctacagccagggcaccttcctcagcatcatcgtggtcgcgctggtggtgcagttcctcagccagccactgggggcgctgctcacttcgcgcatcgacatgcgcaaggcggcatgcctgatggtgctgccggagtttatcctgatgccggcgatgttcttcgccgtggaaaccaaggtctactggatcgccgcggtcggcatgtgcctggccacggtgccgcacgcgatgttctacggcgcggtgggcggtatcctcgcccgagccttcccggcgcgggtgcgctacaccggcctgtcgctggcctaccagctctgctcgctgctggtcggcggcggtacaccggtactggcccagtggattctcaacagtaccggtag

SEQ ID NO: 5510 - DNA, 1311 bp, Pseudomonas aeruginosa
catcgtcggcgtggccctggcctcggcctgctacgcgctggtctcgctggcctgtaccctggccctgttgcggatcaccgggttccacgccagcgacctgtcgaccgccgagcgcgccgacgccgaggacttgcagcggcccgcagcggtcgagcgggaaccggtgttgcgcgcccccgcccggcttctgggcggcgatcccggctagccggcagcgcccatgcgccgctcgtgctccagcaaccagcgcttgcgccacaggccaccgccatagccggtcagggaaccgtccgaaccgatgacgcggtggcagggaatcacaatggcgatctggttggctccgttggcgcgggccacggcgcgcaccgacgacggcgagccgatggacctggccagcccggcgtagctctgcgtgctgccgcacggtacctcgcgcagcgcctgccagaccgtgcgggtgaaggccgaggcgttcagcgccaagggggtctggaagcgcactggagtaccgccgaagtagtcggcgagttccgcctcgatcctgtcgatggaggcgaaacggccgaaaccgatgctcgatccgctgctcttctgcaggcgtttcagctccccgctcaacgccgggcggtcgaagaactccagcaggtgcagggcctgcgcgtcggccaccgcgagcatggcgccgagcggggtctgcagccagtccgccttgagcagctcgcgcccgcgcaactgcgacggcggctcgcccagcaggcgcgcgaaggcgctacggaagccgctgtcggagtcgaagctggcatccagttgcgcgtcgatcacccgcgcgcccgaggacagccgctcggcgacctggccaagacggcgcaagcgagccatttccagaaaggtcacgccgaactcgcgcttgaaggcacggcgcacggtggacgggtcatagcccagcgccgccaggtcgtcttcgaaccagcgccgctgcggttgccgaccgaggcgctggagcaggtcgctgaccagcggcccctgcgtgccgagccgttccagcggccggcaacgcaggcagggccggaagccggcctcgacgcagcccttgatcgaatcgaagaacagggtgttctcgcgcttcggcttgcgcgccgggcaggtcaggcggcagaacaccccggtgctcttcaccccgacgaaggcgaagccatcgtaggcggggtcgcgcgccaacagcgcggcatacagggtgtcgtcatcgggaaggggaaggaacaacgctgcatcggacatggccggctccggaatcagggaggcgatggatag

SEQ ID NO: 5511 - DNA, 696 bp, Pseudomonas aeruginosa
tgcacgcagagcgcgacgaaggcgccgaggaccaggaactgcaccagcatcagcaggccattgacgttcttcgccaggcgcaggccgacgatgttgatcgtcgtggtcacgccgatgaacgcccagcacccagaccgcgttgggtaccgcgggaaaggccgagtgcaggtaggcggcgccgatcagccagatcgccatcggcaggaacaggtagtcgagcagcaccgcccagccggcgatgaagccgagccgggaatcgatggccttgcgcacgtaggtataggccgagccggccacggggaaggccgcggccatgcgcccgtagctgagggcggtgaagagcatcgccagggaagcggcgatgtaggcggcggggacgtgtccctgggtggtctcggcgaggatgccgaaagtcccgaggacgatgatgggggtcatgtaggcgatgccgaacagcaccacggaacccagcgacagggtgcgcttgagtctggccattactgcttactccggaattatcgtttgttatggcagtggcccgcagccggccgggccgcggggcgcaggggcctcccctcacccgggagaccggcggacgctcgggcgcccatcgttgtgctacggctttccgggcccatcctcgcccgctcgctggcggacggaggacgacgcgacgctcctgtcgcgccgcggtga

SEQ ID NO: 5512 - DNA, 492 bp, Pseudomonas aeruginosa
gtttcaccttgcaggacatcgcctggcaccgctccgtcgggcaactggtcgaggcgctggatgcgccggacttctggattcgcctggtacgcctgctcgaacagtacgttccgttcgacagctgggtggccctgctgttcagccagggccggccacaggtgttcgccgaatgcccgggcgccgacggcgggccggatccgctgttccaggactacctgcgaggcctctacctgctcgacccgttctacatcgccagccgcgagaacccgtgcagcggcctgttccgtctggccgacgtggcaccggaatgcttcgagcagaccgattactaccagcgttacttccgcctcaacgtggtggccgatgaaatccagatcaacgtccagctctccggcgaacgcaccctctgcctgtcgctcggctcgcggcgccgcttcacccccgagcaactcgccgtgctcggcctggtgcggccctgggtggccgggctga

SEQ ID NO: 5513 - DNA, 1347 bp, Pseudomonas aeruginosa
ccaggcgcacggcgagcggaccaggtggcatcgacaaggctcggaggcggtcttcgcctcggttacactgcacgccggtttccccaggtctcgctcgtcgtccacatgcccagtcaagcatcctccccttccccccaggtcgccatcgtcggcggcggtcccgcaggcctgatggccgcggaggtcctgagccaggcgggcgtacgcacggaagtgttcgacgccatgccctcggtcggccggaaattcctcctcgcgggcgtcggcggcatgaacatcacccatgccgaggccagggaacaattcctcggccgctatggcaggcgccagaaggaaatcgccgcactgctcggcgaattcgacgcggatgcgttgcgcgcctggatccacggcctgggtatcgacaccttcgtcggcagttccggccgggtgttcccctccgacatgaaggccgcgccgttgctccgtgcctggctcaagcgcctgcgcgagcaaggcgtgctcatccacacccgctgccgttggctgggctggaacgcggacggtacgctggacatccagagcgccgccgagcgcctgtcgatacgcgccgacgccgtgatcctggcgctcggtggcggcagttggcagcgcctgggctccgacggcgcctgggtgcccctgctgcgcgcccgtggcatcgaggtcgagcccctgcggccaagcaattgcggtttcgagatcgacggctggagcgagctgtttcgcgacaagttctccggcgctccggtcaaaccggtggccatgggactggcgggcgaaacgccgcgccagggcgaattcgtcgtgacccgcgacggtatcgagggcagcctggtctatgccctctccgccgccatccgcgaacggatcgaggcacggggctcggccgaagtatggctggacctgttgccgaacaggcgtcgcgagcagatcgaggcatccctggctcgcccgcgcggttccaggtcgatggccaatcacctgcgcagccagttgggcatcgatggggttcgggccggcctcctgcgtgaactcacccccgccgccacctataccgagccggcccgcctggcggcggcgatcaagcgcctgccgctgacgctgctgcgcccgcgtccgctggacgaagcgatcagcagcgccggcggcgtacgcttcgaggcgctcgaccgcaacctgatgctcgatggcctgcccggcgtgttctgcgctggggaaatgctcgactgggaggcgcccaccggcggctacctgttgaccgcctgcttcgccagcgggcgcgtggccggactcggcgcgctggcctggttgcgcggcaggcgctag

SEQ ID NO: 5514 - DNA, 483 bp, Pseudomonas aeruginosa
tcgctatcggcgaagcgctcgggcgccggctcgggatcggcaaactggctggcgtcgaggttatccaccgggacgtcctggatcacctcgacgatttcctgcggctggctgtggcggaacatgccggtgagcaggtcggccaccagcatcccgccagcgaccccagcggccgtctgcagcgcaccgccgagaaagccgctggcccgcgaaggcgcggccgccgcggcgggcgccatacccggacgcatgtcgccggccgccgccgccggattggagaaacgcgtctcgccccagcccgccgggcgccccgattggctcggcgccggctcgtcgcgcgcgccgccgccgaacaggccggagaggaagccgccgctgctcggacggctctgctgcaactgggcgacctgcgcctcgagctccttcacccgttggtcgaggcgcttcagcgcggcttcctggatcagcaccacctgcgccatgtag

SEQ ID NO: 5515 - DNA, 1170 bp, Pseudomonas aeruginosa
ttcgaaaacatgaatccgggatggcacggttccttcatagacaccggaccacgcccctacccggagatacccccgatgagccaagagcaacagccgatccgcttcgcctactgggtccccaacgtcagcggcggcctggtggtgagcaagatcgagcaacgcaccagctgggacatcgactacaaccgcaagctggcccagttggcggaacgcaacggcttcgactacgccctctcgcagatccgcttcaccgccggctacggcgccgagtaccagcacgagtcggtggccatcagccacgccctgctggcggccaccgagaagctcaaggtgatcgcggcgatcctgcctggcccctggcatccggcggtggtggccaagcaactggcgacgatcgaccaactgaccaatggccgggtcgcggtgaacatcgtcagcggctggttcaagggagagttcaccggcatcggcgaaccctggctggagcacgacgaacgctatcggcgctccgaggagttcatccgcgtgctgaaaggcatctggaccgaggaaaacttcaccttcaagggcgatttctatcgtttccacgactacaccctgaaacccaagccgatccagcagccgcacccggaaatcttccagggcggcagctcgcgggcggcgcgggacatggcctcgcgcgtgtccgactggtacttcaccaacggcaacagcatcgacggcatccgcgcccaggtcgaggacatccgcgccaaggcggcggccaacggccattcggtcaaggtcggagtgaacgccttcatcattgcccgcgacaccgaggaggaagcgcgggcggtgctcgacgagatcatcgccaaggccgactacgaggcggtgaacgccttcggcgacgcggtgaaacaggccggcaaggcctcgccggagggcgatggcaactgggccaaatccaccttcgaagacctggtgcaatacaacgacggcttcaagaccaacctgatcggcacgccacggcagatcgccgagcgcatcgtcgcgctgaaggcggccggggtcgacctggtgctgtcggccttcctgcacttccacgaagaagtggagtatttcggcaagcacgtgttgccgctggtccgcgaactggagcaggcccaggctcgcgaagcggcctga

SEQ ID NO: 5516 - DNA, 444 bp, Pseudomonas aeruginosa
agcaacggggcgaaaccggtcagcgaaccgagcacgacgatctgtccgcgccgttcgagcaggctcggcagcgccgcgcgggtgcaatgcacggcgccgaagaagttcaccgccatgaccttgcggaaaacccccaggccggtttcggcgaaggtaccgcggtgggtgatgccggcgttgttgaccagcacgtcgatgccgccgaagcgctccaccgccagcgccacggcacgctccaccgcatcggcgtcggagacgtcgcagcgcaggccgagcgcctcgccgccgagatggtcgcgcaggtgctggaccaaactgtccagcgccgcctggtcgaggtcgaggatcgcccagtggcgcaccggcccgggcgaaacgcagcgccagcgcccgaccgatgccgggaacagccgccgcttgaccagcaccaccttggggcggtag

SEQ ID NO: 5517 - DNA, 582 bp, Pseudomonas aeruginosa
aatgcgcggcggcaagctctatgctctggtcctttccagcatagtctcgattgcgatgtcactgccccgtctacgcaacctgctgttcgtcggcctgctcctgctggtcggcggtgccctgctcgccagctacctgctgagctggcaacccgccgatcgcgaagccgcgcccctgcattgccagggcgccgcgccggcgctgaagccggggcaggccctgaaggtgatgacctggaacatccagtacctggccggcaaacgctacgtcttctgggacgacctgccggatgccaccggcccggaccagcgccccaccgccgaagacctggcgttcaccctcgacgaggtggtccgggtgatccgcgacgagcagccggacctggtcctgctccaggagatcgacgacggctccagcgccaccgacgatcaggaccaactggcgctgatccaggagcgcatcaacgatctctaccattgcagcgcccaggcctacgagtggaagtcggccttcgtgccgacgccgcacatcttcggcagcgtcggccgcaagcaggccaccctgagccgctatcgcatcgatag

SEQ ID NO: 5518 - DNA, 591 bp, Pseudomonas aeruginosa
gggtggagacacgcagtggctcgattcacgacagccgctcccgcagggcacgcccaaacctcaaggtttcctaggcttcgccctggccgtcgcttcagcaaccaatggatcttcaggccaatgatgcttggggtatctacccttcaaatccttcttcacctctacataggtgcttcgccagaagttcgccagatcctgagtaacctgcacgggcctacgagccggcgacagaagatgcagaatcagcggctgcctgctctgggctatgcgtggtgtttctgccaggccaaacagctcctgcagcctcaccgcgaggatcggtggatgctgcgagtaatcgatgcggatattcgaaccagacggcacctgaatcgcctgaggcgcctggacttccagctcctgcggaagcggccaaggcagaaggttcctgactatcgacgacagatccaactggctgaagtgactgagcctcgtgactttacccaggtacggcgtgagccactcttccagcgtgtcgaggaggttggcatcgctgagatcaggccacttactttctgcctggccactctggatatcgagctgacgcagtag

SEQ ID NO: 5519 - DNA, 693 bp, Pseudomonas aeruginosa
tggaggttggtcgagccaggtcatctcttctggcttcattccccaccgggccagctggagtgccagagctgcgagatccgcctgcaggatctctggggtgctgtagccggccatttgctcgtgctgcgattccgaccacaggcgatagcagacacctggctccaagcgccctgcccgccccgcacgctgggtagcactggccttcgagatacgctgagtgtcgagtcgggtcatgccactgcgaggatcgaacttcggcactcgctccagaccactgtccaccacgaccctgacgccttcgatggtcaagctggtctcggcgatgttcgtggccagtacgatcttccgggagcccttgggtgcggggtcaatagcagcacgctgggcgttcagatcgaggtcaccgtacagcgggcatacgatcacctctggacggctgctcagctgctccttgaggtcttctgccacccgccgaatctctgcctgcccaggaaggaaaaccagaacgcttcccgactgttcattgatggcggccaagcaggtgtctgtgactcgcgcatcgattcgctcgcccggctgataggggctaccccaaaccgtagagaccggaaacatccgcccttcactggtgaccacaggagcgtcattcagcaccttggaaaggcgagcaccttccagcgttgcggacattag

SEQ ID NO: 5520 - DNA, 909 bp, Pseudomonas aeruginosa
cagaagcgccccatgagtcccgattccccccacgcccgcctgctgcgcctggccaccctggcctcgctcggagtcgccgtcaccctggtcatcggcaaggccatcgcctggtggctgagcggttcggtgagcctgctcgccggcctcaccgactccctgctggacagtgccgcctcgctgctcaacctgctggcggtgcactattcgctgcgcccggccgacgacgaccaccgctacggccacggcaaggccgaggccctggccggcctggcccaggccatgttcatcggtgccagcgcggtgctggtggctatccaggcggtcgagcaattgcgcgacccgcagcccctcggcgcggccacctggggcatcgcggtgatgctgctgtcgctgctgctcacggcccttctcctggccttccagacccacgtcatccgccgcaccggttccaccgcgatacgcgccgactcgctgcactaccgctcggacctgctgctcaacgccagcatcctcgtggcactgctcctggcccgctacggctggccgcagagcgacggtctgttcggcctgggcatcgccctgtacatcctctggagcgccctgcagatcgctcgcgagtcggtgtcgatcctgatggaccgggaactgcccaccgacatcagcgagcgcatgcgcgaacttgcctgcagcgtgccgggagtgctcggcgcgcacgacgtgcgcacgcggatctccggcaaccactggttcgtccagttgcatctcgagctgcccggcgagctgagcctgtcggtggcccacgccctgaccgaccgcgcagtgctggcgatcaagcgcgaatacccgaaagccgaggtgctgatccatgccgacccacaggaagtggtcggcaaggaaaccgtcagttga

SEQ ID NO: 5521 - DNA, 408 bp, Pseudomonas aeruginosa
aacaagggagtcgccatgaacgccgccgaccgcgtcatgcagagttatggacgctgctgtgccagcaccggattcttcgatgatttctaccggcatttccttgccagttccccgcagattcgcgccaagttcgccaccaccgacatgactgcgcagaaacacctgctgcgtgccgggatcatgaacctggtgatgtacgcccgcggcatgtccgacagtaagctgcgcgccctcggcgccagccattcgcgcgccgcgctggatatccgcccggaactctacgacctgtggctggacgccctgctgatggcggtcgccgagcacgaccgcgactgcgacgccgagacccgcgacgcctggcgcgacgtgatgggtcgtggcatcgccgtgatcaagtcgtactactga

SEQ ID NO: 5522 - DNA, 489 bp, Pseudomonas aeruginosa
tcgttccgcgcccgctggacgacgcccctctcgtcagtccagccgcgccggcacttcccgccattccccgaggcccaggccgtccaggctccaggggccgatccgcacccgcaccagccgcagcgtcggcaagcccaccgccgccgtcatccgccgcacctggcgattgcgcccctcgcggatcaccagttccagccagtaggtcggcaccgacttgcgaaaacgcaccggcggcacccgctcccacaacgtcggctcatccagcagacgcgcctcggcgggcagcgtcgggccgtcgttgagcgtcacaccctcgcgcaggcgccgcaattgctcctcgtccggcgtgccttcgacctgcacccagtaggtcttcggcagcttgtgccgggggtcggcgatgcgcgcctgcaggcgaccgtcgttggtcagcagcaacaggccctcgctgtcgcggtccaggcgcccggccggatacacgcccggtaa

SEQ ID NO: 5523 - DNA, 1104 bp, Pseudomonas aeruginosa
ccgcaagagcatcccctcatgccctccctgcgtcccacctggctgatcagcctgctgaccctggccggctgcgctggcagcgcctatcagggtccgccttcggaccatttcgacggcgaacgtttccgcaatatccagccgaccgcgcacaagagcctgcgcgacctgctcaagtggcagtggaaccgcccgccgcaacgcccgtgggtcgccctgccgccgacggcaacgccgccaagggtgaacgaacgcgcccgcggcgaagaactgcgggtcacctacatcaaccacgccaccctgctgatccagcaccgcggcctgaacatcctcaccgacccggtctggtcgcaacgggtcagcccgctcgccttcatcggcccgaagcgccaccatccgcccgggttgacgctcgaccagttgccgccgatcgacctggtgctggtgagccacaaccactacgaccacctcgacctggaaaccctgcgccagctccaccggcgctggccgacggccaaggtagtcagcggcctgggcaacgccgggctgatccgccagacaggtttcgccgacgtcgtggagatcgactggtggcaggccgtgccgctgggcgctggcctgacgctgcatggcgtaccggtgcagcactggtcgtcgcgcacccgcagcgacaccaaccgcacgctctggctcggcttcgtcatcgactcgccggacggcccgctgctgtttcccggcgataccgggctcggcccggagttcgggctgatccaccagcgcttcggggcgatgcgcttcgccgccctgccgatcggcgcctacgagccgcgctggttcatgcgcgaccaccacatgaatcccgacgacgcggtgcaggcccatcgcacgctgcaggcgcagaccagcatggccatccacttcggtaccttcaatctcaccgacgaacagcaggacgacccgcccaaggcgctccaggcggcgctgcgcagccaaggcgtggacccggcgaccttcggcacgccgaaacccggcgagcagtggcgcgtcgcaccgcgcaacgtcgctcaggaggccgaggccaccaggcgggagcagcagttgcggtag

SEQ ID NO: 5524 - DNA, 1938 bp, Pseudomonas aeruginosa
cgcggatgcgcctgcatcgcgacgcgcctcaggccagtgcggggtggcgcgagccaacagcgcctcgacctcgacgccgcgcgggagggtgccgtagacccgcccgccgtcccccaggcgactgccgatgaaggcgtcggacaccgcggagttgccggcttccagcaacagcttggcctgcagggcgatcgccacgtcctcggtgagctggcgggcgcggtactggatgtcggcggtgtcggcgaagcccgccttgaggttgccgatgtgcgcggcgagacgggcgtcgccatggccgtcgcccagttcggcgaacaacgcgtcgagcacccccggctccttcgacagggcacgcagcacgtccaggcactgcacgttgccggaaccttcccagatcgagttcaccggggcctcgcggtacagccgcggcaggatggtttcctcgacgtagccggcaccgcccatgcattcggaggcttcgttgatcatcgccggggcacgcttgcagatccagtacttgcccaccgcggtgaccaggcgggcgaacttctcctcctgctcgtcgtggccacggtccagggcatgccccatgcgcagggtcagggccagcgccgcctcgctttccagggccaggtcggcgagcacgttctgcatcagcggttgctcggccagcacccgcccgccgaccttgcggtaggcacagtggtgggcggcctgggtcaacgcctgacgcatcagtgcgctggagccgatcatgcagtcgaagcgggtcatggcgaccatctcgatgatggtcggcacgccacggccctcttcgccgaccatccaggccagggcgccgcgatactcgatttcgctggaggcgttcgaccagttgcccagcttgtccttcaggcgctggatgtagaactggttgcggctgccgtccggccggtggcgcggcagcagaaagcaggtcaggcccttgtcggtgtaggccagggtgaggaaggcgtcgcacatcggcgccgagcagaaccacttgtgcccgaccagttcgtaggcctgccccggcccgggaatccccaccgggtaggcccgcgtggtattggcccggacgtcggtgccgccctgcttctcggtcatcgccatgccgatggtgacgcccgccttctgctccatcggcacgttgcgcgggtcgtactcgcgggagaggatcttcggcagccatttctcggccaggtccgcctgcaggcgaatcgccggcacgctggcgtaggtcatggtcaacgggcaaccggtgccggcctccgcctggctgtgcaggtaggacagcccggcccgcgccacctgggcgccggggcgcgggtcggtccagggcagcgagggcagttcgtgctcgatggcggcgcgcatcagctcgtggtaggcgggatggaactccaccaggtcgacgcggttgccgtagcggtcgtggctatggaactccggcttgtgctggttggccaggaagccggccgccatcagcgggccgccggccagctcaccgtagcgctgcaggcgctcctcggcccagccgccctggtagcgacgcacccactcctggagaggcagatcgaggcggtagaggttggcgccatccagcgacggtacctggttggtcacttcgtgggtttcggcgtactggtgcaggttcatgagggttcctcgcagacaggcgcgcccaccgcgcgcaggcagaagttcaccagagccgtactcaccggctccagactcggttccggctggccgctgtcgcgagcggcgcgcgccgggggagacaaggggccgaccagcgcctcggcgatggccccgaccaggcaggccgcggcaagcggcaccagggaaagctggaatgcgccactgcgccggccctcctcgagcagttcgacgaacagtgcggcgtatgcctcgcgatag

SEQ ID NO: 5525 - DNA, 918 bp, Pseudomonas aeruginosa
tcaccggcggacacggcgacgaaagcgaagtgcacaatcgcctgtacagccgcgacggcagccgccgcaccttcacctgccagcgcctgcccggcagctaccatggctccggctgcaccctggccagcgccctggccggtcgcatcgccctcggcgaagcgctgcacggcgccgtgcagagcgccctcgactacacctggcggaccctgcgcgacgccgagagtccgggccacggccaatacgtgccgcgccgcctgcccaccgacttctgtcactgagagccagccgatgaaactgcgcggcctgtacgccatcaccgatagccagctactggacgacggccgcctgctgccctacgtcgaagccgcgctccgcggcggcgcgcgcctgctgcaataccgcgacaaatccagcgaccaggcgcggcgcctgcgcgaggcggaaagcctgcgcgaactctgcgaacgccacggcgcgcagttgatcgtcaacgacgacgccgaactcgccgcgcgcctgggcgtcggcctgcacctcggccagaccgacggttcgctgtcggcggcgcgcgccctgctcggccgccaggcgatcatcggcgccacctgccacgcccaactggaactggccgagcaagcggtggccgagggcgccagctacgtcgccttcggccgcttcttcaattccagcaccaaacccggcgcccccgccgccagcgtcgaactgctcgaccaggcccggccgcgcctgcacctgccgatcaccgccatcggcggcatcagcctcgacaccgcgcccggcctgatcgcccgcggcgtcgatctggtcgccgtgatccatgcgctgttcgccgccgcgtccgccgccgaggtggaacgccgcgcccgcgccttcagcgccctgttcgaacctgcctga

SEQ ID NO: 5526 - DNA, 1197 bp, Pseudomonas aeruginosa
agagctagccatgtcccgttccgaaacgctgttcaacaacgcccagaaacacattcccggcggggtcaactccccggtgcgcgccttcaagagcgtcggcggcaccccgctgttcttcaagcacgccgaaggcgcctatgtactggacgaggacgacaagcgctacgtggactatgtcggctcctggggcccgatgatcctcggccacagccatccggacgtgctcgacgcggtgcgccggcaactcgaccacggcctgtcctatggcgcgccgaccgcgctggaagtggaaatggccgacctggtctgctccatggtgccgtcgatggagatggtgcgcatggtcagctccggcaccgaggcgaccatgagcgccatccgcctggcccgcggctacaccgggcgcgacagcatcatcaagttcgaaggctgctaccacggtcactccgacagcctgctggtgaaggccggctccggcgccctgaccttcggcgtgccgaactccccgggcgttccggcggccttcgccaagcacaccctgaccctgccgttcaacgacatcgaggcggtgcgcaagaccctgggcgaagtcggcaaggaggtcgcctgcatcatcgtcgagccggttgccggcaacatgaactgtgtgccgccggcgccgggcttcctcgaaggcctgcgcgaagcctgcgacgaacacggcgtggtgctgatcttcgacgaagtgatgaccggcttccgtgtcgccctcggcggcgcccaggcctactacggggtcaccccggacctgtcgaccttcggcaagatcatcggcggcggcatgccggtgggcgccttcggcggcaagcgcgagatcatgcagcagatttccccgctgggcccggtctaccaggccggcacgctctcgggcaacccgctggcaatggccgccggcctgaccaccatgcgcctgatcagccgccccggtttccacgacgaactgaccgcctacaccacgcgcatgctcgacggcctgcaacagcgcgcggatgccgccggcatccccttcgtcaccacccaggcgggcggcatgttcggcctgtacttcagcggcgccgacgccatcgtcaccttcgaggacgtgatggccagcgacgtcgaacgcttcaagcgcttcttccacctgatgctagacggtggcgtgtaccttgcgcctag

SEQ ID NO: 5527 - DNA, 642 bp, Pseudomonas aeruginosa
ggaggcgtcggcttatttcataatgtgagggtcagcgcatttcgttggccgggcagcccttgcccgccccgatccaggaggtgtcttcccctcatgttccgtaccggccgcaccctcgccctgggttgcctgttgatcctccagccgctgctcgcgcaggcgggaggcaactcgttgctgattccagcgaccggccgctgcgcgctgaacaccgttcccgaagaattgcagcaggcgctcgccgcctgccagcaggtcgccaatggcggcgacgccgaggcgcaatacgaactgggcgaattcttctacgacggcgagcgcatcccgcgcgacctccaggccgccctcaactggttcgagaaagcctcgctacagggccatgcccaggcccagtaccacctcggcaccatgttcttccgtggcgaaggggttccggcgaacaacgtacaggcctacatcgtgctgaagatggcagcggtgaacggcgccgaggacgccctggacagcgccgacctggtagccgagcagatgaaccgcgacgaactggacatcgccacccgggtgctggggcagatcttccgcaactacctgatcgaactgcagactgccggcggcgtcacgcccttcgcgccgctgccctga

SEQ ID NO: 5528 - DNA, 648 bp, Pseudomonas aeruginosa
tcgaggtcctgcaggacgtccccggcatcagcttcacccacttcaagcccaaggatgtggtccgccacccgctggtgcagcgtatcgtcgaagcctacgagcgtcacgagagccgccagcaaggccaggtgcggccggtcgagggaacgggcaagggcggtcacgatgccgcttgagctcgacctgcaggtcgctagcgccgccccggacctgccctccgaagcgcagttccgcgcctggtgcgaactggccctgcgccagcgtccggagtcggagctgaccatccgcctggtggacgaggccgaaggcctggaactgaacagcacctaccggcacaaggactacgcgaccaacgtgctgtccttccccgccgatgtcccggacgagcttctcgatatcccgctgctcggcgacctggtgatctgcgccccggtggtcgcccgcgaagccctggaacagcgcaagccgttgcaggcccactgggcccacctggtgatccacggctgcctgcacctgctcggctacgaccacatcgacgacgccgaagcggaagaaatggaaacactggaacgtgaattgctggcggaactgggtcatcccgatccgtacgcctgcgacgacgaagagccaccgagcaaggaaaaatga

SEQ ID NO: 5529 - DNA, 1137 bp, Pseudomonas aeruginosa
  unsure (1131): Identity of nucleotide at the above locations are unknown.
ccagttgcagggaccgctggccgggctggtgccggtgggtggcgtatggctgtcctccttcgtcatcgccctcagcgcggccctgctggtgaacctgccgcgcctcttcccgcacggtgccagcctgcttctggggctggtcctgctgctcggcccgtgggcggccggcctctatctcaagggccacgcctggacccattcggccggcgaaccgctgagggtagtggcgatccagggcaacatcgcccaggagctgaaatgggacccgaatcaggtccgcgcgcaactcgacctctaccgcgacctgagcctgccgcagcaggacgtcgacctgatcgtctggccggaaaccgcggtgccgattctccaggacatggccagcggctacctcggcgccatgggccaggtcgccgacgagaagaacgccgcgctgatcaccggggtcccggtgcgcgaacgtctcgccgacggcaagagtcgctacttcaacggcatcaccgtggtcggcgaaggcgcgggcacctacctcaagcagaagctggtgccgttcggcgagtacgtgccgctgcaggacctgctgcgcggcctgatcgccttcttcgacctgccgatgtccgacttcgctcgcggcccggccgaccagccgctgctcaaggccaagggctacgagatcgccccgtacatctgctacgaagtggtctacccggagttcgctgccgcgctcgcggcgcagagccaggtgttgctgacagtgagcaacgacacctggttcggcacttccataggcccgttgcagcacctgcagatggcgcagatgcgcgccctggaaagcggtcgctggatgatccgcgcgaccaacaacggcgtcaccggtctgatcgatccctatggccgaatcgtccggcagatcccgcagttccagcagggcatcctgcgcggcgaggtgattcccatgcagggcctgacgccctatctgcaataccgcgtctggccgctggccgggttggccggcgtgctgctgctatgggctctgctcggccgccagttgcgtccgcaggagcgacgcctgttcggctgaaaccagcccctcctggaaagaccggcgcccctgcggcgccggttgcgtctcancggtag

SEQ ID NO: 5530 - DNA, 1041 bp, Pseudomonas aeruginosa
cgccatgcacgagcaatatcagccactcgagatcgaaacccaggcccagaactactggaaagaacaccagtccttcctcgtcagggagctacccgacaaggagaagttctactgcctgtcgatgttcccgtatccgagcggcaagctgcacatgggccacgtgcgcaactacaccatcggcgacgtgatcagccgctaccaccgcatgcagggccgcaacgtgctgcagccgatgggctgggacgcgttcggcatgccggcggaaaacgccgcgatgaagaacaacgtcgccccggcggcctggacctacgacaacatcgcctacatgaagtcgcagctggacagcctcggcctggcgatcgactggagccgcgaggtcaccacctgcaagccggactactaccgctgggagcagtggctgttcacccgcctgttcgaaaaaggggtgatctaccgcaagaacggcacggtcaattgggatccggtcgaccagaccgtactcgccaacgagcaggtgatcgacgggcgcggctggcgctccggcgcgctgatcgagaagcgcgagatcccgatgtactacttcaagatcaccgcctacgccgaggaactgctggagagcctcgacaacctgcccggctggccggagcaggtgaagaccatgcagcgcaactggatcggcaagtcgcgcgggatggagatcggcttcccctacgaccaggcctccatcggccacgccggccaactgaaggtgttcaccacccgtccggacaccctgatgggcgccacctacgtcgccgtcgccgccgaacacccgctggccacccaggcagcgcagaacgacccgcagttgcaggcgttcatcgacgaatgcaagcgcggcggcgtcgccgaggccgacatcgccacccaggagaagaaaggcatggccacttccctgttcgtcgaacacccgctgaccggcgacaagctgccggtatgggtcgccaactacgtgctgatgaactacggcgaaggcgcggtgatggcggtgcccggccatga

SEQ ID NO: 5531 - DNA, 855 bp, Pseudomonas aeruginosa
cgccaaggccaaggtcgtcggcgcgcgcctgaagagcgacggccagccggtcgagatcggcggcaccgagaagatgtcgaagtcgaagaacaacggcgtcgacccgcaatcgatgatcgaccagtacggtgccgatacctgccgcctgttcatgatgttcgcctcgccgccggacatgagcctggagtggtcggacgccggcgtcgagggcgccaaccgcttcctccgccgcgtctggcgcctggctcacgcccacgtcagcgccggcctccccggcgcgctggacgtcgccgccctgagcgacgcgcagaagcaggtccgccgcgccatccacctggcgatcaggcaggccagccaggatgtcggccagcaccacaagttcaacaccgccatcgccgcggtgatgaccctgatgaacgtgctggagaaggcgccgaaccaggacgcccaggaccgcgccctgatccaggaaggcctggaaaccgtggttctgctgctggcgcccatcactccgcacatctgccacgtgctctggggccagctcggccatgccgaagcggtgatcgatgcgcgctggccgagcgtcgacgagagcgcactggtgcaggacaccctgcaactggtggtgcaggtcaacggcaagctgcgcggacacatcgacgtggccgccagcgccagccgcgaggatgtcgaggccgccgcgcgcgccaacgagaacgtgctgcgtttcaccgaaggcctgagcatccgcaaggtcatcgtggtaccgggcaaactggtcaacatcgtcgccaactgatacgcgattccattggacgcccccggccatccgggggcgctgatcaacaggagtga

SEQ ID NO: 5532 - DNA, 675 bp, Pseudomonas aeruginosa
gggaagcttgatgaaacgtatcctgaccagcgccgcgctgatcggtatgaccaccctgctggccgcctgcggcttccaactgcgcggcctgggcgatgcgcaattcgcgctcaaggaaatcgacgtgtccgcgcgcaacgcctacggcccgaccgtgcgcgaactgaaggaaaccctggaaaacagcggcgtgaaggtcaccagcaacgcgccctaccacctggtgctggtccgcgaggacaaccagcagcgcaccgtcagctacaccggttccgcgcgcggcgcggagttcgagctgaccaacacgatcaactacgagatcgtcggcgccaacgacctggtcctgatgagcaaccaggtacaggtgcagaaggtctacgtgcacgacgaaaacaacctgatcggttccgaccaggaagccgcgcagctgcgcagcgagatgcggcgcgacctgatccagcagttgtccatgcgcctccaggcgctgaccccggcgcaactcgacgaagcccagcgccaggcagaagccaaggccaaggcggaagccgaagccctgcgcgccgccgacgaggcggagcgccagcgccgcgccgccgagccgcagcagtcgccgatcgagttccccaccccgtgatgccccggggccggtttcgccggccccgtcttctcctatga

SEQ ID NO: 5533 - DNA, 201 bp, Pseudomonas aeruginosa
tgcgcgcgctggcgagcgccagcccgatcaccttcgaggacctatgccatggcaaagaaaagcaagcggccgaacaaggccaaatccctggtcgcccagccactgttccgcagccgccaggaacaggcgaagaaaggcaaaggcagctaccgccgcgaagcctcccgtaactgggaggcttctttcgttatggcggcctga

SEQ ID NO: 5534 - DNA, 321 bp, Pseudomonas aeruginosa
aagcctccggctggatcgccggacaaccctggggtttcgaagtccgcctgccggcaggcttcgactattccctggcggaactcaccatccgcaagcccctgggcgaatggcaagggatgggcgtacaaggcgtcaacggcggccccctgccctccggactctccggcgaacaggcctcgctgctgctgccggccgggcaccgcggcccggccttcctggtgctgcacaacttccgcgccatcctcaagtacaacaactccagcgcctacgccctggccgtcggcctgctcgccgacagcttcaagggcggcggccggatag

SEQ ID NO: 5535 - DNA, 1245 bp, Pseudomonas aeruginosa
gccgctcgcagcgcatcgagctgcaacggcaactggccgcccgcggacacgatccgggcgcggtggatggcatcatcggcgccaatacgcgcaaggcgatccgcgcctgccagcaggagttcggctggccggcggacggctatccgaccccggcgctgctcgaccgcctgcggacgccatagggccaccggcggagcttacgaccccacgtccgccgcgaccgctcgcggcacaccggttcgtagggcggataacgccatgggcgttatccgccgctgcggtgtccaggacctagtcatccgcgcagaaccgcaggatagcgtccgccacctgggcggccgcctcgcgctgcggaaaatggccgacgctctccagcaccagccgctggtagcgcccgctgaagtagtgctcgcgtccgcgggagccgtcggggtgggtgcaggcatccgcgccgccgtgcagcaccagggtcggcagcgccaggcgcggtgccgggagcaagcgctgttccgccgccccgtagcgcggctcccccgcgacgaagccccagcgatgccggtaatagtgcagcaccacggcgacccagtccggcccggagaaggcctgggcggcctcctggaaatcgcgctcggcataccatcccggcggcgaccaggtgtcccacatctgccgggcgaatgcctcgccctcctcgcgcagcgcgcgctctccgcgtggcgtagccatgaaccactggtaccagaagctacgggcctgcggcagggaaagaacttgctgcggatcgttgctggcgtaccccaccgagagcatcaccaggtgcgaggctacgccctcgcgcagtccgcaggcactagccaccgcgcgagccccccagtcatggccgaccagcaggggacgttgcaatgccaggctgtcgacgaatgccagcagatcgcaagccagagccgccagttgcccgctgcgcggagtagacgcatcgcggaaccgggtcggggcgaatccccggagggctggtgccagcacccgatagccggcgtccgccagggactccgccaggtctttccaggtatgcgggctgtccggccaaccgtgcaacaagacggcgctgcgcgccccctgcggattccactccaggtaggcgatatccaggacatcggcggaaacgaaggcatagcggctcatcggacctctccaagagaaagaagggacatcctaggacgcttgccaagggtgattcatgaatag

SEQ ID NO: 5536 - DNA, 1083 bp, Pseudomonas aeruginosa
aaaacgccgcgtccctgtgcagggacgcggcgtcggaaggcattggcgcggcgtagatcagccgatcttgttgccgtgcgcctgctggtcggcatggtaggacgaacgcaccagcgggccggacgcgacgttcttgaagcccatcttctcgccttcctcggcgaaccaggcgaaggtgtccggatgcacgaaacgctgcaccggcaggtggttgcgcgacggctgcaggtactggccgagggtcagcatgtcgatgtcgtgctcgcgcatccgctgcatgacctcgatgacctcgtcgtcggtctcgcccaggccgagcatcagcccggacttggtcggtacgtgcggaaccatctgcttgaacttctgcagcaggtccagcgaccactcgaagtccgagcccggccgcgaggagcggtacaggcgcggcaccgtctccaggttgtggttgaacacgtccggcggctcgttggcggtgatctccagggcgatgtccatgcgaccgcgatagtcaggcaccagggtttccagctggatccccggcgacagcttgcggatctcgcgcaggcagtcggcgaagtgctgggcgccgccgtcgcgcagatcgtcgcggtccaccgaggtgatcaccacgtacttcagccgcaggtcggcgatggcgatggccaggttggtcggctcgtcgacgtccagcggcttcggccggccatgaccgacgtcgcagaacgggcagcgtcgggtgcagatatcgcccatgatcatgaaggtcgcggtgccgccggagaagcactcgcccaggttcgggcaggacgcctcttcgcagacgctgtgcagcttgtgcttgcgcagcagttgcttgatgcggtcgacctcgggggaaaccgggatgcgcacgcggatccagtcgggtttcttcggcagttcctcggtgggaatgatcttcaccggaatccgcgcgaccttttccgcgccgcgcagcttcacgccgacttccaccttgcccggcttggcttctccggacttctccacaacagtgctcatgtcagttcgatcccgcccgtaagggtcttctgttcagcgtag

SEQ ID NO: 5537 - DNA, 1176 bp, Pseudomonas aeruginosa
caacagggtaaccagcgaagttccgccataactaatgaaaggcagcggtacccccaccaccggcaacaacccgctcaccataccgatattcacgaagacataaacgaaaaacgtcatggtgatgccaccggccagcagtttgccgtagagcgtctgcgcctgggcggtgatcaccaggccacgactgatcagcagcaggtagagcaccagcagcaggcagacgccgaccaggccgaactcctcgccgaggaccgcaatgataaagtcggtgtggctttccggcaaaaaatccaggtgcgactgggtgcccagcagccagcccttgccgaataccccgccggaaccgatggccgccttagactggatgatgttccagccggtgcccagcgggtcgctttccgggtcgaggaaggtcagcacccgctgtttctggtagtcgtgcatgatgaagaaccacatcgccacggcgatcggcaccgccgccgacaccgcgccgacgatccagcgccagcgcaggccgccgacgaacagcacgaagccgccggaagcgaggatcagcatggcggtgccgaggtcgggttgtttcaggatcagcacgaacggggtgatgatgatcgccaggctgatcaccatgtgcttgagccccggcggcaggttgcgcttggacaggtaccaggccaccgtcatcggcatcagcagcttcatgaactccgagggctggaagcggatcaccccggggatgttgatccagcgcgtcgcccccttggcgtcgtggccgatcacgtcgaccaccaccagcagcgcgacccccaccaggtagcccagcggcacccagcgggccatgaagcgcggctcgatctgggcgatgaccaccatcatgcccagtcccaggccgaacgaggtggcctgcttcatcagcatgtcccagctcttgccgctcgccgaatagaggacgaacaggccggtggcgccgaggatcagcaacagcagcaggagaatcccgtcgatgtgcaggcgctgcaacaggctggcgcgccggcgcatcacgtcttcgttggacagggtgcggtcgaagttactgttcaagggcgggcgcctccggctcggctgccgtgggttcgggcttggccaccgccgccgcgagcggcgcgacgggttccgcgtattcggccttga

SEQ ID NO: 5538 - DNA, 975 bp, Pseudomonas aeruginosa
caggaaatcctcgatgttcagtccgaaaccgagctgcgcgccccagttgatcggcgcgacgaagccgtgtacccagcggccgaagacggtggcgaaggccggttcggcgagtcgatggcggaaccagacgtacccggtgtaatgggcgctgggcgtgatgtgggcactgtcgacacgctctcgttcaaccatgattcaggctcttgttgttatcattcgccagcctatgactgccatggtcccagcgacaatcccatgtcccgcgatcccatccttagtttgccctggcccgacgcccggccgctccccgacaccttcttcgaccgcgatgcgttgctggtcgcccgcgagttgctgggcaaggtgatccgccatcgccagggcaatctctggctggcggcgcgaatcatcgagaccgaggcctactacctggaggagaaaggcagccatgcctcgctcggctacaccgagaagcgcaaggcactgttcctcgacggcgggcacatctatatgtattacgcgcgcggcggcgactcgctgaacttcagcgccggcgggccgggcaatgcggtgctgatcaagtccggccatccctggctggatcgcatcagcgaccacacggcgctggagcggatgcagagcctgaacccggacagccagggccggccccgcgagatcggccgcctgtgcgccggccagaccctgctgtgcaaggccatggggctgaaggtgccggagtgggacgcacagcgcttcgacccgcagcgactgttcgtcgacgatgtcggcgagcgccccagccaggtgatccaggccgctcggctgggcattccgaaggggcgcgacgaacacctgccgtaccgtttcgtcgatgccaccttcgccgccttctgcacccgcaacccactgcgccgcggccaggtcgccgggcgcgactatcatctactcggacatcaggacccgcacctgcaatga

SEQ ID NO: 5539 - DNA, 1557 bp, Pseudomonas aeruginosa
ccgcctgcttcgccagcgggcgcgtggccggactcggcgcgctggcctggttgcgcggcaggcgctagagaccggtacgccagcgcctcgctatttgccggacggccgcttcttcggcttgcccgccgcacccgcgccgaagcccggtgccttgcgcaccgccttgaccgtcggcgcgctgctgtcgaaccaactgcccaagtggatcttgccgggcttgccgacgctctccgcggccttgggtttcttcggcttcttcggtttcttcagcaccacgccgcccggtgcggtctgcggcacccggtgctccggctcgaagtcgggctcctcgcggcgttgcagggtctgcccgatcagtgtttcgatcgccgccagcagctccacttcgtcggcgcagaccagcgacaccgcctggccggaggcaccggcacggccggtacggccgatgcgatgcacgtagtcctcggcgacgatcggcaggtcgaagttgaccaccagcggcatttcctcgatatccaggccacgcgcggccacgtcggtggctaccagcaggtctacctcgccggccttgaaccgctgcaaggcgcgcagccgcgccggctgcggcttgtcgccatggatcgagtcggcggcgataccctgccgctgcaacagtccgaccagttcctcgacgctcttgcgggtcttggcgaagaccagcgcctggcgccagcgattggcctgcaacaggtggcagaacagctcggccttgcgcttcttgtccaccggcaccagccattgcctgacgctcttcgccgcggtattgcgcggactgacctcgatggacagcgggtcgcgcagcagttcacgggccagcgtgcggatggcgtcggagaaggtcgcggaaaacagcagggtctggcgcttgcgcggcagcgcggcgaacagttcgtccagctcgcgggcgaaaccgaggtcgagcatgcgatcggcttcgtccagcaccaacgcctggagctgggcgaacttcaccgcgttctgccgatacaggtcgagcagccgcccgggagtggcgacgaggatatccactcccttgcgcagcttcatcatctgcgggttgatgctgaccccaccgtaggccaccgcggtacgcagcggcaggtgctggccgtagtcgcggacgctgccgtggacctgctcggccagttcgcgggtcggaaccaggaccagtgcacgcaccgagttcgcagcgacctgcggcccctccagggtcagccgctgcagcaacggcagggcgaaaccggcggtcttgccggtgccggtctgtgctgcggcgagcaggtcgcggcccttgagcgccgggggtatggcttgggcctggatcggcgtaggcgtgccgtggccgagcccttcgagggccttgagcaggggggcgagcagaccgagggaagcgaacgtcatgagcgactcggaaaaaaggaaacggacggcattctagcggattcgccgtctcccatcgtcctctggagcgcggccggtcagcccttgagcagcagtccgccctcgatcggcacgtag

SEQ ID NO: 5540 - DNA, 648 bp, Pseudomonas aeruginosa
cgatgcccagcgctccgcacggtcccaggtcgccctgctgatcgtcgacctgcaacgcggcatgcagcgccacgacctgccgccgcgcaacaatcccggcgccgaggcgcgcatcgtcgaactgcttgccgcctggcgcgccgccggctggccggtggtgcacgtccggcacgtatcccggcagcccggctcgcccttcgcgcccggccagcctggcgtggagttccagccagcgctggcgccgcgcgacgacgaggcggtgttcgagaagaacgttcccgacgccttcatcaacagcggcctgcaacgctggctccatgtccgcgacatccgccaggtggcgctcgtcggggtagccacggagaactcggtggaagccagcgcacgcagcgccggcaacctcggcttccagacctgggtagtggccgacgcctgcttcaccttcgccaagcccgatttccacggcaccccgcgcagcgccgacgaggtgcatgcgatggcgttggccaacctgcacggcgagtacgccgtggttctgcgcgccgccgaactgttgcagcgcttgccggcctgactgtctgccgggcaacagcgggacaacagggctgtccggcagaagacaggccggttccgccatatcccccataa

SEQ ID NO: 5541 - DNA, 1164 bp, Pseudomonas aeruginosa
ccagcaccaccttggggcggtaggcccggctggctaaataccttgcgcggcatgcggtaccctcccgctcgaaaaaacgcgaacccttgcgtcaattcgacctgcaaggatgaaatgcgcggcggcaagctctatgctctggtcctttccagcatagtctcgattgcgatgtcactgccccgtctacgcaacctgctgttcgtcggcctgctcctgctggtcggcggtgccctgctcgccagctacctgctgagctggcaacccgccgatcgcgaagccgcgcccctgcattgccagggcgccgcgccggcgctgaagccggggcaggccctgaaggtgatgacctggaacatccagtacctggccggcaaacgctacgtcttctgggacgacctgccggatgccaccggcccggaccagcgccccaccgccgaagacctggcgttcaccctcgacgaggtggtccgggtgatccgcgacgagcagccggacctggtcctgctccaggagatcgacgacggctccagcgccaccgacgatcaggaccaactggcgctgatccaggagcgcatcaacgatctctaccattgcagcgcccaggcctacgagtggaagtcggccttcgtgccgacgccgcacatcttcggcagcgtcggccgcaagcaggccaccctgagccgctatcgcatcgatagcgccgagcggcgccagttgccgccacgcgatggcgggctgttcgaccgcctgttcgggccgcgcccggcgatcctggtcagccacctgccgatcgacggcggcggcgagctggccgtgctcaacgcccgcttcgaccgcccgcaggcgaacgacgacaccctcgagcgccaggtcgagaccacccgtacgctgctcgacgaactgcaggccaggcgcacgccctggctgctcggcggcgacctcaacctgctgccgcccggccagtatccctacctgctggcgccgctgcgcgcgccctaccgggaagacagcgaactgggcatcctgagcgggcgcttcccgatggtgccgtcgctggaagaggccagtggcgtcgaccaggttcgctggtacacgcacttccccaacgacccacgggtccaggggccggatcggacctcgactacctgttccacagcccctcgctga

SEQ ID NO: 5542 - DNA, 1344 bp, Pseudomonas aeruginosa
cccgtctcgatgcccgggtccggcgcagcgatacgctgcagatctccaaccacctgccgctcgccgcgcgcttcctgctgccccattgaccgggcgcgcgccgggctggacaagcggcccggcgcgccgcatgcttcgcccccattcataacaacaaaaaacggcaaggccgcacaccatgcccctacgcaccacaacgcccctgctcgcgctgctggcgttcgccctgctggccgccccgcagctccatgcgcaggacgcaaggccgtcgttgaacgtcggctactacgaattccccccctacatctataccgcccgggatggccacgccgccggttccggcgcccgcctggtccgcctgctgctggagcgggccggctatcgtccggcgttccgcgccctgcccagcgcgcgcctgtacctggggctgcaggatggcagcgtggcgctgtgggccggcgcggccaagccggagctggccgccgacaccctccaggcgcggcgcgtgctcggccacgtcagcctgaacctgtactacccggcgcaccagccggcaccgcgggttccccaggacctggccggacgccggctgatcctgatcagcggctacagctactggaaaccggtcaccgacttcatccaggaccccaacctgcacctgcgcctgtaccgcaccggcacccaccacgccgccttgcgcatgctcgaactcgggcgcggcgactacctgctcgactaccaggcgccggtggaagcggccagccgccaggcgttggcaagccaggaactgtaccgcctgccgctgcggatgatcgtctcgcgccacattcccggcgccgaagcgctgcgcgaccgcctggaccaggcctacgaccagttgcggagcgacggcgccgacctgtccctgctgtgaaccgaccccggaggaggagcccgatgcataccgccatcccctgctgcacgatcaacggcgaacagcccgccctgcgcggacaggtctgccagtcgctgctgatccaggaatggtggtgggaaggccgtccggccgatccggtgaacgtggtctacctgcagttcgagcaacgctggtatcgcctctacttcgagggcgagacggtgttctggcgcagcggcgaagcgccgcggccctgcgagaacgacgaaggcccgggcgagtaccgcctgcacgacctcggccggcagcgcggcctggtcggcgtgcgcctgctggccctggagttcgtcctcaacggcccgaccctggacagccacttcgacttcgccgacggccagcgcctgagtttccggcacttcctcgacgacgacctgacccgggtgctctga

SEQ ID NO: 5543 - DNA, 513 bp, Pseudomonas aeruginosa
attcatgatcaggattacccgaggccatctccaaagcccttctgcgaagggttttggcttgcccctccgggggacggctctcgtgaaccaaaccccggctgcgcctggttttggccctgcgggcttccatcctcaggggacgtcgttcatcgccgagaggttgacgcttcagcacgtcagcggccacattcgaagcggtctcctccgctacaccccaaatgggccggtaagcgtgagatcgcagcgcgtcagcggtcactcgagatcgagacgttggtgacttggcaaaacaaaggggttgaaatgaacctacagctagaacttatgaataaaaacatatccatgctccagacagagataaaatacctgcaaattaaaatgcaagagtccagacacgtaggtgaccaagaaaagcatagccaaatgttagagcagcaaaataatgcagcctactacctcgaacatgcaacaaagacgaagaccaagataattatgaatatccataaaagctag

SEQ ID NO: 5544 - DNA, 1416 bp, Pseudomonas aeruginosa
acgctgcccggtgaacaggcaatcggtaaccaaagcgtcgatagttttggtggcacggccatgtctgatttttcccctctcagcattttcaaatcgcaagccaaacagcatgcccgcaaacatggcatgaagctttctgctgcccaagaagcgctttcccgtagagcggggttcgagaagtaccacgagcttgccgttgtcgcccaacgaaaccccacagatcctcgcttgatgcttgctgcctttggcgtgcgtgacttcaaggacgcgatccatgaggacgatgtgttttctaggctgggacacatgctgaccggctcgatggccaaggccaacgccagtgagttctccatcggtgaaagcgaggtggagtcagccacctatgaccatgcgaccggtgtgctcgcgttgagcatgtcgatcacctaccaaaagcatcaggatttagaccgcgccttccacagcagtgcatttctcctaaaagcggatgtcgagctgattcgacgcgatggcaaatggtcgctcggtgaagacggcgtttcaatcaccagtaacgattcggatcgtgcagctcactggcacgttctagtaacgaatgaggccaagaacatgtatcaaaaagaccattccccccacgaaaagccaatcgaaaagctcagcgaagatgggaagcggataaaaaacccgaacgagattactgtaaatcaacacgtcatcccccaagcgcatttgaagcaatggctaggtggtgaagacctgctcacagtcgtcgataaatcgagtggcaagcccctgaagcgctcacctaagaactcgtttgttgtttcccgtctttgggatcagcctactgaacagggcatgatcaaaatgaacgaggacaattatcagcagcaactgacgttactcgcagagaccggaagcatcgcccaatccccctggatcacagaatacttcgtgatgctggcagcacgggcctactttgccgccaaagaaaggccgctctacgactccatcatggagccgccgtcctgggcgccgtctcaggctgagcttgaagatgatgaggttgagcaggtgcatgataccgttcgaatcttcaggggcgctggaaatccacatgccacagcccgcacagttgtgagcatggcactcacccaattcttcatcagggcgcgcgagttgctgaaggacgctgtgtgggtgccttttaagacgacgggggagaaatttattctccccgactcgaacgtagccctgtacgaaaagcgcttcatggcactgcccgtgagcccggagcttgtgctgcttgacgagaagctgctcgccaagctccaagaggccggccaacttacaccggagtacctcaacaagcgcttcctggagtcttcggtgcgctactacgttgcccccaagtga

SEQ ID NO: 5545 - DNA, 183 bp, Pseudomonas aeruginosa
gctaagccgacgctgaagcgcaagcggagcgcgctaggcgtgaggatggaagcccgtaagggtggagacacgcagtggctcgattcacgacagccgctcccgcagggcacgcccaaacctcaaggtttcctaggcttcgccctggccgtcgcttcagcaaccaatggatcttcaggccaatga

SEQ ID NO: 5546 - DNA, 249 bp, Pseudomonas aeruginosa
gcctgctcgccggcctcaccgactccctgctggacagtgccgcctcgctgctcaacctgctggcggtgcactattcgctgcgcccggccgacgacgaccaccgctacggccacggcaaggccgaggccctggccggcctggcccaggccatgttcatcggtgccagcgcggtgctggtggctatccaggcggtcgagcaattgcgcgacccgcagcccctcggcgcggccacctggggcatcgcggtga

SEQ ID NO: 5547 - DNA, 423 bp, Pseudomonas aeruginosa
atcccgacgacgcggtgcaggcccatcgcacgctgcaggcgcagaccagcatggccatccacttcggtaccttcaatctcaccgacgaacagcaggacgacccgcccaaggcgctccaggcggcgctgcgcagccaaggcgtggacccggcgaccttcggcacgccgaaacccggcgagcagtggcgcgtcgcaccgcgcaacgtcgctcaggaggccgaggccaccaggcgggagcagcagttgcggtagcgcttgccgctgccgcacggacaagcctggtcgccacggccgcccagggccagccagctttccaggcgcgcggccatcccggccaggcgctcgcgggcctcatcgtccaggccggcgcgggccagttggcgccgcaggccgaggtagtcttccagcaggacatcgcggctga

SEQ ID NO: 5548 - DNA, 2109 bp, Pseudomonas aeruginosa
  unsure (1876): Identity of nucleotide at the above locations are unknown.
aagcgcgccgcggtttccgcacggaaaccgcggcgcgtccgatcaacggaacggcggctcgtcgaaactccgcagcttgcgcgagtgcagcgagttgagctggctgcgcaacaggtcgagggcggcgatgccgatccgcaggtgctggttcaccgcgcgctcgtagaaggcgttggccgagccgggcagcttgatctcgctgtgcagcggcttgtccgagacgcacagcaacgtgccgtagggcacccgcaggcggtagccctgggcggcgatggtgccgctctccatgtccaccgcgatggcccgcgccaggttgatcagtggccgctcctgggcccagcgcaactcccagttgcggtcgtcgtaggtgagcacggtgccggtgcgcaagcgtcgcttgagcgactcgccgcgctcgccggtgacttcggcggcggcttcctgcaaggcgacctggacttcggccagcgccgggatcgggatgtgcggcggcagcgcgcggtcgaggatgccgtcgcggcgcatgtaggcgtgcgccagtacgtagtcgccgatggtctgcgactgccgcaggccgccgcagtggccgatcatcagccagcaatgcggacgcaacaccgccaggtggtcggtgatgttcttcgcgttggacgggccgaccccgatgttgaccagggtgataccgtcgccatcggcggcgatcaggtggtaggccggcatctggtagcggtgccagaccaccccggcgacgatggcgttggcctcgccttcgtccatcccgcgttcgatgatcacgttgcccggcaggaccatgcgcacgaagcgcgggtcctcgcgcaggcgggtcaggccgaggcggatgaactggtcgacgtagcggtggtagttggtcagcaggatccacggctgcacgtggcgccagtcgctgccggtgtagtgcaccaggcggcgcagggagaagtccacccgcgcggcgtcgaacagcgccagcggcaactggtcggcgcgttcccattcgtagaggccgtcggcgatgtcgtcggaagcggcggacaggtcggtgctggggaacacccgcgccagctcggcggcggtcaccccggagccggccagctcgtcgccctgctcgaccacgtagggataggggatgtcctgttggctcgggccgacctgcacctgcacggtgaaatcgtccatcagcggacgcaactgttccagcaggtacttgcggaaggcgtcggggtgggtgacggtgacgctgtattcgcccggcacctggaccttggcgtaggcgcgggtggtggacggcacctcgccctggcagcggtagccgatgcgcagttgcgggtagtggaagttctgccgctcggcctcgcttggctcgatgcgctccttgatgtagcgcttgagcgcctggctcagcgccgcggtggcctggcggtgcagctcggcaagacggtcgacggcctcctcggccgtgcgggcgacgacgaacccgtcgtcggaatcgatactcatggtgggcttcctgtcggttcgcatggaaaacatcttgcctgtaccgacaggaaaacacagcgcttttctcccgttatctcattcggccagcgccaccaccgccatggtcacggtggccttgctgaacaggtgccgccgaccgtcccgctcggcgaacacctcggcctcgaccaccgtcacctggcgcccggccttgagcacctcggcgcgacacaacaggcgctggcaaagcgccgggcgcaacaggttgagcttgaactccagggtcagcaccgtctgcccctcctccaccagggtcgcggcggcggccccggcggcatggtccgccatggtctcctggatcccggcatggatgaancctttctgctgggcgtggcggggccaggatgtccagccccgcttcgacccaacccggcccgcagtccagcggacggatgccgaggtcgccgacgaaactggccgcggcgaagccctgctcgaccagctcccggtagcgcggatgcgcctgcatcgcgacgcgcctcaggccagtgcggggtggcgcgagccaacagcgcctcgacctcgacgccgcgcgggagggtgccgtag

SEQ ID NO: 5549 - DNA, 702 bp, Pseudomonas aeruginosa
aggttggcgccatccagcgacggtacctggttggtcacttcgtgggtttcggcgtactggtgcaggttcatgagggttcctcgcagacaggcgcgcccaccgcgcgcaggcagaagttcaccagagccgtactcaccggctccagactcggttccggctggccgctgtcgcgagcggcgcgcgccgggggagacaaggggccgaccagcgcctcggcgatggccccgaccaggcaggccgcggcaagcggcaccagggaaagctggaatgcgccactgcgccggccctcctcgagcagttcgacgaacagtgcggcgtatgcctcgcgatagcgcaggcgctgctcgtcgacttcaggatccaccggctcggcgatcagggcgaaggccagccgctggctgctccaggcgcgcgcggcaaagcgccgcaagccctcggccaggcgccaggcgggcgcgccgggaccgcgcaggaccacggccagggcatcgacctcacgctggctggcgcggcggaagatttccgccgccagctcgcccttgccccggaagtggcggtacaggctgccggtggcaatccccgcgtcgtcggccagggcctgcatggtcagcgcggcgaaaccgccctccgcgacacgccgcaggcctagctggaggatgcgctcgcgcagcgcggaatcgcgttgcaggcggcgttcggtga

SEQ ID NO: 5550 - DNA, 1020 bp, Pseudomonas aeruginosa
tgccccgcagtgctcctcgaacggaccgggagccccacctccctcgtcatggtccgcccttggcgagcgttgtatgaatattccccgaagtttagcacacgccagtccacgtcgggcccgggacgtgtcacgcagggcccgggcgcggcgcccgaaaggtggtccgcgcagccgccacgaagcgcttttagtggtaagctcacgcgccatgaaaacaccgacttcccgccccgtagtgctctgcctgtccggtcacgaccccagtggtggcgccggactgcaagccgacatcgaagccctgctcgcccagggctgccacgccgccccggcggtcaccgcgctgaccgtgcaggacaccgtcaacgtcagcgacttccgcgtcctcgaccgcgagtgggtgctggcccaggccaacgccgtactcgccgacctgcccgtcgcggcggtcaagctgggtatgctcggttcgctggagatggtcgacacggtggccgagatcctcgccgcccacccgcacttgccggtggtctgcgatccggtgctgcgcgccggcggcggcggtgcgttgggcaagggcgacgtcggcttcgccatgcgcgagcggctgctgccgcgcgccaccatcgccacgccgaacctgccggaagcgcgcctgctcgccgacctgcccgagggcagcgccgaccagtgcgccgagcgcctgctggaacactgcgagcacctgttgatcaccggcggacacggcgacgaaagcgaagtgcacaatcgcctgtacagccgcgacggcagccgccgcaccttcacctgccagcgcctgcccggcagctaccatggctccggctgcaccctggccagcgccctggccggtcgcatcgccctcggcgaagcgctgcacggcgccgtgcagagcgccctcgactacacctggcggaccctgcgcgacgccgagagtccgggccacggccaatacgtgccgcgccgcctgcccaccgacttctgtcactgagagccagccgatga

SEQ ID NO: 5551 - DNA, 1464 bp, Pseudomonas aeruginosa
tccatgcgctgttcgccgccgcgtccgccgccgaggtggaacgccgcgcccgcgccttcagcgccctgttcgaacctgcctgacgcctccgcgcctcgcccgagagatagagagctagccatgtcccgttccgaaacgctgttcaacaacgcccagaaacacattcccggcggggtcaactccccggtgcgcgccttcaagagcgtcggcggcaccccgctgttcttcaagcacgccgaaggcgcctatgtactggacgaggacgacaagcgctacgtggactatgtcggctcctggggcccgatgatcctcggccacagccatccggacgtgctcgacgcggtgcgccggcaactcgaccacggcctgtcctatggcgcgccgaccgcgctggaagtggaaatggccgacctggtctgctccatggtgccgtcgatggagatggtgcgcatggtcagctccggcaccgaggcgaccatgagcgccatccgcctggcccgcggctacaccgggcgcgacagcatcatcaagttcgaaggctgctaccacggtcactccgacagcctgctggtgaaggccggctccggcgccctgaccttcggcgtgccgaactccccgggcgttccggcggccttcgccaagcacaccctgaccctgccgttcaacgacatcgaggcggtgcgcaagaccctgggcgaagtcggcaaggaggtcgcctgcatcatcgtcgagccggttgccggcaacatgaactgtgtgccgccggcgccgggcttcctcgaaggcctgcgcgaagcctgcgacgaacacggcgtggtgctgatcttcgacgaagtgatgaccggcttccgtgtcgccctcggcggcgcccaggcctactacggggtcaccccggacctgtcgaccttcggcaagatcatcggcggcggcatgccggtgggcgccttcggcggcaagcgcgagatcatgcagcagatttccccgctgggcccggtctaccaggccggcacgctctcgggcaacccgctggcaatggccgccggcctgaccaccatgcgcctgatcagccgccccggtttccacgacgaactgaccgcctacaccacgcgcatgctcgacggcctgcaacagcgcgcggatgccgccggcatccccttcgtcaccacccaggcgggcggcatgttcggcctgtacttcagcggcgccgacgccatcgtcaccttcgaggacgtgatggccagcgacgtcgaacgcttcaagcgcttcttccacctgatgctagacggtggcgtgtaccttgcgcctagcgccttcgaggccggcttcacctccatcgcccatggcgacaaggagctggaaatcacgctgaacgccgccgaaaaaagccttcgccgcgctgaaatgatcctcttcgcggcgcccttcccgggcgccgccctcctccccgccggaacgccttcctag

SEQ ID NO: 5552 - DNA, 1266 bp, Pseudomonas aeruginosa
accttcccgccgccacggtgcaccaacgtttcagcgggaaccgggaaagcgccgccgcgatacggcaactttgcgcgacgatatccagcggttattctcttctctatcaatcagccactggcgagtacgacagaacaccttgaacgccccccaggaacttcatcgctttatcctcgagccgttcgacgcccgcagcttcgcgacactttgcgggcagttcgacgagcatctccaccagatcgagaaacgcctcgacatcgagatccgcaaccgcggcaaccagttcgaactggccggcgaaccgcgccggaccaaggttgccgaacgcctgctgcagcgtctctaccgcgaggcgcagaacggcaccgatctcactcccgacaccgtgcacctgtacctgcaggagtccggcctggaagacctcgaggaattgcagagcgcgccgcaggtcaccctgaaatcgcgcaaggcgcacatccgcccgcgcggcgccaaccagcagcgctacgtcaaggcgatcctcgaccacgacatcaacttcggcatcggcccggccggcaccggcaagacctatctcgccgtggcctgcgccgtcgacgccctggagcgcgagcagatccgccgcatcctgctggtgcgcccggcggtcgaggccggcgagaagctcggtttccttcccggcgacctgtcgcagaagatcgacccctacctgcgcccgctctacgacgcgctctacgagatgctcggcttcgaacacgtggccaagctgatcgagcgcaacgtcatcgaggtcgcgccgctggcctacatgcgcgggcgcacgctgaacaacagcttcatcatcctcgacgagagccagaacaccacagtcgagcagatgaagatgttcctcacccggatcggcttcggctccaccgcggtgatcaccggcgacgtcacccaggtcgacctgccccgcggcacccgctccggcctcaagcacgtgatcgaggtcctgcaggacgtccccggcatcagcttcacccacttcaagcccaaggatgtggtccgccacccgctggtgcagcgtatcgtcgaagcctacgagcgtcacgagagccgccagcaaggccaggtgcggccggtcgagggaacgggcaagggcggtcacgatgccgcttgagctcgacctgcaggtcgctagcgccgccccggacctgccctccgaagcgcagttccgcgcctggtgcgaactggccctgcgccagcgtccggagtcggagctga

SEQ ID NO: 5553 - DNA, 1545 bp, Pseudomonas aeruginosa
ggacattcgatgcgttggatttctcgtcccggctggcccggacacctgctggcactcgccgcaggcgcgctcacacccctggccctggcgcccttcgattactggccgctggcgatcctctcgatcgccctgctctatctcggcttgcgcggccttcccggcaagtccgccctgtggcgcggctggtggtacggtttcggcgcgttcggcgccggcaccagctggatctacgtcagtatccatgactacggcgccgcctcggtgccgctggcaagcctcctcatgctcggcttcaccgccggcgtcgccttcttcttcgccctgccggcctggctgtgggcgcgctgcctgcgccgcgacaacgcgccgctgggcgacgccctggcgttcgccgccctgtggctggcactggagctgttccgcagttggttccttaccggtttcccctggctctacgccggctatagccagttgcagggaccgctggccgggctggtgccggtgggtggcgtatggctgtcctccttcgtcatcgccctcagcgcggccctgctggtgaacctgccgcgcctcttcccgcacggtgccagcctgcttctggggctggtcctgctgctcggcccgtgggcggccggcctctatctcaagggccacgcctggacccattcggccggcgaaccgctgagggtagtggcgatccagggcaacatcgcccaggagctgaaatgggacccgaatcaggtccgcgcgcaactcgacctctaccgcgacctgagcctgccgcagcaggacgtcgacctgatcgtctggccggaaaccgcggtgccgattctccaggacatggccagcggctacctcggcgccatgggccaggtcgccgacgagaagaacgccgcgctgatcaccggggtcccggtgcgcgaacgtctcgccgacggcaagagtcgctacttcaacggcatcaccgtggtcggcgaaggcgcgggcacctacctcaagcagaagctggtgccgttcggcgagtacgtgccgctgcaggacctgctgcgcggcctgatcgccttcttcgacctgccgatgtccgacttcgctcgcggcccggccgaccagccgctgctcaaggccaagggctacgagatcgccccgtacatctgctacgaagtggtctacccggagttcgctgccgcgctcgcggcgcagagccaggtgttgctgacagtgagcaacgacacctggttcggcacttccataggcccgttgcagcacctgcagatggcgcagatgcgcgccctggaaagcggtcgctggatgatccgcgcgaccaacaacggcgtcaccggtctgatcgatccctatggccgaatcgtccggcagatcccgcagttccagcagggcatcctgcgcggcgaggtgattcccatgcagggcctgacgccctatctgcaataccgcgtctggccgctggccgggttggccggcgtgctgctgctatgggctctgctcggccgccagttgcgtccgcaggagcgacgcctgttcggctga

SEQ ID NO: 5554 - DNA, 438 bp, Pseudomonas aeruginosa
  unsure (53): Identity of nucleotide at the above locations are unknown.
aaccagcccctcctggaaagaccggcgcccctgcggcgccggttgcgtctcancggtagaacaggcgatagccgaccaggccgatcgcctcgttcagcagcatgccgctctgccagaaggcctgcgcttccggcagccagccgccgaagggccgcaggttggccccgccgaggaaaccgaccggcgccgggatcacctcgaacccctggcgctcgaagctccagcgtgcccgctgcatgtgccaggcctgggtcaccagcaccacccggcgcacgccggcccccccgcaactgcgggggcgctcagggtggcgttttcccaggtggtacggctgaaaacttcctgccagcgcgtcggcacccccaaatcctgcatcaaggcattggccatcaacgccgcctcgctgggcggggctccgtaatgccaacccgccgctga

SEQ ID NO: 5555 - DNA, 564 bp, Pseudomonas aeruginosa
agaaataacggatcggcatcgccccctccctgtcggaagaggcaatctaaaggattgcgcgacgcctggcgaaacttccgggaaggagaccctagcggtcgttgcccgaacggaacagttgcgagccgcaatggccgcacggcaacacgccatgccccttgctccactgcaccggcgcaccgcagagcgcacagagcagttgccgctgtttcaacgagacgtgccgacggggcgccggcggttgcggccggggtgtcctgccgggctggcgctcgagcagcgccagctcctcggcggccgcatgccagccgcgcaaccagtgcaggtcctggtcgagataggcgcgtatcagccccatctccgcttcgctcaaaccacgcaactcgagctccgtgggatgctcgtcacgcaggcgctcggccgtatccgcttcatccagagccagggcgagacgctgcagcagcctctcgtacagcccacctcccgtcacactcgcgcgttgcagctcagccatcgaacacctctgaaggtaccactgggcagccagccatcgacggcccatag

SEQ ID NO: 5556 - DNA, 2742 bp, Pseudomonas aeruginosa
ggcaagcttagcgttcccgttcggctgaaccgcccccggcgacaaacggcgcgggctatcgacaggagtgggggtcatgtatgctacgaggctttcgaacagtcacgtctaagtagcgccatgcacgagcaatatcagccactcgagatcgaaacccaggcccagaactactggaaagaacaccagtccttcctcgtcagggagctacccgacaaggagaagttctactgcctgtcgatgttcccgtatccgagcggcaagctgcacatgggccacgtgcgcaactacaccatcggcgacgtgatcagccgctaccaccgcatgcagggccgcaacgtgctgcagccgatgggctgggacgcgttcggcatgccggcggaaaacgccgcgatgaagaacaacgtcgccccggcggcctggacctacgacaacatcgcctacatgaagtcgcagctggacagcctcggcctggcgatcgactggagccgcgaggtcaccacctgcaagccggactactaccgctgggagcagtggctgttcacccgcctgttcgaaaaaggggtgatctaccgcaagaacggcacggtcaattgggatccggtcgaccagaccgtactcgccaacgagcaggtgatcgacgggcgcggctggcgctccggcgcgctgatcgagaagcgcgagatcccgatgtactacttcaagatcaccgcctacgccgaggaactgctggagagcctcgacaacctgcccggctggccggagcaggtgaagaccatgcagcgcaactggatcggcaagtcgcgcgggatggagatcggcttcccctacgaccaggcctccatcggccacgccggccaactgaaggtgttcaccacccgtccggacaccctgatgggcgccacctacgtcgccgtcgccgccgaacacccgctggccacccaggcagcgcagaacgacccgcagttgcaggcgttcatcgacgaatgcaagcgcggcggcgtcgccgaggccgacatcgccacccaggagaagaaaggcatggccacttccctgttcgtcgaacacccgctgaccggcgacaagctgccggtatgggtcgccaactacgtgctgatgaactacggcgaaggcgcggtgatggcggtgcccggccatgacgagcgcgacttcgagttcgccaacaagtacggcctgccgatccgccaggtgatcgccaaggtcgagggcgacaacgacttcgagtccagcgtctggaaggagtggtacggcgccaaggacgagtccgtgctcaccgtcaactccggcaagtacgacaacctcggctaccaggccgccttcgacgccatcggcgccgacctcgaggccaagggcctgggccaggcacgcacccagttccgcctgcgcgactggggcatcagccgccagcgctactggggctgcccgatcccgatcatccactgcgaggcttgcggcgacgtcccggtgccggccgaccagttgccggtggtgctgccggaagacgtggtaccggacggctccggttcgccgctggcgaagatgccggaattctacgaatgcaactgcccgaaatgcggccagccggccaaacgcgaaaccgacaccatggacaccttcgtcgagtcgtcctggtatttcgcccgctacgcctgcccgcagttcgaaggcggcatgctggacaggaaggcggccgactactggctgccggtcgaccagtacatcggcggcatcgagcacgccatcctgcacctgctctatgcgcgcttcttccacaagctgatgcgcgacgaaggcctggtcggcagcgacgaaccgttcaagaacctgctgacccagggcatggtggtcgccgatacctactaccggaccaccgccaacggcggcaaggactggttcaacccggccgacgtcgaggtcgagcgtgacgccaaggccaaggtcgtcggcgcgcgcctgaagagcgacggccagccggtcgagatcggcggcaccgagaagatgtcgaagtcgaagaacaacggcgtcgacccgcaatcgatgatcgaccagtacggtgccgatacctgccgcctgttcatgatgttcgcctcgccgccggacatgagcctggagtggtcggacgccggcgtcgagggcgccaaccgcttcctccgccgcgtctggcgcctggctcacgcccacgtcagcgccggcctccccggcgcgctggacgtcgccgccctgagcgacgcgcagaagcaggtccgccgcgccatccacctggcgatcaggcaggccagccaggatgtcggccagcaccacaagttcaacaccgccatcgccgcggtgatgaccctgatgaacgtgctggagaaggcgccgaaccaggacgcccaggaccgcgccctgatccaggaaggcctggaaaccgtggttctgctgctggcgcccatcactccgcacatctgccacgtgctctggggccagctcggccatgccgaagcggtgatcgatgcgcgctggccgagcgtcgacgagagcgcactggtgcaggacaccctgcaactggtggtgcaggtcaacggcaagctgcgcggacacatcgacgtggccgccagcgccagccgcgaggatgtcgaggccgccgcgcgcgccaacgagaacgtgctgcgtttcaccgaaggcctgagcatccgcaaggtcatcgtggtaccgggcaaactggtcaacatcgtcgccaactga

SEQ ID NO: 5557 - DNA, 690 bp, Pseudomonas aeruginosa
tacgcgattccattggacgcccccggccatccgggggcgctgatcaacaggagtgagggaagcttgatgaaacgtatcctgaccagcgccgcgctgatcggtatgaccaccctgctggccgcctgcggcttccaactgcgcggcctgggcgatgcgcaattcgcgctcaaggaaatcgacgtgtccgcgcgcaacgcctacggcccgaccgtgcgcgaactgaaggaaaccctggaaaacagcggcgtgaaggtcaccagcaacgcgccctaccacctggtgctggtccgcgaggacaaccagcagcgcaccgtcagctacaccggttccgcgcgcggcgcggagttcgagctgaccaacacgatcaactacgagatcgtcggcgccaacgacctggtcctgatgagcaaccaggtacaggtgcagaaggtctacgtgcacgacgaaaacaacctgatcggttccgaccaggaagccgcgcagctgcgcagcgagatgcggcgcgacctgatccagcagttgtccatgcgcctccaggcgctgaccccggcgcaactcgacgaagcccagcgccaggcagaagccaaggccaaggcggaagccgaagccctgcgcgccgccgacgaggcggagcgccagcgccgcgccgccgagccgcagcagtcgccgatcgagttccccaccccgtga

SEQ ID NO: 5558 - DNA, 600 bp, Pseudomonas aeruginosa
accgctgctctgccaggaagcctgcgatgccattcgccaggcctgccgcgagcgcgacttcggcgagcgccaggtattcaatgccgaagccaacttcgattggggcttgctgctggaggccggcgccagcctgtcgctgttcgccgagaagcgcctgatcgaactgcgcctgccctccggcaagcccggcgacaaaggcgcggcgattctccaggaatacctgcaacggccgccggaagacaccgtgctcctgctcagtctgcccaagctcgatggcagcacgcagaagaccaagtgggccaaggccctgatcgatggcaacgccgcgcagttcatccaggtctggccggtcgacgtccaccagttgccgcagtggattcgccagcgcctgtcccaggccggcctgtccgccagccccgaagccctggagctgatcgccgcgcgcgtggaaggcaacctgctcgccgccgcccaggaaatcgaaaagctcaagctgctcgccgagggcaaccagatcgacgccgccaccgtacaggccgcggtcgccgacagcgcacgcttcgatgtcttcggcctgatcgacgctgcccttggcggtga

SEQ ID NO: 5559 - DNA, 411 bp, Pseudomonas aeruginosa
gacgaacgcaccagcgggccggacgcgacgttcttgaagcccatcttctcgccttcctcggcgaaccaggcgaaggtgtccggatgcacgaaacgctgcaccggcaggtggttgcgcgacggctgcaggtactggccgagggtcagcatgtcgatgtcgtgctcgcgcatccgctgcatgacctcgatgacctcgtcgtcggtctcgcccaggccgagcatcagcccggacttggtcggtacgtgcggaaccatctgcttgaacttctgcagcaggtccagcgaccactcgaagtccgagcccggccgcgaggagcggtacaggcgcggcaccgtctccaggttgtggttgaacacgtccggcggctcgttggcggtgatctccagggcgatgtccatgcgaccgcgatag

SEQ ID NO: 5560 - DNA, 1887 bp, Pseudomonas aeruginosa
gtcgatctgcaccggcagcacggcggccgcatgctgcgccggcggcggagtgtaggtctcgatcggctgggccatcgccaccgcctgcgtctgcgccgcggcgggagcggcctgggccaccgcctgcttgggctgcgccaggaccatcggtgccggccggccgcgctgggcccaccactgcaccgggtcgatgccttcgaccttgacccgcgcggtgccggtctcggcataaccgagcttcttcgccgcggcgaaggacaggtcgatgacccggtcggaatagaacgggccgcggtcgttgacgcggacgatcacgctcttgccgttgtccaggttggtcacccgcacatagctcggcaacggcagggtcttgtgcgcggcggtcatgccgtagaggtcgtaggtctcgccgttggcggtggcctggccgtggaacttggtgccgtaccaggacgcggtgccgaccatccggtaggcccgcgcatcgttcatcgggtagtaggtcttgcccagcacggtgtaggggttggccttcaccgaaccgttgtgcggcatcggtaccgcatcggggatccgcgacacgtcgacgtcccaccagggggcgccgtcgcgatgcggacgggaatagtcgccccgcccggaaatgcccgcctggcctggccggctgctggggcgccttgctggagcaactgctcaacagcacggccgccagcccggaggcggcagacggcgggcaggatcagggaagagcgggacacgcttgctcaatgggcacctggcgcgcggggcatctccccccgccagctgataaaccgccatggcatacatggcgctgcgattatagcgggtgatcacgtagaagttcggcaaaccgacccaatactcgatgcccttgtcgccgacgaaacgcatcgccgtgaccttctggtcgtcgcgcagcgcatcgtgggtgcgccagccgcgggcacgcagctcgcccaggctcatggtcgggtcgacgcccctggtcaccgcgctctcggcgctctcgtcgttgatctcggccaccgagaccaccggctcgccggtgacccagccgtgctgcttgaagtagctggcgacgctaccgatggcgtcggtcgggtcgctccagatattgatgtggccatcgccgtcgaagtccaccgcgtaggcgcggaagctgctcggcatgaattgtggcaggcccatggcgccggcgtaggagccggtcaggctgagcgggtcgacctgctgttcgcgggcgagcaggaggaactcgcgcaactccttgcggaagaagtcggcccgcggcgggtagtcgaagccgagggtggacagcgcgtccatcacccggtaactgccggtgttgcggccgaagaaggtttccacgccgatgatcgagacgatgatctcggccggcacgccgtattccttctccgcccgcaccaggtcttcggcatgcttgttccagaagtcgacgccacgactgatgcgcgcgtcgctgatgaagatcggccggtattccttccactgcttgacccgctcggccgggcgcgagatcgcatcgaggatcgactgcttgcggttcacgtcgcggaacagccccatcagctgctctccggcgaagccgtagtcgcgggtcatttcgctgacgaactcggccacttgcggcgagccgtcgtagtcccccgcctgggccgccccggacaggccaatgacgccggctacgccgacccattggacgcccctggccgcccatgtacgcagtacttgcattgcgttcttcactcttggtctcaaacctgggcgatccacttccgatgggtatggatcgacatcagaaccccgaaccctgacaacagggtaaccagcgaagttccgccataa

SEQ ID NO: 5561 - DNA, 2721 bp, Pseudomonas aeruginosa
aggacgaacaggccggtggcgccgaggatcagcaacagcagcaggagaatcccgtcgatgtgcaggcgctgcaacaggctggcgcgccggcgcatcacgtcttcgttggacagggtgcggtcgaagttactgttcaagggcgggcgcctccggctcggctgccgtgggttcgggcttggccaccgccgccgcgagcggcgcgacgggttccgcgtattcggccttgagcttgccgtgctcgtcgagcagccaggcgtccatcacctgcttgaccaccggggcggcgacgccggagccggactcgccgttctccaccatcaccgccaccgcgatctgcgggttgttggccggcgcgaagccgacgaacagggcgtggtcgcggtgccgctcgagcagcttggagcggtcgtagcgctcgttctgcttgatcgccaccacctgggcggtaccgctcttgccggcgatcaggtaggccgaggtggcgccgaccttgcgcgccgtgccgcgggcgccatgcaccacctgctgcatgccgtagtcgacgcggtcccagttggccgggtcgcgcagcacgatgtcgggcatcgggtcggggtcgaccggcggctggccgtcgatggtcttggccaggtgcgggcggatccagtggcccttgttggccagcagcgcggtcatctgcgccagttggatcggcgtcgcctgcatgtagccctggccgatgccgaggatcagggtctcgcccgggtaccagacctggcggcgggtcttgcgcttccattcgcgcgagggcatcagcccgtcggcttcgccgaacatgtccagggcgactttctggccgaagccgaagcggctcatgaaggcgtgcaggcggtcgatccccagcttgtgcgcgaggtcgtagaaataggtgtcgttggaccggtagatcgccgactccaggctcacccagccatcgccgtagcggttccagttacggtacttgtggtcgtagttgggcaactggtagtagccggggtcgaagacccgcgaggtcggcgtgaccaccccggcgtcgaggccggccagcgccaccgccggcttcaccgtcgagcccggcggatagagcccgcgcaggacgcggttgtacagcggccggtcgatggagtcacgcagctcggcataggccttgaagctgatgccggtgacgaacaggttggggtcgtagctcggctggctgaccatcgccagcacgtcgccggtggacggctggatcgccacgatggcgccccgccgcccggccagggcgttctcggcggcctcctgcaggcggctgtcgatgctcaggacgatgtccttgccgggaatcgggtcggtgcgcttgagcacccgcagcacccgcccgcgggcgttggtctcgacttcctcgtagccaaccgtgccgtgcaactcgctctcgtagaagcgctcgatgccggtcttgccgatatggtgggtgccgctgtagttgatcgggtcgaggttcttcagttcctgctcgttgatccgcccgacgtacccgaccgaatgggcgaagtgctccttcagcgggtagtggcggacgaactgggtcgccacgtcgacgcccggcaggcggaaggggttcaccgcgatgcgggcgatctgttcccccttgaattcgaacatgatgggaaccggctcgaacggacccccccctggcttcctgcgcctctccaaaaaggcccggtcgtccccggtcagggcgaggatctccaccagcgtgtcgagggtcttctgcaggtcctcagtgcgttcgcgggtgatggtcaggctgaagctcggccggttgtcggcgatgatcacgccgttgcggtcgaagatgatcccgcgggtcggcgggatcggctgcacatggacccggttgttctccgacagcgtcgaatggtactcgtactgggtcacctgcaggtggtacatgcgcgccaccagcaccagggtcagcaagaccaccgccaccgccccgacgatgacgcgccgacgcaccaggcgggcgtctttctcgtggtctttcaggtggatcggctgcggcatcgggactggggactatttgtggtaggggtgcccggacaacacggtccaggcccggtagatctgctcgccgaccaggatccgcaccaacgggtgcggcagcgtcaacggcgacagcgaccagcgctgctcgctgcgcgcgcagacctccggcgccagcccttccgggccgccgaccatgagattcacggtgcgtgcgtcgagacgccagcgatccagttcgcgagccagttgctcggtgctccagggccgaccttcgacctccagggtcaccacccgttcccccggctgcacgcgcgccagcatggcctcgccttcctgacggatcaggcgcgccacgtcggcgttcttgccgcgggtgttgagcgggatctccaccagttcgagggacagctcggccggcaggcgcttgacgtattcctgccagccttcctcgacccagcgaggcatgcgcgagccaaccgcgatcaggcgcaaccgcatgccggcgtcactcttccggctggtgctgggcgcggctctgctcggcgccctgccacaggcgctccaggtcgtagaactggcgggtcgccgggagcatcacgtggaccaccacgtcgcccaggtcgagcagcgcccattcgccggactccaggccttcgctgcccaggggcttga

SEQ ID NO: 5562 - DNA, 405 bp, Pseudomonas aeruginosa
gacggcttgtcgcgctgcagttcgcggggatcgaccgtcaatcgctcgactcccgccaccgcccgctcgaccatcgccaaccgctgcgcggccgacacctgcggggtttcccggtgcggcggccgcgcattgggcagcaggcgcagttcgtcgagggcgaactgctcggccatttccacggcgctgcgcatatgtccgatatgcacggggtcgaaagtgccgccgaacaggccgatacgtttgcccatcaggtgcgcacgtgaccgtcgccgaagacgacgtacttctcgctggtcaggccttccaggccgaccgggccgcgggcgtgcagcttgtcggtggaaatcccgatctcggcgccgaggccgtactcgaagccgtcggcgaagcgggtcgaggcgttga

SEQ ID NO: 5563 - DNA, 555 bp, Pseudomonas aeruginosa
tcccgaccacgcccagcggcacgcgcatcttgccgatctggatgcccgagggcacatagcgcatgtcgcggatctcgccgatcgggtcgggcagcgtggcgacctggcgcaggccctcgatcatgtcgtcgatgcgcgccggggtcagcgccaggcggtccagcatcgccggctccaggccattggcgcggccggcggcgaggtcctgctcgttggcgtgggacaactccgcgcgggcggcgtccagcgcatcggccgcggccagcagggcgcggttcttctgcgcggtggcggcgcgcgcgagcaaccgcgaggcggcgcgggcatcgcggccaaggcggctcatatagtcgaggacggactcggtcatggtctcggcatctggcgtcagggaaatgcgcgattatagcgagccagccccggcgcgcccagccgcaacagccggtcggtagacagtgcgttccatcgcccccggcggtaacgcggcagccccgctgcgcctggggctgtgcgcgagacggtgacacctgggcgcaggcgccggccgaaggatag

SEQ ID NO: 5564 - DNA, 744 bp, Pseudomonas aeruginosa
gtaaacaaaattgctacctctgtttaccttcgaggcgagcctggccactgccacccaccggcacccgctcggcagaacaacaataacgacgcacacaccgcggggcctcgccatgcgctaccgtaccgactacagcgcgcagtcgctgagcagcgaaccggatatcctcttcctagacggctggcaactgcgctaccaggccttcgccgcccgcgccgacgacccgcgcccgccggtgctcctgctgggcggcgccttccagagcttccgctcattcaccggcgaggtcagcgaactgctcgccgagcacccggtgatcctgctcgacctgccgagccagggcggcaacctgcaactggcggcggaactgagcctggaagacctcgccgacctgatcgcggccttcgccgaacagctcggcctgccgccgttgatgcccatcggcctgtcctacggctcggccctggccgcgctgttcgccgcccgccatccgcgccgctgcgcgcgcctgctactggccggcatcaccgcattcggccgccccggtgcgcggctgctgctggaagaagccctggcccggctcgacgagggcgaccagagcgccttcgcccacggcgtactgaccggcctgatcaacccgctacagctggaacgtaccggcgtctccccggtatttcgcaaggccatgctgcgccagttgcaacgcctgaccgcggcggagatcgaacgctaccggcagaatag

SEQ ID NO: 5565 - DNA, 657 bp, Pseudomonas aeruginosa
tcctcggcgacgatcggcaggtcgaagttgaccaccagcggcatttcctcgatatccaggccacgcgcggccacgtcggtggctaccagcaggtctacctcgccggccttgaaccgctgcaaggcgcgcagccgcgccggctgcggcttgtcgccatggatcgagtcggcggcgataccctgccgctgcaacagtccgaccagttcctcgacgctcttgcgggtcttggcgaagaccagcgcctggcgccagcgattggcctgcaacaggtggcagaacagctcggccttgcgcttcttgtccaccggcaccagccattgcctgacgctcttcgccgcggtattgcgcggactgacctcgatggacagcgggtcgcgcagcagttcacgggccagcgtgcggatggcgtcggagaaggtcgcggaaaacagcagggtctggcgcttgcgcggcagcgcggcgaacagttcgtccagctcgcgggcgaaaccgaggtcgagcatgcgatcggcttcgtccagcaccaacgcctggagctgggcgaacttcaccgcgttctgccgatacaggtcgagcagccgcccgggagtggcgacgaggatatccactcccttgcgcagcttcatcatctgcgggttgatgctgaccccaccgtag

SEQ ID NO: 5566 - DNA, 1401 bp, Pseudomonas aeruginosa
cggtcaggtgaacaaatcgtcgtcgccgaggaagctggagtcgtcgttgaaatcgctgtcgctgaaatcgccatcggcgaaaccgccgtcggcgggatagtcgctatcggcgaagcgctcgggcgccggctcgggatcggcaaactggctggcgtcgaggttatccaccgggacgtcctggatcacctcgacgatttcctgcggctggctgtggcggaacatgccggtgagcaggtcggccaccagcatcccgccagcgaccccagcggccgtctgcagcgcaccgccgagaaagccgctggcccgcgaaggcgcggccgccgcggcgggcgccatacccggacgcatgtcgccggccgccgccgccggattggagaaacgcgtctcgccccagcccgccgggcgccccgattggctcggcgccggctcgtcgcgcgcgccgccgccgaacaggccggagaggaagccgccgctgctcggacggctctgctgcaactgggcgacctgcgcctcgagctccttcacccgttggtcgaggcgcttcagcgcggcttcctggatcagcaccacctgcgccatgtagtacggcgccgccggctgccgcaccaggtgctggttgatctgcgcctcggcctcggcgtcacgcggagcggactgcccctcggcctcgcgcaggcggctgaacaggccgtcgatcagggttttctcatcggatttcatcgcacgcctcgactgcatttcgagaaggaaggatggattgcaccaaagggaaatattggagcaccctgcacgatctcaagttcctccggtgaattcccgatgaatgacgatgcccagcgctccgcacggtcccaggtcgccctgctgatcgtcgacctgcaacgcggcatgcagcgccacgacctgccgccgcgcaacaatcccggcgccgaggcgcgcatcgtcgaactgcttgccgcctggcgcgccgccggctggccggtggtgcacgtccggcacgtatcccggcagcccggctcgcccttcgcgcccggccagcctggcgtggagttccagccagcgctggcgccgcgcgacgacgaggcggtgttcgagaagaacgttcccgacgccttcatcaacagcggcctgcaacgctggctccatgtccgcgacatccgccaggtggcgctcgtcggggtagccacggagaactcggtggaagccagcgcacgcagcgccggcaacctcggcttccagacctgggtagtggccgacgcctgcttcaccttcgccaagcccgatttccacggcaccccgcgcagcgccgacgaggtgcatgcgatggcgttggccaacctgcacggcgagtacgccgtggttctgcgcgccgccgaactgttgcagcgcttgccggcctga

SEQ ID NO: 5567 - DNA, 1992 bp, Pseudomonas aeruginosa
ctgtctgccgggcaacagcgggacaacagggctgtccggcagaagacaggccggttccgccatatcccccataagccattgattcgaaaacatgaatccgggatggcacggttccttcatagacaccggaccacgcccctacccggagatacccccgatgagccaagagcaacagccgatccgcttcgcctactgggtccccaacgtcagcggcggcctggtggtgagcaagatcgagcaacgcaccagctgggacatcgactacaaccgcaagctggcccagttggcggaacgcaacggcttcgactacgccctctcgcagatccgcttcaccgccggctacggcgccgagtaccagcacgagtcggtggccatcagccacgccctgctggcggccaccgagaagctcaaggtgatcgcggcgatcctgcctggcccctggcatccggcggtggtggccaagcaactggcgacgatcgaccaactgaccaatggccgggtcgcggtgaacatcgtcagcggctggttcaagggagagttcaccggcatcggcgaaccctggctggagcacgacgaacgctatcggcgctccgaggagttcatccgcgtgctgaaaggcatctggaccgaggaaaacttcaccttcaagggcgatttctatcgtttccacgactacaccctgaaacccaagccgatccagcagccgcacccggaaatcttccagggcggcagctcgcgggcggcgcgggacatggcctcgcgcgtgtccgactggtacttcaccaacggcaacagcatcgacggcatccgcgcccaggtcgaggacatccgcgccaaggcggcggccaacggccattcggtcaaggtcggagtgaacgccttcatcattgcccgcgacaccgaggaggaagcgcgggcggtgctcgacgagatcatcgccaaggccgactacgaggcggtgaacgccttcggcgacgcggtgaaacaggccggcaaggcctcgccggagggcgatggcaactgggccaaatccaccttcgaagacctggtgcaatacaacgacggcttcaagaccaacctgatcggcacgccacggcagatcgccgagcgcatcgtcgcgctgaaggcggccggggtcgacctggtgctgtcggccttcctgcacttccacgaagaagtggagtatttcggcaagcacgtgttgccgctggtccgcgaactggagcaggcccaggctcgcgaagcggcctgaacggcaacggcggccgccaggcgttggcctcggcggccggctgggttagagtcgcgggctcgtatccgatctgccgacccgcgatgaatcctctgctgccgctgcgtgacgcctggttcttcttcacccgccacctgaccaccctggtgccgctctgcctgccctggatattcctcgaaagcctgctccagcagcagatcgacgaagccgtcggcccccagcagatgggcgcctggagcctggtcgccggactgctcttctacccgctctacaccgcagccctgatcctgttcatggacgcgcgcgggcgcgacgagcggcctcgcgtcggccagctgtggagcgccgcgctgcgcctgtggccagccttcgcgctactcgcggcgctgacttcgctgctgatcgtgctcggcctgtcgctgctgatcctgccgggcatcttcgtcatggtgaagctgtccttcgccgaattctgcctggtgctgcgcggccgtagtccgctgcaggcgctgcgggaaagcttcgagttcacccgtgggcgattcttcctgatcctcgcctgttcgctggtgatcctgctgccggtctggagcctggaagcctggctcgccgattcggccggcgacgccgtcgtgctgcgggtcgccctgcatgcgctcagcgggttcttccagctgctgttgaccatcgtcgccttccgcatctacagcctcggtccggcgccacgcaacgggatgtga

SEQ ID NO: 5568 - DNA, 501 bp, Pseudomonas aeruginosa
acggcgccgcgcgccgattcgccgcgctggcctatgcttgacgagccctgcctcgaggaacggaccatgagcgacgaatcggccaaccccagctgcatttcccacctgtccatcggcaccaacgactttccccgtgcccgagccttctacgacgcggtgatggccgccctcggctgcaaggtgatcctcgaataccccggcgccgtagcctacggcaagctctatccggagttctgggtgcaggcgccgatcgacggccgtcccgccagcgtcggcaacggcagccacgtcggcttcttcgccgacagcaaggcccaggtcgacgccttccacgccgcggccctggccgccggcgcacgcgacgagggcgcgccgggcccgcgtccgctgtacggcgagccctactacgggtgtttcatccgcgacctcgacgggcacaaggtcgaggcctcctactgggacatgagccagggtttcgacgcccacgaccacgcccactga

SEQ ID NO: 5569 - DNA, 348 bp, Pseudomonas aeruginosa
gccgctatcgcatcgatagcgccgagcggcgccagttgccgccacgcgatggcgggctgttcgaccgcctgttcgggccgcgcccggcgatcctggtcagccacctgccgatcgacggcggcggcgagctggccgtgctcaacgcccgcttcgaccgcccgcaggcgaacgacgacaccctcgagcgccaggtcgagaccacccgtacgctgctcgacgaactgcaggccaggcgcacgccctggctgctcggcggcgacctcaacctgctgccgcccggccagtatccctacctgctggcgccgctgcgcgcgccctaccgggaagacagcgaactgggcatcctga

SEQ ID NO: 5570 - DNA, 762 bp, Pseudomonas aeruginosa
caacaaaaaacggcaaggccgcacaccatgcccctacgcaccacaacgcccctgctcgcgctgctggcgttcgccctgctggccgccccgcagctccatgcgcaggacgcaaggccgtcgttgaacgtcggctactacgaattccccccctacatctataccgcccgggatggccacgccgccggttccggcgcccgcctggtccgcctgctgctggagcgggccggctatcgtccggcgttccgcgccctgcccagcgcgcgcctgtacctggggctgcaggatggcagcgtggcgctgtgggccggcgcggccaagccggagctggccgccgacaccctccaggcgcggcgcgtgctcggccacgtcagcctgaacctgtactacccggcgcaccagccggcaccgcgggttccccaggacctggccggacgccggctgatcctgatcagcggctacagctactggaaaccggtcaccgacttcatccaggaccccaacctgcacctgcgcctgtaccgcaccggcacccaccacgccgccttgcgcatgctcgaactcgggcgcggcgactacctgctcgactaccaggcgccggtggaagcggccagccgccaggcgttggcaagccaggaactgtaccgcctgccgctgcggatgatcgtctcgcgccacattcccggcgccgaagcgctgcgcgaccgcctggaccaggcctacgaccagttgcggagcgacggcgccgacctgtccctgctgtga

SEQ ID NO: 5571 - DNA, 798 bp, Pseudomonas aeruginosa
gttatggatggcgttactttcaagcaagccggtcagtacgcaatgtgctgtattgagaacctgtcggacgagctcataacggctctacgggacaacctgactagaatttgtcatggcgccgacctgggtagccgcaacatagtcatcttcaaatatgaggccaccctgaagtcgttctgggatcgctactccaccaaggatctcaacacccggactggcatgcttggcgagctacttgcccacgtcataattctcaaaaaactcgacagtttcgatgtggtttctccattcttcaacatggaagaaaagcacattcgaaagggtttcgacctcgttctctacgagtccacttccaatgaagtatggatcacagaggtaaaatcaggaggcgctggtaaaaagacctcgtgcgcggccaccaaggcattactggcgaaggctcgagacgatctcaagggtcgccttgctgaggcagaaatgaaccattggctcaacgccatgaacgccgcccagaaatccattaatgacaaaacccgctacaaagaatctgtgctagaaatcctaggcatggaaggcgaaaaggcatatggaaactctgctgtagcctctgacaacaacgttgttttggtttcagcactcttcaacgatgctactcaaaaagtggaagaagcgaccatttcaggcttcacggacagccttttaactacgccaatatttaaaacagttttggtgctatccatccaaaaaggaacgcttcaaaagcttgaggacttccttcgcacagaggcaggatgctaa

SEQ ID NO: 5572 - DNA, 2481 bp, Pseudomonas aeruginosa
atgcaagagttaaccatcaaggaattggccaagacccgtttcaaagacatctacctggagcttctccgtggaggccagatgtcagatggggatatcgtgaagcttttggcgattgcagtcctgctactcaaccatcaggcgcccgagataaaacgccttggttatcgaatcacgctattctacggaaacctaactggccgatatgaaccgctttatgatgtagctgttaacagcggcctattaccggttactgctgtgattggtaagtcgttcgcacaagacgagcgactcagcaggtctttcattcaaaacattgtgagcagttacgtagacacattccgtgaccagggcatggtgctgacggagcagcaggatacgctgagagtcttcgtccaagatgagtacgagaactcttcggtcgttatcgccccgacctcctacggaaagtccgagctcatcatcaagtcagtaaaagacaacccctctaagcgcattcttattttggtgccatcaaaggcacttctagcgcagacaaagaagcgtttgatctacgcggacatcccaaagctgggtaaggtcgttacccatcctgaaatgttctcgcccgagcgaaataatcgggcttttgtccttacacaagagcgcctaaatcgcttacttaatgaatacagcaccctaaaattcgacatggtttttgtggacgaggctcacaaccttctccaaggcgatagtcgcaatgagctcttggccacaatgctatgcatcctgggggccaggaaccctaagacttcattcaagttcctgacccctttcctttgtaacgaactcaacgtccgagtgcgttacctggacatgacgcccaaaggcttcagggttgatgaatacattaaatccgagcgcttttacactcgggacttcagaactggcaaaaacgacggaaagctcaagctttacgaccatttcctcaaccaatggttagagatagatagaaagtacaagagcggcttcgatctcatcaagggcgagtcgctggccaaaaacattatctatggcaataccaaaaagaaaattgagcagttcgcactcgagctcgctgagacgctgcctaacatcgagtgcccattggttcaaacagcttgcgatgagcttgaagatgcgttcgacaaacgatatcgactgatttcgtgcctgcggaaaggggtgatgtaccaccacggctccatccccgacaccatccgactgtatctggaaaacctgttccaccaatccaaggccatgaagtatctggtttgcaactccactctgcttgaaggggtaaacctccctatcgaacggcttttcgtcttcgattattcgaaaggtcgagggaacctcacctcatcgcaatttaagaacctggttgggcgtgtgaataggttcagtgaggtgtttgcgcccgaagcaggaaccaccctcaaaaagcttgagtcgagcatctacttgctggggatggacggctacacgaacaaaaaatctaacctccagacattttacgagaaagcggtcaacgtctcgaaggttgatcaggacagtgttagtaacgttctccttgaagcgaccaccatattggagggcgaggtggctgaccgccatcgtgacgctgtatcaaggctggagaaccttcagccaggggtagtcactggtcaagaatgcaagtacgtgaagacggaggttggccggttattgatcgccaacagcgtaagcgagatcgatgtcttcacctctgaggaggagatagacgacgccatcagcatgtcggttgatgcgaacggcatgatcgacaacgccgaccgcctgctgctggagatcaagacctgcttcatcgacaagttcgatgacaagcgaaaatacagcgacctgaaacgcctccagaacaaagcgacgattgatttttacgccatgttcctagactggaagctcaaaaagtatagcgttaagcaaatcctgagatacacgcttaaatactggagcgagctccctgagaagaaaggtactgactatgtttacgtgtccaactggggcgatactaaatacggtgacagtcactatgcttactgggtcagaatttcaaccaaaaatgacgtagagaaagtcaacctcgctatcgtccgtctgaaagaagaagacgatttcttcgacaataagatttttaagttcgtagaagttctgaacggtgtaggtgctgttgatcccggcttctacaagcgcatcaagtatggcaccaccgacgatgcaaaaattaagctgatccgagagggctacagtcgcgggctggctgagctgttgctggatcgatacccacggtatgttcgcctcgacaacaatggcgaaatcgaagtcagctcaagggtcatcgggctcatgagggaaaatgaggagagcgatttgctcatctttgaagcccagatgaacctgaaatccactccagaatcagtggcgtaa

SEQ ID NO: 5573 - DNA, 1521 bp, Pseudomonas aeruginosa
atatccataaaagctagaaacttacaacagctaatatttgcagaaaggatatgcaaattgttaaagccaatcaacaaggaagcaagtgtaaatgaaagcgagaagattcttgccacgattgcttcaaatacattttttagcctatggtgctaccccagcctgtatcggtcgttaggaaaaggaaaagagcttaccgacctcaccgtgtacttcaataacacggttatactattttccgacaaggggcacgttaaattccaagagcagaatgacccaaaacttgcttggagccgatggtacagagccgcagtcaaggaatctgcaaagcaactgcatggagcagaaagttgcattaggaatcacccgaacaaaatcttcctcaacagcaaacttgatgagcgattcccttttgacttgagtaggactgacctcaaaatacacttgatagcggtaacccgaggaataggtaaacatgccaagcagcatttcgacgccataaggcccggcagccgtggctcgctcggctacctttatggagctaatgaagaacagttgctcgacaaacctttcttcgtcggcgatgtagacatgagcaaaaccttcgttcacgtgctagatgaagggggtataaaacttcttctagaagagctttgcacacctgcagactttatccgatacctcgaggttaaagaggatgcaatccgcaacaaagaccttctgatcagcgctggagaagaggaaacacttgcatgctatctccaagaggatggtggcaacgggttcggaaaaatcaccaacccacctcacaacaaaggcaacttcctaatgatacccgaaggagaatgggatcattacaggaaaacggtaatatatgccttgaggtatcaacaaagaaaagaagcaaagctatggaatgaaataatttcccgcttcgcggacgggattgtggatgcacaggtaggcgaagcaagtgacttaccgttcataacgcatgcaaatgctgtgcaggtgttggcgtcggaaaaccttctgtcgagtagtctccttgcaactgccctattcgataaattccatacagtccccagcggaacacgctcagcacgaacgacttactccgtctgtaatccaggccgagtgtacgtcttcgtatttttcccctggagtcataaattcaactcctatgatgaatataggcaggagcgaactgcctacatgcagctatacgcatgtgtagcgcgctacaagttccagaaagcaaaagaaattgtagttcttggagccgacaccaaaggccatcaagggggctctgagacaatttttgctatagatgcatctgttccgcttactggcgatgagcgaacgactgctcaacaaatcatgaaaacctacaacatactagacaacatttctcagagagcaacaccagggaacggggcgaccaagaacgttagccgaaatgctccgtgcccatgtggctctaataagaagtataagaaatgctgcttaaacccagagccataa

SEQ ID NO: 5574 - DNA, 228 bp, Pseudomonas aeruginosa
gcgaacggattgcgaatccgctctttgatatctcgcataccctgcagggctttacgcgcccttggcgatggattctcccctaataattcgtcaactttctcgttccatgtcttggacatgaaggctttgaatccctcagcgggtaagggcactcctgtaaaggcacgaagcaagttcaacctgtgctctaaagcactaaaatatgcgtcgaccatggcaaccgagtaa

SEQ ID NO: 5575 - DNA, 447 bp, Pseudomonas aeruginosa
ttcgccgtcatgttcacccggaggtcatacatgcgccttgccacccgcgtttcctgtgccgttctcagtgcagccctgctgagccagttgtcggcctgcggtacgctgttctaccccgagcgacgcggccagatcgacggccgcatcgatccggccatcgtcgccttcgacgccatcggcctgctgttctatatcatccccggcctgatcgccttcggcgtcgacttcgccaccggcgccatctacctgcccgacgccaagtactcggtcgccccggaagtgctcaaggatgccgtcggcgcagacggcaaggtcgacaaccgcaagctcaaggccatcctcgaacgcgagatcggccgtgaactgccgctcgacgacccgcgcctgctccgccacagcggcagcgtcgagcaactggcggcctatggcctgaagccggccgcctga

SEQ ID NO: 5576 - DNA, 993 bp, Pseudomonas aeruginosa
tccgccctccgagcgcgaccgtgcgtcagtgcccggtcgccgcccggttggtttacagtggcgccgtccctcctgacagaagcgccccatgagtcccgattccccccacgcccgcctgctgcgcctggccaccctggcctcgctcggagtcgccgtcaccctggtcatcggcaaggccatcgcctggtggctgagcggttcggtgagcctgctcgccggcctcaccgactccctgctggacagtgccgcctcgctgctcaacctgctggcggtgcactattcgctgcgcccggccgacgacgaccaccgctacggccacggcaaggccgaggccctggccggcctggcccaggccatgttcatcggtgccagcgcggtgctggtggctatccaggcggtcgagcaattgcgcgacccgcagcccctcggcgcggccacctggggcatcgcggtgatgctgctgtcgctgctgctcacggcccttctcctggccttccagacccacgtcatccgccgcaccggttccaccgcgatacgcgccgactcgctgcactaccgctcggacctgctgctcaacgccagcatcctcgtggcactgctcctggcccgctacggctggccgcagagcgacggtctgttcggcctgggcatcgccctgtacatcctctggagcgccctgcagatcgctcgcgagtcggtgtcgatcctgatggaccgggaactgcccaccgacatcagcgagcgcatgcgcgaacttgcctgcagcgtgccgggagtgctcggcgcgcacgacgtgcgcacgcggatctccggcaaccactggttcgtccagttgcatctcgagctgcccggcgagctgagcctgtcggtggcccacgccctgaccgaccgcgcagtgctggcgatcaagcgcgaatacccgaaagccgaggtgctgatccatgccgacccacaggaagtggtcggcaaggaaaccgtcagttgacgctgtag

SEQ ID NO: 5577 - DNA, 327 bp, Pseudomonas aeruginosa
ggcacccgcaggtgcccgcgcggcaaggcctccaccacccggcccggacgccagtcgggatgcggtccccaactgccgccgtacgcttcgccgcggccaggtcccggttgtccgtgggcaacaccgcgctcgccgccgggtccaccgcgtccccctcggccgtcgtcggcctgcgcctggacgcacaggctcagcgaaagagcgcccaccccgagcattcgccaccatccaccgttcatcgtctgcctcgccccgggcctggtcgcccggccacgttcgaatgatcccgggaacgactttccgccgttttccgccaagggtgggtaa

SEQ ID NO: 5578 - DNA, 543 bp, Pseudomonas aeruginosa
ttgcgcaataaatcactcaaattctccttgccaatggcaatcaacctgaaagaaatcttcgccatgaacaaactcgaccgctacgacctgcgtatcctcgaagaactccagcgcgacgcacgcatctccaaccaggaactggcagaacggataggcctgtcgccatcgccctgttcgcgacgggtcaagcagctcgaggacgacggctacatcgtccgccaggtagccttgctggaccgcaagaaactcggcctgagcctcaccgccttcgtcctcataggcatggaccgacacaccccggaacgcttcgaacatttccaggaagtcatcggcaaatgcccggaagtgctggagtgcagcctggtcaccgggatggacgcggactaccagttgaaggtcgtggtgccggacatggaccattaccagaagctcctgctgggtaccctgacgcgcatcgagggggtctccagcgtgcgctccagcttcgtcctcaaccaggtgctggcgagtaccgaactgccgctggagcacctgcgcgattga

SEQ ID NO: 5579 - DNA, 297 bp, Pseudomonas aeruginosa
aacgataaacgccttgcccgccccccatggcacgctccgtccgaccgcgagccggacttcgtttgcttgaaaatccggaggttgccaatggatcccgaactgttcgaagagtggatgatgaccggtctggtgaccgtgcttatcctgttcatggctttcatcgtgtgggacctggcgaagaagtcgaaagccggcaagttcggaaccctgatcctgttcttcgccctcggcctgggcgtactgggcttcatcatcaagggcctggtcatcggcagcctcgaaggcgcgggcatgtaa

SEQ ID NO: 5580 - DNA, 489 bp, Pseudomonas aeruginosa
gctgcgcgccctcggcgccagccattcgcgcgccgcgctggatatccgcccggaactctacgacctgtggctggacgccctgctgatggcggtcgccgagcacgaccgcgactgcgacgccgagacccgcgacgcctggcgcgacgtgatgggtcgtggcatcgccgtgatcaagtcgtactactgatcgttccgcgcccgctggacgacgcccctctcgtcagtccagccgcgccggcacttcccgccattccccgaggcccaggccgtccaggctccaggggccgatccgcacccgcaccagccgcagcgtcggcaagcccaccgccgccgtcatccgccgcacctggcgattgcgcccctcgcggatcaccagttccagccagtaggtcggcaccgacttgcgaaaacgcaccggcggcacccgctcccacaacgtcggctcatccagcagacgcgcctcggcgggcagcgtcgggccgtcgttga

SEQ ID NO: 5581 - DNA, 1668 bp, Pseudomonas aeruginosa
ctggaaacgagttggcttgatcggggtaccgggcggcatgctaggttgtccgagagcctgaccgcaagagcatcccctcatgccctccctgcgtcccacctggctgatcagcctgctgaccctggccggctgcgctggcagcgcctatcagggtccgccttcggaccatttcgacggcgaacgtttccgcaatatccagccgaccgcgcacaagagcctgcgcgacctgctcaagtggcagtggaaccgcccgccgcaacgcccgtgggtcgccctgccgccgacggcaacgccgccaagggtgaacgaacgcgcccgcggcgaagaactgcgggtcacctacatcaaccacgccaccctgctgatccagcaccgcggcctgaacatcctcaccgacccggtctggtcgcaacgggtcagcccgctcgccttcatcggcccgaagcgccaccatccgcccgggttgacgctcgaccagttgccgccgatcgacctggtgctggtgagccacaaccactacgaccacctcgacctggaaaccctgcgccagctccaccggcgctggccgacggccaaggtagtcagcggcctgggcaacgccgggctgatccgccagacaggtttcgccgacgtcgtggagatcgactggtggcaggccgtgccgctgggcgctggcctgacgctgcatggcgtaccggtgcagcactggtcgtcgcgcacccgcagcgacaccaaccgcacgctctggctcggcttcgtcatcgactcgccggacggcccgctgctgtttcccggcgataccgggctcggcccggagttcgggctgatccaccagcgcttcggggcgatgcgcttcgccgccctgccgatcggcgcctacgagccgcgctggttcatgcgcgaccaccacatgaatcccgacgacgcggtgcaggcccatcgcacgctgcaggcgcagaccagcatggccatccacttcggtaccttcaatctcaccgacgaacagcaggacgacccgcccaaggcgctccaggcggcgctgcgcagccaaggcgtggacccggcgaccttcggcacgccgaaacccggcgagcagtggcgcgtcgcaccgcgcaacgtcgctcaggaggccgaggccaccaggcgggagcagcagttgcggtagcgcttgccgctgccgcacggacaagcctggtcgccacggccgcccagggccagccagctttccaggcgcgcggccatcccggccaggcgctcgcgggcctcatcgtccaggccggcgcgggccagttggcgccgcaggccgaggtagtcttccagcaggacatcgcggctgagcgcctggtactggtcggccagcggcacgccttcgtagcgccgctgcgggtcggccaggaaagcgatggcgccgcctgcggcaggacattccacaggttgccgcgcggatcgcgccagcaagcgctgaaacgcgcgcgcagggccaagccacgccattcttccaggatccagccatcgacccgctcgccgccgagggcctcgaccgcccgcccgaccgagaaccacggttcgccggccaggctttccggcatcggcaacggcgctgccacttccggcgcggcatcgggtaccaggcggcgggcgaagcgacggagcgggttgctgagatga

SEQ ID NO: 5582 - DNA, 537 bp, Pseudomonas aeruginosa
cgcccgccttctgctccatcggcacgttgcgcgggtcgtactcgcgggagaggatcttcggcagccatttctcggccaggtccgcctgcaggcgaatcgccggcacgctggcgtaggtcatggtcaacgggcaaccggtgccggcctccgcctggctgtgcaggtaggacagcccggcccgcgccacctgggcgccggggcgcgggtcggtccagggcagcgagggcagttcgtgctcgatggcggcgcgcatcagctcgtggtaggcgggatggaactccaccaggtcgacgcggttgccgtagcggtcgtggctatggaactccggcttgtgctggttggccaggaagccggccgccatcagcgggccgccggccagctcaccgtagcgctgcaggcgctcctcggcccagccgccctggtagcgacgcacccactcctggagaggcagatcgaggcggtagaggttggcgccatccagcgacggtacctggttggtcacttcgtgggtttcggcgtactggtgcaggttcatga

SEQ ID NO: 5583 - DNA, 1368 bp, Pseudomonas aeruginosa
agagacatacaggtcgcgcaggccggcatttcagccagccgcggaacggcttcaggcggacttggtgacgatcggctggcacagcagccaatcgtgcagcagggtctgcaactcttcgaacttgaccggcttggccatgtagtcgctcatgcccgccgccaggcagcgctcgcgatcgccgctgtggctgtgggcggtcaacgccagcaccggcagttccgcgcagccgggcagcgcgcggatcgcccgacaggtggcgaagccgtccatcaccggcatctggcagtcgagcagtacgccgtccggccgctcgcgcgccagcaactccagggcttcgctaccgttgtcggcggtgcgcacccggtagccgagcttgagcagcatgccgcgagtcaccaactggttgatggcgttgtcctccaccaccagcaccgtgcactcctcgggacgccgcaccgcctgcccgccggcgcgccgcggcggcggcgccaggccctgggccggctgggtcagttgcaggcgcaggaggaagcggctgccctgtcccggccgggactcgtgggtcagctcgccgccaagcagctccaccagcttgcggcacagagccaggccgatgccgaggcctccgtagccacgggtcaacgagctgtcggcctggacgaaacgctggtagaggtcgctgccggcggccatgtcgaaaccgatgccggtgtcgatcacttccacccgcagcgccaccccgtcatgggtacgcccggcggcgacgcgcagggtcacgctgcccctggcggtgaacttgatcgcgttgtcgaccaggtagcccagcgcctgggccagcttgccggcatcgccttcgagggtgtccggcaggctgtcgtccagttgcagggcgaagcgcaggcccttctcctcggcgcgcggcgcgtactgcgcgcgcaggctgtcgaacaggccgcgcaggctgaacggctcgcggcgcgggtagagcttgccggcctgcagttcgatgagggcgaggatgtcgttgaccatccgcatcatgtcccgcgccgaaccggcggcggtgcgctggtactcggcgagttcgacgtccatcggcaccgtctgcatcagctccagcgaaccgatcaccccgctcatcggggtgcgcagttcgtgggtgacggtggcgaggaactcctccttcaggcggttgctgttggccagttcctggttcagcgcttccagcttgcggctggactcctggaggattcgcgcgcgctcctccttcatcgcgttgatccggtcggccagcgccagcgacagcaagcccacctccagcgccgaaccgatctggctggcatacatggtgaggaacatgttcggtag

SEQ ID NO: 5584 - DNA, 2079 bp, Pseudomonas aeruginosa
gtagccgaggaccatcagggtgttgacgatgccgccgagaaggaaggcggtccaggcgatgatgaaatagcgcgccacgcgcatgccgcgcagccaggcgaggatgccggcggcgaagatcaggccggtgaaggccagcgccaggtaggtggccaggcgcagggccacggcgtagctcatggtcagcgccatcagcatgaccagcgcgccgaccgccatcagcgccagcaggccgcggtcgacccacacgctgtggtcgcgggtatgcaggaagctgcgcgcgaactggcagccgaacagcgccgccgaaccgatcaggaatggcgtggcggcgttcgcccaccaggggctgtcgggccagaagtactcgatgccggcgccgttcaccgagacctggtagagcccgaacgaagcgatatagaggatgtagtagagatagctggtatcgcggacgctgaggaagatgaacaggttgtagatcagcatcaccagcagcacgccatagatgatgccgagcacatagatgcgttcgggctgctcctccaggtaggccttgggcgaccacagggtcagcggcgcctggatcgacccctggctttccagccgcaggtagacacgctgcggcttgttcggctcgaggccgagttcgaacaggtagttgttctgccggatcggccgactggcgaacggcaatgtgtcgccggtgcgctgggcgaggcggtagccgccctggccatcgggcaggtagaggtcgagcttgtccagcggcggataggccagctccagcagccaggtgcgcggatcgctggaggcgaccggccggtagtccaggtccaggcgcaaccagaacaccgagcgcgaatagccggcattgagcacgtccttgtcatggcggcggaagctgctgtcgatggcccgcgaggtgatgtcgttgatatcggcgctaccgcgcacgtcctcgaacacgtcgatggactgccccagcggcaggcgctcgacctgctcgttgaagctcaccgcacccgccaggcacggcaacgcaagaagaaagagaatcagccagtgccgcatgatgccccgcagtgctcctcgaacggaccgggagccccacctccctcgtcatggtccgcccttggcgagcgttgtatgaatattccccgaagtttagcacacgccagtccacgtcgggcccgggacgtgtcacgcagggcccgggcgcggcgcccgaaaggtggtccgcgcagccgccacgaagcgcttttagtggtaagctcacgcgccatgaaaacaccgacttcccgccccgtagtgctctgcctgtccggtcacgaccccagtggtggcgccggactgcaagccgacatcgaagccctgctcgcccagggctgccacgccgccccggcggtcaccgcgctgaccgtgcaggacaccgtcaacgtcagcgacttccgcgtcctcgaccgcgagtgggtgctggcccaggccaacgccgtactcgccgacctgcccgtcgcggcggtcaagctgggtatgctcggttcgctggagatggtcgacacggtggccgagatcctcgccgcccacccgcacttgccggtggtctgcgatccggtgctgcgcgccggcggcggcggtgcgttgggcaagggcgacgtcggcttcgccatgcgcgagcggctgctgccgcgcgccaccatcgccacgccgaacctgccggaagcgcgcctgctcgccgacctgcccgagggcagcgccgaccagtgcgccgagcgcctgctggaacactgcgagcacctgttgatcaccggcggacacggcgacgaaagcgaagtgcacaatcgcctgtacagccgcgacggcagccgccgcaccttcacctgccagcgcctgcccggcagctaccatggctccggctgcaccctggccagcgccctggccggtcgcatcgccctcggcgaagcgctgcacggcgccgtgcagagcgccctcgactacacctggcggaccctgcgcgacgccgagagtccgggccacggccaatacgtgccgcgccgcctgcccaccgacttctgtcactga

SEQ ID NO: 5585 - DNA, 630 bp, Pseudomonas aeruginosa
ccagctactggacgacggccgcctgctgccctacgtcgaagccgcgctccgcggcggcgcgcgcctgctgcaataccgcgacaaatccagcgaccaggcgcggcgcctgcgcgaggcggaaagcctgcgcgaactctgcgaacgccacggcgcgcagttgatcgtcaacgacgacgccgaactcgccgcgcgcctgggcgtcggcctgcacctcggccagaccgacggttcgctgtcggcggcgcgcgccctgctcggccgccaggcgatcatcggcgccacctgccacgcccaactggaactggccgagcaagcggtggccgagggcgccagctacgtcgccttcggccgcttcttcaattccagcaccaaacccggcgcccccgccgccagcgtcgaactgctcgaccaggcccggccgcgcctgcacctgccgatcaccgccatcggcggcatcagcctcgacaccgcgcccggcctgatcgcccgcggcgtcgatctggtcgccgtgatccatgcgctgttcgccgccgcgtccgccgccgaggtggaacgccgcgcccgcgccttcagcgccctgttcgaacctgcctgacgcctccgcgcctcgcccgagagatagagagctag

SEQ ID NO: 5586 - DNA, 1509 bp, Pseudomonas aeruginosa
ggaaaatcaccttgtagatggggttttcgcgcttgttcatggcggggaaagcaatgccggaaaatgaagggcgcgaatcatagcacagcctttcggccagcaacgctaggaaccgggggccccgccctctataatgcgcggtccttttcgaactgtccgacgaagcgcatggccaagaagcttttcatcgaaacccacggctgccagatgaacgagtacgactcgtcgcgaatggcggacctgctcggtgaacaccaagccctcgaggtgaccgaaaacgccgccgaggccgacgtcatcctgctcaatacctgctcgatccgcgagaaggcccaggaaaaggtgttttccaagctcggcatgtggcgcgagctgaagcagcagaatcccgacctggtgatcggcgtcggcggctgcgtggccagccaggaaggcgccgcgatccgtgagcgcgcgccctatgtcgacgtggtcttcggcccgcagaccctgcaccgcctgccggaaatgatcgacgccgcgcgcagcacgcgcaagccgcaggtcgacgtgtccttcccggaaatcgagaaattcgaccgcctgccggaaccgcgggtcgatggccccaccgccttcgtctcggtgatggaaggctgcagcaagtactgcagcttctgcgtggtgccctacacccgcggcgaggaagtcagccgaccattcgacgacgtgatcgccgaagtgatccacctggccgagaacggcgtccgcgaagtcaccctgctgggacagaacgtcaacggcttccgcggcctgacccacgatggccgcctggccgacttcgccgaactgctgcgggtggtcgccgccgtcgacggtatcgagcgcatccgctataccacctcgcacccgctggaattctccgacgcgctgatccaggcccacgccgaggtgccggagctggtgaaattcatccacctgccggtgcagtcgggctccgaccgcgtgctggcggcgatgaagcgcaaccataccgtgctggaatacaagtcgcgtatccgcaagctgaaggccgcggtaccggacatctgcatcagctccgacttcatcgtcggtttccccggcgaaaccgagaaggacttcgagcagaccatgaagctggtggaggacgtcggcttcgacttctccttctccttcatctacagcgcgcggcccggcacgcccgccgccgacctcgccgacgacctgccggaagaagtgaagaaacagcgcctgcagatcctccagagccgcatccaccagcaaggctacgagatcagccggcgcatggtcggcagcacccagcggatcctggtcaccgacttctcgaagaaggacccaggcatgctccaggggcgcaccgagaacaaccggatcgtcaacttccgctgcgacaatccacgcctgatcggccagttcgcccaggtgcacatcgacgacgcgctgccgcactcgctgcgcggtaccctgatcgacagcaccctgcattga

SEQ ID NO: 5587 - DNA, 1191 bp, Pseudomonas aeruginosa
ggccgacgaccgtacggcgggctcgctgaaccttcccgccgccacggtgcaccaacgtttcagcgggaaccgggaaagcgccgccgcgatacggcaactttgcgcgacgatatccagcggttattctcttctctatcaatcagccactggcgagtacgacagaacaccttgaacgccccccaggaacttcatcgctttatcctcgagccgttcgacgcccgcagcttcgcgacactttgcgggcagttcgacgagcatctccaccagatcgagaaacgcctcgacatcgagatccgcaaccgcggcaaccagttcgaactggccggcgaaccgcgccggaccaaggttgccgaacgcctgctgcagcgtctctaccgcgaggcgcagaacggcaccgatctcactcccgacaccgtgcacctgtacctgcaggagtccggcctggaagacctcgaggaattgcagagcgcgccgcaggtcaccctgaaatcgcgcaaggcgcacatccgcccgcgcggcgccaaccagcagcgctacgtcaaggcgatcctcgaccacgacatcaacttcggcatcggcccggccggcaccggcaagacctatctcgccgtggcctgcgccgtcgacgccctggagcgcgagcagatccgccgcatcctgctggtgcgcccggcggtcgaggccggcgagaagctcggtttccttcccggcgacctgtcgcagaagatcgacccctacctgcgcccgctctacgacgcgctctacgagatgctcggcttcgaacacgtggccaagctgatcgagcgcaacgtcatcgaggtcgcgccgctggcctacatgcgcgggcgcacgctgaacaacagcttcatcatcctcgacgagagccagaacaccacagtcgagcagatgaagatgttcctcacccggatcggcttcggctccaccgcggtgatcaccggcgacgtcacccaggtcgacctgccccgcggcacccgctccggcctcaagcacgtgatcgaggtcctgcaggacgtccccggcatcagcttcacccacttcaagcccaaggatgtggtccgccacccgctggtgcagcgtatcgtcgaagcctacgagcgtcacgagagccgccagcaaggccaggtgcggccggtcgagggaacgggcaagggcggtcacgatgccgcttga

SEQ ID NO: 5588 - DNA, 909 bp, Pseudomonas aeruginosa
attgctggcggaactgggtcatcccgatccgtacgcctgcgacgacgaagagccaccgagcaaggaaaaatgagcgaagaccgatcgagcaacgggcacaagtcctggctggacaagatcacccaggcttttgcccacgagccgagaaaccgccaggagctactcgagctgctgcgcgatgcccacgacaacaagctgctggacagcgaggcgctgtccatcgtcgagggggcgatccaggtcgccgacctgcaggtgcgcgacatcatggtgccgcgctcgcagatgatgagcatccgctcgacccagacgccgaaggaattccttccggccatcatcgaagccgcccactcgcgctacccggtggtcggcgaaagcctcgacgacgtcatgggcgtactgctggccaaggacctcctgccactgatcctgcacaacgacgagcgtcccttcgacatcaaggaactgctgcgtccggctaccttcgtccccgaatccaagcgcctcaacgtgctgctccgcgaattccgcgccaaccgcaaccacatggctatcgtcatcgacgaatacggcggcgtggccggcctggtgaccatcgaggacgtgctggaacagatcgtcggtgatatcgaggacgagcacgacgtcgaggaggacagctacatcaagccgctgcccagcggcgatttcatcgtcaaggcgctgacccccgtggacgccttcaacgacttcttcggctcggaattctctgacgaggaattcgataccgtgggcggcctggtgatgagcgccttcggccacctgcccaagcgcaacgaagtggtcgagctgggcgagttccgtttccgcgtactcaacgccgacagccgccgcgtccatctgctgcgcctgtctcccctgcagaactga

SEQ ID NO: 5589 - DNA, 570 bp, Pseudomonas aeruginosa
acaggctctaaggacattcgatgcgttggatttctcgtcccggctggcccggacacctgctggcactcgccgcaggcgcgctcacacccctggccctggcgcccttcgattactggccgctggcgatcctctcgatcgccctgctctatctcggcttgcgcggccttcccggcaagtccgccctgtggcgcggctggtggtacggtttcggcgcgttcggcgccggcaccagctggatctacgtcagtatccatgactacggcgccgcctcggtgccgctggcaagcctcctcatgctcggcttcaccgccggcgtcgccttcttcttcgccctgccggcctggctgtgggcgcgctgcctgcgccgcgacaacgcgccgctgggcgacgccctggcgttcgccgccctgtggctggcactggagctgttccgcagttggttccttaccggtttcccctggctctacgccggctatagccagttgcagggaccgctggccgggctggtgccggtgggtggcgtatggctgtcctccttcgtcatcgccctcagcgcggccctgctggtga

SEQ ID NO: 5590 - DNA, 774 bp, Pseudomonas aeruginosa
ggccggttcgctttcgagccagcgccccatccactccacgctgagcggcatgctcatcagccacagaccgaaaaacccgcagacaccgcacagccgcgccagccgcggtcggctggtgcgccaccagaaagcgaaaaacagcagcagcaacaggccgcccggcggcagcagcagttgcttgaagaaataacggatcggcatcgccccctccctgtcggaagaggcaatctaaaggattgcgcgacgcctggcgaaacttccgggaaggagaccctagcggtcgttgcccgaacggaacagttgcgagccgcaatggccgcacggcaacacgccatgccccttgctccactgcaccggcgcaccgcagagcgcacagagcagttgccgctgtttcaacgagacgtgccgacggggcgccggcggttgcggccggggtgtcctgccgggctggcgctcgagcagcgccagctcctcggcggccgcatgccagccgcgcaaccagtgcaggtcctggtcgagataggcgcgtatcagccccatctccgcttcgctcaaaccacgcaactcgagctccgtgggatgctcgtcacgcaggcgctcggccgtatccgcttcatccagagccagggcgagacgctgcagcagcctctcgtacagcccacctcccgtcacactcgcgcgttgcagctcagccatcgaacacctctgaaggtaccactgggcagccagccatcgacggcccatagggcaagcttagcgttcccgttcggctga

SEQ ID NO: 5591 - DNA, 588 bp, Pseudomonas aeruginosa
tcgccaaggtcgagggcgacaacgacttcgagtccagcgtctggaaggagtggtacggcgccaaggacgagtccgtgctcaccgtcaactccggcaagtacgacaacctcggctaccaggccgccttcgacgccatcggcgccgacctcgaggccaagggcctgggccaggcacgcacccagttccgcctgcgcgactggggcatcagccgccagcgctactggggctgcccgatcccgatcatccactgcgaggcttgcggcgacgtcccggtgccggccgaccagttgccggtggtgctgccggaagacgtggtaccggacggctccggttcgccgctggcgaagatgccggaattctacgaatgcaactgcccgaaatgcggccagccggccaaacgcgaaaccgacaccatggacaccttcgtcgagtcgtcctggtatttcgcccgctacgcctgcccgcagttcgaaggcggcatgctggacaggaaggcggccgactactggctgccggtcgaccagtacatcggcggcatcgagcacgccatcctgcacctgctctatgcgcgcttcttccacaagctga

SEQ ID NO: 5592 - DNA, 1221 bp, Pseudomonas aeruginosa
ccccggcgcaactcgacgaagcccagcgccaggcagaagccaaggccaaggcggaagccgaagccctgcgcgccgccgacgaggcggagcgccagcgccgcgccgccgagccgcagcagtcgccgatcgagttccccaccccgtgatgccccggggccggtttcgccggccccgtcttctcctatgaagctgactcccgcgcaactcgccaagcacctccagggccccctggcgcccgtctatgtcgtcagcggcgatgaaccgctgctctgccaggaagcctgcgatgccattcgccaggcctgccgcgagcgcgacttcggcgagcgccaggtattcaatgccgaagccaacttcgattggggcttgctgctggaggccggcgccagcctgtcgctgttcgccgagaagcgcctgatcgaactgcgcctgccctccggcaagcccggcgacaaaggcgcggcgattctccaggaatacctgcaacggccgccggaagacaccgtgctcctgctcagtctgcccaagctcgatggcagcacgcagaagaccaagtgggccaaggccctgatcgatggcaacgccgcgcagttcatccaggtctggccggtcgacgtccaccagttgccgcagtggattcgccagcgcctgtcccaggccggcctgtccgccagccccgaagccctggagctgatcgccgcgcgcgtggaaggcaacctgctcgccgccgcccaggaaatcgaaaagctcaagctgctcgccgagggcaaccagatcgacgccgccaccgtacaggccgcggtcgccgacagcgcacgcttcgatgtcttcggcctgatcgacgctgcccttggcggtgaagcggcccacgccctgcgcatcctggaaggactgcgcggcgaaggcatcgagccgccggtgatcctctggggcctggcccgcgagatccgcctgctggctggcctgtcccagcaatacggccagggcatcccgctggagaaagccttcgcccaggcgcgtccgccggtctgggacaagcgccgtccgctgctgacccgtgccctgcaacgccactccagcagccgctggaaccagatgctgagggatgcccagttgatcgacgcgcagatcaagggacaggcacccggcagcccctggagcggtctctcgcttctcgccctgagcctcgccggccagcgcctcggcctgccggcagcctga

SEQ ID NO: 5593 - DNA, 1443 bp, Pseudomonas aeruginosa
cgaacccggggccccgccggcgcgtccaacgacggcagacgcgtcctggccggcgtgctaaggtggcccgtcccgaggaccctgctgaggagagcaatgcgtaaccccgaacgatccgccctgctgaaggtgagcgggctgctgggcagcaccgtcgtcgccatggggcttggcctctccagcgcgtgcgcgcagaagaatccgacagtcgaatacaaccagcctgccgctccccagcagaccaaggcgcccttctccggcgccggcccggccgcctcggtgcccgctggcgcgccgaacgaggcccagcctgggcaaagcttcgaacagtggcgcgacgccttccgtcaacaggcgctggccggtggaatcgatgcgcagaccttcgatcgcgccttcgccggcgtccagcccgatcccgccgtggtcgaagcagaccgcagccagccggaattcacccgaccggtatggaagtacctggaaggcgccctcgatccgctgcgcgttcgccagggccaggcgcgcctggcgcagcatgcgcgcatcctcggcgaagtcgacgcgcgctatgcggtggatgcggatgcggtggtggcgatctggggcatggagagcaactacggttcgcacatgggcaacaagaacgtgatccgctccctggcgaccctagcctatgaaggacgccgcccggaattcgcccacgcccagttgctcgccgccctgaagattctccagcacggcgacgttccggcctccttcatgatcggctcctgggccggcgccatgggccagacccagttcatcccgaccacctacaaccagtatgccgtggacttcgacggcgacggcaagcgtgacatctggggctcgcccggcgacgccctggcctccaccgccaactacctgaaagcctccggctggatcgccggacaaccctggggtttcgaagtccgcctgccggcaggcttcgactattccctggcggaactcaccatccgcaagcccctgggcgaatggcaagggatgggcgtacaaggcgtcaacggcggccccctgccctccggactctccggcgaacaggcctcgctgctgctgccggccgggcaccgcggcccggccttcctggtgctgcacaacttccgcgccatcctcaagtacaacaactccagcgcctacgccctggccgtcggcctgctcgccgacagcttcaagggcggcggccggatagtcggcgcctggccgctggaggatgttccgctgagccgctcgcagcgcatcgagctgcaacggcaactggccgcccgcggacacgatccgggcgcggtggatggcatcatcggcgccaatacgcgcaaggcgatccgcgcctgccagcaggagttcggctggccggcggacggctatccgaccccggcgctgctcgaccgcctgcggacgccatag

SEQ ID NO: 5594 - DNA, 915 bp, Pseudomonas aeruginosa
aacgagatgaatggaagacctcatggagcttgccgtccccacctccaatccctggatatcgtgttgttgcgtacctttctcgaagtggtcgacagcggcggtttcgccctcgccgcggacaatctcgcgctcaccccctccgcagtcagcgggcatatcaagcgcctggaacagacagccggcgtcagcctgctcagccgcaccactcgccgcctggagctgacccaggcgggcgagacgctctacgcctatgcccgcaacatcgtcgagctggagcgcgaggcccgcgccaggctgcacggcacgccgatccgcgaccgcctgcgcatcggcgcttcggaggacttcgccagcgcctggctgccacgcgtcctgcaacgctttcgccgctggcaccccgaagcatccatcgaactcaaggtcggtatcaccaccgacctgctccgccagcaggcccaggggcgcaccgacgtggtgttcggcaagcagtgccggcgggtaggagacgacggcgaactgctctgggaggaaccgctggtctgggccgcggcgaccgcgatcgagctgcccgcgggcgaaccgctgccgctggcgctgttccccgaaccctgcgtctaccgcgaagcggcgattacagccctcggcgccgctgcgcgtccctggcgcctggtgttcgagagcgccagcatggccggctgcctgtccgccgcgctggccggtttcgccgtgacggtggtggcgcgcagccagatgcgcgaggggctacgcgaactgggcccggaacagggttttccgacgctgccggaggcgcgtttctacgccttctcgcgccaacccagcctggcagccgatgcactgatcgaggcggtgcggcagctcggccagcgcagtcgcttcgttaccgcacagggatga

SEQ ID NO: 5595 - DNA, 825 bp, Pseudomonas aeruginosa
gacgagctcagcgcgcaatcgggtacacacctcggcaaaatccactggcccaaccaggtcgcgcagttgggtcatgggcatcccggcgtagccgcagggattgattcgttggaacggtcgcaggtccatgtccaggttcagcgccaggccatggaaggaacagccgttacggatgcgcaggccgagggaggcgatcttcgccccgtcgacgtagacacccggcgcgtccggcttggccacggcctgcacgtcataggacgccagcaggccgatcaggctctgctcgatccggctgaccagctcgcgcacgcccagtcccaggcggcggacatcgagcagcaggtaggtgaccaactggccggggccgtggtaggtcacctggccgccgcgatccacctggatcaccgggatgtcgccggggaacagcacatgctccgccttgccggcctgcccctgggtgaagaccgcagggtgctgcaacagccaggcttcgtccattaccgatttgtcgcgttcggcaacgaagcgctgcatggcatgccaggtcggttcgtagggaacctcgccgagctcacggaagcccagctcgagtcccatcagagcaccatgtgcacgcgtccggtcgcgcgcaggtcgttatggatggcttgcagttggtcgacatcggtggcggtgatcagcacctgcaccgagaggaatcgccccttgctgctgtcacggaccaccagggtctcgacgtcgagatccggcgcgtggcgctggatgatttccacgaccaggtcggagaaaccttcgccggcgtcgccgatcaccttgatcggatag

SEQ ID NO: 5596 - DNA, 645 bp, Pseudomonas aeruginosa
acgtcaggggtatcggtcatggcggcggcggacccgtggtccgcggggacgggcgcccgctggcctcgtgagcgggcgggcgccggtcggtcagttgaacaaaccgtagaagaacaggcggatgctatcccacaggcggcggaagaaaccaccctcctcgacggcgttgagggcgaccaggtcggcgctgcggatgaccttgtcgtccagcttcacttccaccttgccgatcacctggccctgctggatcggcgccatcagctgcggctccaggaccatgctggcctgcagcttctgcatctggccgcgcggcagggtcatggtcaggtcttcggcgaggccggctttcacttcatgctcggaacccttccagaccaggcccttggtcagctcggtgcccttcttgtagaagttgcggctttcgaagaagcggaagccataggtcagcagcttctgggtctcggcggcgcgggcctgctcgctgttggtgccgaacaccacggcgatcatgcgctggccgtcgcgtaccgcggaagccaccaggcagtagccggcttcgtcggtgtggccggtcttcaggccgtcgacggtcttgtcgcgccacagcagcaggttgcggttcggctgcttgatgttgttccatag

SEQ ID NO: 5597 - DNA, 576 bp, Pseudomonas aeruginosa
gaattccttctgcgcgtagatcgcgtagtggctcggctcgccgtagatgatcgcgcgggccagcaccgccatgtcgcgggcggaggaatagtggtccgggttgggcaggccggtggcgtccatgaagtgggagttggtcaggcccagcttctgcgcggtggtgttcatcatgtcggcgaaggcgtcttcgctgccggcgatatgctcggccagggcgacgctggcgtcgttgccggactggatgatgatgccatgcagcaggtcgctcaccgatacctggctgccgaccttgatgaacatccgcgaaccgccggtgcgccaggcatgttcgctgacggtgaccaggtcgttctcgccgatgcggccggcctcgatctccttggtggcgatgtaggcggtcatcagtttggtcaggctggccggcggcaggcgctggtcgccgttgttctcgaccagaacctggccgctctcgccgtccatcaggacgtacgacttggcggccagttgcggcggcgccggaaccatggattcagcagcccagccagccgtaggggcgatgaacaggacaagcagtga

SEQ ID NO: 5598 - DNA, 492 bp, Pseudomonas aeruginosa
ccaccatcatgcccagtcccaggccgaacgaggtggcctgcttcatcagcatgtcccagctcttgccgctcgccgaatagaggacgaacaggccggtggcgccgaggatcagcaacagcagcaggagaatcccgtcgatgtgcaggcgctgcaacaggctggcgcgccggcgcatcacgtcttcgttggacagggtgcggtcgaagttactgttcaagggcgggcgcctccggctcggctgccgtgggttcgggcttggccaccgccgccgcgagcggcgcgacgggttccgcgtattcggccttgagcttgccgtgctcgtcgagcagccaggcgtccatcacctgcttgaccaccggggcggcgacgccggagccggactcgccgttctccaccatcaccgccaccgcgatctgcgggttgttggccggcgcgaagccgacgaacagggcgtggtcgcggtgccgctcgagcagcttggagcggtcgtag

SEQ ID NO: 5599 - DNA, 528 bp, Pseudomonas aeruginosa
cggatcaggcgcgccacgtcggcgttcttgccgcgggtgttgagcgggatctccaccagttcgagggacagctcggccggcaggcgcttgacgtattcctgccagccttcctcgacccagcgaggcatgcgcgagccaaccgcgatcaggcgcaaccgcatgccggcgtcactcttccggctggtgctgggcgcggctctgctcggcgccctgccacaggcgctccaggtcgtagaactggcgggtcgccgggagcatcacgtggaccaccacgtcgcccaggtcgagcagcgcccattcgccggactccaggccttcgctgcccaggggcttgacgccgttttccttggccttggtcaggacgttgtcggccagcgacttgacctggcggctggaactgccgcaggcgatcaccatgtagtcggtgacgctggtcttgtcccgcacatcgagggtcacgatgtcctgggccttgaggtcttccagggcatcgatggccacttggacgagttgttcggtttgcattga

SEQ ID NO: 5600 - DNA, 1611 bp, Pseudomonas aeruginosa
acaactggtcgtcggccgccagttccgcccgcaccgactccagggtgtcgatggtgtaggacggcttgtcgcgctgcagttcgcggggatcgaccgtcaatcgctcgactcccgccaccgcccgctcgaccatcgccaaccgctgcgcggccgacacctgcggggtttcccggtgcggcggccgcgcattgggcagcaggcgcagttcgtcgagggcgaactgctcggccatttccacggcgctgcgcatatgtccgatatgcacggggtcgaaagtgccgccgaacaggccgatacgtttgcccatcaggtgcgcacgtgaccgtcgccgaagacgacgtacttctcgctggtcaggccttccaggccgaccgggccgcgggcgtgcagcttgtcggtggaaatcccgatctcggcgccgaggccgtactcgaagccgtcggcgaagcgggtcgaggcgttgaccatcaccgaagcggaatccacttcggcgaggaaacgccgcgcatcgctgaagttctcggtaatgatcgcgtcggtgtgctgcgagccgtaggtgttgatgtgctcgatcgccgcgtccagcccgtcgacgatgcggatcgacaggatcggcgcgttgtactcggtacgccagtcctcctcggtagcctccagcacgtctgcgccgagcagcgcgcgggtcgcggcgtcgccgcgcagttccacgcccttctcgcggtagatcgtggccagcggcggcagcacctgctcggcgatgccggcatgcaccagcagcgtctccatggtgttgcacggtgcatagcgctgggtcttggcgttgtcggcgacgcgaatcgccttgtccaggtcggcggcgacatcgatgtagacgtggcagatgccgtccaggtgcttgatcaccggcaccttggcctcgcggctgatgcgctcgatcaggcccttgccgccgcgcgggacgatcacgtcgacgtattcgggcatgctgatcagcgcgccgaccgcggcgcggtcggtggtttccaccacctgcacggcggcggccggcaggccggcctcggccaggccctgctggatgcagcgggcgatcgcctggttggagtggatcgcctcggagccgccgcgcaggatggtcgcgttgccggacttcaggcacaggctggcggcgtcgatggtcacgttcggccgcgactcgtagatgatcccgaccacgcccagcggcacgcgcatcttgccgatctggatgcccgagggcacatagcgcatgtcgcggatctcgccgatcgggtcgggcagcgtggcgacctggcgcaggccctcgatcatgtcgtcgatgcgcgccggggtcagcgccaggcggtccagcatcgccggctccaggccattggcgcggccggcggcgaggtcctgctcgttggcgtgggacaactccgcgcgggcggcgtccagcgcatcggccgcggccagcagggcgcggttcttctgcgcggtggcggcgcgcgcgagcaaccgcgaggcggcgcgggcatcgcggccaaggcggctcatatagtcgaggacggactcggtcatggtctcggcatctggcgtcagggaaatgcgcgattatag

SEQ ID NO: 5601 - DNA, 1332 bp, Pseudomonas aeruginosa
acaaaattgctacctctgtttaccttcgaggcgagcctggccactgccacccaccggcacccgctcggcagaacaacaataacgacgcacacaccgcggggcctcgccatgcgctaccgtaccgactacagcgcgcagtcgctgagcagcgaaccggatatcctcttcctagacggctggcaactgcgctaccaggccttcgccgcccgcgccgacgacccgcgcccgccggtgctcctgctgggcggcgccttccagagcttccgctcattcaccggcgaggtcagcgaactgctcgccgagcacccggtgatcctgctcgacctgccgagccagggcggcaacctgcaactggcggcggaactgagcctggaagacctcgccgacctgatcgcggccttcgccgaacagctcggcctgccgccgttgatgcccatcggcctgtcctacggctcggccctggccgcgctgttcgccgcccgccatccgcgccgctgcgcgcgcctgctactggccggcatcaccgcattcggccgccccggtgcgcggctgctgctggaagaagccctggcccggctcgacgagggcgaccagagcgccttcgcccacggcgtactgaccggcctgatcaacccgctacagctggaacgtaccggcgtctccccggtatttcgcaaggccatgctgcgccagttgcaacgcctgaccgcggcggagatcgaacgctaccggcagaatagccggcgcctgctggccttcggcggcttcgagcggcacccgacctgcccgaccctggtgctcgccggcgagtacgaccatttcacccagccctgggaacatgcggtgttcgcccatgcctgcgggaacgccgagttcgccctgatccacgacgccgaccatcttgcccagttcgaacgacgcgaggcctgcgcccggctctacggcccgtttctgcgcggcgaggcactgccggagcgcgccgagggcagcacgcggatcccgcgcacgcgcctgctcggcctggagcgacgcttcgaggtccgccatcggccagcccaagggcacgctcggctggaacatccgcagttcggcgtctatgcggcggaactgatggaactcggctatttcggcgggcggctgcacgccgagctgcccgaatcccgcccgcaacgcggctggcggttgtgctgcgacggcctggcggacttggacatcctgcccctgcgctcgaccgccggcggcttcgccttcatcttcccgcactccgatccggcggccagcgccggactggccgacctcctcgccgcctgggagcgagcggaggtcgcctga

SEQ ID NO: 5602 - DNA, 1239 bp, Pseudomonas aeruginosa
tttgccctggcccgacgcccggccgctccccgacaccttcttcgaccgcgatgcgttgctggtcgcccgcgagttgctgggcaaggtgatccgccatcgccagggcaatctctggctggcggcgcgaatcatcgagaccgaggcctactacctggaggagaaaggcagccatgcctcgctcggctacaccgagaagcgcaaggcactgttcctcgacggcgggcacatctatatgtattacgcgcgcggcggcgactcgctgaacttcagcgccggcgggccgggcaatgcggtgctgatcaagtccggccatccctggctggatcgcatcagcgaccacacggcgctggagcggatgcagagcctgaacccggacagccagggccggccccgcgagatcggccgcctgtgcgccggccagaccctgctgtgcaaggccatggggctgaaggtgccggagtgggacgcacagcgcttcgacccgcagcgactgttcgtcgacgatgtcggcgagcgccccagccaggtgatccaggccgctcggctgggcattccgaaggggcgcgacgaacacctgccgtaccgtttcgtcgatgccaccttcgccgccttctgcacccgcaacccactgcgccgcggccaggtcgccgggcgcgactatcatctactcggacatcaggacccgcacctgcaatgagtctcgacagcttcaacgcctggatggccgccaaccccgagtggctggggctggccatcttcctcatcgccttcctcgaatgcgcggccatcgtcggtatcgtcctccccggcgtggtgctgctgttcggcgtcgcggtgatcgccggcagcggcgccctcggcctcggcgaaaccctgctgctggcctacgccggcggggtgctgggcgacctcagctcgtactggatcggccgccgcttccaccagaacatccgccgcctgcccggcctgcgcagccatccgcagtggatcaccgccgccgaggtgtacttcgaacgctacggtatcgccagcctgctggtcggccgcttcatcggcgccctgcgaccgatgctgccgatggtcgccggcatgctcgacaagtgtgatccgtgcctggactacgctgaaaagcgaaatctgccgtggcacgcgcatcgcctccgacaaggagcgtgctgcttgcgacccgtgatcgtctcttgttgcagcccccagtggatggtcattcagttggcatag

SEQ ID NO: 5603 - DNA, 327 bp, Pseudomonas aeruginosa
  unsure (124): Identity of nucleotide at the above locations are unknown.
tgcaagatggcgcggtgctcgcgtcgcgccacccccgcggagacgaaaatgccaaggtggccaacatgttggtgcaacaggtacaccacgcgctggcccgccgccaccaagtctgcggtcgtcngatataccgctttgagccagccgaacgcctggtgggggcgtgtgatgttggtcccgtttgagcaaaaaaccacagcggtgcgccaatgccgtgaaatcccgcgggaatggccatccaacaagaactcgccgctcctcaagttaataaccaccaaaaagatcgccggcgatcgaaaactttcctccccgggcaacctggtataa

SEQ ID NO: 5604 - DNA, 861 bp, Pseudomonas aeruginosa
atcatggttgaacgagagcgtgtcgacagtgcccacatcacgcccagcgcccattacaccgggtacgtctggttccgccatcgactcgccgaaccggccttcgccaccgtcttcggccgctgggtacacggcttcgtcgcgccgatcaactggggcgcgcagctcggtttcggactgaacatcgaggatttcctgttacaaagacacctcatgatcgacgcgcgcctgacccaggccgtcgaacgcgagggagtggtccaggtggtggaaatggcctgcgggctctcgccgcgtgggcgacgcttccggcaacgctatccacagttgcgctacctggaggccgacctgccgccgatggccgcgcgcaaggcggcgttgctccgcgagcagggttggctgggcccgaagcacgcggtggcggctgtggatatcctcgccgaggacggcgagcgcagcctcgccgcgctgttcgccgggctcgatcgcgagcgcccgctggtggtggtcaccgaggggttggtgaactatttccagcgcccggtgatcgaggccttctggagtcgcctggcgaccgaacttaaacgcttcccccagggcatctacctgaccgacctctatcccgatctccgcgagcacccgcgctaccggcagatccgctggggagtggggatcatcgggcggctgacgcggggaagctatccgttgcattaccgcaatgccgcggaaatcgaggcggccttcgcccgctgcggcttcgcctccaccctggtgctcgacccgcagcgcgaaggcgccgccctgggcttgccgcagggacgcctgccgagcctggtgcgggtaatcgaaagccgcacggcatag

SEQ ID NO: 5605 - DNA, 2118 bp, Pseudomonas aeruginosa
acagaggtagcaattttgtttacctatccttcggccggcgcctgcgcccaggtgtcaccgtctcgcgcacagccccaggcgcagcggggctgccgcgttaccgccgggggcgatggaacgcactgtctaccgaccggctgttgcggctgggcgcgccggggctggctcgctataatcgcgcatttccctgacgccagatgccgagaccatgaccgagtccgtcctcgactatatgagccgccttggccgcgatgcccgcgccgcctcgcggttgctcgcgcgcgccgccaccgcgcagaagaaccgcgccctgctggccgcggccgatgcgctggacgccgcccgcgcggagttgtcccacgccaacgagcaggacctcgccgccggccgcgccaatggcctggagccggcgatgctggaccgcctggcgctgaccccggcgcgcatcgacgacatgatcgagggcctgcgccaggtcgccacgctgcccgacccgatcggcgagatccgcgacatgcgctatgtgccctcgggcatccagatcggcaagatgcgcgtgccgctgggcgtggtcgggatcatctacgagtcgcggccgaacgtgaccatcgacgccgccagcctgtgcctgaagtccggcaacgcgaccatcctgcgcggcggctccgaggcgatccactccaaccaggcgatcgcccgctgcatccagcagggcctggccgaggccggcctgccggccgccgccgtgcaggtggtggaaaccaccgaccgcgccgcggtcggcgcgctgatcagcatgcccgaatacgtcgacgtgatcgtcccgcgcggcggcaagggcctgatcgagcgcatcagccgcgaggccaaggtgccggtgatcaagcacctggacggcatctgccacgtctacatcgatgtcgccgccgacctggacaaggcgattcgcgtcgccgacaacgccaagacccagcgctatgcaccgtgcaacaccatggagacgctgctggtgcatgccggcatcgccgagcaggtgctgccgccgctggccacgatctaccgcgagaagggcgtggaactgcgcggcgacgccgcgacccgcgcgctgctcggcgcagacgtgctggaggctaccgaggaggactggcgtaccgagtacaacgcgccgatcctgtcgatccgcatcgtcgacgggctggacgcggcgatcgagcacatcaacacctacggctcgcagcacaccgacgcgatcattaccgagaacttcagcgatgcgcggcgtttcctcgccgaagtggattccgcttcggtgatggtcaacgcctcgacccgcttcgccgacggcttcgagtacggcctcggcgccgagatcgggatttccaccgacaagctgcacgcccgcggcccggtcggcctggaaggcctgaccagcgagaagtacgtcgtcttcggcgacggtcacgtgcgcacctgatgggcaaacgtatcggcctgttcggcggcactttcgaccccgtgcatatcggacatatgcgcagcgccgtggaaatggccgagcagttcgccctcgacgaactgcgcctgctgcccaatgcgcggccgccgcaccgggaaaccccgcaggtgtcggccgcgcagcggttggcgatggtcgagcgggcggtggcgggagtcgagcgattgacggtcgatccccgcgaactgcagcgcgacaagccgtcctacaccatcgacaccctggagtcggtgcgggcggaactggcggccgacgaccagttgttcatgctgatcggctgggatgccttctgcggcttgccgacgtggcaccgctgggaggcgttgctggatcactgccacatcgtcgtgttgcagcgtccggatgccgacagcgagccgccggagtcgctgcgcgacctgctggcggcgcggagcgtggccgacccgcaggccctgaaagggccgggcggacagatcaccttcgtctggcagacgccgctggcggtgtccgccacccagatccgcgcgctgctgggtgccgggcgctccgtgcgtttcctggtgccggacgcggtattgaactacatcgaggcgcaccacctgtatcgtgcgccacactga

SEQ ID NO: 5606 - DNA, 399 bp, Pseudomonas aeruginosa
agaaacagagaccgactcaatgcaaaccgaacaactcgtccaagtggccatcgatgccctggaagacctcaaggcccaggacatcgtgaccctcgatgtgcgggacaagaccagcgtcaccgactacatggtgatcgcctgcggcagttccagccgccaggtcaagtcgctggccgacaacgtcctgaccaaggccaaggaaaacggcgtcaagcccctgggcagcgaaggcctggagtccggcgaatgggcgctgctcgacctgggcgacgtggtggtccacgtgatgctcccggcgacccgccagttctacgacctggagcgcctgtggcagggcgccgagcagagccgcgcccagcaccagccggaagagtgacgccggcatgcggttgcgcctga

SEQ ID NO: 5607 - DNA, 1269 bp, Pseudomonas aeruginosa
tggacgcctggctgctcgacgagcacggcaagctcaaggccgaatacgcggaacccgtcgcgccgctcgcggcggcggtggccaagcccgaacccacggcagccgagccggaggcgcccgcccttgaacagtaacttcgaccgcaccctgtccaacgaagacgtgatgcgccggcgcgccagcctgttgcagcgcctgcacatcgacgggattctcctgctgctgttgctgatcctcggcgccaccggcctgttcgtcctctattcggcgagcggcaagagctgggacatgctgatgaagcaggccacctcgttcggcctgggactgggcatgatggtggtcatcgcccagatcgagccgcgcttcatggcccgctgggtgccgctgggctacctggtgggggtcgcgctgctggtggtggtcgacgtgatcggccacgacgccaagggggcgacgcgctggatcaacatccccggggtgatccgcttccagccctcggagttcatgaagctgctgatgccgatgacggtggcctggtacctgtccaagcgcaacctgccgccggggctcaagcacatggtgatcagcctggcgatcatcatcaccccgttcgtgctgatcctgaaacaacccgacctcggcaccgccatgctgatcctcgcttccggcggcttcgtgctgttcgtcggcggcctgcgctggcgctggatcgtcggcgcggtgtcggcggcggtgccgatcgccgtggcgatgtggttcttcatcatgcacgactaccagaaacagcgggtgctgaccttcctcgacccggaaagcgacccgctgggcaccggctggaacatcatccagtctaaggcggccatcggttccggcggggtattcggcaagggctggctgctgggcacccagtcgcacctggattttttgccggaaagccacaccgactttatcattgcggtcctcggcgaggagttcggcctggtcggcgtctgcctgctgctggtgctctacctgctgctgatcagtcgtggcctggtgatcaccgcccaggcgcagacgctctacggcaaactgctggccggtggcatcaccatgacgtttttcgtttatgtcttcgtgaatatcggtatggtgagcgggttgttgccggtggtgggggtaccgctgcctttcattagttatggcggaacttcgctggttaccctgttgtcagggttcggggttctgatgtcgatccatacccatcggaagtggatcgcccaggtttga

SEQ ID NO: 5608 - DNA, 822 bp, Pseudomonas aeruginosa
atccatggttccggcgccgccgcaactggccgccaagtcgtacgtcctgatggacggcgagagcggccaggttctggtcgagaacaacggcgaccagcgcctgccgccggccagcctgaccaaactgatgaccgcctacatcgccaccaaggagatcgaggccggccgcatcggcgagaacgacctggtcaccgtcagcgaacatgcctggcgcaccggcggttcgcggatgttcatcaaggtcggcagccaggtatcggtgagcgacctgctgcatggcatcatcatccagtccggcaacgacgccagcgtcgccctggccgagcatatcgccggcagcgaagacgccttcgccgacatgatgaacaccaccgcgcagaagctgggcctgaccaactcccacttcatggacgccaccggcctgcccaacccggaccactattcctccgcccgcgacatggcggtgctggcccgcgcgatcatctacggcgagccgagccactacgcgatctacgcgcagaaggaattcctatggaacaacatcaagcagccgaaccgcaacctgctgctgtggcgcgacaagaccgtcgacggcctgaagaccggccacaccgacgaagccggctactgcctggtggcttccgcggtacgcgacggccagcgcatgatcgccgtggtgttcggcaccaacagcgagcaggcccgcgccgccgagacccagaagctgctgacctatggcttccgcttcttcgaaagccgcaacttctacaagaagggcaccgagctgaccaagggcctggtctggaagggttccgagcatga

SEQ ID NO: 5609 - DNA, 1017 bp, Pseudomonas aeruginosa
acagaagacccttacgggcgggatcgaactgacatgagcactgttgtggagaagtccggagaagccaagccgggcaaggtggaagtcggcgtgaagctgcgcggcgcggaaaaggtcgcgcggattccggtgaagatcattcccaccgaggaactgccgaagaaacccgactggatccgcgtgcgcatcccggtttcccccgaggtcgaccgcatcaagcaactgctgcgcaagcacaagctgcacagcgtctgcgaagaggcgtcctgcccgaacctgggcgagtgcttctccggcggcaccgcgaccttcatgatcatgggcgatatctgcacccgacgctgcccgttctgcgacgtcggtcatggccggccgaagccgctggacgtcgacgagccgaccaacctggccatcgccatcgccgacctgcggctgaagtacgtggtgatcacctcggtggaccgcgacgatctgcgcgacggcggcgcccagcacttcgccgactgcctgcgcgagatccgcaagctgtcgccggggatccagctggaaaccctggtgcctgactatcgcggtcgcatggacatcgccctggagatcaccgccaacgagccgccggacgtgttcaaccacaacctggagacggtgccgcgcctgtaccgctcctcgcggccgggctcggacttcgagtggtcgctggacctgctgcagaagttcaagcagatggttccgcacgtaccgaccaagtccgggctgatgctcggcctgggcgagaccgacgacgaggtcatcgaggtcatgcagcggatgcgcgagcacgacatcgacatgctgaccctcggccagtacctgcagccgtcgcgcaaccacctgccggtgcagcgtttcgtgcatccggacaccttcgcctggttcgccgaggaaggcgagaagatgggcttcaagaacgtcgcgtccggcccgctggtgcgttcgtcctaccatgccgaccagcaggcgcacggcaacaagatcggctga

SEQ ID NO: 5610 - DNA, 921 bp, Pseudomonas aeruginosa
gatgtcccttctttctcttggagaggtccgatgagccgctatgccttcgtttccgccgatgtcctggatatcgcctacctggagtggaatccgcagggggcgcgcagcgccgtcttgttgcacggttggccggacagcccgcatacctggaaagacctggcggagtccctggcggacgccggctatcgggtgctggcaccagccctccggggattcgccccgacccggttccgcgatgcgtctactccgcgcagcgggcaactggcggctctggcttgcgatctgctggcattcgtcgacagcctggcattgcaacgtcccctgctggtcggccatgactggggggctcgcgcggtggctagtgcctgcggactgcgcgagggcgtagcctcgcacctggtgatgctctcggtggggtacgccagcaacgatccgcagcaagttctttccctgccgcaggcccgtagcttctggtaccagtggttcatggctacgccacgcggagagcgcgcgctgcgcgaggagggcgaggcattcgcccggcagatgtgggacacctggtcgccgccgggatggtatgccgagcgcgatttccaggaggccgcccaggccttctccgggccggactgggtcgccgtggtgctgcactattaccggcatcgctggggcttcgtcgcgggggagccgcgctacggggcggcggaacagcgcttgctcccggcaccgcgcctggcgctgccgaccctggtgctgcacggcggcgcggatgcctgcacccaccccgacggctcccgcggacgcgagcactacttcagcgggcgctaccagcggctggtgctggagagcgtcggccattttccgcagcgcgaggcggccgcccaggtggcggacgctatcctgcggttctgcgcggatgactag

SEQ ID NO: 5611 - DNA, 651 bp, Pseudomonas aeruginosa
tcttgtccagccaggacttgtgcccgttgctcgatcggtcttcgctcatttttccttgctcggtggctcttcgtcgtcgcaggcgtacggatcgggatgacccagttccgccagcaattcacgttccagtgtttccatttcttccgcttcggcgtcgtcgatgtggtcgtagccgagcaggtgcaggcagccgtggatcaccaggtgggcccagtgggcctgcaacggcttgcgctgttccagggcttcgcgggcgaccaccggggcgcagatcaccaggtcgccgagcagcgggatatcgagaagctcgtccgggacatcggcggggaaggacagcacgttggtcgcgtagtccttgtgccggtaggtgctgttcagttccaggccttcggcctcgtccaccaggcggatggtcagctccgactccggacgctggcgcagggccagttcgcaccaggcgcggaactgcgcttcggagggcaggtccggggcggcgctagcgacctgcaggtcgagctcaagcggcatcgtgaccgcccttgcccgttccctcgaccggccgcacctggccttgctggcggctctcgtgacgctcgtaggcttcgacgatacgctgcaccagcgggtggcggaccacatccttgggcttga

SEQ ID NO: 5612 - DNA, 477 bp, Pseudomonas aeruginosa
aaagcttcttggccatgcgcttcgtcggacagttcgaaaaggaccgcgcattatagagggcggggcccccggttcctagcgttgctggccgaaaggctgtgctatgattcgcgcccttcattttccggcattgctttccccgccatgaacaagcgcgaaaaccccatctacaaggtgattttcctcaaccagggccaggtcttcgagatgtatgccaagcagatctaccagagcgatctgtggggcttcctggaaatcgaggagttcgtcttcggcgagcgcacccaggtggtggtggaccccagcgaggagaagctcaaggcgcagttcgaaggcgttctgcgcagcttcgtgccgatgcacgcgatcgtccgcatcgacgaggtcgagcgcctgggtacgccgaagatcagcgaggccaagggcgcgggcaacgtcatgccgttccccatgccgatgcccggcaagagcgactga

SEQ ID NO: 5613 - DNA, 753 bp, Pseudomonas aeruginosa
gcgccttcggcgtgcttgaagaacagcggggtgccgccgacgctcttgaaggcgcgcaccggggagttgaccccgccgggaatgtgtttctgggcgttgttgaacagcgtttcggaacgggacatggctagctctctatctctcgggcgaggcgcggaggcgtcaggcaggttcgaacagggcgctgaaggcgcgggcgcggcgttccacctcggcggcggacgcggcggcgaacagcgcatggatcacggcgaccagatcgacgccgcgggcgatcaggccgggcgcggtgtcgaggctgatgccgccgatggcggtgatcggcaggtgcaggcgcggccgggcctggtcgagcagttcgacgctggcggcgggggcgccgggtttggtgctggaattgaagaagcggccgaaggcgacgtagctggcgccctcggccaccgcttgctcggccagttccagttgggcgtggcaggtggcgccgatgatcgcctggcggccgagcagggcgcgcgccgccgacagcgaaccgtcggtctggccgaggtgcaggccgacgcccaggcgcgcggcgagttcggcgtcgtcgttgacgatcaactgcgcgccgtggcgttcgcagagttcgcgcaggctttccgcctcgcgcaggcgccgcgcctggtcgctggatttgtcgcggtattgcagcaggcgcgcgccgccgcggagcgcggcttcgacgtagggcagcaggcggccgtcgtccagtag

SEQ ID NO: 5614 - DNA, 1512 bp, Pseudomonas aeruginosa
caaggacgtgctcaatgccggctattcgcgctcggtgttctggttgcgcctggacctggactaccggccggtcgcctccagcgatccgcgcacctggctgctggagctggcctatccgccgctggacaagctcgacctctacctgcccgatggccagggcggctaccgcctcgcccagcgcaccggcgacacattgccgttcgccagtcggccgatccggcagaacaactacctgttcgaactcggcctcgagccgaacaagccgcagcgtgtctacctgcggctggaaagccaggggtcgatccaggcgccgctgaccctgtggtcgcccaaggcctacctggaggagcagcccgaacgcatctatgtgctcggcatcatctatggcgtgctgctggtgatgctgatctacaacctgttcatcttcctcagcgtccgcgataccagctatctctactacatcctctatatcgcttcgttcgggctctaccaggtctcggtgaacggcgccggcatcgagtacttctggcccgacagcccctggtgggcgaacgccgccacgccattcctgatcggttcggcggcgctgttcggctgccagttcgcgcgcagcttcctgcatacccgcgaccacagcgtgtgggtcgaccgcggcctgctggcgctgatggcggtcggcgcgctggtcatgctgatggcgctgaccatgagctacgccgtggccctgcgcctggccacctacctggcgctggccttcaccggcctgatcttcgccgccggcatcctcgcctggctgcgcggcatgcgcgtggcgcgctatttcatcatcgcctggaccgccttccttctcggcggcatcgtcaacaccctgatggtcctcggctacctaccgaacatgttcctcaccatgtatgccagccagatcggttcggcgctggaggtgggcttgctgtcgctggcgctggccgaccggatcaacgcgatgaaggaggagcgcgcgcgaatcctccaggagtccagccgcaagctggaagcgctgaaccaggaactggccaacagcaaccgcctgaaggaggagttcctcgccaccgtcacccacgaactgcgcaccccgatgagcggggtgatcggttcgctggagctgatgcagacggtgccgatggacgtcgaactcgccgagtaccagcgcaccgccgccggttcggcgcgggacatgatgcggatggtcaacgacatcctcgccctcatcgaactgcaggccggcaagctctacccgcgccgcgagccgttcagcctgcgcggcctgttcgacagcctgcgcgcgcagtacgcgccgcgcgccgaggagaagggcctgcgcttcgccctgcaactggacgacagcctgccggacaccctcgaaggcgatgccggcaagctggcccaggcgctgggctacctggtcgacaacgcgatcaagttcaccgccaggggcagcgtgaccctgcgcgtcgccgccgggcgtacccatga

SEQ ID NO: 5615 - DNA, 405 bp, Pseudomonas aeruginosa
cggggtggcgctgcgggtggaagtgatcgacaccggcatcggtttcgacatggccgccggcagcgacctctaccagcgtttcgtccaggccgacagctcgttgacccgtggctacggaggcctcggcatcggcctggctctgtgccgcaagctggtggagctgcttggcggcgagctgacccacgagtcccggccgggacagggcagccgcttcctcctgcgcctgcaactgacccagccggcccagggcctggcgccgccgccgcggcgcgccggcgggcaggcggtgcggcgtcccgaggagtgcacggtgctggtggtggaggacaacgccatcaaccagttggtgactcgcggcatgctgctcaagctcggctaccgggtgcgcaccgccgacaacggtag

SEQ ID NO: 5616 - DNA, 2187 bp, Pseudomonas aeruginosa
  unsure (2096): Identity of nucleotide at the above locations are unknown.
agtcgacgagcagcgcctgcgctatcgcgaggcatacgccgcactgttcgtcgaactgctcgaggagggccggcgcagtggcgcattccagctttccctggtgccgcttgccgcggcctgcctggtcggggccatcgccgaggcgctggtcggccccttgtctcccccggcgcgcgccgctcgcgacagcggccagccggaaccgagtctggagccggtgagtacggctctggtgaacttctgcctgcgcgcggtgggcgcgcctgtctgcgaggaaccctcatgaacctgcaccagtacgccgaaacccacgaagtgaccaaccaggtaccgtcgctggatggcgccaacctctaccgcctcgatctgcctctccaggagtgggtgcgtcgctaccagggcggctgggccgaggagcgcctgcagcgctacggtgagctggccggcggcccgctgatggcggccggcttcctggccaaccagcacaagccggagttccatagccacgaccgctacggcaaccgcgtcgacctggtggagttccatcccgcctaccacgagctgatgcgcgccgccatcgagcacgaactgccctcgctgccctggaccgacccgcgccccggcgcccaggtggcgcgggccgggctgtcctacctgcacagccaggcggaggccggcaccggttgcccgttgaccatgacctacgccagcgtgccggcgattcgcctgcaggcggacctggccgagaaatggctgccgaagatcctctcccgcgagtacgacccgcgcaacgtgccgatggagcagaaggcgggcgtcaccatcggcatggcgatgaccgagaagcagggcggcaccgacgtccgggccaataccacgcgggcctacccggtggggattcccgggccggggcaggcctacgaactggtcgggcacaagtggttctgctcggcgccgatgtgcgacgccttcctcaccctggcctacaccgacaagggcctgacctgctttctgctgccgcgccaccggccggacggcagccgcaaccagttctacatccagcgcctgaaggacaagctgggcaactggtcgaacgcctccagcgaaatcgagtatcgcggcgccctggcctggatggtcggcgaagagggccgtggcgtgccgaccatcatcgagatggtcgccatgacccgcttcgactgcatgatcggctccagcgcactgatgcgtcaggcgttgacccaggccgcccaccactgtgcctaccgcaaggtcggcgggcgggtgctggccgagcaaccgctgatgcagaacgtgctcgccgacctggccctggaaagcgaggcggcgctggccctgaccctgcgcatggggcatgccctggaccgtggccacgacgagcaggaggagaagttcgcccgcctggtcaccgcggtgggcaagtactggatctgcaagcgtgccccggcgatgatcaacgaagcctccgaatgcatgggcggtgccggctacgtcgaggaaaccatcctgccgcggctgtaccgcgaggccccggtgaactcgatctgggaaggttccggcaacgtgcagtgcctggacgtgctgcgtgccctgtcgaaggagccgggggtgctcgacgcgttgttcgccgaactgggcgacggccatggcgacgcccgtctcgccgcgcacatcggcaacctcaaggcgggcttcgccgacaccgccgacatccagtaccgcgcccgccagctcaccgaggacgtggcgatcgccctgcaggccaagctgttgctggaagccggcaactccgcggtgtccgacgccttcatcggcagtcgcctgggggacggcgggcgggtctacggcaccctcccgcgcggcgtcgaggtcgaggcgctgttggctcgcgccaccccgcactggcctgaggcgcgtcgcgatgcaggcgcatccgcgctaccgggagctggtcgagcagggcttcgccgcggccagtttcgtcggcgacctcggcatccgtccgctggactgcgggccgggttgggtcgaagcggggctggacatcctggccccgccacgcccagcagaaaggnttcatccatgccgggatccaggagaccatggcggaccatgccgccggggccgccgccgcgaccctggtggaggaggggcagacggtgctga

SEQ ID NO: 5617 - DNA, 1224 bp, Pseudomonas aeruginosa
ggcccgcgagcgcctggccgggatggccgcgcgcctggaaagctggctggccctgggcggccgtggcgaccaggcttgtccgtgcggcagcggcaagcgctaccgcaactgctgctcccgcctggtggcctcggcctcctgagcgacgttgcgcggtgcgacgcgccactgctcgccgggtttcggcgtgccgaaggtcgccgggtccacgccttggctgcgcagcgccgcctggagcgccttgggcgggtcgtcctgctgttcgtcggtgagattgaaggtaccgaagtggatggccatgctggtctgcgcctgcagcgtgcgatgggcctgcaccgcgtcgtcgggattcatgtggtggtcgcgcatgaaccagcgcggctcgtaggcgccgatcggcagggcggcgaagcgcatcgccccgaagcgctggtggatcagcccgaactccgggccgagcccggtatcgccgggaaacagcagcgggccgtccggcgagtcgatgacgaagccgagccagagcgtgcggttggtgtcgctgcgggtgcgcgacgaccagtgctgcaccggtacgccatgcagcgtcaggccagcgcccagcggcacggcctgccaccagtcgatctccacgacgtcggcgaaacctgtctggcggatcagcccggcgttgcccaggccgctgactaccttggccgtcggccagcgccggtggagctggcgcagggtttccaggtcgaggtggtcgtagtggttgtggctcaccagcaccaggtcgatcggcggcaactggtcgagcgtcaacccgggcggatggtggcgcttcgggccgatgaaggcgagcgggctgacccgttgcgaccagaccgggtcggtgaggatgttcaggccgcggtgctggatcagcagggtggcgtggttgatgtaggtgacccgcagttcttcgccgcgggcgcgttcgttcacccttggcggcgttgccgtcggcggcagggcgacccacgggcgttgcggcgggcggttccactgccacttgagcaggtcgcgcaggctcttgtgcgcggtcggctggatattgcggaaacgttcgccgtcgaaatggtccgaaggcggaccctgataggcgctgccagcgcagccggccagggtcagcaggctgatcagccaggtgggacgcagggagggcatgaggggatgctcttgcggtcaggctctcggacaacctag

SEQ ID NO: 5618 - DNA, 669 bp, Pseudomonas aeruginosa
catgccgcccggtaccccgatcaagccaactcgtttccagtcatgtcccgtcccccgcgtccttccccgcgtcatcccgttcgccctgcgccacgccgggtggccaaggcgccgccgagcgagccgaagctgctgctgttcaacaagccgttcgacgtactgacccagttcaacgacgagcaagggcgttcgaccctcaaggacttcatcccgttaccgggcgtgtatccggccgggcgcctggaccgcgacagcgagggcctgttgctgctgaccaacgacggtcgcctgcaggcgcgcatcgccgacccccggcacaagctgccgaagacctactgggtgcaggtcgaaggcacgccggacgaggagcaattgcggcgcctgcgcgagggtgtgacgctcaacgacggcccgacgctgcccgccgaggcgcgtctgctggatgagccgacgttgtgggagcgggtgccgccggtgcgttttcgcaagtcggtgccgacctactggctggaactggtgatccgcgaggggcgcaatcgccaggtgcggcggatgacggcggcggtgggcttgccgacgctgcggctggtgcgggtgcggatcggcccctggagcctggacggcctgggcctcggggaatggcgggaagtgccggcgcggctggactga

SEQ ID NO: 5619 - DNA, 630 bp, Pseudomonas aeruginosa
gcctgtgcgtccaggcgcaggccgacgacggccgagggggacgcggtggacccggcggcgagcgcggtgttgcccacggacaaccgggacctggccgcggcgaagcgtacggcggcagttggggaccgcatcccgactggcgtccgggccgggtggtggaggccttgccgcgcgggcacctgcgggtgccctatcgcggcggcgagtatttcttcgacgacggctactggtaccgacacgacggcccgcgctatgtgctggtcgtgccgccccgcggggtgcgcgtccgcagcctgccaccctatgcggagcaggtctggctgggcagcgtgctgtacttccttgccgccggcacttactacctgtggcatgccgacacccgtgagtacgaagtggtcagcccgccgccgcaggcagcgggacccggttatccggtcagcgtgccggccaccggctacgacgtggtggcctacccggcgcgcggccaggggcccgaccagcagagccgcgatcgctacgagtgccaccgctgggcggtgggcgagagcggcttcgacccggcgggggcgacctatgcgccggccgccgaggtcgccaacggctaccgccgggccatggccgcctgcctga

SEQ ID NO: 5620 - DNA, 951 bp, Pseudomonas aeruginosa
gcgggcgcggctacagcgtcaactgacggtttccttgccgaccacttcctgtgggtcggcatggatcagcacctcggctttcgggtattcgcgcttgatcgccagcactgcgcggtcggtcagggcgtgggccaccgacaggctcagctcgccgggcagctcgagatgcaactggacgaaccagtggttgccggagatccgcgtgcgcacgtcgtgcgcgccgagcactcccggcacgctgcaggcaagttcgcgcatgcgctcgctgatgtcggtgggcagttcccggtccatcaggatcgacaccgactcgcgagcgatctgcagggcgctccagaggatgtacagggcgatgcccaggccgaacagaccgtcgctctgcggccagccgtagcgggccaggagcagtgccacgaggatgctggcgttgagcagcaggtccgagcggtagtgcagcgagtcggcgcgtatcgcggtggaaccggtgcggcggatgacgtgggtctggaaggccaggagaagggccgtgagcagcagcgacagcagcatcaccgcgatgccccaggtggccgcgccgaggggctgcgggtcgcgcaattgctcgaccgcctggatagccaccagcaccgcgctggcaccgatgaacatggcctgggccaggccggccagggcctcggccttgccgtggccgtagcggtggtcgtcgtcggccgggcgcagcgaatagtgcaccgccagcaggttgagcagcgaggcggcactgtccagcagggagtcggtgaggccggcgagcaggctcaccgaaccgctcagccaccaggcgatggccttgccgatgaccagggtgacggcgactccgagcgaggccagggtggccaggcgcagcaggcgggcgtggggggaatcgggactcatggggcgcttctgtcaggagggacggcgccactgtaa

SEQ ID NO: 5621 - DNA, 519 bp, Pseudomonas aeruginosa
cggcgaactatagcaatcgaccagcgttcggcaatcttctgccgcgacgatgacgataagaccgccgaaagcgcccgccggttcgccggtatacttcgccggtcagtccggagccagcatgatttccctacccatcgacgccgttgttcccgccctgcgccaggcccttggcgcacaacaccaggccgttctggaagccccgccgggcgccggcaagaccacccgcgtgccgctggccctgctcgacgagccctggctcgccggccaacgcatcctcatgctcgaaccgcggcgtctggcggcgcgggcggcggccgagcggctggccgacgagctgggcgaaaaggtcggcgagaccgtcggctaccggatccgcctggagagcagggtcggcccgaagacccgcatcgaagtggtcaccgagggtatccttgcccgtcgcctgcaagacgacccggcgctggacggtgtcggcctggtgatcttcgacgaattccacgttttgccgattgcacgtaa

SEQ ID NO: 5622 - DNA, 2631 bp, Pseudomonas aeruginosa
atcatcattttcttgtcaaaaactcccatccttcccttcacagtccttgagctgagccaactctccacagagcccgtcgtatactgcctccctgatttgggagcctcgatgatttctctacctattgacctcgtattgccagacctacgagaggccctggccaatcgcaacgaagtgatccttgaagcaccacctggtgcgggcaagaccactcgagtgcccctggcgctgctgaatgagccttggcttggtgaccagaagatcctgatgctcgagcctcgtcgcttagctgctcgggcggcagcagagcgtttggcgagtgagctgggtgagaaggttggggagactgtcggctaccgaattcgccttgaaagcaaggtaggcccgcgcacccagatcgaagtggtcaccgaaggtatcctggctcgccgtctccaagatgatcctgcgctggacggtgtgggcgtggtcatcttcgatgagtaccacctccgaaacctcgactccgaccttgcactcgcgctgtgcctgagtggccgtgagctcctgcgtgaagagcccccgctgaagttgctcctaatgtccgcaacgctggaaggtgctcgcctttccaaggtgctgaatgacgctcctgtggtcaccagtgaagggcggatgtttccggtctctacggtttggggtagcccctatcagccgggcgagcgaatcgatgcgcgagtcacagacacctgcttggccgccatcaatgaacagtcgggaagcgttctggttttccttcctgggcaggcagagattcggcgggtggcagaagacctcaaggagcagctgagcagccgtccagaggtgatcgtatgcccgctgtacggtgacctcgatctgaacgcccagcgtgctgctattgaccccgcacccaagggctcccggaagatcgtactggccacgaacatcgccgagaccagcttgaccatcgaaggcgtcagggtcgtggtggacagtggtctggagcgagtgccgaagttcgatcctcgcagtggcatgacccgactcgacactcagcgtatctcgaaggccagtgctacccagcgtgcggggcgggcagggcgcttggagccaggtgtctgctatcgcctgtggtcggaatcgcagcacgagcaaatggccggctacagcaccccagagatcctgcaggcggatctcgcagctctggcactccagctggcccggtggggaatgaagccagaagagatgacctggctcgaccaacctccatcagctcctttcggccaagccagagacctgttgaagcgcctgggcgcactcgacgatgcaggacagctcacaccgcacggatcagccatgagcgagctcccagcgcatccacggatcgctcacatgctcatcaaaggcaatgcgatgggcctagatgacctggcgtgcaacatcgcggcgctgctcggagagaaagacatcctacgtggagccggtgctgaccttcacaccaggctgagtgccttgtcaggcgagcaacattcacgtcgtagtggtggttccctccagcgggtgaagcagtcggctcggcagtaccgatccctgctgcgcgggaaggcctccagccctgtcagcgagcctgatcacccacggtgggtagggtgcctcctggcgtttgcgtaccctgaccgaatcggcctgcagaggcgtgcaagtgcatccgaataccgtctgtccaacggtcgtgctgcggtgttctcagagcccgatgctctcaccaaacatgagtggctggtggtggccgacctgggtagccggcaagggcagcgtgaggaacggatctacttagcgagtgacctcgatccggctctgttcgatgacgagctggctgacctggtgaggtcggtggatgaggtcgactgggacgaaagggaaggtgttctgaaggctgagcggcagttgaaggttgggcagctgatcttgtcgacgaaagccctaccgagtcttgatgagcaaactcgttcgctggccctggtcaacctggtgaggcgcaagggcatcgagctcctgccctggaacccggagcttcggcagtggcagtcgcgggtcgacctactgcgtcagctcgatatccagagtggccaggcagaaagtaagtggcctgatctcagcgatgccaacctcctcgacacgctggaagagtggctcacgccgtacctgggtaaagtcacgaggctcagtcacttcagccagttggatctgtcgtcgatagtcaggaaccttctgccttggccgcttccgcaggagctggaagtccaggcgcctcaggcgattcaggtgccgtctggttcgaatatccgcatcgattactcgcagcatccaccgatcctcgcggtgaggctgcaggagctgtttggcctggcagaaacaccacgcatagcccagagcaggcagccgctgattctgcatcttctgtcgccggctcgtaggcccgtgcaggttactcaggatctggcgaacttctggcgaagcacctatgtagaggtgaagaaggatttgaagggtagataccccaagcatcattggcctgaagatccattggttgctgaagcgacggccagggcgaagcctaggaaaccttga

SEQ ID NO: 5623 - DNA, 189 bp, Pseudomonas aeruginosa
atttatgactccaggggaaaaatacgaagacgtacactcggcctggattacagacggagtaagtcgttcgtgctgagcgtgttccgctggggactgtatggaatttatcgaatagggcagttgcaaggagactactcgacagaaggttttccgacgccaacacctgcacagcatttgcatgcgttatga

SEQ ID NO: 5624 - DNA, 690 bp, Pseudomonas aeruginosa
cgtggccgagcacgcgccgcgcctggagggtgtcggcggccagctccggcttggccgcgccggcccacagcgccacgctgccatcctgcagccccaggtacaggcgcgcgctgggcagggcgcggaacgccggacgatagccggcccgctccagcagcaggcggaccaggcgggcgccggaaccggcggcgtggccatcccgggcggtatagatgtagggggggaattcgtagtagccgacgttcaacgacggccttgcgtcctgcgcatggagctgcggggcggccagcagggcgaacgccagcagcgcgagcaggggcgttgtggtgcgtaggggcatggtgtgcggccttgccgttttttgttgttatgaatgggggcgaagcatgcggcgcgccgggccgcttgtccagcccggcgcgcgcccggtcaatggggcagcaggaagcgcgcggcgagcggcaggtggttggagatctgcagcgtatcgctgcgccggacccgggcatcgagacgggtcagcgaggggctgtggaacaggtagtcgaggtccgatccggcccctggacccgtgggtcgttggggaagtgcgtgtaccagcgaacctggtcgacgccactggcctcttccagcgacggcaccatcgggaagcgcccgctcaggatgcccagttcgctgtcttcccggtag

SEQ ID NO: 5625 - DNA, 1011 bp, Pseudomonas aeruginosa
agcttgccgccgcgcatttcatccttgcaggtcgaattgacgcaagggttcgcgttttttcgagcgggagggtaccgcatgccgcgcaaggtatttagccagccgggcctaccgccccaaggtggtgctggtcaagcggcggctgttcccggcatcggtcgggcgctggcgctgcgtttcgcccgggccggtgcgccactgggcgatcctcgacctcgaccaggcggcgctggacagtttggtccagcacctgcgcgaccatctcggcggcgaggcgctcggcctgcgctgcgacgtctccgacgccgatgcggtggagcgtgccgtggcgctggcggtggagcgcttcggcggcatcgacgtgctggtcaacaacgccggcatcacccaccgcggtaccttcgccgaaaccggcctgggggttttccgcaaggtcatggcggtgaacttcttcggcgccgtgcattgcacccgcgcggcgctgccgagcctgctcgaacggcgcggacagatcgtcgtgctcggttcgctgaccggtttcgccccgttgctctaccgcagcgcctacaacgccagcaagcatgccttgcacggtctgttcgacaccctgcggatggagctggaaggcaccggcgtcagcgtgaccctggcctgcccgggattcaccgccaccgacctgcgcaagaacgcgctggtcggcgatggctcggtgactcgccagccggtgcaagtgctgggcagccaggtggcatcgccggtggaggtcgccgaggcgatcttccagggcgccgcgcggcgccggcgcctgctggtgctgtccaacgtcaactggcgggcgcggctgctggcgcgcttctttccgcgtctcttcgaaaagctgctggtgccgcgcctgtcgggactcaagccgcaaccctgacggtgctcagtgggcgtggtcgtgggcgtcgaaaccctggctcatgtcccagtaggaggcctcgaccttgtgcccgtcgaggtcgcggatga

SEQ ID NO: 5626 - DNA, 1434 bp, Pseudomonas aeruginosa
cccagccggccgccgaggccaacgcctggcggccgccgttgccgttcaggccgcttcgcgagcctgggcctgctccagttcgcggaccagcggcaacacgtgcttgccgaaatactccacttcttcgtggaagtgcaggaaggccgacagcaccaggtcgaccccggccgccttcagcgcgacgatgcgctcggcgatctgccgtggcgtgccgatcaggttggtcttgaagccgtcgttgtattgcaccaggtcttcgaaggtggatttggcccagttgccatcgccctccggcgaggccttgccggcctgtttcaccgcgtcgccgaaggcgttcaccgcctcgtagtcggccttggcgatgatctcgtcgagcaccgcccgcgcttcctcctcggtgtcgcgggcaatgatgaaggcgttcactccgaccttgaccgaatggccgttggccgccgccttggcgcggatgtcctcgacctgggcgcggatgccgtcgatgctgttgccgttggtgaagtaccagtcggacacgcgcgaggccatgtcccgcgccgcccgcgagctgccgccctggaagatttccgggtgcggctgctggatcggcttgggtttcagggtgtagtcgtggaaacgatagaaatcgcccttgaaggtgaagttttcctcggtccagatgcctttcagcacgcggatgaactcctcggagcgccgatagcgttcgtcgtgctccagccagggttcgccgatgccggtgaactctcccttgaaccagccgctgacgatgttcaccgcgacccggccattggtcagttggtcgatcgtcgccagttgcttggccaccaccgccggatgccaggggccaggcaggatcgccgcgatcaccttgagcttctcggtggccgccagcagggcgtggctgatggccaccgactcgtgctggtactcggcgccgtagccggcggtgaagcggatctgcgagagggcgtagtcgaagccgttgcgttccgccaactgggccagcttgcggttgtagtcgatgtcccagctggtgcgttgctcgatcttgctcaccaccaggccgccgctgacgttggggacccagtaggcgaagcggatcggctgttgctcttggctcatcgggggtatctccgggtaggggcgtggtccggtgtctatgaaggaaccgtgccatcccggattcatgttttcgaatcaatggcttatgggggatatggcggaaccggcctgtcttctgccggacagccctgttgtcccgctgttgcccggcagacagtcaggccggcaagcgctgcaacagttcggcggcgcgcagaaccacggcgtactcgccgtgcaggttggccaacgccatcgcatgcacctcgtcggcgctgcgcggggtgccgtggaaatcgggcttggcgaaggtga

SEQ ID NO: 5627 - DNA, 537 bp, Pseudomonas aeruginosa
tggtggcccactgccgtcgttccggagttccccttgagtcgtcccgagtcgcccgcggcgaagaagatcgctgtcttcgccgatgtgcagaacctctactacaccgtgcgccaggcctacggctgccatctcaactacgccgccctgtgggcagacatcgctcgcggcgggagcatcgtcgaggcctatgcctacgccatcgaccgcggcgacccgcgtcagcagcagttccagcagattctgcgcaacctcggtttcacggtgaagctgaagccctacatccagcgtgccgacggctcggccaagggtgactgggatgtcggcatcaccatcgacgtactggatgccgcgccgcgggtggacgaagtggtgctgctgtccggtgacggcgacttcgatctgctgctggagaaggtcatccgcgcccacggcgtcgtggctacggcctacggggtgcctggcctgaccgccaacgcgctgatccgagcggcgtcgcgctacgtgccgatcgagggcggactgctgctcaagggctga

SEQ ID NO: 5628 - DNA, 453 bp, Pseudomonas aeruginosa
agttcgcccagctccaggcgttggtgctggacgaagccgatcgcatgctcgacctcggtttcgcccgcgagctggacgaactgttcgccgcgctgccgcgcaagcgccagaccctgctgttttccgcgaccttctccgacgccatccgcacgctggcccgtgaactgctgcgcgacccgctgtccatcgaggtcagtccgcgcaataccgcggcgaagagcgtcaggcaatggctggtgccggtggacaagaagcgcaaggccgagctgttctgccacctgttgcaggccaatcgctggcgccaggcgctggtcttcgccaagacccgcaagagcgtcgaggaactggtcggactgttgcagcggcagggtatcgccgccgactcgatccatggcgacaagccgcagccggcgcggctgcgcgccttgcagcggttcaaggccggcgaggtag

SEQ ID NO: 5629 - DNA, 1614 bp, Pseudomonas aeruginosa
agaaaccgaagaagccgaagaaacccaaggccgcggagagcgtcggcaagcccggcaagatccacttgggcagttggttcgacagcagcgcgccgacggtcaaggcggtgcgcaaggcaccgggcttcggcgcgggtgcggcgggcaagccgaagaagcggccgtccggcaaatagcgaggcgctggcgtaccggtctctagcgcctgccgcgcaaccaggccagcgcgccgagtccggccacgcgcccgctggcgaagcaggcggtcaacaggtagccgccggtgggcgcctcccagtcgagcatttccccagcgcagaacacgccgggcaggccatcgagcatcaggttgcggtcgagcgcctcgaagcgtacgccgccggcgctgctgatcgcttcgtccagcggacgcgggcgcagcagcgtcagcggcaggcgcttgatcgccgccgccaggcgggccggctcggtataggtggcggcgggggtgagttcacgcaggaggccggcccgaaccccatcgatgcccaactggctgcgcaggtgattggccatcgacctggaaccgcgcgggcgagccagggatgcctcgatctgctcgcgacgcctgttcggcaacaggtccagccatacttcggccgagccccgtgcctcgatccgttcgcggatggcggcggagagggcatagaccaggctgccctcgataccgtcgcgggtcacgacgaattcgccctggcgcggcgtttcgcccgccagtcccatggccaccggtttgaccggagcgccggagaacttgtcgcgaaacagctcgctccagccgtcgatctcgaaaccgcaattgcttggccgcaggggctcgacctcgatgccacgggcgcgcagcaggggcacccaggcgccgtcggagcccaggcgctgccaactgccgccaccgagcgccaggatcacggcgtcggcgcgtatcgacaggcgctcggcggcgctctggatgtccagcgtaccgtccgcgttccagcccagccaacggcagcgggtgtggatgagcacgccttgctcgcgcaggcgcttgagccaggcacggagcaacggcgcggccttcatgtcggaggggaacacccggccggaactgccgacgaaggtgtcgatacccaggccgtggatccaggcgcgcaacgcatccgcgtcgaattcgccgagcagtgcggcgatttccttctggcgcctgccatagcggccgaggaattgttccctggcctcggcatgggtgatgttcatgccgccgacgcccgcgaggaggaatttccggccgaccgagggcatggcgtcgaacacttccgtgcgtacgcccgcctggctcaggacctccgcggccatcaggcctgcgggaccgccgccgacgatggcgacctggggggaaggggaggatgcttgactgggcatgtggacgacgagcgagacctggggaaaccggcgtgcagtgtaaccgaggcgaagaccgcctccgagccttgtcgatgccacctggtccgctcgccgtgcgcctggtcaggaactgatcaaccgtcgcaaggccaggcacgatgcgctgcgcgaagcgtttttcgcaccttatcc

SEQ ID NO: 5630 - DNA, 582 bp, Pseudomonas aeruginosa
gcttgtgttcgagcaggcctatgccaactgaatgaccatccactgggggctgcaacaagagacgatcacgggtcgcaagcagcacgctccttgtcggaggcgatgcgcgtgccacggcagatttcgcttttcagcgtagtccaggcacggatcacacttgtcgagcatgccggcgaccatcggcagcatcggtcgcagggcgccgatgaagcggccgaccagcaggctggcgataccgtagcgttcgaagtacacctcggcggcggtgatccactgcggatggctgcgcaggccgggcaggcggcggatgttctggtggaagcggcggccgatccagtacgagctgaggtcgcccagcaccccgccggcgtaggccagcagcagggtttcgccgaggccgagggcgccgctgccggcgatcaccgcgacgccgaacagcagcaccacgccggggaggacgataccgacgatggccgcgcattcgaggaaggcgatgaggaagatggccagccccagccactcggggttggcggccatccaggcgttgaagctgtcgagactcattgcaggtgcgggtcctga

SEQ ID NO: 5631 - DNA, 1299 bp, Pseudomonas aeruginosa
tcgcgcatttccctgacgccagatgccgagaccatgaccgagtccgtcctcgactatatgagccgccttggccgcgatgcccgcgccgcctcgcggttgctcgcgcgcgccgccaccgcgcagaagaaccgcgccctgctggccgcggccgatgcgctggacgccgcccgcgcggagttgtcccacgccaacgagcaggacctcgccgccggccgcgccaatggcctggagccggcgatgctggaccgcctggcgctgaccccggcgcgcatcgacgacatgatcgagggcctgcgccaggtcgccacgctgcccgacccgatcggcgagatccgcgacatgcgctatgtgccctcgggcatccagatcggcaagatgcgcgtgccgctgggcgtggtcgggatcatctacgagtcgcggccgaacgtgaccatcgacgccgccagcctgtgcctgaagtccggcaacgcgaccatcctgcgcggcggctccgaggcgatccactccaaccaggcgatcgcccgctgcatccagcagggcctggccgaggccggcctgccggccgccgccgtgcaggtggtggaaaccaccgaccgcgccgcggtcggcgcgctgatcagcatgcccgaatacgtcgacgtgatcgtcccgcgcggcggcaagggcctgatcgagcgcatcagccgcgaggccaaggtgccggtgatcaagcacctggacggcatctgccacgtctacatcgatgtcgccgccgacctggacaaggcgattcgcgtcgccgacaacgccaagacccagcgctatgcaccgtgcaacaccatggagacgctgctggtgcatgccggcatcgccgagcaggtgctgccgccgctggccacgatctaccgcgagaagggcgtggaactgcgcggcgacgccgcgacccgcgcgctgctcggcgcagacgtgctggaggctaccgaggaggactggcgtaccgagtacaacgcgccgatcctgtcgatccgcatcgtcgacgggctggacgcggcgatcgagcacatcaacacctacggctcgcagcacaccgacgcgatcattaccgagaacttcagcgatgcgcggcgtttcctcgccgaagtggattccgcttcggtgatggtcaacgcctcgacccgcttcgccgacggcttcgagtacggcctcggcgccgagatcgggatttccaccgacaagctgcacgcccgcggcccggtcggcctggaaggcctgaccagcgagaagtacgtcgtcttcggcgacggtcacgtgcgcacctga

SEQ ID NO: 5632 - DNA, 420 bp, Pseudomonas aeruginosa
actacatcgaggcgcaccacctgtatcgtgcgccacactgataaagaaacagagaccgactcaatgcaaaccgaacaactcgtccaagtggccatcgatgccctggaagacctcaaggcccaggacatcgtgaccctcgatgtgcgggacaagaccagcgtcaccgactacatggtgatcgcctgcggcagttccagccgccaggtcaagtcgctggccgacaacgtcctgaccaaggccaaggaaaacggcgtcaagcccctgggcagcgaaggcctggagtccggcgaatgggcgctgctcgacctgggcgacgtggtggtccacgtgatgctcccggcgacccgccagttctacgacctggagcgcctgtggcagggcgccgagcagagccgcgcccagcaccagccggaagagtga

SEQ ID NO: 5633 - DNA, 774 bp, Pseudomonas aeruginosa
cgccggcatgcggttgcgcctgatcgcggttggctcgcgcatgcctcgctgggtcgaggaaggctggcaggaatacgtcaagcgcctgccggccgagctgtccctcgaactggtggagatcccgctcaacacccgcggcaagaacgccgacgtggcgcgcctgatccgtcaggaaggcgaggccatgctggcgcgcgtgcagccgggggaacgggtggtgaccctggaggtcgaaggtcggccctggagcaccgagcaactggctcgcgaactggatcgctggcgtctcgacgcacgcaccgtgaatctcatggtcggcggcccggaagggctggcgccggaggtctgcgcgcgcagcgagcagcgctggtcgctgtcgccgttgacgctgccgcacccgttggtgcggatcctggtcggcgagcagatctaccgggcctggaccgtgttgtccgggcacccctaccacaaatagtccccagtcccgatgccgcagccgatccacctgaaagaccacgagaaagacgcccgcctggtgcgtcggcgcgtcatcgtcggggcggtggcggtggtcttgctgaccctggtgctggtggcgcgcatgtaccacctgcaggtgacccagtacgagtaccattcgacgctgtcggagaacaaccgggtccatgtgcagccgatcccgccgacccgcgggatcatcttcgaccgcaacggcgtgatcatcgccgacaaccggccgagcttcagcctgaccatcacccgcgaacgcactga

SEQ ID NO: 5634 - DNA, 939 bp, Pseudomonas aeruginosa
tcctgcccgccgtctgccgcctccgggctggcggccgtgctgttgagcagttgctccagcaaggcgccccagcagccggccaggccaggcgggcatttccgggcggggcgactattcccgtccgcatcgcgacggcgccccctggtgggacgtcgacgtgtcgcggatccccgatgcggtaccgatgccgcacaacggttcggtgaaggccaacccctacaccgtgctgggcaagacctactacccgatgaacgatgcgcgggcctaccggatggtcggcaccgcgtcctggtacggcaccaagttccacggccaggccaccgccaacggcgagacctacgacctctacggcatgaccgccgcgcacaagaccctgccgttgccgagctatgtgcgggtgaccaacctggacaacggcaagagcgtgatcgtccgcgtcaacgaccgcggcccgttctattccgaccgggtcatcgacctgtccttcgccgcggcgaagaagctcggttatgccgagaccggcaccgcgcgggtcaaggtcgaaggcatcgacccggtgcagtggtgggcccagcgcggccggccggcaccgatggtcctggcgcagcccaagcaggcggtggcccaggccgctcccgccgcggcgcagacgcaggcggtggcgatggcccagccgatcgagacctacactccgccgccggcgcagcatgcggccgccgtgctgccggtgcagatcgactcaaaaaaaaacgcttcattaccagccgatggcctgtatctccaggtgggcgccttcgccaacccggatgcggcggagctgctgaaggccaagctgagcggcgtgacggctgcgccggtgtttatcagctcggtcgtgcgcaaccagcagattctgcaccgggtgcggctgggaccgatcggttcggcggacgaggttag

SEQ ID NO: 5635 - DNA, 1185 bp, Pseudomonas aeruginosa
ccattggtagaaccagagagacggatgaacatcaccactatcgcgaaacgcttgtcactgcttgtcctgttcatcgcccctacggctggctgggctgctgaatccatggttccggcgccgccgcaactggccgccaagtcgtacgtcctgatggacggcgagagcggccaggttctggtcgagaacaacggcgaccagcgcctgccgccggccagcctgaccaaactgatgaccgcctacatcgccaccaaggagatcgaggccggccgcatcggcgagaacgacctggtcaccgtcagcgaacatgcctggcgcaccggcggttcgcggatgttcatcaaggtcggcagccaggtatcggtgagcgacctgctgcatggcatcatcatccagtccggcaacgacgccagcgtcgccctggccgagcatatcgccggcagcgaagacgccttcgccgacatgatgaacaccaccgcgcagaagctgggcctgaccaactcccacttcatggacgccaccggcctgcccaacccggaccactattcctccgcccgcgacatggcggtgctggcccgcgcgatcatctacggcgagccgagccactacgcgatctacgcgcagaaggaattcctatggaacaacatcaagcagccgaaccgcaacctgctgctgtggcgcgacaagaccgtcgacggcctgaagaccggccacaccgacgaagccggctactgcctggtggcttccgcggtacgcgacggccagcgcatgatcgccgtggtgttcggcaccaacagcgagcaggcccgcgccgccgagacccagaagctgctgacctatggcttccgcttcttcgaaagccgcaacttctacaagaagggcaccgagctgaccaagggcctggtctggaagggttccgagcatgaagtgaaagccggcctcgccgaagacctgaccatgaccctgccgcgcggccagatgcagaagctgcaggccagcatggtcctggagccgcagctgatggcgccgatccagcagggccaggtgatcggcaaggtggaagtgaagctggacgacaaggtcatccgcagcgccgacctggtcgccctcaacgccgtcgaggagggtggtttcttccgccgcctgtgggatagcatccgcctgttcttctacggtttgttcaactga

SEQ ID NO: 5636 - DNA, 693 bp, Pseudomonas aeruginosa
cgacctgcgcgcgaccggacgcgtgcacatggtgctctgatgggactcgagctgggcttccgtgagctcggcgaggttccctacgaaccgacctggcatgccatgcagcgcttcgttgccgaacgcgacaaatcggtaatggacgaagcctggctgttgcagcaccctgcggtcttcacccaggggcaggccggcaaggcggagcatgtgctgttccccggcgacatcccggtgatccaggtggatcgcggcggccaggtgacctaccacggccccggccagttggtcacctacctgctgctcgatgtccgccgcctgggactgggcgtgcgcgagctggtcagccggatcgagcagagcctgatcggcctgctggcgtcctatgacgtgcaggccgtggccaagccggacgcgccgggtgtctacgtcgacggggcgaagatcgcctccctcggcctgcgcatccgtaacggctgttccttccatggcctggcgctgaacctggacatggacctgcgaccgttccaacgaatcaatccctgcggctacgccgggatgcccatgacccaactgcgcgacctggttgggccagtggattttgccgaggtgtgtacccgattgcgcgctgagctcgtctcacgccttggctacgctgaacagaagacccttacgggcgggatcgaactgacatga

SEQ ID NO: 5637 - DNA, 768 bp, Pseudomonas aeruginosa
cccctcgcgcatctggctgcgcgccaccaccgtcacggcgaaaccggccagcgcggcggacaggcagccggccatgctggcgctctcgaacaccaggcgccagggacgcgcagcggcgccgagggctgtaatcgccgcttcgcggtagacgcagggttcggggaacagcgccagcggcagcggttcgcccgcgggcagctcgatcgcggtcgccgcggcccagaccagcggttcctcccagagcagttcgccgtcgtctcctacccgccggcactgcttgccgaacaccacgtcggtgcgcccctgggcctgctggcggagcaggtcggtggtgataccgaccttgagttcgatggatgcttcggggtgccagcggcgaaagcgttgcaggacgcgtggcagccaggcgctggcgaagtcctccgaagcgccgatgcgcaggcggtcgcggatcggcgtgccgtgcagcctggcgcgggcctcgcgctccagctcgacgatgttgcgggcataggcgtagagcgtctcgcccgcctgggtcagctccaggcggcgagtggtgcggctgagcaggctgacgccggctgtctgttccaggcgcttgatatgcccgctgactgcggagggggtgagcgcgagattgtccgcggcgagggcgaaaccgccgctgtcgaccacttcgagaaaggtacgcaacaacacgatatccagggattggaggtggggacggcaagctccatgaggtcttccattcatctcgtttcatga

SEQ ID NO: 5638 - DNA, 1485 bp, Pseudomonas aeruginosa
gtcctcgaaggtgatcgggctggcgctcgccagcgcgcgcatcatctgcctgtcgccgcggattgtccagtgccggttgcgccttcaggctgccggcaggccgaggcgctggccggcgaggctcagggcgagaagcgagagaccgctccaggggctgccgggtgcctgtcccttgatctgcgcgtcgatcaactgggcatccctcagcatctggttccagcggctgctggagtggcgttgcagggcacgggtcagcagcggacggcgcttgtcccagaccggcggacgcgcctgggcgaaggctttctccagcgggatgccctggccgtattgctgggacaggccagccagcaggcggatctcgcgggccaggccccagaggatcaccggcggctcgatgccttcgccgcgcagtccttccaggatgcgcagggcgtgggccgcttcaccgccaagggcagcgtcgatcaggccgaagacatcgaagcgtgcgctgtcggcgaccgcggcctgtacggtggcggcgtcgatctggttgccctcggcgagcagcttgagcttttcgatttcctgggcggcggcgagcaggttgccttccacgcgcgcggcgatcagctccagggcttcggggctggcggacaggccggcctgggacaggcgctggcgaatccactgcggcaactggtggacgtcgaccggccagacctggatgaactgcgcggcgttgccatcgatcagggccttggcccacttggtcttctgcgtgctgccatcgagcttgggcagactgagcaggagcacggtgtcttccggcggccgttgcaggtattcctggagaatcgccgcgcctttgtcgccgggcttgccggagggcaggcgcagttcgatcaggcgcttctcggcgaacagcgacaggctggcgccggcctccagcagcaagccccaatcgaagttggcttcggcattgaatacctggcgctcgccgaagtcgcgctcgcggcaggcctggcgaatggcatcgcaggcttcctggcagagcagcggttcatcgccgctgacgacatagacgggcgccagggggccctggaggtgcttggcgagttgcgcgggagtcagcttcataggagaagacggggccggcgaaaccggccccggggcatcacggggtggggaactcgatcggcgactgctgcggctcggcggcgcggcgctggcgctccgcctcgtcggcggcgcgcagggcttcggcttccgccttggccttggcttctgcctggcgctgggcttcgtcgagttgcgccggggtcagcgcctggaggcgcatggacaactgctggatcaggtcgcgccgcatctcgctgcgcagctgcgcggcttcctggtcggaaccgatcaggttgttttcgtcgtgcacgtagaccttctgcacctgtacctggttgctcatcaggaccaggtcgttggcgccgacgatctcgtagttga

SEQ ID NO: 5639 - DNA, 480 bp, Pseudomonas aeruginosa
gcttgccctatgggccgtcgatggctggctgcccagtggtaccttcagaggtgttcgatggctgagctgcaacgcgcgagtgtgacgggaggtgggctgtacgagaggctgctgcagcgtctcgccctggctctggatgaagcggatacggccgagcgcctgcgtgacgagcatcccacggagctcgagttgcgtggtttgagcgaagcggagatggggctgatacgcgcctatctcgaccaggacctgcactggttgcgcggctggcatgcggccgccgaggagctggcgctgctcgagcgccagcccggcaggacaccccggccgcaaccgccggcgccccgtcggcacgtctcgttgaaacagcggcaactgctctgtgcgctctgcggtgcgccggtgcagtggagcaaggggcatggcgtgttgccgtgcggccattgcggctcgcaactgttccgttcgggcaacgaccgctag

SEQ ID NO: 5640 - DNA, 792 bp, Pseudomonas aeruginosa
  unsure (789): Identity of nucleotide at the above locations are unknown.
attgcctcttccgacagggagggggcgatgccgatccgttatttcttcaagcaactgctgctgccgccgggcggcctgttgctgctgctgtttttcgctttctggtggcgcaccagccgaccgcggctggcgcggctgtgcggtgtctgcgggtttttcggtctgtggctgatgagcatgccgctcagcgtggagtggatggggcgctggctcgaaagcgaaccggccctactggcggaggatatgccgggcctggcgcagcgcgccgacgccatcgtcatcctcggtgccggccggcagaccaacgacccggcctggggcgacgatgcgccgagcctgctggcggccgagcggatgcgatatgccgcgcggctggccaagaccttggcgctgccggtactgatcagcggcgggttggcattacggagccccgcccagcgaggcggcgttgatggccaatgccttgatgcaggatttgggggtgccgacgcgctggcaggaagttttcagccgtaccacctgggaaaacgccaccctgagcgcccccgcagttgcgggggggccggcgtgcgccgggtggtgctggtgacccaggcctggcacatgcagcgggcacgctggagcttcgagcgccaggggttcgaggtgatcccggcgccggtcggtttcctcggcggggccaacctgcggcccttcggcggctggctgccggaagcgcaggccttctggcagagcggcatgctgctgaacgaggcgatcggcctggtcggctatcgcctgttctaccgntga

SEQ ID NO: 5641 - DNA, 822 bp, Pseudomonas aeruginosa
aggaggggctggcgagacgccagaaggacggcgcgggaagatgccccctccgccgcggcggagggggcgcgctcagttctgcaggggagacaggcgcagcagatggacgcggcggctgtcggcgttgagtacgcggaaacggaactcgcccagctcgaccacttcgttgcgcttgggcaggtggccgaaggcgctcatcaccaggccgcccacggtatcgaattcctcgtcagagaattccgagccgaagaagtcgttgaaggcgtccacgggggtcagcgccttgacgatgaaatcgccgctgggcagcggcttgatgtagctgtcctcctcgacgtcgtgctcgtcctcgatatcaccgacgatctgttccagcacgtcctcgatggtcaccaggccggccacgccgccgtattcgtcgatgacgatagccatgtggttgcggttggcgcggaattcgcggagcagcacgttgaggcgcttggattcggggacgaaggtagccggacgcagcagttccttgatgtcgaagggacgctcgtcgttgtgcaggatcagtggcaggaggtccttggccagcagtacgcccatgacgtcgtcgaggctttcgccgaccaccgggtagcgcgagtgggcggcttcgatgatggccggaaggaattccttcggcgtctgggtcgagcggatgctcatcatctgcgagcgcggcaccatgatgtcgcgcacctgcaggtcggcgacctggatcgccccctcgacgatggacagcgcctcgctgtccagcagcttgttgtcgtgggcatcgcgcagcagctcgagtag

SEQ ID NO: 5642 - DNA, 1206 bp, Pseudomonas aeruginosa
gtgctgttcagttccaggccttcggcctcgtccaccaggcggatggtcagctccgactccggacgctggcgcagggccagttcgcaccaggcgcggaactgcgcttcggagggcaggtccggggcggcgctagcgacctgcaggtcgagctcaagcggcatcgtgaccgcccttgcccgttccctcgaccggccgcacctggccttgctggcggctctcgtgacgctcgtaggcttcgacgatacgctgcaccagcgggtggcggaccacatccttgggcttgaagtgggtgaagctgatgccggggacgtcctgcaggacctcgatcacgtgcttgaggccggagcgggtgccgcggggcaggtcgacctgggtgacgtcgccggtgatcaccgcggtggagccgaagccgatccgggtgaggaacatcttcatctgctcgactgtggtgttctggctctcgtcgaggatgatgaagctgttgttcagcgtgcgcccgcgcatgtaggccagcggcgcgacctcgatgacgttgcgctcgatcagcttggccacgtgttcgaagccgagcatctcgtagagcgcgtcgtagagcgggcgcaggtaggggtcgatcttctgcgacaggtcgccgggaaggaaaccgagcttctcgccggcctcgaccgccgggcgcaccagcaggatgcggcggatctgctcgcgctccagggcgtcgacggcgcaggccacggcgagataggtcttgccggtgccggccgggccgatgccgaagttgatgtcgtggtcgaggatcgccttgacgtagcgctgctggttggcgccgcgcgggcggatgtgcgccttgcgcgatttcagggtgacctgcggcgcgctctgcaattcctcgaggtcttccaggccggactcctgcaggtacaggtgcacggtgtcgggagtgagatcggtgccgttctgcgcctcgcggtagagacgctgcagcaggcgttcggcaaccttggtccggcgcggttcgccggccagttcgaactggttgccgcggttgcggatctcgatgtcgaggcgtttctcgatctggtggagatgctcgtcgaactgcccgcaaagtgtcgcgaagctgcgggcgtcgaacggctcgaggataaagcgatgaagttcctggggggcgttcaaggtgttctgtcgtactcgccagtggctgattga

SEQ ID NO: 5643 - DNA, 1524 bp, Pseudomonas aeruginosa
ccgctggatatcgtcgcgcaaagttgccgtatcgcggcggcgctttcccggttcccgctgaaacgttggtgcaccgtggcggcgggaaggttcagcgagcccgccgtacggtcgtcggcctcaatgcagggtgctgtcgatcagggtaccgcgcagcgagtgcggcagcgcgtcgtcgatgtgcacctgggcgaactggccgatcaggcgtggattgtcgcagcggaagttgacgatccggttgttctcggtgcgcccctggagcatgcctgggtccttcttcgagaagtcggtgaccaggatccgctgggtgctgccgaccatgcgccggctgatctcgtagccttgctggtggatgcggctctggaggatctgcaggcgctgtttcttcacttcttccggcaggtcgtcggcgaggtcggcggcgggcgtgccgggccgcgcgctgtagatgaaggagaaggagaagtcgaagccgacgtcctccaccagcttcatggtctgctcgaagtccttctcggtttcgccggggaaaccgacgatgaagtcggagctgatgcagatgtccggtaccgcggccttcagcttgcggatacgcgacttgtattccagcacggtatggttgcgcttcatcgccgccagcacgcggtcggagcccgactgcaccggcaggtggatgaatttcaccagctccggcacctcggcgtgggcctggatcagcgcgtcggagaattccagcgggtgcgaggtggtatagcggatgcgctcgataccgtcgacggcggcgaccacccgcagcagttcggcgaagtcggccaggcggccatcgtgggtcaggccgcggaagccgttgacgttctgtcccagcagggtgacttcgcggacgccgttctcggccaggtggatcacttcggcgatcacgtcgtcgaatggtcggctgacttcctcgccgcgggtgtagggcaccacgcagaagctgcagtacttgctgcagccttccatcaccgagacgaaggcggtggggccatcgacccgcggttccggcaggcggtcgaatttctcgatttccgggaaggacacgtcgacctgcggcttgcgcgtgctgcgcgcggcgtcgatcatttccggcaggcggtgcagggtctgcgggccgaagaccacgtcgacatagggcgcgcgctcacggatcgcggcgccttcctggctggccacgcagccgccgacgccgatcaccaggtcgggattctgctgcttcagctcgcgccacatgccgagcttggaaaacaccttttcctgggccttctcgcggatcgagcaggtattgagcaggatgacgtcggcctcggcggcgttttcggtcacctcgagggcttggtgttcaccgagcaggtccgccattcgcgacgagtcgtactcgttcatctggcagccgtgggtttcgatgaaaagcttcttggccatgcgcttcgtcggacagttcgaaaaggaccgcgcattatagagggcggggcccccggttcctag

SEQ ID NO: 5644 - DNA, 882 bp, Pseudomonas aeruginosa
ggcagcaggcggccgtcgtccagtagctggctatcggtgatggcgtacaggccgcgcagtttcatcggctggctctcagtgacagaagtcggtgggcaggcggcgcggcacgtattggccgtggcccggactctcggcgtcgcgcagggtccgccaggtgtagtcgagggcgctctgcacggcgccgtgcagcgcttcgccgagggcgatgcgaccggccagggcgctggccagggtgcagccggagccatggtagctgccgggcaggcgctggcaggtgaaggtgcggcggctgccgtcgcggctgtacaggcgattgtgcacttcgctttcgtcgccgtgtccgccggtgatcaacaggtgctcgcagtgttccagcaggcgctcggcgcactggtcggcgctgccctcgggcaggtcggcgagcaggcgcgcttccggcaggttcggcgtggcgatggtggcgcgcggcagcagccgctcgcgcatggcgaagccgacgtcgcccttgcccaacgcaccgccgccgccggcgcgcagcaccggatcgcagaccaccggcaagtgcgggtgggcggcgaggatctcggccaccgtgtcgaccatctccagcgaaccgagcatacccagcttgaccgccgcgacgggcaggtcggcgagtacggcgttggcctgggccagcacccactcgcggtcgaggacgcggaagtcgctgacgttgacggtgtcctgcacggtcagcgcggtgaccgccggggcggcgtggcagccctgggcgagcagggcttcgatgtcggcttgcagtccggcgccaccactggggtcgtgaccggacaggcagagcactacggggcgggaagtcggtgttttcatggcgcgtga

SEQ ID NO: 5645 - DNA, 2436 bp, Pseudomonas aeruginosa
cgagggaggtggggctcccggtccgttcgaggagcactgcggggcatcatgcggcactggctgattctctttcttcttgcgttgccgtgcctggcgggtgcggtgagcttcaacgagcaggtcgagcgcctgccgctggggcagtccatcgacgtgttcgaggacgtgcgcggtagcgccgatatcaacgacatcacctcgcgggccatcgacagcagcttccgccgccatgacaaggacgtgctcaatgccggctattcgcgctcggtgttctggttgcgcctggacctggactaccggccggtcgcctccagcgatccgcgcacctggctgctggagctggcctatccgccgctggacaagctcgacctctacctgcccgatggccagggcggctaccgcctcgcccagcgcaccggcgacacattgccgttcgccagtcggccgatccggcagaacaactacctgttcgaactcggcctcgagccgaacaagccgcagcgtgtctacctgcggctggaaagccaggggtcgatccaggcgccgctgaccctgtggtcgcccaaggcctacctggaggagcagcccgaacgcatctatgtgctcggcatcatctatggcgtgctgctggtgatgctgatctacaacctgttcatcttcctcagcgtccgcgataccagctatctctactacatcctctatatcgcttcgttcgggctctaccaggtctcggtgaacggcgccggcatcgagtacttctggcccgacagcccctggtgggcgaacgccgccacgccattcctgatcggttcggcggcgctgttcggctgccagttcgcgcgcagcttcctgcatacccgcgaccacagcgtgtgggtcgaccgcggcctgctggcgctgatggcggtcggcgcgctggtcatgctgatggcgctgaccatgagctacgccgtggccctgcgcctggccacctacctggcgctggccttcaccggcctgatcttcgccgccggcatcctcgcctggctgcgcggcatgcgcgtggcgcgctatttcatcatcgcctggaccgccttccttctcggcggcatcgtcaacaccctgatggtcctcggctacctaccgaacatgttcctcaccatgtatgccagccagatcggttcggcgctggaggtgggcttgctgtcgctggcgctggccgaccggatcaacgcgatgaaggaggagcgcgcgcgaatcctccaggagtccagccgcaagctggaagcgctgaaccaggaactggccaacagcaaccgcctgaaggaggagttcctcgccaccgtcacccacgaactgcgcaccccgatgagcggggtgatcggttcgctggagctgatgcagacggtgccgatggacgtcgaactcgccgagtaccagcgcaccgccgccggttcggcgcgggacatgatgcggatggtcaacgacatcctcgccctcatcgaactgcaggccggcaagctctacccgcgccgcgagccgttcagcctgcgcggcctgttcgacagcctgcgcgcgcagtacgcgccgcgcgccgaggagaagggcctgcgcttcgccctgcaactggacgacagcctgccggacaccctcgaaggcgatgccggcaagctggcccaggcgctgggctacctggtcgacaacgcgatcaagttcaccgccaggggcagcgtgaccctgcgcgtcgccgccgggcgtacccatgacggggtggcgctgcgggtggaagtgatcgacaccggcatcggtttcgacatggccgccggcagcgacctctaccagcgtttcgtccaggccgacagctcgttgacccgtggctacggaggcctcggcatcggcctggctctgtgccgcaagctggtggagctgcttggcggcgagctgacccacgagtcccggccgggacagggcagccgcttcctcctgcgcctgcaactgacccagccggcccagggcctggcgccgccgccgcggcgcgccggcgggcaggcggtgcggcgtcccgaggagtgcacggtgctggtggtggaggacaacgccatcaaccagttggtgactcgcggcatgctgctcaagctcggctaccgggtgcgcaccgccgacaacggtagcgaagccctggagttgctggcgcgcgagcggccggacggcgtactgctcgactgccagatgccggtgatggacggcttcgccacctgtcgggcgatccgcgcgctgcccggctgcgcggaactgccggtgctggcgttgaccgcccacagccacagcggcgatcgcgagcgctgcctggcggcgggcatgagcgactacatggccaagccggtcaagttcgaagagttgcagaccctgctgcacgattggctgctgtgccagccgatcgtcaccaagtccgcctga

SEQ ID NO: 5646 - DNA, 687 bp, Pseudomonas aeruginosa
agcgtgattcactgggaaaaagtgaatccggattcagtcatggtctatcgtgtcaccgaacgccgcctgcaacgcgattccgcgctgcgcgagcgcatcctccagctaggcctgcggcgtgtcgcggagggcggtttcgccgcgctgaccatgcaggccctggccgacgacgcggggattgccaccggcagcctgtaccgccacttccggggcaagggcgagctggcggcggaaatcttccgccgcgccagccagcgtgaggtcgatgccctggccgtggtcctgcgcggtcccggcgcgcccgcctggcgcctggccgagggcttgcggcgctttgccgcgcgcgcctggagcagccagcggctggccttcgccctgatcgccgagccggtggatcctgaagtcgacgagcagcgcctgcgctatcgcgaggcatacgccgcactgttcgtcgaactgctcgaggagggccggcgcagtggcgcattccagctttccctggtgccgcttgccgcggcctgcctggtcggggccatcgccgaggcgctggtcggccccttgtctcccccggcgcgcgccgctcgcgacagcggccagccggaaccgagtctggagccggtgagtacggctctggtgaacttctgcctgcgcgcggtgggcgcgcctgtctgcgaggaaccctcatga

SEQ ID NO: 5647 - DNA, 822 bp, Pseudomonas aeruginosa
  unsure (538): Identity of nucleotide at the above locations are unknown.
actcgatctgggaaggttccggcaacgtgcagtgcctggacgtgctgcgtgccctgtcgaaggagccgggggtgctcgacgcgttgttcgccgaactgggcgacggccatggcgacgcccgtctcgccgcgcacatcggcaacctcaaggcgggcttcgccgacaccgccgacatccagtaccgcgcccgccagctcaccgaggacgtggcgatcgccctgcaggccaagctgttgctggaagccggcaactccgcggtgtccgacgccttcatcggcagtcgcctgggggacggcgggcgggtctacggcaccctcccgcgcggcgtcgaggtcgaggcgctgttggctcgcgccaccccgcactggcctgaggcgcgtcgcgatgcaggcgcatccgcgctaccgggagctggtcgagcagggcttcgccgcggccagtttcgtcggcgacctcggcatccgtccgctggactgcgggccgggttgggtcgaagcggggctggacatcctggccccgccacgcccagcagaaaggnttcatccatgccgggatccaggagaccatggcggaccatgccgccggggccgccgccgcgaccctggtggaggaggggcagacggtgctgaccctggagttcaagctcaacctgttgcgcccggcgctttgccagcgcctgttgtgtcgcgccgaggtgctcaaggccgggcgccaggtgacggtggtcgaggccgaggtgttcgccgagcgggacggtcggcggcacctgttcagcaaggccaccgtgaccatggcggtggtggcgctggccgaatgagataa

SEQ ID NO: 5648 - DNA, 1623 bp, Pseudomonas aeruginosa
cgggagaaaagcgctgtgttttcctgtcggtacaggcaagatgttttccatgcgaaccgacaggaagcccaccatgagtatcgattccgacgacgggttcgtcgtcgcccgcacggccgaggaggccgtcgaccgtcttgccgagctgcaccgccaggccaccgcggcgctgagccaggcgctcaagcgctacatcaaggagcgcatcgagccaagcgaggccgagcggcagaacttccactacccgcaactgcgcatcggctaccgctgccagggcgaggtgccgtccaccacccgcgcctacgccaaggtccaggtgccgggcgaatacagcgtcaccgtcacccaccccgacgccttccgcaagtacctgctggaacagttgcgtccgctgatggacgatttcaccgtgcaggtgcaggtcggcccgagccaacaggacatcccctatccctacgtggtcgagcagggcgacgagctggccggctccggggtgaccgccgccgagctggcgcgggtgttccccagcaccgacctgtccgccgcttccgacgacatcgccgacggcctctacgaatgggaacgcgccgaccagttgccgctggcgctgttcgacgccgcgcgggtggacttctccctgcgccgcctggtgcactacaccggcagcgactggcgccacgtgcagccgtggatcctgctgaccaactaccaccgctacgtcgaccagttcatccgcctcggcctgacccgcctgcgcgaggacccgcgcttcgtgcgcatggtcctgccgggcaacgtgatcatcgaacgcgggatggacgaaggcgaggccaacgccatcgtcgccggggtggtctggcaccgctaccagatgccggcctaccacctgatcgccgccgatggcgacggtatcaccctggtcaacatcggggtcggcccgtccaacgcgaagaacatcaccgaccacctggcggtgttgcgtccgcattgctggctgatgatcggccactgcggcggcctgcggcagtcgcagaccatcggcgactacgtactggcgcacgcctacatgcgccgcgacggcatcctcgaccgcgcgctgccgccgcacatcccgatcccggcgctggccgaagtccaggtcgccttgcaggaagccgccgccgaagtcaccggcgagcgcggcgagtcgctcaagcgacgcttgcgcaccggcaccgtgctcacctacgacgaccgcaactgggagttgcgctgggcccaggagcggccactgatcaacctggcgcgggccatcgcggtggacatggagagcggcaccatcgccgcccagggctaccgcctgcgggtgccctacggcacgttgctgtgcgtctcggacaagccgctgcacagcgagatcaagctgcccggctcggccaacgccttctacgagcgcgcggtgaaccagcacctgcggatcggcatcgccgccctcgacctgttgcgcagccagctcaactcgctgcactcgcgcaagctgcggagtttcgacgagccgccgttccgttgatcggacgcgccgcggtttccgtgcggaaaccgcggcgcgcttctacgccttgcggcgccgaggccctacaatga

SEQ ID NO: 5649 - DNA, 642 bp, Pseudomonas aeruginosa
tggccggtcgccctgcgtggaaccgcggcgccctctgccggtcggaacgaccacgcctgccatcgatgtgagccccatgccgttcagcgtccccactcatctcagcaacccgctccgtcgcttcgcccgccgcctggtacccgatgccgcgccggaagtggcagcgccgttgccgatgccggaaagcctggccggcgaaccgtggttctcggtcgggcgggcggtcgaggccctcggcggcgagcgggtcgatggctggatcctggaagaatggcgtggcttggccctgcgcgcgcgtttcagcgcttgctggcgcgatccgcgcggcaacctgtggaatgtcctgccgcaggcggcgccatcgctttcctggccgacccgcagcggcgctacgaaggcgtgccgctggccgaccagtaccaggcgctcagccgcgatgtcctgctggaagactacctcggcctgcggcgccaactggcccgcgccggcctggacgatgaggcccgcgagcgcctggccgggatggccgcgcgcctggaaagctggctggccctgggcggccgtggcgaccaggcttgtccgtgcggcagcggcaagcgctaccgcaactgctgctcccgcctggtggcctcggcctcctga

SEQ ID NO: 5650 - DNA, 600 bp, Pseudomonas aeruginosa
caactgaaacaggctgccgattatacggcatgccgcctgttccgtgtcatgtcccaggtctcgctacgatcaatcgcgcaggtgctccagcggcagttcggtactcgccagcacctggttgaggacgaagctggagcgcacgctggagaccccctcgatgcgcgtcagggtacccagcaggagcttctggtaatggtccatgtccggcaccacgaccttcaactggtagtccgcgtccatcccggtgaccaggctgcactccagcacttccgggcatttgccgatgacttcctggaaatgttcgaagcgttccggggtgtgtcggtccatgcctatgaggacgaaggcggtgaggctcaggccgagtttcttgcggtccagcaaggctacctggcggacgatgtagccgtcgtcctcgagctgcttgacccgtcgcgaacagggcgatggcgacaggcctatccgttctgccagttcctggttggagatgcgtgcgtcgcgctggagttcttcgaggatacgcaggtcgtagcggtcgagtttgttcatggcgaagatttctttcaggttgattgccattggcaaggagaatttgagtga

SEQ ID NO: 5651 - DNA, 561 bp, Pseudomonas aeruginosa
caatcgaccagcgttcggcaatcttctgccgcgacgatgacgataagaccgccgaaagcgcccgccggttcgccggtatacttcgccggtcagtccggagccagcatgatttccctacccatcgacgccgttgttcccgccctgcgccaggcccttggcgcacaacaccaggccgttctggaagccccgccgggcgccggcaagaccacccgcgtgccgctggccctgctcgacgagccctggctcgccggccaacgcatcctcatgctcgaaccgcggcgtctggcggcgcgggcggcggccgagcggctggccgacgagctgggcgaaaaggtcggcgagaccgtcggctaccggatccgcctggagagcagggtcggcccgaagacccgcatcgaagtggtcaccgagggtatccttgcccgtcgcctgcaagacgacccggcgctggacggtgtcggcctggtgatcttcgacgaattccacgttttgccgattgcacgtaaatcatcattttcttgtcaaaaactcccatccttcccttcacagtccttgagctga

SEQ ID NO: 5652 - DNA, 234 bp, Pseudomonas aeruginosa
ggctttagaaaggttcatcgaccgctggcatcatatgtgggagcgtcacgccaacatggattactagcgcatgtagctgtgttagagggtcaggttttcatcttccatgcgatcaggttctacttgaggtacacgttttgtagtggtctactaaccccggacacccatttaggcgagaatgctcgccacagagaggtgtccgatgaccaagcaacgccgtacctttacccctga

SEQ ID NO: 5653 - DNA, 654 bp, Pseudomonas aeruginosa
acgcgagaaatcgatactaaaaaaggctaccgcgctcttgatgtcggaagatctcgagcgtacgcgctgatccgccagctcagcgaccatgagcccgttgattgtttgtgcgaagtgttcgaagtcactcgctcaagttactacgcacatcgtcacagaaggcgaactccggacgttgaacgactgcggttgcgcagtcgagtgaatgagttgtttacgcgaggtcgaagtgcgcccggcagccgtaccatcatggcaatgatgcaagaagaaggtgagcaaatcgggcggttcaaggtccgcagcctgatgcgtgagctggcgttgatcagtaagcagccaggatcacatgcgtacaaaaaggccacagtggagcggccagatattccgaacaccttgaaccgagcgtttgatgtcgaagcgccaaatcaggtctggtgtggagacatcacttacgtctgggcacagggcaaatggcactatctggcggttgtcctggatctgtatgcacgcagagtggttggttgggccttatcagaaaagccggatggagacctggtggtcaaagcgctggacgtcgcctacgaacaacgtggaaagcctcaaggactcctgttccactccgaccagggatcgcaatatggcagccgttag

SEQ ID NO: 5654 - DNA, 270 bp, Pseudomonas aeruginosa
ttccgccagagactgtggcgctaccgcatgcgccagagcatgagccgccgaggcaactgttgggataatgcaccgatggagcgagtatttcgcagtttgaaatcagagtggataccgaccacgggctacctgaccgggcagcaagctcaacgagacattggccaatacctgatgggccactacaactggatccggccgcatcagttcaacgatggactggctccagcgaaagctgaagaaaaacttaaaaccgtgtccgggatgagttga

SEQ ID NO: 5655 - DNA, 384 bp, Pseudomonas aeruginosa
cacgtgaacgaaggttttgctcatgtctacatcgccgacgaagaaaggtttgtcgagcaactgttcttcattagctccataaaggtagccgagcgagccacggctgccgggccttatggcgtcgaaatgctgcttggcatgtttacctattcctcgggttaccgctatcaagtgtattttgaggtcagtcctactcaagtcaaaagggaatcgctcatcaagtttgctgttgaggaagattttgttcgggtgattcctaatgcaactttctgctccatgcagttgctttgcagattccttgactgcggctctgtaccatcggctccaagcaagttttgggtcattctgctcttggaatttaacgtgccccttgtcggaaaatag

SEQ ID NO: 5656 - DNA, 252 bp, Pseudomonas aeruginosa
ctacacacgtctgagaggttgagaagctgttctgaacaccctcgttggctttactggctttccatgcgcatgaggaaaggtgtcaatgttctgcagagggcaggaggggagggtggattcggggcgtcaatggtgatggctggcaagggtgatttcagtcaatcactggagctagaattgacagtcaaccaccgtcgcaccccgattgagctaggccctggttttcctgggggcagggggtgtcaatcttaa

SEQ ID NO: 5657 - DNA, 879 bp, Pseudomonas aeruginosa
cgcaagggttcgcgttttttcgagcgggagggtaccgcatgccgcgcaaggtatttagccagccgggcctaccgccccaaggtggtgctggtcaagcggcggctgttcccggcatcggtcgggcgctggcgctgcgtttcgcccgggccggtgcgccactgggcgatcctcgacctcgaccaggcggcgctggacagtttggtccagcacctgcgcgaccatctcggcggcgaggcgctcggcctgcgctgcgacgtctccgacgccgatgcggtggagcgtgccgtggcgctggcggtggagcgcttcggcggcatcgacgtgctggtcaacaacgccggcatcacccaccgcggtaccttcgccgaaaccggcctgggggttttccgcaaggtcatggcggtgaacttcttcggcgccgtgcattgcacccgcgcggcgctgccgagcctgctcgaacggcgcggacagatcgtcgtgctcggttcgctgaccggtttcgccccgttgctctaccgcagcgcctacaacgccagcaagcatgccttgcacggtctgttcgacaccctgcggatggagctggaaggcaccggcgtcagcgtgaccctggcctgcccgggattcaccgccaccgacctgcgcaagaacgcgctggtcggcgatggctcggtgactcgccagccggtgcaagtgctgggcagccaggtggcatcgccggtggaggtcgccgaggcgatcttccagggcgccgcgcggcgccggcgcctgctggtgctgtccaacgtcaactggcgggcgcggctgctggcgcgcttctttccgcgtctcttcgaaaagctgctggtgccgcgcctgtcgggactcaagccgcaaccctga

SEQ ID NO: 5658 - DNA, 873 bp, Pseudomonas aeruginosa
cggtgctcagtgggcgtggtcgtgggcgtcgaaaccctggctcatgtcccagtaggaggcctcgaccttgtgcccgtcgaggtcgcggatgaaacacccgtagtagggctcgccgtacagcggacgcgggcccggcgcgccctcgtcgcgtgcgccggcggccagggccgcggcgtggaaggcgtcgacctgggccttgctgtcggcgaagaagccgacgtggctgccgttgccgacgctggcgggacggccgtcgatcggcgcctgcacccagaactccggatagagcttgccgtaggctacggcgccggggtattcgaggatcaccttgcagccgagggcggccatcaccgcgtcgtagaaggctcgggcacggggaaagtcgttggtgccgatggacaggtgggaaatgcagctggggttggccgattcgtcgctcatggtccgttcctcgaggcagggctcgtcaagcataggccagcgcggcgaatcggcgcgcggcgccgttcacatcccgttgcgtggcgccggaccgaggctgtagatgcggaaggcgacgatggtcaacagcagctggaagaacccgctgagcgcatgcagggcgacccgcagcacgacggcgtcgccggccgaatcggcgagccaggcttccaggctccagaccggcagcaggatcaccagcgaacaggcgaggatcaggaagaatcgcccacgggtgaactcgaagctttcccgcagcgcctgcagcggactacggccgcgcagcaccaggcagaattcggcgaaggacagcttcaccatgacgaagatgcccggcaggatcagcagcgacaggccgagcacgatcagcagcgaagtcagcgccgcgagtag

SEQ ID NO: 5659 - DNA, 792 bp, Pseudomonas aeruginosa
gatcgtgcagggtgctccaatatttccctttggtgcaatccatccttccttctcgaaatgcagtcgaggcgtgcgatgaaatccgatgagaaaaccctgatcgacggcctgttcagccgcctgcgcgaggccgaggggcagtccgctccgcgtgacgccgaggccgaggcgcagatcaaccagcacctggtgcggcagccggcggcgccgtactacatggcgcaggtggtgctgatccaggaagccgcgctgaagcgcctcgaccaacgggtgaaggagctcgaggcgcaggtcgcccagttgcagcagagccgtccgagcagcggcggcttcctctccggcctgttcggcggcggcgcgcgcgacgagccggcgccgagccaatcggggcgcccggcgggctggggcgagacgcgtttctccaatccggcggcggcggccggcgacatgcgtccgggtatggcgcccgccgcggcggccgcgccttcgcgggccagcggctttctcggcggtgcgctgcagacggccgctggggtcgctggcgggatgctggtggccgacctgctcaccggcatgttccgccacagccagccgcaggaaatcgtcgaggtgatccaggacgtcccggtggataacctcgacgccagccagtttgccgatcccgagccggcgcccgagcgcttcgccgatagcgactatcccgccgacggcggtttcgccgatggcgatttcagcgacagcgatttcaacgacgactccagcttcctcggcgacgacgatttgttcacctga

SEQ ID NO: 5660 - DNA, 900 bp, Pseudomonas aeruginosa
  unsure (281),(488),(585),(618): Identity of nucleotide at the above locations are unknown.
agaaaaagaaaagtttttcgcccaccggaggaagggggggattcgctttctgggatttggggggttgggggaatggattataccaggttgcccggggaggaaagttttcgatcgccggcgatctttttggtggttattaacttgaggagcggcgagttcttgttggatggccattcccgcgggatttcacggcattggcgcaccgctgtggttttttgctcaaacgggaccaacatcacacgcccccaccaggcgttcggctggctcaaagcggtatatcngacgaccgcagacttggtggcggcgggccagcgcgtggtgtacctgttgcaccaacatgttggccaccttggcattttcgtctccgcgggggtggcgcgacgcgagcaccgcgccatcttgcatcatgccgaatcgatccaggcactcaagcctggactttacgagatggttttggaggacagcgcctcttcggagtcggccgccgntgcgcagttccagccgcggcggctggaagacctgccttatgacgccaacccggcggggttcgacaaggtcgaagcactctcggagatcaccgagcgnttctattcgcagtgggtgtcgccgtgggtccgnttcgccgtcacccccgactcggctcgtgaacttcgcgcgctgcaccccatgcgcgtcagtcgcaaggtttggtccgagcaggtgaccccggccctggcgctgctgccatgggtgcaacgatggcttgagcagtggagtgcgcaggatccccatcgggtcgaaaatccttggtatcagcttgagcgaactggtgcagacgcgattgggcaggccatggaatcatggcgcaagagccgggacctgtgggctgagcttgtgttcgagcaggcctatgccaactga

SEQ ID NO: 5661 - DNA, 498 bp, Pseudomonas aeruginosa
acgcttcccccagggcatctacctgaccgacctctatcccgatctccgcgagcacccgcgctaccggcagatccgctggggagtggggatcatcgggcggctgacgcggggaagctatccgttgcattaccgcaatgccgcggaaatcgaggcggccttcgcccgctgcggcttcgcctccaccctggtgctcgacccgcagcgcgaaggcgccgccctgggcttgccgcagggacgcctgccgagcctggtgcgggtaatcgaaagccgcacggcatagccgcctctcaggcgacctccgctcgctcccaggcggcgaggaggtcggccagtccggcgctggccgccggatcggagtgcgggaagatgaaggcgaagccgccggcggtcgagcgcaggggcaggatgtccaagtccgccaggccgtcgcagcacaaccgccagccgcgttgcgggcgggattcgggcagctcggcgtgcagccgcccgccgaaatag

SEQ ID NO: 5662 - DNA, 564 bp, Pseudomonas aeruginosa
tgctcccggcgacccgccagttctacgacctggagcgcctgtggcagggcgccgagcagagccgcgcccagcaccagccggaagagtgacgccggcatgcggttgcgcctgatcgcggttggctcgcgcatgcctcgctgggtcgaggaaggctggcaggaatacgtcaagcgcctgccggccgagctgtccctcgaactggtggagatcccgctcaacacccgcggcaagaacgccgacgtggcgcgcctgatccgtcaggaaggcgaggccatgctggcgcgcgtgcagccgggggaacgggtggtgaccctggaggtcgaaggtcggccctggagcaccgagcaactggctcgcgaactggatcgctggcgtctcgacgcacgcaccgtgaatctcatggtcggcggcccggaagggctggcgccggaggtctgcgcgcgcagcgagcagcgctggtcgctgtcgccgttgacgctgccgcacccgttggtgcggatcctggtcggcgagcagatctaccgggcctggaccgtgttgtccgggcacccctaccacaaatag

SEQ ID NO: 5663 - DNA, 1953 bp, Pseudomonas aeruginosa
tccccagtcccgatgccgcagccgatccacctgaaagaccacgagaaagacgcccgcctggtgcgtcggcgcgtcatcgtcggggcggtggcggtggtcttgctgaccctggtgctggtggcgcgcatgtaccacctgcaggtgacccagtacgagtaccattcgacgctgtcggagaacaaccgggtccatgtgcagccgatcccgccgacccgcgggatcatcttcgaccgcaacggcgtgatcatcgccgacaaccggccgagcttcagcctgaccatcacccgcgaacgcactgaggacctgcagaagaccctcgacacgctggtggagatcctcgccctgaccggggacgaccgggcctttttggagaggcgcaggaagccaggggggggtccgttcgagccggttcccatcatgttcgaattcaagggggaacagatcgcccgcatcgcggtgaaccccttccgcctgccgggcgtcgacgtggcgacccagttcgtccgccactacccgctgaaggagcacttcgcccattcggtcgggtacgtcgggcggatcaacgagcaggaactgaagaacctcgacccgatcaactacagcggcacccaccatatcggcaagaccggcatcgagcgcttctacgagagcgagttgcacggcacggttggctacgaggaagtcgagaccaacgcccgcgggcgggtgctgcgggtgctcaagcgcaccgacccgattcccggcaaggacatcgtcctgagcatcgacagccgcctgcaggaggccgccgagaacgccctggccgggcggcggggcgccatcgtggcgatccagccgtccaccggcgacgtgctggcgatggtcagccagccgagctacgaccccaacctgttcgtcaccggcatcagcttcaaggcctatgccgagctgcgtgactccatcgaccggccgctgtacaaccgcgtcctgcgcgggctctatccgccgggctcgacggtgaagccggcggtggcgctggccggcctcgacgccggggtggtcacgccgacctcgcgggtcttcgaccccggctactaccagttgcccaactacgaccacaagtaccgtaactggaaccgctacggcgatggctgggtgagcctggagtcggcgatctaccggtccaacgacacctatttctacgacctcgcgcacaagctggggatcgaccgcctgcacgccttcatgagccgcttcggcttcggccagaaagtcgccctggacatgttcggcgaagccgacgggctgatgccctcgcgcgaatggaagcgcaagacccgccgccaggtctggtacccgggcgagaccctgatcctcggcatcggccagggctacatgcaggcgacgccgatccaactggcgcagatgaccgcgctgctggccaacaagggccactggatccgcccgcacctggccaagaccatcgacggccagccgccggtcgaccccgacccgatgcccgacatcgtgctgcgcgacccggccaactgggaccgcgtcgactacggcatgcagcaggtggtgcatggcgcccgcggcacggcgcgcaaggtcggcgccacctcggcctacctgatcgccggcaagagcggtaccgcccaggtggtggcgatcaagcagaacgagcgctacgaccgctccaagctgctcgagcggcaccgcgaccacgccctgttcgtcggcttcgcgccggccaacaacccgcagatcgcggtggcggtgatggtggagaacggcgagtccggctccggcgtcgccgccccggtggtcaagcaggtgatggacgcctggctgctcgacgagcacggcaagctcaaggccgaatacgcggaacccgtcgcgccgctcgcggcggcggtggccaagcccgaacccacggcagccgagccggaggcgcccgcccttgaacagtaa

SEQ ID NO: 5664 - DNA, 1194 bp, Pseudomonas aeruginosa
ttatggcggaacttcgctggttaccctgttgtcagggttcggggttctgatgtcgatccatacccatcggaagtggatcgcccaggtttgagaccaagagtgaagaacgcaatgcaagtactgcgtacatgggcggccaggggcgtccaatgggtcggcgtagccggcgtcattggcctgtccggggcggcccaggcgggggactacgacggctcgccgcaagtggccgagttcgtcagcgaaatgacccgcgactacggcttcgccggagagcagctgatggggctgttccgcgacgtgaaccgcaagcagtcgatcctcgatgcgatctcgcgcccggccgagcgggtcaagcagtggaaggaataccggccgatcttcatcagcgacgcgcgcatcagtcgtggcgtcgacttctggaacaagcatgccgaagacctggtgcgggcggagaaggaatacggcgtgccggccgagatcatcgtctcgatcatcggcgtggaaaccttcttcggccgcaacaccggcagttaccgggtgatggacgcgctgtccaccctcggcttcgactacccgccgcgggccgacttcttccgcaaggagttgcgcgagttcctcctgctcgcccgcgaacagcaggtcgacccgctcagcctgaccggctcctacgccggcgccatgggcctgccacaattcatgccgagcagcttccgcgcctacgcggtggacttcgacggcgatggccacatcaatatctggagcgacccgaccgacgccatcggtagcgtcgccagctacttcaagcagcacggctgggtcaccggcgagccggtggtctcggtggccgagatcaacgacgagagcgccgagagcgcggtgaccaggggcgtcgacccgaccatgagcctgggcgagctgcgtgcccgcggctggcgcacccacgatgcgctgcgcgacgaccagaaggtcacggcgatgcgtttcgtcggcgacaagggcatcgagtattgggtcggtttgccgaacttctacgtgatcacccgctataatcgcagcgccatgtatgccatggcggtttatcagctggcggggggagatgccccgcgcgccaggtgcccattgagcaagcgtgtcccgctcttccctgatcctgcccgccgtctgccgcctccgggctggcggccgtgctgttga

SEQ ID NO: 5665 - DNA, 957 bp, Pseudomonas aeruginosa
gcagttgctccagcaaggcgccccagcagccggccaggccaggcgggcatttccgggcggggcgactattcccgtccgcatcgcgacggcgccccctggtgggacgtcgacgtgtcgcggatccccgatgcggtaccgatgccgcacaacggttcggtgaaggccaacccctacaccgtgctgggcaagacctactacccgatgaacgatgcgcgggcctaccggatggtcggcaccgcgtcctggtacggcaccaagttccacggccaggccaccgccaacggcgagacctacgacctctacggcatgaccgccgcgcacaagaccctgccgttgccgagctatgtgcgggtgaccaacctggacaacggcaagagcgtgatcgtccgcgtcaacgaccgcggcccgttctattccgaccgggtcatcgacctgtccttcgccgcggcgaagaagctcggttatgccgagaccggcaccgcgcgggtcaaggtcgaaggcatcgacccggtgcagtggtgggcccagcgcggccggccggcaccgatggtcctggcgcagcccaagcaggcggtggcccaggccgctcccgccgcggcgcagacgcaggcggtggcgatggcccagccgatcgagacctacactccgccgccggcgcagcatgcggccgccgtgctgccggtgcagatcgactcaaaaaaaaacgcttcattaccagccgatggcctgtatctccaggtgggcgccttcgccaacccggatgcggcggagctgctgaaggccaagctgagcggcgtgacggctgcgccggtgtttatcagctcggtcgtgcgcaaccagcagattctgcaccgggtgcggctgggaccgatcggttcggcggacgaggttagccgcacccaggacagcatccgcgtggccaaccttggccagccgacgctggtacgccccgactga

SEQ ID NO: 5666 - DNA, 474 bp, Pseudomonas aeruginosa
agctggacgacaaggtcatccgcagcgccgacctggtcgccctcaacgccgtcgaggagggtggtttcttccgccgcctgtgggatagcatccgcctgttcttctacggtttgttcaactgaccgaccggcgcccgcccgctcacgaggccagcgggcgcccgtccccgcggaccacgggtccgccgccgccatgaccgatacccctgacgttcaacccccgaaaatcgaattcccctgcgagcgctatccgatcaaggtgatcggcgacgccggcgaaggtttctccgacctggtcgtggaaatcatccagcgccacgcgccggatctcgacgtcgagaccctggtggtccgtgacagcagcaaggggcgattcctctcggtgcaggtgctgatcaccgccaccgatgtcgaccaactgcaagccatccataacgacctgcgcgcgaccggacgcgtgcacatggtgctctga

SEQ ID NO: 5667 - DNA, 1212 bp, Pseudomonas aeruginosa
cgaaagaagcctcccagttacgggaggcttcgcggcggtagctgcctttgcctttcttcgcctgttcctggcggctgcggaacagtggctgggcgaccagggatttggccttgttcggccgcttgcttttctttgccatggcataggtcctcgaaggtgatcgggctggcgctcgccagcgcgcgcatcatctgcctgtcgccgcggattgtccagtgccggttgcgccttcaggctgccggcaggccgaggcgctggccggcgaggctcagggcgagaagcgagagaccgctccaggggctgccgggtgcctgtcccttgatctgcgcgtcgatcaactgggcatccctcagcatctggttccagcggctgctggagtggcgttgcagggcacgggtcagcagcggacggcgcttgtcccagaccggcggacgcgcctgggcgaaggctttctccagcgggatgccctggccgtattgctgggacaggccagccagcaggcggatctcgcgggccaggccccagaggatcaccggcggctcgatgccttcgccgcgcagtccttccaggatgcgcagggcgtgggccgcttcaccgccaagggcagcgtcgatcaggccgaagacatcgaagcgtgcgctgtcggcgaccgcggcctgtacggtggcggcgtcgatctggttgccctcggcgagcagcttgagcttttcgatttcctgggcggcggcgagcaggttgccttccacgcgcgcggcgatcagctccagggcttcggggctggcggacaggccggcctgggacaggcgctggcgaatccactgcggcaactggtggacgtcgaccggccagacctggatgaactgcgcggcgttgccatcgatcagggccttggcccacttggtcttctgcgtgctgccatcgagcttgggcagactgagcaggagcacggtgtcttccggcggccgttgcaggtattcctggagaatcgccgcgcctttgtcgccgggcttgccggagggcaggcgcagttcgatcaggcgcttctcggcgaacagcgacaggctggcgccggcctccagcagcaagccccaatcgaagttggcttcggcattgaatacctggcgctcgccgaagtcgcgctcgcggcaggcctggcgaatggcatcgcaggcttcctggcagagcagcggttcatcgccgctgacgacatag

SEQ ID NO: 5668 - DNA, 3321 bp, Pseudomonas aeruginosa
acgggcgccagggggccctggaggtgcttggcgagttgcgcgggagtcagcttcataggagaagacggggccggcgaaaccggccccggggcatcacggggtggggaactcgatcggcgactgctgcggctcggcggcgcggcgctggcgctccgcctcgtcggcggcgcgcagggcttcggcttccgccttggccttggcttctgcctggcgctgggcttcgtcgagttgcgccggggtcagcgcctggaggcgcatggacaactgctggatcaggtcgcgccgcatctcgctgcgcagctgcgcggcttcctggtcggaaccgatcaggttgttttcgtcgtgcacgtagaccttctgcacctgtacctggttgctcatcaggaccaggtcgttggcgccgacgatctcgtagttgatcgtgttggtcagctcgaactccgcgccgcgcgcggaaccggtgtagctgacggtgcgctgctggttgtcctcgcggaccagcaccaggtggtagggcgcgttgctggtgaccttcacgccgctgttttccagggtttccttcagttcgcgcacggtcgggccgtaggcgttgcgcgcggacacgtcgatttccttgagcgcgaattgcgcatcgcccaggccgcgcagttggaagccgcaggcggccagcagggtggtcataccgatcagcgcggcgctggtcaggatacgtttcatcaagcttccctcactcctgttgatcagcgcccccggatggccgggggcgtccaatggaatcgcgtatcagttggcgacgatgttgaccagtttgcccggtaccacgatgaccttgcggatgctcaggccttcggtgaaacgcagcacgttctcgttggcgcgcgcggcggcctcgacatcctcgcggctggcgctggcggccacgtcgatgtgtccgcgcagcttgccgttgacctgcaccaccagttgcagggtgtcctgcaccagtgcgctctcgtcgacgctcggccagcgcgcatcgatcaccgcttcggcatggccgagctggccccagagcacgtggcagatgtgcggagtgatgggcgccagcagcagaaccacggtttccaggccttcctggatcagggcgcggtcctgggcgtcctggttcggcgccttctccagcacgttcatcagggtcatcaccgcggcgatggcggtgttgaacttgtggtgctggccgacatcctggctggcctgcctgatcgccaggtggatggcgcggcggacctgcttctgcgcgtcgctcagggcggcgacgtccagcgcgccggggaggccggcgctgacgtgggcgtgagccaggcgccagacgcggcggaggaagcggttggcgccctcgacgccggcgtccgaccactccaggctcatgtccggcggcgaggcgaacatcatgaacaggcggcaggtatcggcaccgtactggtcgatcatcgattgcgggtcgacgccgttgttcttcgacttcgacatcttctcggtgccgccgatctcgaccggctggccgtcgctcttcaggcgcgcgccgacgaccttggccttggcgtcacgctcgacctcgacgtcggccgggttgaaccagtccttgccgccgttggcggtggtccggtagtaggtatcggcgaccaccatgccctgggtcagcaggttcttgaacggttcgtcgctgccgaccaggccttcgtcgcgcatcagcttgtggaagaagcgcgcatagagcaggtgcaggatggcgtgctcgatgccgccgatgtactggtcgaccggcagccagtagtcggccgccttcctgtccagcatgccgccttcgaactgcgggcaggcgtagcgggcgaaataccaggacgactcgacgaaggtgtccatggtgtcggtttcgcgtttggccggctggccgcatttcgggcagttgcattcgtagaattccggcatcttcgccagcggcgaaccggagccgtccggtaccacgtcttccggcagcaccaccggcaactggtcggccggcaccgggacgtcgccgcaagcctcgcagtggatgatcgggatcgggcagccccagtagcgctggcggctgatgccccagtcgcgcaggcggaactgggtgcgtgcctggcccaggcccttggcctcgaggtcggcgccgatggcgtcgaaggcggcctggtagccgaggttgtcgtacttgccggagttgacggtgagcacggactcgtccttggcgccgtaccactccttccagacgctggactcgaagtcgttgtcgccctcgaccttggcgatcacctggcggatcggcaggccgtacttgttggcgaactcgaagtcgcgctcgtcatggccgggcaccgccatcaccgcgccttcgccgtagttcatcagcacgtagttggcgacccataccggcagcttgtcgccggtcagcgggtgttcgacgaacagggaagtggccatgcctttcttctcctgggtggcgatgtcggcctcggcgacgccgccgcgcttgcattcgtcgatgaacgcctgcaactgcgggtcgttctgcgctgcctgggtggccagcgggtgttcggcggcgacggcgacgtaggtggcgcccatcagggtgtccggacgggtggtgaacaccttcagttggccggcgtggccgatggaggcctggtcgtaggggaagccgatctccatcccgcgcgacttgccgatccagttgcgctgcatggtcttcacctgctccggccagccgggcaggttgtcgaggctctccagcagttcctcggcgtaggcggtgatcttgaagtagtacatcgggatctcgcgcttctcgatcagcgcgccggagcgccagccgcgcccgtcgatcacctgctcgttggcgagtacggtctggtcgaccggatcccaattgaccgtgccgttcttgcggtagatcacccctttttcgaacaggcgggtgaacagccactgctcccagcggtagtagtccggcttgcaggtggtgacctcgcggctccagtcgatcgccaggccgaggctgtccagctgcgacttcatgtaggcgatgttgtcgtaggtccaggccgccggggcgacgttgttcttcatcgcggcgttttccgccggcatgccgaacgcgtcccagcccatcggctgcagcacgttgcggccctgcatgcggtggtagcggctgatcacgtcgccgatggtgtagttgcgcacgtggcccatgtgcagcttgccgctcggatacgggaacatcgacaggcagtagaacttctccttgtcgggtag

SEQ ID NO: 5669 - DNA, 186 bp, Pseudomonas aeruginosa
tcagcggcgggttggcattacggagccccgcccagcgaggcggcgttgatggccaatgccttgatgcaggatttgggggtgccgacgcgctggcaggaagttttcagccgtaccacctgggaaaacgccaccctgagcgcccccgcagttgcgggggggccggcgtgcgccgggtggtgctggtga

SEQ ID NO: 5670 - DNA, 1914 bp, Pseudomonas aeruginosa
cagcagcacgccggccaacccggccagcggccagacgcggtattgcagatagggcgtcaggccctgcatgggaatcacctcgccgcgcaggatgccctgctggaactgcgggatctgccggacgattcggccatagggatcgatcagaccggtgacgccgttgttggtcgcgcggatcatccagcgaccgctttccagggcgcgcatctgcgccatctgcaggtgctgcaacgggcctatggaagtgccgaaccaggtgtcgttgctcactgtcagcaacacctggctctgcgccgcgagcgcggcagcgaactccgggtagaccacttcgtagcagatgtacggggcgatctcgtagcccttggccttgagcagcggctggtcggccgggccgcgagcgaagtcggacatcggcaggtcgaagaaggcgatcaggccgcgcagcaggtcctgcagcggcacgtactcgccgaacggcaccagcttctgcttgaggtaggtgcccgcgccttcgccgaccacggtgatgccgttgaagtagcgactcttgccgtcggcgagacgttcgcgcaccgggaccccggtgatcagcgcggcgttcttctcgtcggcgacctggcccatggcgccgaggtagccgctggccatgtcctggagaatcggcaccgcggtttccggccagacgatcaggtcgacgtcctgctgcggcaggctcaggtcgcggtagaggtcgagttgcgcgcggacctgattcgggtcccatttcagctcctgggcgatgttgccctggatcgccactaccctcagcggttcgccggccgaatgggtccaggcgtggcccttgagatagaggccggccgcccacgggccgagcagcaggaccagccccagaagcaggctggcaccgtgcgggaagaggcgcggcaggttcaccagcagggccgcgctgagggcgatgacgaaggaggacagccatacgccacccaccggcaccagcccggccagcggtccctgcaactggctatagccggcgtagagccaggggaaaccggtaaggaaccaactgcggaacagctccagtgccagccacagggcggcgaacgccagggcgtcgcccagcggcgcgttgtcgcggcgcaggcagcgcgcccacagccaggccggcagggcgaagaagaaggcgacgccggcggtgaagccgagcatgaggaggcttgccagcggcaccgaggcggcgccgtagtcatggatactgacgtagatccagctggtgccggcgccgaacgcgccgaaaccgtaccaccagccgcgccacagggcggacttgccgggaaggccgcgcaagccgagatagagcagggcgatcgagaggatcgccagcggccagtaatcgaagggcgccagggccaggggtgtgagcgcgcctgcggcgagtgccagcaggtgtccgggccagccgggacgagaaatccaacgcatcgaatgtccttagagcctgttcaatgtccgactgcgcagaccggggccgccttcggctgccggacggcaacgtccgcggcgacaggggagtctggcgcaaggcgcaagagtaaaggaggggctggcgagacgccagaaggacggcgcgggaagatgccccctccgccgcggcggagggggcgcgctcagttctgcaggggagacaggcgcagcagatggacgcggcggctgtcggcgttgagtacgcggaaacggaactcgcccagctcgaccacttcgttgcgcttgggcaggtggccgaaggcgctcatcaccaggccgcccacggtatcgaattcctcgtcagagaattccgagccgaagaagtcgttgaaggcgtccacgggggtcagcgccttgacgatgaaatcgccgctgggcagcggcttgatgtag

SEQ ID NO: 5671 - DNA, 738 bp, Pseudomonas aeruginosa
cgcgagtgggcggcttcgatgatggccggaaggaattccttcggcgtctgggtcgagcggatgctcatcatctgcgagcgcggcaccatgatgtcgcgcacctgcaggtcggcgacctggatcgccccctcgacgatggacagcgcctcgctgtccagcagcttgttgtcgtgggcatcgcgcagcagctcgagtagctcctggcggtttctcggctcgtgggcaaaagcctgggtgatcttgtccagccaggacttgtgcccgttgctcgatcggtcttcgctcatttttccttgctcggtggctcttcgtcgtcgcaggcgtacggatcgggatgacccagttccgccagcaattcacgttccagtgtttccatttcttccgcttcggcgtcgtcgatgtggtcgtagccgagcaggtgcaggcagccgtggatcaccaggtgggcccagtgggcctgcaacggcttgcgctgttccagggcttcgcgggcgaccaccggggcgcagatcaccaggtcgccgagcagcgggatatcgagaagctcgtccgggacatcggcggggaaggacagcacgttggtcgcgtagtccttgtgccggtaggtgctgttcagttccaggccttcggcctcgtccaccaggcggatggtcagctccgactccggacgctggcgcagggccagttcgcaccaggcgcggaactgcgcttcggagggcaggtccggggcggcgctag

SEQ ID NO: 5672 - DNA, 270 bp, Pseudomonas aeruginosa
cgccgccggcagtctgcagttcgatcaggtagttgcggaagatctgccccagcacccgggtggcgatgtccagttcgtcgcggttcatctgctcggctaccaggtcggcgctgtccagggcgtcctcggcgccgttcaccgctgccatcttcagcacgatgtaggcctgtacgttgttcgccggaaccccttcgccacggaagaacatggtgccgaggtggtactgggcctgggcatggccctgtagcgaggctttctcgaaccagttga

SEQ ID NO: 5673 - DNA, 1164 bp, Pseudomonas aeruginosa
catcaggtggaagaagcgcttgaagcgttcgacgtcgctggccatcacgtcctcgaaggtgacgatggcgtcggcgccgctgaagtacaggccgaacatgccgcccgcctgggtggtgacgaaggggatgccggcggcatccgcgcgctgttgcaggccgtcgagcatgcgcgtggtgtaggcggtcagttcgtcgtggaaaccggggcggctgatcaggcgcatggtggtcaggccggcggccattgccagcgggttgcccgagagcgtgccggcctggtagaccgggcccagcggggaaatctgctgcatgatctcgcgcttgccgccgaaggcgcccaccggcatgccgccgccgatgatcttgccgaaggtcgacaggtccggggtgaccccgtagtaggcctgggcgccgccgagggcgacacggaagccggtcatcacttcgtcgaagatcagcaccacgccgtgttcgtcgcaggcttcgcgcaggccttcgaggaagcccggcgccggcggcacacagttcatgttgccggcaaccggctcgacgatgatgcaggcgacctccttgccgacttcgcccagggtcttgcgcaccgcctcgatgtcgttgaacggcagggtcagggtgtgcttggcgaaggccgccggaacgcccggggagttcggcacgccgaaggtcagggcgccggagccggccttcaccagcaggctgtcggagtgaccgtggtagcagccttcgaacttgatgatgctgtcgcgcccggtgtagccgcgggccaggcggatggcgctcatggtcgcctcggtgccggagctgaccatgcgcaccatctccatcgacggcaccatggagcagaccaggtcggccatttccacttccagcgcggtcggcgcgccataggacaggccgtggtcgagttgccggcgcaccgcgtcgagcacgtccggatggctgtggccgaggatcatcgggccccaggagccgacatagtccacgtagcgcttgtcgtcctcgtccagtacataggcgccttcggcgtgcttgaagaacagcggggtgccgccgacgctcttgaaggcgcgcaccggggagttgaccccgccgggaatgtgtttctgggcgttgttgaacagcgtttcggaacgggacatggctag

SEQ ID NO: 5674 - DNA, 573 bp, Pseudomonas aeruginosa
ctgccgggcaggcgctggcaggtgaaggtgcggcggctgccgtcgcggctgtacaggcgattgtgcacttcgctttcgtcgccgtgtccgccggtgatcaacaggtgctcgcagtgttccagcaggcgctcggcgcactggtcggcgctgccctcgggcaggtcggcgagcaggcgcgcttccggcaggttcggcgtggcgatggtggcgcgcggcagcagccgctcgcgcatggcgaagccgacgtcgcccttgcccaacgcaccgccgccgccggcgcgcagcaccggatcgcagaccaccggcaagtgcgggtgggcggcgaggatctcggccaccgtgtcgaccatctccagcgaaccgagcatacccagcttgaccgccgcgacgggcaggtcggcgagtacggcgttggcctgggccagcacccactcgcggtcgaggacgcggaagtcgctgacgttgacggtgtcctgcacggtcagcgcggtgaccgccggggcggcgtggcagccctgggcgagcagggcttcgatgtcggcttgcagtccggcgccaccactggggtcgtga

SEQ ID NO: 5675 - DNA, 444 bp, Pseudomonas aeruginosa
gcttcaacgagcaggtcgagcgcctgccgctggggcagtccatcgacgtgttcgaggacgtgcgcggtagcgccgatatcaacgacatcacctcgcgggccatcgacagcagcttccgccgccatgacaaggacgtgctcaatgccggctattcgcgctcggtgttctggttgcgcctggacctggactaccggccggtcgcctccagcgatccgcgcacctggctgctggagctggcctatccgccgctggacaagctcgacctctacctgcccgatggccagggcggctaccgcctcgcccagcgcaccggcgacacattgccgttcgccagtcggccgatccggcagaacaactacctgttcgaactcggcctcgagccgaacaagccgcagcgtgtctacctgcggctggaaagccaggggtcgatccaggcgccgctga

SEQ ID NO: 5676 - DNA, 1428 bp, Pseudomonas aeruginosa
ccacgaccgctacggcaaccgcgtcgacctggtggagttccatcccgcctaccacgagctgatgcgcgccgccatcgagcacgaactgccctcgctgccctggaccgacccgcgccccggcgcccaggtggcgcgggccgggctgtcctacctgcacagccaggcggaggccggcaccggttgcccgttgaccatgacctacgccagcgtgccggcgattcgcctgcaggcggacctggccgagaaatggctgccgaagatcctctcccgcgagtacgacccgcgcaacgtgccgatggagcagaaggcgggcgtcaccatcggcatggcgatgaccgagaagcagggcggcaccgacgtccgggccaataccacgcgggcctacccggtggggattcccgggccggggcaggcctacgaactggtcgggcacaagtggttctgctcggcgccgatgtgcgacgccttcctcaccctggcctacaccgacaagggcctgacctgctttctgctgccgcgccaccggccggacggcagccgcaaccagttctacatccagcgcctgaaggacaagctgggcaactggtcgaacgcctccagcgaaatcgagtatcgcggcgccctggcctggatggtcggcgaagagggccgtggcgtgccgaccatcatcgagatggtcgccatgacccgcttcgactgcatgatcggctccagcgcactgatgcgtcaggcgttgacccaggccgcccaccactgtgcctaccgcaaggtcggcgggcgggtgctggccgagcaaccgctgatgcagaacgtgctcgccgacctggccctggaaagcgaggcggcgctggccctgaccctgcgcatggggcatgccctggaccgtggccacgacgagcaggaggagaagttcgcccgcctggtcaccgcggtgggcaagtactggatctgcaagcgtgccccggcgatgatcaacgaagcctccgaatgcatgggcggtgccggctacgtcgaggaaaccatcctgccgcggctgtaccgcgaggccccggtgaactcgatctgggaaggttccggcaacgtgcagtgcctggacgtgctgcgtgccctgtcgaaggagccgggggtgctcgacgcgttgttcgccgaactgggcgacggccatggcgacgcccgtctcgccgcgcacatcggcaacctcaaggcgggcttcgccgacaccgccgacatccagtaccgcgcccgccagctcaccgaggacgtggcgatcgccctgcaggccaagctgttgctggaagccggcaactccgcggtgtccgacgccttcatcggcagtcgcctgggggacggcgggcgggtctacggcaccctcccgcgcggcgtcgaggtcgaggcgctgttggctcgcgccaccccgcactggcctga

SEQ ID NO: 5677 - DNA, 444 bp, Pseudomonas aeruginosa
  unsure (165): Identity of nucleotide at the above locations are unknown.
ggcgcgtcgcgatgcaggcgcatccgcgctaccgggagctggtcgagcagggcttcgccgcggccagtttcgtcggcgacctcggcatccgtccgctggactgcgggccgggttgggtcgaagcggggctggacatcctggccccgccacgcccagcagaaaggnttcatccatgccgggatccaggagaccatggcggaccatgccgccggggccgccgccgcgaccctggtggaggaggggcagacggtgctgaccctggagttcaagctcaacctgttgcgcccggcgctttgccagcgcctgttgtgtcgcgccgaggtgctcaaggccgggcgccaggtgacggtggtcgaggccgaggtgttcgccgagcgggacggtcggcggcacctgttcagcaaggccaccgtgaccatggcggtggtggcgctggccgaatga

SEQ ID NO: 5678 - DNA, 1554 bp, Pseudomonas aeruginosa
gataacgggagaaaagcgctgtgttttcctgtcggtacaggcaagatgttttccatgcgaaccgacaggaagcccaccatgagtatcgattccgacgacgggttcgtcgtcgcccgcacggccgaggaggccgtcgaccgtcttgccgagctgcaccgccaggccaccgcggcgctgagccaggcgctcaagcgctacatcaaggagcgcatcgagccaagcgaggccgagcggcagaacttccactacccgcaactgcgcatcggctaccgctgccagggcgaggtgccgtccaccacccgcgcctacgccaaggtccaggtgccgggcgaatacagcgtcaccgtcacccaccccgacgccttccgcaagtacctgctggaacagttgcgtccgctgatggacgatttcaccgtgcaggtgcaggtcggcccgagccaacaggacatcccctatccctacgtggtcgagcagggcgacgagctggccggctccggggtgaccgccgccgagctggcgcgggtgttccccagcaccgacctgtccgccgcttccgacgacatcgccgacggcctctacgaatgggaacgcgccgaccagttgccgctggcgctgttcgacgccgcgcgggtggacttctccctgcgccgcctggtgcactacaccggcagcgactggcgccacgtgcagccgtggatcctgctgaccaactaccaccgctacgtcgaccagttcatccgcctcggcctgacccgcctgcgcgaggacccgcgcttcgtgcgcatggtcctgccgggcaacgtgatcatcgaacgcgggatggacgaaggcgaggccaacgccatcgtcgccggggtggtctggcaccgctaccagatgccggcctaccacctgatcgccgccgatggcgacggtatcaccctggtcaacatcggggtcggcccgtccaacgcgaagaacatcaccgaccacctggcggtgttgcgtccgcattgctggctgatgatcggccactgcggcggcctgcggcagtcgcagaccatcggcgactacgtactggcgcacgcctacatgcgccgcgacggcatcctcgaccgcgcgctgccgccgcacatcccgatcccggcgctggccgaagtccaggtcgccttgcaggaagccgccgccgaagtcaccggcgagcgcggcgagtcgctcaagcgacgcttgcgcaccggcaccgtgctcacctacgacgaccgcaactgggagttgcgctgggcccaggagcggccactgatcaacctggcgcgggccatcgcggtggacatggagagcggcaccatcgccgcccagggctaccgcctgcgggtgccctacggcacgttgctgtgcgtctcggacaagccgctgcacagcgagatcaagctgcccggctcggccaacgccttctacgagcgcgcggtgaaccagcacctgcggatcggcatcgccgccctcgacctgttgcgcagccagctcaactcgctgcactcgcgcaagctgcggagtttcgacgagccgccgttccgttga

SEQ ID NO: 5679 - DNA, 912 bp, Pseudomonas aeruginosa
gccgtcgccaacagcgccgagccaggacagttaccccagaagggaggtcgacgggcctccctttttctttgcccgcgatccggcccgtgccgcgcttttacccattctttacccggcgtttacccacccttggcggaaaacggcggaaagtcgttcccgggatcattcgaacgtggccgggcgaccaggcccggggcgaggcagacgatgaacggtggatggtggcgaatgctcggggtgggcgctctttcgctgagcctgtgcgtccaggcgcaggccgacgacggccgagggggacgcggtggacccggcggcgagcgcggtgttgcccacggacaaccgggacctggccgcggcgaagcgtacggcggcagttggggaccgcatcccgactggcgtccgggccgggtggtggaggccttgccgcgcgggcacctgcgggtgccctatcgcggcggcgagtatttcttcgacgacggctactggtaccgacacgacggcccgcgctatgtgctggtcgtgccgccccgcggggtgcgcgtccgcagcctgccaccctatgcggagcaggtctggctgggcagcgtgctgtacttccttgccgccggcacttactacctgtggcatgccgacacccgtgagtacgaagtggtcagcccgccgccgcaggcagcgggacccggttatccggtcagcgtgccggccaccggctacgacgtggtggcctacccggcgcgcggccaggggcccgaccagcagagccgcgatcgctacgagtgccaccgctgggcggtgggcgagagcggcttcgacccggcgggggcgacctatgcgccggccgccgaggtcgccaacggctaccgccgggccatggccgcctgcctgagcgggcgcggctacagcgtcaactga

SEQ ID NO: 5680 - DNA, 1221 bp, Pseudomonas aeruginosa
gtcccacatataattcgagcaaggaggtcaaaagtgtcagaaaacggcgaggtggaaagagatgatcttgaactgctacgagcagatctctccaagagactgaatggatttaacagtaactatccggacgtcagtgtttatgagctgagaagctcacggctgtctagggaagagtttccggtgcctgagatgctcttgctcatgctccgaaacgtactggggtggcggtggtctggcaccggcgagaagattcgctggactgtttatggctcattcaatggcgagccgctctcgattgaactcggaaagtttggtctcaccatgcgtagctcaccagtcctagatgagagccggaggcggatcgagggccagctgaaaagtgcagtaaacctcgtcgagcaattcatcaaaccgatgatcgataaccagattaccaatggtgagttgaccatcggtaatcatcttactgagttcatgtcacgctatgaatttttccgtgacaaggcggataaagcttttcgacgcgccgaccggaaagctagagagaaacctaaggagagtggcgaatttccagagggcatcatcagtgcccttatgcatggttacagtagaagtatgagtgatcagcaggaaggattctattactcggttgccatggtcgacgcatattttagtgctttagagcacaggttgaacttgcttcgtgcctttacaggagtgcccttacccgctgagggattcaaagccttcatgtccaagacatggaacgagaaagttgacgaattattaggggagaatccatcgccaagggcgcgtaaagccctgcagggtatgcgagatatcaaagagcggattcgcaatccgttcgctcacggcggatatgaaaatgacaaaggggcgctccatgtccacatcccgacaataggagctatccccggaaatattaccaaatttgggaaaagtgctaggttttccttcattcctgtaggtgtcaacgatcataaattaaattgcacggtattcgacgaggtcgataagttgttgtccacggatcagcttgctgccccctaccggcttatggtggctggtatcgacccatcgttcaatgagaaatccttatgttcctacagggacgcgatctcgggtggagataaggctttagaaaggttcatcgaccgctggcatcatatgtgggagcgtcacgccaacatggattactag

SEQ ID NO: 5681 - DNA, 339 bp, Pseudomonas aeruginosa
gcgagaatgctcgccacagagaggtgtccgatgaccaagcaacgccgtacctttacccctgagttcaagcgcgaagctgcctgcctggtgctcgatcaaggctacagccatgccgaagcggcccgttcgctcggcttggtcgagtcggccctacgccgatgggttaatcagcttcagcaggagcgcggcggcgttacgccggccagcaaagcgttgacgccagagcagcaaaaaatccaagagttggaagcccggatcacgcgccttgaacgcgagaaatcgatactaaaaaaggctaccgcgctcttgatgtcggaagatctcgagcgtacgcgctga

SEQ ID NO: 5682 - DNA, 1263 bp, Pseudomonas aeruginosa
ccgacgttcaacgacggccttgcgtcctgcgcatggagctgcggggcggccagcagggcgaacgccagcagcgcgagcaggggcgttgtggtgcgtaggggcatggtgtgcggccttgccgttttttgttgttatgaatgggggcgaagcatgcggcgcgccgggccgcttgtccagcccggcgcgcgcccggtcaatggggcagcaggaagcgcgcggcgagcggcaggtggttggagatctgcagcgtatcgctgcgccggacccgggcatcgagacgggtcagcgaggggctgtggaacaggtagtcgaggtccgatccggcccctggacccgtgggtcgttggggaagtgcgtgtaccagcgaacctggtcgacgccactggcctcttccagcgacggcaccatcgggaagcgcccgctcaggatgcccagttcgctgtcttcccggtagggcgcgcgcagcggcgccagcaggtagggatactggccgggcggcagcaggttgaggtcgccgccgagcagccagggcgtgcgcctggcctgcagttcgtcgagcagcgtacgggtggtctcgacctggcgctcgagggtgtcgtcgttcgcctgcgggcggtcgaagcgggcgttgagcacggccagctcgccgccgccgtcgatcggcaggtggctgaccaggatcgccgggcgcggcccgaacaggcggtcgaacagcccgccatcgcgtggcggcaactggcgccgctcggcgctatcgatgcgatagcggctcagggtggcctgcttgcggccgacgctgccgaagatgtgcggcgtcggcacgaaggccgacttccactcgtaggcctgggcgctgcaatggtagagatcgttgatgcgctcctggatcagcgccagttggtcctgatcgtcggtggcgctggagccgtcgtcgatctcctggagcaggaccaggtccggctgctcgtcgcggatcacccggaccacctcgtcgagggtgaacgccaggtcttcggcggtggggcgctggtccgggccggtggcatccggcaggtcgtcccagaagacgtagcgtttgccggccaggtactggatgttccaggtcatcaccttcagggcctgccccggcttcagcgccggcgcggcgccctggcaatgcaggggcgcggcttcgcgatcggcgggttgccagctcagcaggtagctggcgagcagggcaccgccgaccagcaggagcaggccgacgaacagcaggttgcgtag

SEQ ID NO: 5683 - DNA, 435 bp, Pseudomonas aeruginosa
atgcggaaggcgacgatggtcaacagcagctggaagaacccgctgagcgcatgcagggcgacccgcagcacgacggcgtcgccggccgaatcggcgagccaggcttccaggctccagaccggcagcaggatcaccagcgaacaggcgaggatcaggaagaatcgcccacgggtgaactcgaagctttcccgcagcgcctgcagcggactacggccgcgcagcaccaggcagaattcggcgaaggacagcttcaccatgacgaagatgcccggcaggatcagcagcgacaggccgagcacgatcagcagcgaagtcagcgccgcgagtagcgcgaaggctggccacaggcgcagcgcggcgctccacagctggccgacgcgaggccgctcgtcgcgcccgcgcgcgtccatgaacaggatcagggctgcggtgtag

SEQ ID NO: 5684 - DNA, 1383 bp, Pseudomonas aeruginosa
aatgccgtccgtttccttttttccgagtcgctcatgacgttcgcttccctcggtctgctcgcccccctgctcaaggccctcgaagggctcggccacggcacgcctacgccgatccaggcccaagccatacccccggcgctcaagggccgcgacctgctcgccgcagcacagaccggcaccggcaagaccgccggtttcgccctgccgttgctgcagcggctgaccctggaggggccgcaggtcgctgcgaactcggtgcgtgcactggtcctggttccgacccgcgaactggccgagcaggtccacggcagcgtccgcgactacggccagcacctgccgctgcgtaccgcggtggcctacggtggggtcagcatcaacccgcagatgatgaagctgcgcaagggagtggatatcctcgtcgccactcccgggcggctgctcgacctgtatcggcagaacgcggtgaagttcgcccagctccaggcgttggtgctggacgaagccgatcgcatgctcgacctcggtttcgcccgcgagctggacgaactgttcgccgcgctgccgcgcaagcgccagaccctgctgttttccgcgaccttctccgacgccatccgcacgctggcccgtgaactgctgcgcgacccgctgtccatcgaggtcagtccgcgcaataccgcggcgaagagcgtcaggcaatggctggtgccggtggacaagaagcgcaaggccgagctgttctgccacctgttgcaggccaatcgctggcgccaggcgctggtcttcgccaagacccgcaagagcgtcgaggaactggtcggactgttgcagcggcagggtatcgccgccgactcgatccatggcgacaagccgcagccggcgcggctgcgcgccttgcagcggttcaaggccggcgaggtagacctgctggtagccaccgacgtggccgcgcgtggcctggatatcgaggaaatgccgctggtggtcaacttcgacctgccgatcgtcgccgaggactacgtgcatcgcatcggccgtaccggccgtgccggtgcctccggccaggcggtgtcgctggtctgcgccgacgaagtggagctgctggcggcgatcgaaacactgatcgggcagaccctgcaacgccgcgaggagcccgacttcgagccggagcaccgggtgccgcagaccgcaccgggcggcgtggtgctgaagaaaccgaagaagccgaagaaacccaaggccgcggagagcgtcggcaagcccggcaagatccacttgggcagttggttcgacagcagcgcgccgacggtcaaggcggtgcgcaaggcaccgggcttcggcgcgggtgcggcgggcaagccgaagaagcggccgtccggcaaatag

SEQ ID NO: 5685 - DNA, 2190 bp, Pseudomonas aeruginosa
ccacggccgttagcggatactgttctcttgtttcagagcggaacgcgtcttgctcgaacgacacgctcatttccagcaaccggtcagcgcaaccgggaaatggccgattcctttcgttcccgtccctgcctttcaccactgaattccgttttcctcattcacacctgtttgacggcgaccccgccgcaccaccgaacttttgtcatgaaaacttcatgcgaccggccgttcgcgcgccgccggcggggacgaacgggcattcacccgagaatcgaccagcgcctcggaagttcgccgaaaaaaaggccctccgtggggagggcctggcgggtatcgtgcctccgcggcggtgccttacaggatcaggttgccgcgctcttcatcggtcaattggctgcgcgcctgttcgccgagggctccggcgccgagcacctgcacggcgctgtccgggttgtagcccggcgaacgactggcgccgtcgcgcgaaggctccaggcgctcgttgccgaacccgagcacctgcaccgtgatcaccgacggcatgcgctgccgcgcggcggcctgctgctggcgactgacgtcctccgccgcctgggtcgcggaactcgccgcggcgctggcggaggtcaacgccccggtattcaccgaagccaccagcggaatgccgctggactggccctgggtctggatgttcgccgcgttgaccacctgcagcgccgccacgttgacgttgccggaaacccggatgcccgcctcgccggcatcgatggtgccgagcggggcgatcaggtcgatgtcgcccggtgccacttcgggaatcgggttgagggtggcgataccggcgccggtgctgggcacctgtggcgacaggctgacgttgccccaggcgtcgtagatgcgccgcggcggggtgtagaccacggtggtctgggaaccgcgaccggcgttgatgtcgccttccgccgaccaggccaatatgctgccgccgaaggtggtcatgatgcggctctggccgagcaggatgctgtcccgcgagtaggcctggatatcgccctggccctgggtgacgatacctgcggtggacggcggcgcctcgccctcgataccgaacacctggcgcccgccggggctgagcaactggatgtcgccgccgaagtcggtgtgcacgccggcaccgccatacatgacgatatcgccttcgtagctgatcggattgcccgccggatcgcgctcggggaacagcgcggcgatcgcgttgcgcccacgcaggtagctaccctggcgtaccccgccgacttcgttgtactcgcggccgccggccctgagttcggcgaagtacacctggcgggcgaagatccgctgctgctcggcgggcaggccggcgaagaacgcctgggcctgttccgcgtcgccggcgaagccgaagcgctcgttcaaccacttggccaactcgctttcgtaggtcctgaccaccttgcccggctgctcggccagcggggtgccggcctgcgccaggttggccggatccaggtagcgctcgaggaaggcctgatagtcggcccccgccgcgccggcctggagcacgatatcggcacccggccggctgtcgcccggcaccaccgcgccgagactggtgatcgctgcgcggtcctccatgaggatgttgcgcccggcgctgatctccagggtaccggggccggcgacgttgaagttgccgtagaggatgtcgcggccggcctggaccagcgagaggtcgttggggtcgtcgtggacgaagaggttgccggtgaacgaggcatccgtactgatctgactgggagcgctgatacgctgtcccaatggggttccggaggcaacgatgtcgcgcccggcgcgcatccagacgggacccgcaccttcataccaggtttgcccggcgcggttccccgcctgctcgccgaaacgaatctgcgcaccgctattgagcccgacgatatctcctgtcaacgcatagaaacgcgccggttgcagatcgcgcgccaggctcgcagcgctatcggggccgaagtagaacagaggcaatccgccaatgacggccggattcccgtccggactgccgttgcccgctatcgggttgagcagcgcggcatcggagtagccggcaaatgccggcgtccagatcgatggcaggttcgcaggatcggcacctga

SEQ ID NO: 5686 - DNA, 1665 bp, Pseudomonas aeruginosa
gagcacttcgtaatccgcgccaccggcgcccagtaccgacccattgaacagaccgcgaggctgattgaatcccgtcgcgacatcggcggcctgcgttccggcggtatagacgccgtacggcgaccattgcgtaaggttaccggcactggccaggtcaagatcgccagtgccggtgcgcagcacactgaacaactggttctgcggtgtgaccacggttttgccgagattctcgatacacagggacggatcgacactgcaccaccacagatcgccctcgccgatcgccgtaccagcaggcatgcccaggtaattgccgggcgcccaggtccagcggggaggctcggcacaatacggccccagcccgcagatccattcattgctctcgtcgaccggagttcccggggtgatcccccagtcggtagcctgatcggtgaacaccagccctcccgagctctgttcgatcttcgcctgatagtgcgtatcggccaggttcaggctggccgaggagtccggacgcaccagacggttgtcggcagccgcgagatcggcaccggcgaccaggcgcatggaccaggactggctaccggccggcagcatctcggccaatgcccagttgcgtccctggcggacaccgtcgctgggccgcaactcgatgaaaggcgcatcgccagccagtaccacctcggtctgcgaagggatcagagaaccacgtgccaaggccagctctccattgagcagcaggacattgggtctgctgggcccctcgcgcaggatgctcggcaagggcacgcccgcaggccaggtcatcgcctgcacgctggccggtgccgccagcagggtaccggcacccagccggctgccgacctccagcgtcaccccgtcgcgcagcaggctgcccgcggcgtacagcaggttgccggcggcatcgtggatgtccgctaccagcacgctgccggcggccagggtatagggctgttcgagtactgcctcggtggccagacgggtgccggcggccagggtggtgcccttgatcggcaggtcgtagttgagggtgcggccgccgaggaacgcggtaccgtcgccgagcaccacgcccgggccgggaaccaccaggtcgccgccgaacggctgcacccccggggtgaggatccagcccttgtcgtccggcgagtccggcggcggcgcgaagccgtcgttgatactgccgtagaggttcaggtcaccgccggcgcgcagcaccagcgcgccgacctcgccggaaccgtagacctcggtcagcggcgtgttcggattgaggctggcgtagcggtagccggacagatcgagatcgccctgcaccaccaggtcgccgtccgccgttgcgctgacgatctccacccctggacgcaggtggaaagcatccgcgtaggtggcattggtcagtccggccagcttgccgtcgagcaactcgcggttggccagcgccgcggcgatgaacgcgctgctctcggcatgccgcgcatcgaggtaagcctggtcgatcacctggtagggccgcccggccggccgccggatcgttgccccagggcgcatcgtcgtaacgctgcaccgcgttcagggcgatgctgccggcgccgcggatgtccagcgcgccgctggcatcgatggcgatgtcgccggcgctga

SEQ ID NO: 5687 - DNA, 483 bp, Pseudomonas aeruginosa
gccaacgtatcgttgtcctccggcgccagcagcaggttgctccacaagccgctggcatccagccgtacgccgtcgcccacgcgcaagatgccgtcttcgcggccggcatcgacgaaaccatcgatcgtcccgttcggagaaatctgcgccaacacgttgccggcctgcaggctgccgccatgggcggtgatgtcggcgtcgatcgccacgtcgttggcgaacaggattgcctcgccgccattggccagggtcagcgcgccgtcgacgcggatgctctcgccggccgccaccttcaggccgcccagctggaagccgttgagcagttcgctgtccaggctcaggcggccctggcgctcggcggccaccggagcgtccagggtcggctcctcggccgccgcctcgccggcaccgatgaccacctgcttgaggctgccggcatcggcgccgagagcgtactccagcaggccgctgctcttcacgtag

SEQ ID NO: 5688 - DNA, 2136 bp, Pseudomonas aeruginosa
cggcgccgcctcgcccagcggtaccgcgcgcagcggccgcgggctcgggcgcaagtcgtaggcggcctgcgggatgccctgctgcgccggcggcagcaccggagcctgcatgtcgccgacgctccagtcgtggcgcggctgcacgcgctgctgggcgcggcggatgaagtcgtagcggttgagggtgatgctgcggccggcggcggcgtcgcggacgatgtagggacgcaggaagaccatcaggttggtcttggtccgcgagcgcttctggtagcggaacagcgaaccgacgccggggaggctggagagtccgggaacaccgtcggtgttgtcctgcacgttgtcctgcaacaggccgccgaggaccatgatctggccgtcgtcgaggaggatgctggtatcgatcgcgcgcttgttagtgaccaccccggcggcggtgctggcgcgctcgtcgacgctgctgacctcctggtagacgtcgagcttgaccgtgccgccctcggagatctgcggacggatgttcagcttcaggccgacgtcctcgcgctggatggtctggaacgggttgttgctggtaccgccgccgtcggtgacgtactggccgctgacgaagggtatggtctggccgaccatgatgctcgccgactcgttgtccagggtcagcaggttcggggtcgacaggacgttggtgccgccgcggctcttcagcgcccgggcgagcaccttgaggtcgaggatcttgccgatcccggggatgtccacggtgccatccaccaggccgatgttgagccccttgggcaacacgtcgatggtgttcttgccggccgtgttcagcgccgactggccgaagttgaccccgccgaacacgccgttgccgccgaggttgccggcctgccactggatgccgaactcgctggagtcgtcttcgctgacctcgacgatcaggctttcgatcaccacctgggcgcggcgctggtcgagcaggtcgatgacttcgcggaggttgcggtacaacggctcgggtgcggaaatcagcagggtgttggtggtggcgtcggcctgtacggtgaccccgccggcggagaacgccgagttctcctcgcccatcgcaccgggtccggcgccgccctggccgctgcccatcgcaccataggcgccgccgctgcggttgctgccgcccaacccgctggaaccgctgcccgtggtattgccgctggttcccaggccctggctaccagtaccgctgttgccgctaccgagcatgccgccgccgctcaggcgcgcgcgctgctggtcgccctcgttgccctcgccgccgctgtcgccggtgatcagcccgcgcagggcctgggccaggcgggtcgcctgggcgttgcgcaagtagaccacatggaggttgccgggattgctttgcacgctgtccagcttgccgatcaggtcgcgcgccaattgcgtgcgctcggggctcggcgagcggatcacgatgctgttggagcgtgggtcggcgagcaccacggtcttctggccctgctcggcgccgccgctgccctggctgtcgagcagttcggagacggtgctggcgatgtccaccgcgatgccgttctggatcggcaccacgtcggtgtcgctggcgctggggatgtcgatgctggcgatgatcccggcgacccggtcgaggttttccgcgtagtcggtgaccaccacggtgttgttccccggataggcattgatcgggttgttctgcgcgacgatcgggcgcagcaccgggatcaggttcaccgcgttctcgtagcgcaggcggaaggtccgcgtgaccatgccgttggccgccggccggtcggcgccgtagaccggcccgccgagcagcttggcgtcggcctccggcaccacctggctgaccccgtcgacgtcgaccacgctgaagccctgcatgcgcagggcgctggtgagcatgcggtaggcggtgcgcgccggcacctggccttcggaaaccagggtcagcttgcccttcacccgcgggtcgaccaggaactgccggccggtggcgcgcgacagcgcgcgcaccaccgcttccacctcggtatcgacgaaattcaggctgaccggctgctcgccgagttcggccgctgccgctga

SEQ ID NO: 5689 - DNA, 819 bp, Pseudomonas aeruginosa
tcaatcccgccagttgcacctctacctcaccggaaggcgccgcgaaccagcgttgagcggcgtcctcgccgctgggcggcggaacgtcggcgacctcggcctggaccacgccgggaatcggcgccagcaacagatagccccagaacagcaggccggcgaggatcgccagcacggcggcgaactggaccaggcggggcggatcgatacggggcatggccggcatggcgggctctcctggcgtatgggcgacgggcgccacgaacggcgccccggcaccagcctagcgcggaattctctccgttatgtttcacacgccgatcatcttcgtcgggcactctggaaacctctctcttcgcggagcggcatccggtgaggcgaccccggcaaggcggtttcaccctgatcgaactgatggtggtgctggtaatcgtcggcatcgccacggcggccatcagcctgagcgcccgccccgacccgacgggcctgctgcgccaggatgccgcgcgcctggcgcggttgctggaaatagcccagggcgaagcgcgggtacgcggtacgccgatcctctggcagcccagcgccaagggctatcgcttcagcccgcaggcctatcgcggcaagaccgacgccttcgccgccgacaccgaattgcgcgcgcgcgactggcaggccgcgccgctgcgggtcagcgtgcgcccgccgcgaccggtgttgctggacgccgaatggatcggcgcgccgttgcggataacgctctccgacggccaacacagcgtcaccgtgctgcgcgaggcgaacggccatgtccgggtacgctga

SEQ ID NO: 5690 - DNA, 672 bp, Pseudomonas aeruginosa
acgcgcgacgacgcggcgccggcaaaccggcttcaccctgatcgaggtgatggtcgcgatcatgctcatggccatcgtcagcctgatggcctggcgcggcctggacagcatcgcccgggccagcgcgcacctggaggacagcaccgagcagggcgccgcgctactgcgcgcgctgaaccaactggagcgcgacatcgccctgcacagcgccatccgggaggagaccggcctgcccagcggcgacgagccgatccgggccggcgacagcctgccgcccggactcgcactgaagcgcctgagcgagatcccattgcgcctggacatcgtccgcgccagtaccgagccaggcgcgccgctgcagcgcgtgcgctggtggcgacagggcaaggtcctctaccgcgccgcctcgcccagcggcgaccgcctgccgttgccgccgctggcggagcgggtggctgtgctggacgacgtgagtcggttcgagatccgtgcctgggtgccgggaaaaggctgggcgcgcctgccggcacgcagcaaagtccgcgccagcggactggagatcagcctggcgcgggtcacccgcaacggcgtggagcgctatcgacgggtggtggccctgcaatgaagcggtggctcagccgagcagcaccaccccgcccggcaggcgggtga

SEQ ID NO: 5691 - DNA, 381 bp, Pseudomonas aeruginosa
catgttttcaccgattgccgtataagcgggaaaccaccatcccagcgcgggagaatcgccatgcaccgttcatcgcaggttctgccggccctgatcctgggcctggccatgaacgccaccctggccgacgagccgacgccgccggcgaactgcatcaacaccgaggtcaacggctaccaggctttgtcctatgaatgcctgagccagcagatggccgatcctgacagcgcggccagggcccgccgcgaacaggagctggattccgccgccatcgtccggcgtccgccaaaccagctcggcctgtacaaccaatcggcgacgcgcattcgcctgggcacctcgttcggcaactcagtggaagcgcagcggccgcctcgctaa

SEQ ID NO: 5692 - DNA, 1821 bp, Pseudomonas aeruginosa
cccaggcgcaacgtcgtgtcgtcctggtcggcgccccctacgtaccttatccgcaggcctggctggccgccgcggtcgacctgcgccacctggtcctgctgcaggccagcggacgcgacgccttgtgggctgccgaacagtgcctgcgctcgggcagttgcgccgcagtgctgtgctggccgcagcaggccgacgaccgcgccctgcgccgcctccaggtcgccgccgaaagcggtcaggccctgggtttcgcctatcgccccctgcgcgaagcggtcaatccttcgccggcagcgctacgcctgtgcatcgaaacccgccccccacgcctgcgcatcctcaagtgccggggcggcctcgcgccggcgaccgccctgccggccagcgcctggcaatgaggcggccatgctctgggcttgcattctcctgccgcaactggccatggacagcgcgctgcgtcaacggagcaatcccgacgcaccgctggcgctgctcggcggcccagcgcagcgccggcagttgcaggcggtcaaccctgcggcacgcgcgctcggcctgaagcccggtcaatcgctgatcgccgcccaggccctgagccgggacttcgccacggcggaatacgacctcgccgccgtggagcgctggcaggccttcctcgccgcctgggcctacggtttcagctcgcaggtcagcctgcactatccgcgtgcgctgctgctggaagtgcagtccagccttgccctgttcggcccctggccacgcttcgaggcccgcttgcgcaaggaactcacggcgctgggcttccgccatcgcctgtgcctggcgccgaacccggtggcggcgagggtcctggcgaacagccacgacggcctggccatcgaggacgagacagcgctgcaacgccagttgtccgcccttccgctggaccgcctgggactctcgcgggagctggccgtcgccctcggacgcatgggactgcgccatctgcgccaggtcctcgagttgccgcgcgccgccctggcccgtcgcttcccagccgaactgctgttgcacatcgaccgcctctgcggccgcagcccactggcgctggagcactaccggccgccggacaccttcgacctgcgcatcgaactcaatttcgacgtggaatcgcaccaggccctgctcttccccctgcgacggctgagcgccgatctcgccgcctttctcgccggacgcgacagcggcgtgcagcgcttcaccctgcacctggaacatcacgggcgcgccgacagccaggtcacggtcggcctgctcagcgccgaacgcgaggcggccatgctcttcgaactgacccgcggccgtctcgaacagctgcaactgcccgcccccgtgcatgccgtgcgcctggaggcccgcgagctgcctcctttcacgccgcagcaccgcgaactgttcgacgagcgcccacagcagtatctcggctgggaacagttgcgggaacgcctgcgcgcgcggctgggcgacgaggcggtacagggcctgagcgccgtcgccgaacaccgtccggagcgaagctggcggccgcacagctgcgacagggcgcaatcgccggcagcctgcggcctccgccccggctggctgctggcggagccacgccccctcggcgaggccttgcccaccgtgctggccggcccggagcggatcgagtcgggctggtgggatggcgaagacatccgccgcgactattacctggtggaaacccgcagcggacaacgtgcctgggtctatcgcgaggtcggcagcgaagggccgctgtggctgcatggctggttcgcatga

SEQ ID NO: 5693 - DNA, 879 bp, Pseudomonas aeruginosa
atcccacgccgccagcttcgccctgctcacctacgccagcagttggctgaaacgtcacgagccggcggccttcgcctgcgccttgatcaacagttggccgatgggcttctacagccccgaccagttgctccaggacgcccgccgccacaccctgcagacacgcccggtggatgtccgccacagcggttgggattgcagcctggagccgttcggccaggcgcaaccggccatacgcctcggcctgcggatgatccgaggctttcgcgaggaggatgccaggcgtatcgagcaggtccgggaggcccagccgttcctcgacgtgcacgatctcggccgacgcgccaggctcgacgcccgggccctggagttgctggccgatgccggcgccctgcgcggtctcgccggacaccggcacaaggcgcgctgggccgtcgccagcgtcgagccgcaattgccactgttcgccgaagggaccgtcatcgaagaaaccacggtcagcctgccgctgccttcgcgcggcgaggaactgctgagcgattacgctctcctcggcaccaccctcggcccgcatccgctgaaactcttgcgtggacagctcaaggcctgccgctgccgcgactcccgcgaactggcgaaactgggacatggacgaccgatacgggtcgccggcctggtggtcggccggcagcgcccacagaccgccagcggcattaccttcatcaccctggaggacgagttcggcatgctcaacgtggtggtccggcacgacctcgccgaacggcagaggcggccattcctcgagtcccggctgctgcaggtggagggcatcctggagtcctccggcgaggtgcgccacgtcatcgcagggcgcctgcatga

SEQ ID NO: 5694 - DNA, 1890 bp, Pseudomonas aeruginosa
tcgccgcgccttgcggggtggtatcgaccgagacctgcttgcggtactgccagtcgtcctgccaccaggcactggcgctggccggggccagcaggcccaggcagatcagcgatgtcagcaataagcgatacatgtggggttactccggggtcagcgtcagaagctcgcctgcacgctgaaatgcaggcgcgagtcgtgtttgtcggtgttcgtcccttccagcagcgggaaggcccagtcgaggctgccggacagccagtcggcgagttgcgcgcgggtgccgatgccgacgctggccaggctgaagtcgtcgtcctgttcgggcagcgcatcctgcaggcgcagttgcgcgccctcggcgaacacgtagaagcgccagtcgttgacgtagccgccggcgcgcttgccgaggaagcgtccgagggacggcgtacgccattcctgggagagcagatagccgtcgtcggcggtgttctccgccgccaggtagccacgcacgctggtggcaccgccggcggcgaactgttcgttggaaatcagcggcccggaggcgagctggaaggccgccttggtcgccacctgccagtcgccgccgaaggtcagggtgtggttgagatcgcccttgagcacgccgaagccggacttggcgcgataacgcttgcggtcgaattcctcgtcgtcgtcgccgtagccgaggagactgccggtaccggccaccaggctcaggccaagggccaactgggaacgttcggtgtagcggaaaccgttgtagccgagggtcagcggggcgtacttgatcggcaccctgtcgttgttgccgccgatccggatctgttcctcgaagtccttgaagtcgacgccgaaggagaacgagtgcgaccagaggccggtcaccggcaggctgtagatcgccgccacgccataggaatggccctggccgaccacattcatgctgcccaccgtggccacgtcgctgtcggactggtagccggacagctgcacgctccagcgctggctcagcggcgcggtataggagccggaccagaccttggcgttgtcctggtcctgcggcgcggtgaaataggtcagcgagatggcgtggccgagttgccagaggttgtcgtagcccagcgaaaccaccgagcgcaagtgacgggtgtcggcgctgtagtcgttgttcaggccgatgctggcgtgccagggattcttgtcttccacctgcaggtcgacgtccatggtgccgggccgctggccctcgcgcaccatcggcagcacctggcggccgggggtgcggttgacctgcgccagctcgcgctggacctgggcgaagtcgggcaccttgccctcctccagggccggcacttcctcgcgcaactccaccggcgaatagtgcttggcgccgaccacccggacgcgaccgacagtggtctcggtgacctgcaggtagaccaccccgccgctcacctgctgctccggcagctcgacgtagaccgactggtagcccttctcctggtaggcggcctgcagcgcatcgcgcgccccctcgatgtcgcccaggctgcgctgcggtccgaggaagggatacaccgccgcctcgatggcgcggttgtccagcacggtgttgccgcgtaccacgtactcgttgatgtccaccagacgctgggtctcggctcccgccgcggcgggaggggcctcgtcggccagcgaagcgcacgacaatgcgacagccaggcaaccgatcgaccagcgctggcgaaacgggtgcgcacaattgaacagcgaacgcttcacacggtcccccgaagttccatcgggacttattgttctaatgcaacaagtccgttcatcgaacagttctgtgaaagacaacaaactagcggcgacgcatga

SEQ ID NO: 5695 - DNA, 930 bp, Pseudomonas aeruginosa
cgagaccgcgctatccaggcggatctcgcgggcgctgagggacaactcggcaccaagcccggcggtgccgctgtcgaaggtcaccgcggcagcgcccgccggagccgccaggctgaggctaccgccactgctgatccgactcagcgaaccggcctcgccggtcagcaacggcgtgctcaggcgcaggtcgccgccgctgtagtgcaagccttcgccggcgacgtagccgtccaggcgctggtagacccgcaagctgcccttgtggttggcgctgatccgctcgctggcgttcagttgcacctcggcgaagcccagcgccaggcgcgcctcgtcggtctcgccggccggctgggtattcgcgccgtagcccagggtgatgcgctcggcgtccacccgcagggttccgctgccgctaccggcgccgccggtgaccggtgccgcagccggctggctggagccgctccagaccaggctggcggtgcgaatgctggcgacatcctcgccggtgccatggccgtagatggccggggtgcccagcaccaggttggccaggctggatttgccggtggccgggtcgtaggtgtcgaggctgacgctaccgtacatgttgaccgcgtcgcgggcgctgagaatcaggttttccagggccggaatacccgccccgcgctcgccgcgcagcaggcgctggagcaccgtctggtccagcgccaggccgttcggcaacacgccgcgagcggccgcgtcggccagcgactggctggagccgatattgatcgtactcagcgccaggctgagattgcgtgtcccgtaacgaacgttgtcgccaaacgtcaccgtaccattggtggcgatacccagagtgccctccgaatagagttcggtgtcggcgcagcccgccccttccgcacaacctccgagacgaaccggtaa

SEQ ID NO: 5696 - DNA, 858 bp, Pseudomonas aeruginosa
tctgtccgggaccgcgcaggacgatggcgcgccccggatcgacctcgaccagcgaaccgcgccccagctccagcgtctggctggcgggatcgagctgcccgaggatattgccgtcgccgcctgcctgcaggtacaggtccgccccttcgcgttggatcaagcgtccggccaaggcatcctccaggtacagcggcggtgtccaggcctccagcgcctctcgcggcgcctcgccagccgcgacctcgccggccccgctggcgaaacggtagaccggccgcgcgacccgcacctgggcatcctcggctaccgtcaatccggagcgaccgaccacccggtagctggcgaagccctgctggaagaaatcttcggccagttgcaggctgccatccccgaggtcgtcgccgccgatccgcaccttgccgctctgcagcgacagcgtgccggcgccgctcgtgccgagaccattcaatgtgccgcccaactgcaattggccatcgctggcctgcgccagcccggcactggcgtgcaaggcgatgtcgccgccgcgaccgcccagtcgcttgccgtcggccagcagcgccgccccggacgacacgtcgagcagactgccctgtcccaggctcaggtcgccgccgctgcgcagggaaatccgtccgccgtcgcggtaggccaacgtatcgttgtcctccggcgccagcagcaggttgctccacaagccgctggcatccagccgtacgccgtcgcccacgcgcaagatgccgtcttcgcggccggcatcgacgaaaccatcgatcgtcccgttcggagaaatctgcgccaacacgttgccggcctgcaggctgccgccatgggcggtga

SEQ ID NO: 5697 - DNA, 468 bp, Pseudomonas aeruginosa
ggctgccggcatcggcgccgagagcgtactccagcaggccgctgctcttcacgtagtagggggtgtagcgcccgacgaccaactgtgcgccgcgcgccacggcattctgcgactggttgtagccgtccaggccggcctgtggcgcttcggtctgccgctcgccgcggtaggtgtcgccgaccacctggccgtcgagccgcgcattggcgctgccgatcaccagactgccggcgtcgcggccgacgatgtagccgttctcgtagcgctgggtcggcgcgatcagcggattgtagaaataacgggtctggtcccagcgctcgctgtgtgcctcgtagccgcggtagatgccgtcgtagagcaggtcgcccggcgccgacccgagttcgtagaggcgtccgtccgagcccttcagccaggtctggcggatgtagccgccctgcacatcgagggttccgccggacaggttga

SEQ ID NO: 5698 - DNA, 414 bp, Pseudomonas aeruginosa
ggatcggcgggaacacctgccgcgtgcgcagcgccgaggccagcgagacaccttcgcgaacctgcgcggtggcctcctccaccgcctgcgcgaggcagtcgttggccagcgtctggcgcgccgcatcgagcgcgcgcagcagcggtacgccagcgctgccgaggatcgccagggtggaggcgaagcgcgcggtattcaccccgagcacgaagcgtccgagcagaggcaggcgcagcactcgccggtgccagccgagccgcgcctgcgggtcgcgcaggtacaagcgccagccccagtaagcgctaccgatggcgccggcgcagagccagccccaggcgcgcacgaagtcgctggcctggagcatcgcccgggtcagcgccggcaggtcctggcgcgcctgggagaaggcgctga

SEQ ID NO: 5699 - DNA, 1971 bp, Pseudomonas aeruginosa
ggatcttgccgcgcagggcgttgcgttcctcgatgtagtcggccaggcgctccatcacctgggccaggtcgccggactcctcgcccgcagccaccagcgcccggtagatttccgggaagtcccgcggccgtgcggcaagggcgtcggccaggcgcatgccgccgcgcacgtcgctgcgcacggcgctcagggtctgggcgatgtgcttgcgctcggcctggtcgagggtggcgctcagcgccgcctccagcggcaggctggcggccagcaggctggccagctggcgggtggcccaggccaggtcgccgtcggacaggcgcggggcgaacagcgcgcccgccccttgcccggtcccgccgccagcctgctcgcggacctccagcggggtcaggccgcgggcgcgcagttggccgagggcgccacgctggctgtccgcctccagggtgccggtctcgatccggccctgggcgtcggcggcttcgtaacggaaggtctgcatcaggcgtcccgggtcacgcggaggatttcctccagggtggtggagccgctggcgatccagcgctcgccgtcctcgcgcatgctgcgcatgccggccgcgcgggcggcttcgcggagatcctgctcggcgcggccctggtggaccaggcggcggatctcgtcgtcgatcacgaacagttcgtggatgccggtgcgcccgctgtagccggtctggttgcaagccgggcagccgaccgcgcgccagccgccgtcctcttcgacccggcaatgcgtgcacaggcgccgcaccaggcgctgggcgagtacgccaagcatcgacgaggcgagcaggaacggctcgacccccatgtccaccagccgcgtcactgccgaaaccgcgtcgttggtgtgcagcgtggccagcaccaggtgcccggtgagcgaagcctgcacggcgatctgcgcggtctccaggtcgcggatctcgccgatcatgatgatgtccgggtcctgccggaggatcgcccgcagggctacggcgaaggtcatgtcgatgcgcgcgttgacctggatctggctgatccccggcaggtcgtactccaccgggtcctcgacggtgaggatgttgctggtgctggcgtcgagccgcgccagggcggcgtagagggtggtggtcttgccgctgccggtgggcccggtgaccagcacgatgccgtgcggctggcggatcaggttgtccagcggcgccagcacgccgggagccatgcccagggtctccagcctcaggcgtccggcctgcttgtcgagcaggcgcatcaccacccgttcgccgtggccggtgggcacggtggagacgcgaatgtcgatcggccgcccggctacccgcaaggcgatgcggccgtcctggggcaggcgtttctcggcgatatccagctgcgccatgatcttgatccgcgacaccagcgccgcgtgcagcgccttgcgcggcgcgaccacgtcgcgcagggcgccgtcgacgcgatagcgcaccaccgaatgggtctcgaagggctcgatgtggatgtcgctggcctcatcgcgcgcggcctgggtcagcagcgcgttgatcatgcggatcaccggcgcgccatcctgggtgtcgagcaggtcggtaacctcggggatatcgtccatcaggcggtcgaggtcgacctcgctctccgccgcgccgaccaccgccgcggcgctgccggtatcggagtaggcgctggccagcagggtgtcgagctcgtcgtcgcggacgctctccaggctggccggcgcatgccgctggcgcacctcgctgatcgcccagccgggcgtgcgcgggctgaccagcagggtcgcgccatgctcgcccggccgcagcaaggcgcgctgcgccttggcccaggcgtagggcagcaggctcatagcggcgccgcctcgcccagcggtaccgcgcgcagcggccgcgggctcgggcgcaagtcgtag

SEQ ID NO: 5700 - DNA, 576 bp, Pseudomonas aeruginosa
gcggtgcgcgccggcacctggccttcggaaaccagggtcagcttgcccttcacccgcgggtcgaccaggaactgccggccggtggcgcgcgacagcgcgcgcaccaccgcttccacctcggtatcgacgaaattcaggctgaccggctgctcgccgagttcggccgctgccgctgagaccggagccacggcaccggagcgcgctacgccgcgcccggcactcagcgcgcggcgggcttgctcggcctggggccgctcgcggacgtcggcgctgcgcaacggcgcaccggagcggacactgctcagcggccggccgacttcctcgtcggccgggggcacgccggggaccttcggcgtctcgctacacgccgcgaccagcagcgcgcccagcgccacgcccagtacaggccaacgacgccgggcatggtggaaagctgattgcctcatggggaatccttgggagcggaagacgactgcaaatggatcgaggcggacaccagcccgccggacggctcgctcgaagagccagagcgctcctcggaaggagcgtcgagacgcgtcacctgcgcctcgctga

SEQ ID NO: 5701 - DNA, 363 bp, Pseudomonas aeruginosa
acacttgccaggtcagcgccaggcatagcgccaggccaccgccggcgagaatcttgcgctcgcgcggcgccagttgccgccagtaggcctgcagccgcagcagcaggggactccagcgctgcgccggggtattcagtaggcccgccaggcgcttattcatcttcatcggcagccgcctcggcagtgccactgtctgccgcgccagcggccggcgctggcggcgcttccatggcgcgcacctgccagcccttgtcggaggcatcggcctgcaacccgtgcttgcccaactcgccctgccaggcagcggcatcgccgcctggcggtcccggcagcagctccaggtccagttcgccggcgtggtag

SEQ ID NO: 5702 - DNA, 837 bp, Pseudomonas aeruginosa
ctgctctgccgttgcaaggactggccctgcccggccagttgcccggcgtacaggttcagaccggcgacccacaccagcaaggccagggcagcgcagaacaggggcatcttccaggtgccgttgccggcgctcgtcgccggcgctttcagcgccaatccccacggactggcgggcccgctccagcgcagcgcttcgtccagcatctcggcccgctccagggctgcggagcgccacgccggacgctcgcccagccagaacagccgcaactcctgcgggacctcagcgaggccctgctccggcaagggatggaccacagcgtcgctcagcgagcggcgcaacagcagatggccgtcccactcgccggccacccaagcgtcatcgcgcaacggcaggaggaacggcgcggcctgcacctcccgcacgtcgagccgcagccgctgcacggcctgctccagcgaggccagcgccgacgcctccagccaccccaaggtcaggcgcccgtcggcaccgcgcgggccgtgggccaggcgtagctgcgccggatcgccgaggaccagcgcctcggccgcgcagttcaccgcggcggcgagcttcgccgcaggcagcgccggcagttcgagactgaccaggcggcaatcgcgcggatgcaggaacagcgccaccggcaatccctggcgccgccgcgccagttccgcgagcgagacctcgattcgttcctgcaccgcgccgcgcgcatccaggcgcaaacaatgcagcggcgccgcctcggcgaactcgttcagcggcggcagcaggcaacgccaggcggccttcatgagcccaccctcatccagttga

SEQ ID NO: 5703 - DNA, 693 bp, Pseudomonas aeruginosa
cgctctccgacggccaacacagcgtcaccgtgctgcgcgaggcgaacggccatgtccgggtacgctgaacgcgcgacgacgcggcgccggcaaaccggcttcaccctgatcgaggtgatggtcgcgatcatgctcatggccatcgtcagcctgatggcctggcgcggcctggacagcatcgcccgggccagcgcgcacctggaggacagcaccgagcagggcgccgcgctactgcgcgcgctgaaccaactggagcgcgacatcgccctgcacagcgccatccgggaggagaccggcctgcccagcggcgacgagccgatccgggccggcgacagcctgccgcccggactcgcactgaagcgcctgagcgagatcccattgcgcctggacatcgtccgcgccagtaccgagccaggcgcgccgctgcagcgcgtgcgctggtggcgacagggcaaggtcctctaccgcgccgcctcgcccagcggcgaccgcctgccgttgccgccgctggcggagcgggtggctgtgctggacgacgtgagtcggttcgagatccgtgcctgggtgccgggaaaaggctgggcgcgcctgccggcacgcagcaaagtccgcgccagcggactggagatcagcctggcgcgggtcacccgcaacggcgtggagcgctatcgacgggtggtggccctgcaatga

SEQ ID NO: 5704 - DNA, 708 bp, Pseudomonas aeruginosa
gccagcagatggccgatcctgacagcgcggccagggcccgccgcgaacaggagctggattccgccgccatcgtccggcgtccgccaaaccagctcggcctgtacaaccaatcggcgacgcgcattcgcctgggcacctcgttcggcaactcagtggaagcgcagcggccgcctcgctaagggcctccgcaggtccgcgttcctggccggcggcgcaagacaaaaaaccccggcaaccaggccggggcaatcgtcgtcggcgaggttggccgccgatcaaaggacaaggaacgcccctcaggcgaaggtacgctccagcaggtcgccgaaacgattgaaggcatcgctggcgcccttggcggccaggcgctcttcctcctcgttcagctcgatgccgtcgaggatcgccacgaagctcttccagccttgcgcgcggccgccttccggctcggccagatggcgggcgccgaagttctcgtcgagttcgagcgcggcggcttttttgaacaggaacgcagcgcccagcttcgaaccttcggaaacgaacagccagcccagtgcctcggccaggctcaggtcggcctcgcgcacgctctggtcgccctccggcaccggatggccgaggtccgccaggtctgcacgagcggcgtcgtcgcgggcgcgggaagccaggccggggaacaggcgggccagcgcttcgttgcgataa

SEQ ID NO: 5705 - DNA, 735 bp, Pseudomonas aeruginosa
gatctggaaaggccagtccgccgtaccggccggcgcttccctgcccaccgggcatgcgcgcctggacgcactgctgcccggcggcggttggccggagcatgccctgagcgaaatcctccatgcccgcgacggtgtcggcgaactgcaactactgatgccgaccctcgctcgcctgacccaggcgcaacgtcgtgtcgtcctggtcggcgccccctacgtaccttatccgcaggcctggctggccgccgcggtcgacctgcgccacctggtcctgctgcaggccagcggacgcgacgccttgtgggctgccgaacagtgcctgcgctcgggcagttgcgccgcagtgctgtgctggccgcagcaggccgacgaccgcgccctgcgccgcctccaggtcgccgccgaaagcggtcaggccctgggtttcgcctatcgccccctgcgcgaagcggtcaatccttcgccggcagcgctacgcctgtgcatcgaaacccgccccccacgcctgcgcatcctcaagtgccggggcggcctcgcgccggcgaccgccctgccggccagcgcctggcaatgaggcggccatgctctgggcttgcattctcctgccgcaactggccatggacagcgcgctgcgtcaacggagcaatcccgacgcaccgctggcgctgctcggcggcccagcgcagcgccggcagttgcaggcggtcaaccctgcggcacgcgcgctcggcctga

SEQ ID NO: 5706 - DNA, 759 bp, Pseudomonas aeruginosa
gcgccgtcgccgaacaccgtccggagcgaagctggcggccgcacagctgcgacagggcgcaatcgccggcagcctgcggcctccgccccggctggctgctggcggagccacgccccctcggcgaggccttgcccaccgtgctggccggcccggagcggatcgagtcgggctggtgggatggcgaagacatccgccgcgactattacctggtggaaacccgcagcggacaacgtgcctgggtctatcgcgaggtcggcagcgaagggccgctgtggctgcatggctggttcgcatgagcgcctacgccgaactgcattgcctgtccaacttcagtttccagcgcggcgcctccagcgccgcggaactcttcgcccgtgcagcacgcctgggctatcgggccctggcgatcaccgacgaatgcagcctggccggtatcgtgcgggcctggcaggcggcgcgggagcatcaggtacaactgatcgtcggcagcgaaatccgcctcgaacaggggcccaagctggtcctcctggcggaggacctggagggctaccagaacctctgtcgcctcatcacccgcggccggcgacaagccgacaagggccactaccggctgctgcgcgaagatctgcaacagccgctcgccggcctgttggcgatctggttgccgaacgaccatggggacgagcaggctgcctggctccgcgaacgcttcccccagcgcctttggctgggcgtcgagttgcatcgcggcgccgatga

SEQ ID NO: 5707 - DNA, 2160 bp, Pseudomonas aeruginosa
  unsure (193),(206): Identity of nucleotide at the above locations are unknown.
aagctatttcctcaccgtgcaggacatcgtcgccttcgcccggggccggaaaatcctttgccagggccgcggctcggcggccaactcggcagtgtgcttcgccctcggcatcaccgagttggacccggaccggaccaacctgctgttcgagcgcttcctttcccgcgagcgcaacgaaccaccggaaatagangtggattttttancacgagggggcccgaggaggtcatcccgtacgttttcacacgctacggacgccagcgcgcggcgctgaccgcggtggtcagcacctaccacggcgccggcgcggtgcgcgacgtagccaaggccctgggtctgccgcccgagcaggtcgacgtcctggccaactgctgcggccgctggagcgaccaggcccccagcgccgaacgcctggaagaggccggcttcgatccgcagagtccgatcctgcgccgggtgctggccctgaccgacgagttgatcggttttccgcgccacctctcgcagcaccccggcggcttcgtcatctccgaacagccattggacaccctggtcccggtggagaatgccagcatggccgagcgcacggtgatccagtgggacaaggacgatctcgacgcggtcggcctgctcaaggtcgacgtcctcgccctgggcatgctcagcgccctgcgccgcagcttcgacctgatccacgcgctgcgcggcggcaagcggttgagcatcgccagtatcccgagcgaagacccggccacctacgaaatgatcagccgcgccgataccatcggtgtgttccagatcgaatcgcgcgcacagatggccatgctgccacgcctgcgcccgcagaagttctacgacctggtgatccaggtcgccatcgtccggccggggccgatccagggcgacatggtgcatccttacctgcgccggcgaaacggtgaagagccggtggcctatccatcggccgaactggagaaggtcttcgaacgtaccctgggcgtcccgttgttccaggaacaggtcatggaactggcgatcgtcgccgccgactacacgccgggcgaggcggacgaactgcgtcgttcgatggccgcctggaagcgtcatggcggcctggaacaccaccgcgagcggctgacccggggcatgctcgccaagggctacgaggccgacttcgcagcgcgcatcttcgagcagatcaaaggcttcggcagctacggtttccctgaatcccacgccgccagcttcgccctgctcacctacgccagcagttggctgaaacgtcacgagccggcggccttcgcctgcgccttgatcaacagttggccgatgggcttctacagccccgaccagttgctccaggacgcccgccgccacaccctgcagacacgcccggtggatgtccgccacagcggttgggattgcagcctggagccgttcggccaggcgcaaccggccatacgcctcggcctgcggatgatccgaggctttcgcgaggaggatgccaggcgtatcgagcaggtccgggaggcccagccgttcctcgacgtgcacgatctcggccgacgcgccaggctcgacgcccgggccctggagttgctggccgatgccggcgccctgcgcggtctcgccggacaccggcacaaggcgcgctgggccgtcgccagcgtcgagccgcaattgccactgttcgccgaagggaccgtcatcgaagaaaccacggtcagcctgccgctgccttcgcgcggcgaggaactgctgagcgattacgctctcctcggcaccaccctcggcccgcatccgctgaaactcttgcgtggacagctcaaggcctgccgctgccgcgactcccgcgaactggcgaaactgggacatggacgaccgatacgggtcgccggcctggtggtcggccggcagcgcccacagaccgccagcggcattaccttcatcaccctggaggacgagttcggcatgctcaacgtggtggtccggcacgacctcgccgaacggcagaggcggccattcctcgagtcccggctgctgcaggtggagggcatcctggagtcctccggcgaggtgcgccacgtcatcgcagggcgcctgcatgacctgacccctctactcaccggcctggacgtccgcagccgggatttccattga

SEQ ID NO: 5708 - DNA, 2085 bp, Pseudomonas aeruginosa
gcgtcgaggaacacctggccggcgtcgttcaccgagatcgccttggtcttgggctgcgacagcgccacggtggcactggccttcggcaggttgatctggatcccggcgacctgggcggtggcggtgaggatgaacatcaccagcaccaccatcagcacgtccaccagcggggtgatgttgatgctgtcgacggcgccgtcgtcgtcatcgtcgtggctgctgttcacggaagccatggcgttctcctcaggccggcaacggctggccgttgcgaccatgggccacttcgctgagctggctttcgccatgcacctcggcgaggcgggtgacgaactcgtcgacgaacacccgcatgtccgcgctgacttccttgttccgcgtgaccaggcggttgtagccgaacaacgcggggatcgcgacgaacaggcccatggccgtggccagcagggcggcgcccatgcccggggcgatggcattgatgttgacgtcgccggccatggcggtgccgaggaacaccaccatgatccccagcacggtgccgagcaggccgatgtaggggccgccggcgatggcgttggacaggctcgacaggcgcgagccgagctgctggttctccttggtgcgcacgccgtccatggaggcgcggatcgcctcgatggtggccgcggagacggaagaggtgtcggcgccctgctcgcggcgggtgcggatctccttcaccgccacctggtacaggcgccacagcgaggagtgttgcaggcgggcggccagctcgcggtcgtcggcgagcagttccaggcgcgtgccgacctcggcgaagcgctcgcggaacagcccgttggcgcgactgacacggccgacgttctggttcttgcggtacatgatgacccacgactggaccatcatcagcgccaggatcgcgatgatcacccaggcatccagcggcactgcgttgagcaggaagccgagcttgccgaagccgaagccggactgcttctcgtcgaccccgtaggccaccaggcgcgactcggcgccctgggcggtggcgtcggcgaggagcagcgccgccgggcgggcgatcttcgacaggcgcaactcgtcgatggcgccctggaagggttgcagggtcggcgccgcggcgctcgcctcaccttccccgcttgccgcttcggtggcgaccgcaggcgcggcctggccttccgcgccgatggcgatcgcaccgctgaacgccggcagcgccgccgccaggctggcgacttcgcgccccccgagatacagcgccagccgggtaccgtcggcgaccagcgccagatgctgccattgcccctgcgccagggcctggctggcggcagcgcgctgaccgttcagctcgacgaagggcgcgccctgggccaggccgaccaacagggcgttgccgccttcgcggcgcgacagcaggacctgttcaccggccagttggtcgggacgcacccagccgctgaagctgaaggtgccaccggcgctcaccgccagcgatgggctggccggcagcagcagcggctggcccagcagttgcgcggagcgaccgatgacgccctccaccggactgccggcggcggtctgcgcattgttggcgtaggcggtggagtcccgcggcggagtgcccggcgcaccgtcgaagtgatagaccagggtgtagtccgggtcgaacaccgactggccgttgccgctctccggcgccttggcgttgccgtagtacatccagatgtcctggcgctggccaccctccacccgcggcacgtcgacccagatcagggccatgcccatcagcgggtcgaagctctcgacctggtggcgcaacacggtcttgtcgtcggcggcgacgaagcggatgtccgagccgttctcgttgaccccgtcgaaggtgaagttgccggtatgcaggcgcaccagcaacggcaggcgaccgagactctcgttgatcgccgcgccttgcggggtggtatcgaccgagacctgcttgcggtactgccagtcgtcctgccaccaggcactggcgctggccggggccagcaggcccaggcagatcagcgatgtcagcaataa

SEQ ID NO: 5709 - DNA, 360 bp, Pseudomonas aeruginosa
ctgtcgcgccgcagcaggctcccatgcgcatccagcagcgcgttgccgcccaggctcaggccgcggccaccggccaggcggatctcgccgacctgcgcgccgctggcgtccaccgttccgctcacgccgagctggccattgtcgagggacacctcgatgcgatgcgccttcaggccgtcgccgatctgcaggtcgccttgcttgagctggaagcgccgcgcgccgaagacctcgccctggttcaggcgctggttcaaggcggtgaactgctcgctcaggctgccgccatcgcccaggcgctgggcgcggatctccagctcgccaccgaggaacggcacgcgggtgccgccggcatcgtag

SEQ ID NO: 5710 - DNA, 492 bp, Pseudomonas aeruginosa
tcgccgctggcgccacccagtatgcggccctgcaggtccaccatcccggcgtcctcggccaacgccacggcgctcagggtaccgccgcggttgttgcgcgccgacaggtcgatcagcgaaccggcggcctggcggatgtcgccggcgcgactgctcagcagcaggtcgccaccccagctgtatttatccacatcgttgaagctggccttgcgtccggccaggtcgatgcgcgcgccatcgcccagctccaggtcgtcttcggcgctcaggctcagcttgccgctgggtagcgagaccgcgctatccaggcggatctcgcgggcgctgagggacaactcggcaccaagcccggcggtgccgctgtcgaaggtcaccgcggcagcgcccgccggagccgccaggctgaggctaccgccactgctgatccgactcagcgaaccggcctcgccggtcagcaacggcgtgctcaggcgcaggtcgccgccgctgtag

SEQ ID NO: 5711 - DNA, 4230 bp, Pseudomonas aeruginosa
aagttggtcgaatccgccgctcgtcagcgactgcgtcccaactcggctctggccatagcgcagagccgaatcgtccattcccggttgcagcaaggtcggcaatcccgaatcggcatgccctgccgtcaggatcagctcgcgcatggccaatacccggtcatccacgacagtaaaaccctggtacaggggagcgtccgcaatgatctccaggctgccgcccgccgctcccgagccgccggctgcggcgcgcaacgagccgtcaagatacagcccattgtaggaactgagagcgatgcgcccgccgtcgccggccagcaaaacccttcccagtcccggtacatccagctgtgcctggctgccggaggcctccagtcgtgcaccggggcgtacgatgacgaacgcatccgccgaggtcgcgatcgccttgcccggatcgatctcgccgccgatgacgatgctgccgccggactgcacttctccatagcggcgaccgcgcccatccacggcagtgacagcgcggccggcaacatccagcaatgcctgctctccaatccagatggagcgtgcatggggctggccttgcgccttgggctgattgtcctgagtaacgtcgagcgcgccgaactgctgctggcgcacgtcgatgcgtccgccccaagcgttcagagtgccatccaaggtgatctgtccgggaccgcgcaggacgatggcgcgccccggatcgacctcgaccagcgaaccgcgccccagctccagcgtctggctggcgggatcgagctgcccgaggatattgccgtcgccgcctgcctgcaggtacaggtccgccccttcgcgttggatcaagcgtccggccaaggcatcctccaggtacagcggcggtgtccaggcctccagcgcctctcgcggcgcctcgccagccgcgacctcgccggccccgctggcgaaacggtagaccggccgcgcgacccgcacctgggcatcctcggctaccgtcaatccggagcgaccgaccacccggtagctggcgaagccctgctggaagaaatcttcggccagttgcaggctgccatccccgaggtcgtcgccgccgatccgcaccttgccgctctgcagcgacagcgtgccggcgccgctcgtgccgagaccattcaatgtgccgcccaactgcaattggccatcgctggcctgcgccagcccggcactggcgtgcaaggcgatgtcgccgccgcgaccgcccagtcgcttgccgtcggccagcagcgccgccccggacgacacgtcgagcagactgccctgtcccaggctcaggtcgccgccgctgcgcagggaaatccgtccgccgtcgcggtaggccaacgtatcgttgtcctccggcgccagcagcaggttgctccacaagccgctggcatccagccgtacgccgtcgcccacgcgcaagatgccgtcttcgcggccggcatcgacgaaaccatcgatcgtcccgttcggagaaatctgcgccaacacgttgccggcctgcaggctgccgccatgggcggtgatgtcggcgtcgatcgccacgtcgttggcgaacaggattgcctcgccgccattggccagggtcagcgcgccgtcgacgcggatgctctcgccggccgccaccttcaggccgcccagctggaagccgttgagcagttcgctgtccaggctcaggcggccctggcgctcggcggccaccggagcgtccagggtcggctcctcggccgccgcctcgccggcaccgatgaccacctgcttgaggctgccggcatcggcgccgagagcgtactccagcaggccgctgctcttcacgtagtagggggtgtagcgcccgacgaccaactgtgcgccgcgcgccacggcattctgcgactggttgtagccgtccaggccggcctgtggcgcttcggtctgccgctcgccgcggtaggtgtcgccgaccacctggccgtcgagccgcgcattggcgctgccgatcaccagactgccggcgtcgcggccgacgatgtagccgttctcgtagcgctgggtcggcgcgatcagcggattgtagaaataacgggtctggtcccagcgctcgctgtgtgcctcgtagccgcggtagatgccgtcgtagagcaggtcgcccggcgccgacccgagttcgtagaggcgtccgtccgagcccttcagccaggtctggcggatgtagccgccctgcacatcgagggttccgccggacaggttgatctgcgaaccggcctgggtcaccacgtcgttgccggtgaaactgacgatgccgccctgggccatccactcgcccgccgagtggccctgggtgcccaggtagccaccgacctccagcaggccgccggcggtgtaccagcggtcgctggcatagccgttggtgccggcaggcacccgtaccaggtcgcgcacgtcgacccacacatcctggctgttcagaccgccgccctcgcggttgaccgaggcgtcgcgctgctcgttgccgcgcacgttgaccttgatgctgttggtctccatcgccacctgcacgccttgcgcgccggagacatcgatcaccgcgccgtcacgcaacagcgcgcgctggccagcgttgaccgccacctggccgccgctggcgagggtgatggagccgtcgcggaaatcgacgctgccggcggagtcgatctccacccgcgacaggtcgcggcggtcgtcgtcgccccggctgacggcggcactggagccgttcaacggcttgagcaaggcctcgcgctggctgtcgagggcggcgctgccgctgctgtccaccaagatcgcgctggtggcaccttcggccagggtgatccgctcgctggccttcaggtgcagggtgccgcggctgtccaccgaactgctggaaagcaatacgccggcctgctccacctcgcggccgctgaggctgatatcgccggtggcggcctgcaccaggccgctgttgcgcacccggccggcactgctgtcggcggcgaagcccggcagcacctcgttgccgcgggtggtggaggtcaggttgccgtcggtgccctggccacggcggatgacgaagttgtcgccggcggacaggaccgtctgccccttcggcgtgacgatgctgccggcgttgtccacctcgctgccgagcagcaggacgtagccgccgcccctggtcgagccggacggcgctgccgtgcgcaactgtgcgccctgctccacgcgcacggcaccagccgcgtcggtgaaggtcggacggctgccggcattgtcgtagtagaggccgcgctgacggaactgttcgtccgagatgttcgccgccgccaccgtcaggttgcgcacgtccacctggctgctgccggaaaacaccacgccgttgcggttgaccagcatcaccgtgccgtcggccttgatctgcccctggatctggctgggccgcgcgctggggtcgttgacccggcgagcagagcccagtcggcgtgctgctggaagtccacggtggtgttgcggccgacgttgaaggtctcccagttgagcaccgccttgtcggcggtctgctcgatgctcaccgtggtcttgccgccggcctgggtctgcaccggtcccttggcgttctgccacgcctgctcgaacggcatcgaggcgtcgaccttgaggccgccctcgccgagtccgtccggaacatcctgcggaaggttcagcgccgcctggcgtccggcggactgggcggcctgctgggcggctatggcggagacggtgttgttcaagttggccatcgaacgctgcaactgctggttgacccgctgctgctgcgccagcggcggcggcgcccccgggctactgcgctcccggtcgcggcgccccggcagcgccgccctgcgccacacccttggcagcgaaccaagcggcgctgaacggctgcccggcggcctgggcgccccctgcgaccagcagcagggcgatggcctgggccagcggcttcaggcgcggcgcgtaaagcgcgcgggaggaacgggcggacgacggcgaacgggacggcatggcgaaggggtccttgagcatgaagtcggtcgggcgcccgcaacgacgcccgttactggtagacggcctggcggagggtgggccgaagacttgtcatggaaagttcatggagcggagcgaggagcctgggcgaacggaaacacgacggcagccggatttcagccaccgtcatgctag

SEQ ID NO: 5712 - DNA, 1152 bp, Pseudomonas aeruginosa
gcgaagcgcttacgggcggcctttggtgttgcagacgttggtgttgccgatggccaggttttcgctggtgccggtgtagaaggcgctcacgatggcgctcttccaggccggagtcagcgggatgaagccatgggcggcaactgcggcgttggtggtagtgccaccgtagtgcttgttgatgaaggcgcggacgtcggtggaaacgctggcgtccttgtagcactggccgaagacgaagttggtgtaaccgacgatggagtagccggcgctcggattggtgaacaccggaacccacttgctggggtccgcacggtcggcggcgttggccggcggagccacgctgcccagggcagtggaaacgttagcctgggtcggcaggttgccgttcacacgggaaacctcggcgttgctgttgatgttcaccgcatccgggctgacatagccgagggaaccgttggttgccttgacggtcgacaccacggtggaagtggcggcgacgccaacccagttgctcggcaacgtaccgccggccggcagacgggcgttggtaaaggtcgagttggtggcgaagcgagtcgggcagatcgagttcaggtggcgggtgaacagttcggtggtgccgctgctaccggtgcggtagacgatgcggatcggcgtgctgtcggtagtgcccagcagttgaccccaggtggtcttggcgccggagaaggcgtcgcagagttgggcgctggtcaggttgagcgtggtgttgccgtccttgcgatagggcacggtgaccgaggtggctaccgacgggatctggatcagcggaccgtaggtgccgttgtagttgctgttgtaggtggtcagttcgctaccgctcaggaccgagtcgctaccagcatagtgaacggtaccggtggtgccgaacagcgaggagttgttggtcaggaaagcgttcttgccggtgccgctgccggtcacggcatagctgaagttggccggcaggatgctgtcggcggagcctttgtacagctcggccggcagggaagcgccaccgccggtgacggccatggcttgggcggatacgagggcggccacgctcagcgaggcagcgatcagagagcgcttgaacatgaagaatctcctttcatcgtggtgttggtacgttga

SEQ ID NO: 5713 - DNA, 1548 bp, Pseudomonas aeruginosa
ggcggattacgccagcggcgttatccgccgatacctctcttcggaagactgctgagacgccccatccccacggcggatagccgcgagcggttaatcgcccagcacgggaagggcttgttcaggcacggactactggaccagttggttcatctcgatgatcggcatcagcaccgccatcacgatggtcagcaccacgccgcccatgaccacgatcatcagcggctcgagcaacgcggtcatgcccatggcgcggcgctcgatgtcgcgcgacagggtctgcgccgcgcggtcgagcatcggcggcagcgcaccggtcttctcgccgctggcgatcaggtgggtgaggatcggcgggaacacctgccgcgtgcgcagcgccgaggccagcgagacaccttcgcgaacctgcgcggtggcctcctccaccgcctgcgcgaggcagtcgttggccagcgtctggcgcgccgcatcgagcgcgcgcagcagcggtacgccagcgctgccgaggatcgccagggtggaggcgaagcgcgcggtattcaccccgagcacgaagcgtccgagcagaggcaggcgcagcactcgccggtgccagccgagccgcgcctgcgggtcgcgcaggtacaagcgccagccccagtaagcgctaccgatggcgccggcgcagagccagccccaggcgcgcacgaagtcgctggcctggagcatcgcccgggtcagcgccggcaggtcctggcgcgcctgggagaaggcgctgaccacctgcggcaccacgtagccgaggaggaaaatgacgatgccgatggagaccacgccgaccaccgccgggtagatgaacgcggtgaggatcttgccgcgcagggcgttgcgttcctcgatgtagtcggccaggcgctccatcacctgggccaggtcgccggactcctcgcccgcagccaccagcgcccggtagatttccgggaagtcccgcggccgtgcggcaagggcgtcggccaggcgcatgccgccgcgcacgtcgctgcgcacggcgctcagggtctgggcgatgtgcttgcgctcggcctggtcgagggtggcgctcagcgccgcctccagcggcaggctggcggccagcaggctggccagctggcgggtggcccaggccaggtcgccgtcggacaggcgcggggcgaacagcgcgcccgccccttgcccggtcccgccgccagcctgctcgcggacctccagcggggtcaggccgcgggcgcgcagttggccgagggcgccacgctggctgtccgcctccagggtgccggtctcgatccggccctgggcgtcggcggcttcgtaacggaaggtctgcatcaggcgtcccgggtcacgcggaggatttcctccagggtggtggagccgctggcgatccagcgctcgccgtcctcgcgcatgctgcgcatgccggccgcgcgggcggcttcgcggagatcctgctcggcgcggccctggtggaccaggcggcggatctcgtcgtcgatcacgaacagttcgtggatgccggtgcgcccgctgtag

SEQ ID NO: 5714 - DNA, 438 bp, Pseudomonas aeruginosa
ccggtctggttgcaagccgggcagccgaccgcgcgccagccgccgtcctcttcgacccggcaatgcgtgcacaggcgccgcaccaggcgctgggcgagtacgccaagcatcgacgaggcgagcaggaacggctcgacccccatgtccaccagccgcgtcactgccgaaaccgcgtcgttggtgtgcagcgtggccagcaccaggtgcccggtgagcgaagcctgcacggcgatctgcgcggtctccaggtcgcggatctcgccgatcatgatgatgtccgggtcctgccggaggatcgcccgcagggctacggcgaaggtcatgtcgatgcgcgcgttgacctggatctggctgatccccggcaggtcgtactccaccgggtcctcgacggtgaggatgttgctggtgctggcgtcgagccgcgccagggcggcgtag

SEQ ID NO: 5715 - DNA, 1035 bp, Pseudomonas aeruginosa
gcccgccaggcgcttattcatcttcatcggcagccgcctcggcagtgccactgtctgccgcgccagcggccggcgctggcggcgcttccatggcgcgcacctgccagcccttgtcggaggcatcggcctgcaacccgtgcttgcccaactcgccctgccaggcagcggcatcgccgcctggcggtcccggcagcagctccaggtccagttcgccggcgtggtagtccagtcgttgcaggcgtccggcgaggaacggcatcgcctcgccggcgccatgcagcagcgcggccagccccggtacggcatcgccatcggccttgccggccagataggcgtcgcgtcgctcgcgagcctggcgcaacggatcgagcaccaccggcagttccgggaaggcctgctgcacgcgttgactgctctgccgttgcaaggactggccctgcccggccagttgcccggcgtacaggttcagaccggcgacccacaccagcaaggccagggcagcgcagaacaggggcatcttccaggtgccgttgccggcgctcgtcgccggcgctttcagcgccaatccccacggactggcgggcccgctccagcgcagcgcttcgtccagcatctcggcccgctccagggctgcggagcgccacgccggacgctcgcccagccagaacagccgcaactcctgcgggacctcagcgaggccctgctccggcaagggatggaccacagcgtcgctcagcgagcggcgcaacagcagatggccgtcccactcgccggccacccaagcgtcatcgcgcaacggcaggaggaacggcgcggcctgcacctcccgcacgtcgagccgcagccgctgcacggcctgctccagcgaggccagcgccgacgcctccagccaccccaaggtcaggcgcccgtcggcaccgcgcgggccgtgggccaggcgtagctgcgccggatcgccgaggaccagcgcctcggccgcgcagttcaccgcggcggcgagcttcgccgcaggcagcgccggcagttcgagactga

SEQ ID NO: 5716 - DNA, 624 bp, Pseudomonas aeruginosa
actgcacgacatccatctcgacactcctcggcatggttcgattcgccgcggattgtttcaggaagatatgtcaacgatattgaaaatcctcgggtgcgccgctcttccggaggcgcccgcaaggccctggagccgggctttccggcaggcgccggggatggctcgcgggggcgccctcccgagcttttgtcagggatcggtcagatttcccggctagcctggaagtcccctttcgccgacctttccgcgatgtccacgcgcctgtcttcccgcggtttcaccctgatcgaagtgctggtcgcgctggccatcgtcgccatcgccctggccgcggcgatccgcgcggtgggcctgatgaccgacggcaatggtctgttgcgcgacaagtcgctggccctgctggcagcggagagccggctcgccgagctacgcctgggcgtcggcgcggctccgggaaacagcgatttcgaatgctcccagggccgcctgcggttgtactgcgaacaacgcgtcgaggccaccgacgaccccgcgctactgtgggtggaaatccgtgtgcgcacgcagcgcgaacaggcggtgccgctggcgcgcctgaacaccctgctgagccgctcccggtga

SEQ ID NO: 5717 - DNA, 549 bp, Pseudomonas aeruginosa
agcgcccctgcaagcgggccgagcgccgtccacgagccagctcgccatccaccagaaccgccattcccgtcaccccgctgtaggtcaccagcgccgatgccaggctctgcggaggaatatcgaacgcgtgcaccgccaggcgcaacggcggcctgccgccatcgcccggcacggcgccggacgccggcagcagcatgccgagaccgagcaacgacactgcgcacgaccttgccaccccgaggatcgacatcaacggattccagtccgaactacccggttcaggccagatggccatcacccaggagggacatcctgatggcactgtgtgactgtggtgtgacggtacctgcggtgacatgttttcaccgattgccgtataagcgggaaaccaccatcccagcgcgggagaatcgccatgcaccgttcatcgcaggttctgccggccctgatcctgggcctggccatgaacgccaccctggccgacgagccgacgccgccggcgaactgcatcaacaccgaggtcaacggctaccaggctttgtcctatga

SEQ ID NO: 5718 - DNA, 795 bp, Pseudomonas aeruginosa
cgattctcaattatattcgttattgaatctcagtgtcacatgaaaggatgccgaccgactgccattgaccagaaaaggactacagcaaatactgtatttacatacagcattcgagttatttccttggcctccctttcatccgtagccgacatcaccccacccgcagccgtcgccggacgaggcaatggcatagcgctgagtgcgctgctcgacgcgcgtaggatctggaaaggccagtccgccgtaccggccggcgcttccctgcccaccgggcatgcgcgcctggacgcactgctgcccggcggcggttggccggagcatgccctgagcgaaatcctccatgcccgcgacggtgtcggcgaactgcaactactgatgccgaccctcgctcgcctgacccaggcgcaacgtcgtgtcgtcctggtcggcgccccctacgtaccttatccgcaggcctggctggccgccgcggtcgacctgcgccacctggtcctgctgcaggccagcggacgcgacgccttgtgggctgccgaacagtgcctgcgctcgggcagttgcgccgcagtgctgtgctggccgcagcaggccgacgaccgcgccctgcgccgcctccaggtcgccgccgaaagcggtcaggccctgggtttcgcctatcgccccctgcgcgaagcggtcaatccttcgccggcagcgctacgcctgtgcatcgaaacccgccccccacgcctgcgcatcctcaagtgccggggcggcctcgcgccggcgaccgccctgccggccagcgcctggcaatga

SEQ ID NO: 5719 - DNA, 2610 bp, Pseudomonas aeruginosa
  unsure (2529),(2542): Identity of nucleotide at the above locations are unknown.
ggcggccatgctctgggcttgcattctcctgccgcaactggccatggacagcgcgctgcgtcaacggagcaatcccgacgcaccgctggcgctgctcggcggcccagcgcagcgccggcagttgcaggcggtcaaccctgcggcacgcgcgctcggcctgaagcccggtcaatcgctgatcgccgcccaggccctgagccgggacttcgccacggcggaatacgacctcgccgccgtggagcgctggcaggccttcctcgccgcctgggcctacggtttcagctcgcaggtcagcctgcactatccgcgtgcgctgctgctggaagtgcagtccagccttgccctgttcggcccctggccacgcttcgaggcccgcttgcgcaaggaactcacggcgctgggcttccgccatcgcctgtgcctggcgccgaacccggtggcggcgagggtcctggcgaacagccacgacggcctggccatcgaggacgagacagcgctgcaacgccagttgtccgcccttccgctggaccgcctgggactctcgcgggagctggccgtcgccctcggacgcatgggactgcgccatctgcgccaggtcctcgagttgccgcgcgccgccctggcccgtcgcttcccagccgaactgctgttgcacatcgaccgcctctgcggccgcagcccactggcgctggagcactaccggccgccggacaccttcgacctgcgcatcgaactcaatttcgacgtggaatcgcaccaggccctgctcttccccctgcgacggctgagcgccgatctcgccgcctttctcgccggacgcgacagcggcgtgcagcgcttcaccctgcacctggaacatcacgggcgcgccgacagccaggtcacggtcggcctgctcagcgccgaacgcgaggcggccatgctcttcgaactgacccgcggccgtctcgaacagctgcaactgcccgcccccgtgcatgccgtgcgcctggaggcccgcgagctgcctcctttcacgccgcagcaccgcgaactgttcgacgagcgcccacagcagtatctcggctgggaacagttgcgggaacgcctgcgcgcgcggctgggcgacgaggcggtacagggcctgagcgccgtcgccgaacaccgtccggagcgaagctggcggccgcacagctgcgacagggcgcaatcgccggcagcctgcggcctccgccccggctggctgctggcggagccacgccccctcggcgaggccttgcccaccgtgctggccggcccggagcggatcgagtcgggctggtgggatggcgaagacatccgccgcgactattacctggtggaaacccgcagcggacaacgtgcctgggtctatcgcgaggtcggcagcgaagggccgctgtggctgcatggctggttcgcatgagcgcctacgccgaactgcattgcctgtccaacttcagtttccagcgcggcgcctccagcgccgcggaactcttcgcccgtgcagcacgcctgggctatcgggccctggcgatcaccgacgaatgcagcctggccggtatcgtgcgggcctggcaggcggcgcgggagcatcaggtacaactgatcgtcggcagcgaaatccgcctcgaacaggggcccaagctggtcctcctggcggaggacctggagggctaccagaacctctgtcgcctcatcacccgcggccggcgacaagccgacaagggccactaccggctgctgcgcgaagatctgcaacagccgctcgccggcctgttggcgatctggttgccgaacgaccatggggacgagcaggctgcctggctccgcgaacgcttcccccagcgcctttggctgggcgtcgagttgcatcgcggcgccgatgacgatgcccgcctggacaaactgctcgcgctcgcctcgcatctccggctaccgcccgtggcctgcggcgacgtccacatgcacgcccgcggcaggcgagccctgcaggactgcatgacagcgatccgcaaccatctgccggtcagcgaggccggcgcctatctcttccccaacggggaacgccacctgcgtaccctggaggccctgcaggggatctacccgcaagccctgctggcggaaaccctgaagatcgccgaacgctgccggttcgatctggaacagctgaaataccagtacccacgcgaattggtaccggccggacacgacccggcgtcatggctccgccatctcaccgaacagggcatcgccaggcgctggccgaacggcgcgagcgccaaggtccgcaagcagatcgagagagaactcgagctgatcgccgaactgggctatgaaagctatttcctcaccgtgcaggacatcgtcgccttcgcccggggccggaaaatcctttgccagggccgcggctcggcggccaactcggcagtgtgcttcgccctcggcatcaccgagttggacccggaccggaccaacctgctgttcgagcgcttcctttcccgcgagcgcaacgaaccaccggaaatagangtggattttttancacgagggggcccgaggaggtcatcccgtacgttttcacacgctacggacgccagcgcgcggcgctga

SEQ ID NO: 5720 - DNA, 1515 bp, Pseudomonas aeruginosa
agttggacaggcaatgcagttcggcgtaggcgctcatgcgaaccagccatgcagccacagcggcccttcgctgccgacctcgcgatagacccaggcacgttgtccgctgcgggtttccaccaggtaatagtcgcggcggatgtcttcgccatcccaccagcccgactcgatccgctccgggccggccagcacggtgggcaaggcctcgccgagggggcgtggctccgccagcagccagccggggcggaggccgcaggctgccggcgattgcgccctgtcgcagctgtgcggccgccagcttcgctccggacggtgttcggcgacggcgctcaggccctgtaccgcctcgtcgcccagccgcgcgcgcaggcgttcccgcaactgttcccagccgagatactgctgtgggcgctcgtcgaacagttcgcggtgctgcggcgtgaaaggaggcagctcgcgggcctccaggcgcacggcatgcacgggggcgggcagttgcagctgttcgagacggccgcgggtcagttcgaagagcatggccgcctcgcgttcggcgctgagcaggccgaccgtgacctggctgtcggcgcgcccgtgatgttccaggtgcagggtgaagcgctgcacgccgctgtcgcgtccggcgagaaaggcggcgagatcggcgctcagccgtcgcagggggaagagcagggcctggtgcgattccacgtcgaaattgagttcgatgcgcaggtcgaaggtgtccggcggccggtagtgctccagcgccagtgggctgcggccgcagaggcggtcgatgtgcaacagcagttcggctgggaagcgacgggccagggcggcgcgcggcaactcgaggacctggcgcagatggcgcagtcccatgcgtccgagggcgacggccagctcccgcgagagtcccaggcggtccagcggaagggcggacaactggcgttgcagcgctgtctcgtcctcgatggccaggccgtcgtggctgttcgccaggaccctcgccgccaccgggttcggcgccaggcacaggcgatggcggaagcccagcgccgtgagttccttgcgcaagcgggcctcgaagcgtggccaggggccgaacagggcaaggctggactgcacttccagcagcagcgcacgcggatagtgcaggctgacctgcgagctgaaaccgtaggcccaggcggcgaggaaggcctgccagcgctccacggcggcgaggtcgtattccgccgtggcgaagtcccggctcagggcctgggcggcgatcagcgattgaccgggcttcaggccgagcgcgcgtgccgcagggttgaccgcctgcaactgccggcgctgcgctgggccgccgagcagcgccagcggtgcgtcgggattgctccgttgacgcagcgcgctgtccatggccagttgcggcaggagaatgcaagcccagagcatggccgcctcattgccaggcgctggccggcagggcggtcgccggcgcgaggccgccccggcacttga

SEQ ID NO: 5721 - DNA, 669 bp, Pseudomonas aeruginosa
ttgagaatcgttattgatcctgggcgcgctatgtcggcccagtgcgttccgtccctcgaaaggaattcccctatggataccctggcccctgaatccactcggcaaaacctgcgttcgcaacgcctcaacctgctgaccaacgagccgcaccagcgcctggagagcctggtgaaaagcaaggaacccttcgccagccgggacaatttcgcccgcttcgtcgccgcccagtacctcttccagcatgacctggagccgctttatcgcaacgaagcgctggcccgcctgttccccggcctggcttcccgcgcccgcgacgacgccgctcgtgcagacctggcggacctcggccatccggtgccggagggcgaccagagcgtgcgcgaggccgacctgagcctggccgaggcactgggctggctgttcgtttccgaaggttcgaagctgggcgctgcgttcctgttcaaaaaagccgccgcgctcgaactcgacgagaacttcggcgcccgccatctggccgagccggaaggcggccgcgcgcaaggctggaagagcttcgtggcgatcctcgacggcatcgagctgaacgaggaggaagagcgcctggccgccaagggcgccagcgatgccttcaatcgtttcggcgacctgctggagcgtaccttcgcctga

SEQ ID NO: 5722 - DNA, 891 bp, Pseudomonas aeruginosa
acggtgcatggcgattctcccgcgctgggatggtggtttcccgcttatacggcaatcggtgaaaacatgtcaccgcaggtaccgtcacaccacagtcacacagtgccatcaggatgtccctcctgggtgatggccatctggcctgaaccgggtagttcggactggaatccgttgatgtcgatcctcggggtggcaaggtcgtgcgcagtgtcgttgctcggtctcggcatgctgctgccggcgtccggcgccgtgccgggcgatggcggcaggccgccgttgcgcctggcggtgcacgcgttcgatattcctccgcagagcctggcatcggcgctggtgacctacagcggggtgacgggaatggcggttctggtggatggcgagctggctcgtggacggcgctcggcccgcttgcaggggcgcttcaccgccagcgacgccctgacccgactgctcggcggaaccggcctgatggcgcgctacaccagccaggaagcgttcaccctgctgccggcgcaggccgtcaggaacgctgcgccgctgccggcagagatgccgaaggtcgagcagccgctggatcggcgctacgcgggagcggtccaggcggcgctggaagaacagttgtgtcgctcgccgcgcactcgtccgggtacctatcgcgcggtgctgcaactctggatcggtcgcttcggcgaggttcgccacagtcgcctgctcggttcgaccggcgacccgcagcgggacagcgccctggtggaaagcctgcgcggcgtgcgggtgatgcaggcgacgcccgctacgctggcccagccgctgaccatcctgttgctgccgaagacgacgggcaaggccatggaatgcaagctgacggagggagtgggagggtcatga

SEQ ID NO: 5723 - DNA, 504 bp, Pseudomonas aeruginosa
catatcttcctgaaacaatccgcggcgaatcgaaccatgccgaggagtgtcgagatggatgtcgtgcagttcagctccagcccgaaaggacatcggggacagcggggcttcaccctgatcgagatcatggtggtggtggtgatcctcggcatcctcgccgcgatggtggtgcccaaggtgctcgaccgtcccgaccaggcccgcgccaccgcagcgcgccaggacatctccgggctgatgcaggcgctcaagctctaccgcctcgaccagggccgctatccgagccaggcgcagggcttgaaggtgctcgcggagcgccctgccgatgcctcggcgagcaactggcgctcgtacctggagcgcctgcccaacgacccctggggcaagccctaccagtacctgaatcccggcgtgaacggtgagatcgacgtgttctccctcggcgccgacgggcagccgggcggcgagggcatcaacgccgacatcggctcctggcagctctga

SEQ ID NO: 5724 - DNA, 936 bp, Pseudomonas aeruginosa
gcgcgccatgaacggtcatcgccagcgcggcatggcgatcatcagcgcgctgctgatcgtcaccgtggtcgcggtcatagccgccggcctgatcgcccgccagagcgcattcatccgcgccctggaaagcgagcagctacgcatccaggccggctggatgctgcgcggcggcctggaatggagccgccagttgctgctcgaggacagccgccgcgacccgctgacccgcctcgaccagcgctgggcgcaaccgatgcgtggcttgcgtctgagcagcgccgaattgccgttcaacggccaactggaagacgagcagggcaagttcaacctgcgcaacctgttggtcgaccagcgccccgatctccaggaacgagcgaacttcgaacgcctcgccggtctgctcggcgtgcgcccgaaggaggcgcggctgatcgtcgagcgggtcctcgcctcctatgcacggctgcccgccgaagcgccgccggccgagacgcaacccgcaggcttcgacagcggccgcgagacttcgccgggcgccgtgttgcgtgcgcttccggcgcgcatgccggcgctcaggcgtctcgacgacctggcgcggctgggcattccgccggcgaccctggagcgcctgcggccctacgtcaccatcctgcccgaaaccacctggatcaacggcaacaccgcgcgcgccgaagtgctcgccgcctgtgtccccggcctcgggctggaccaggcgcggcgggtgctcggcgagcgcgaccggggccgctggttcctcaatcgcggcgacttcgtcaaccgcctgaacatgccgcaattgcaggcgcagtcggtgaaggtcgggatcaccagcgactggttcctgctcaccgcctatgctcggcgcgaccggcaagaggtgcgcctgcaagccctggtgcagcgcaaggccggtga

SEQ ID NO: 5725 - DNA, 1245 bp, Pseudomonas aeruginosa
aagcacggcggtcaactggatgagggtgggctcatgaaggccgcctggcgttgcctgctgccgccgctgaacgagttcgccgaggcggcgccgctgcattgtttgcgcctggatgcgcgcggcgcggtgcaggaacgaatcgaggtctcgctcgcggaactggcgcggcggcgccagggattgccggtggcgctgttcctgcatccgcgcgattgccgcctggtcagtctcgaactgccggcgctgcctgcggcgaagctcgccgccgcggtgaactgcgcggccgaggcgctggtcctcggcgatccggcgcagctacgcctggcccacggcccgcgcggtgccgacgggcgcctgaccttggggtggctggaggcgtcggcgctggcctcgctggagcaggccgtgcagcggctgcggctcgacgtgcgggaggtgcaggccgcgccgttcctcctgccgttgcgcgatgacgcttgggtggccggcgagtgggacggccatctgctgttgcgccgctcgctgagcgacgctgtggtccatcccttgccggagcagggcctcgctgaggtcccgcaggagttgcggctgttctggctgggcgagcgtccggcgtggcgctccgcagccctggagcgggccgagatgctggacgaagcgctgcgctggagcgggcccgccagtccgtggggattggcgctgaaagcgccggcgacgagcgccggcaacggcacctggaagatgcccctgttctgcgctgccctggccttgctggtgtgggtcgccggtctgaacctgtacgccgggcaactggccgggcagggccagtccttgcaacggcagagcagtcaacgcgtgcagcaggccttcccggaactgccggtggtgctcgatccgttgcgccaggctcgcgagcgacgcgacgcctatctggccggcaaggccgatggcgatgccgtaccggggctggccgcgctgctgcatggcgccggcgaggcgatgccgttcctcgccggacgcctgcaacgactggactaccacgccggcgaactggacctggagctgctgccgggaccgccaggcggcgatgccgctgcctggcagggcgagttgggcaagcacgggttgcaggccgatgcctccgacaagggctggcaggtgcgcgccatggaagcgccgccagcgccggccgctggcgcggcagacagtggcactgccgaggcggctgccgatgaagatgaataa

SEQ ID NO: 5726 - DNA, 2988 bp, Pseudomonas aeruginosa
gcgcctggcgggcctactgaataccccggcgcagcgctggagtcccctgctgctgcggctgcaggcctactggcggcaactggcgccgcgcgagcgcaagattctcgccggcggtggcctggcgctatgcctggcgctgacctggcaagtgttcatcgatccgccgctggcgcggatcgagcattggcaagccgagctgccgcgcctgcgtgcgcaggccgcggcggtggacggcgtgttgcgcgaggtcgaggcgttgcgcggtccgaccctgagcggtacggcggacgccgaggcgatccgtcgcagcctgcgcgatcagggactcgacggtttccaactggacgccccgcaaccgggccaatggcaactggacttcgccagcgtgtccggcgaggccttgctgcgctggctggcgcgcagcccggcggcgttgcgcctgagcgtcagcgaggcgcaggtgacgcgtctcgacgctccttccgaggagcgctctggctcttcgagcgagccgtccggcgggctggtgtccgcctcgatccatttgcagtcgtcttccgctcccaaggattccccatgaggcaatcagctttccaccatgcccggcgtcgttggcctgtactgggcgtggcgctgggcgcgctgctggtcgcggcgtgtagcgagacgccgaaggtccccggcgtgcccccggccgacgaggaagtcggccggccgctgagcagtgtccgctccggtgcgccgttgcgcagcgccgacgtccgcgagcggccccaggccgagcaagcccgccgcgcgctgagtgccgggcgcggcgtagcgcgctccggtgccgtggctccggtctcagcggcagcggccgaactcggcgagcagccggtcagcctgaatttcgtcgataccgaggtggaagcggtggtgcgcgcgctgtcgcgcgccaccggccggcagttcctggtcgacccgcgggtgaagggcaagctgaccctggtttccgaaggccaggtgccggcgcgcaccgcctaccgcatgctcaccagcgccctgcgcatgcagggcttcagcgtggtcgacgtcgacggggtcagccaggtggtgccggaggccgacgccaagctgctcggcgggccggtctacggcgccgaccggccggcggccaacggcatggtcacgcggaccttccgcctgcgctacgagaacgcggtgaacctgatcccggtgctgcgcccgatcgtcgcgcagaacaacccgatcaatgcctatccggggaacaacaccgtggtggtcaccgactacgcggaaaacctcgaccgggtcgccgggatcatcgccagcatcgacatccccagcgccagcgacaccgacgtggtgccgatccagaacggcatcgcggtggacatcgccagcaccgtctccgaactgctcgacagccagggcagcggcggcgccgagcagggccagaagaccgtggtgctcgccgacccacgctccaacagcatcgtgatccgctcgccgagccccgagcgcacgcaattggcgcgcgacctgatcggcaagctggacagcgtgcaaagcaatcccggcaacctccatgtggtctacttgcgcaacgcccaggcgacccgcctggcccaggccctgcgcgggctgatcaccggcgacagcggcggcgagggcaacgagggcgaccagcagcgcgcgcgcctgagcggcggcggcatgctcggtagcggcaacagcggtactggtagccagggcctgggaaccagcggcaataccacgggcagcggttccagcgggttgggcggcagcaaccgcagcggcggcgcctatggtgcgatgggcagcggccagggcggcgccggacccggtgcgatgggcgaggagaactcggcgttctccgccggcggggtcaccgtacaggccgacgccaccaccaacaccctgctgatttccgcacccgagccgttgtaccgcaacctccgcgaagtcatcgacctgctcgaccagcgccgcgcccaggtggtgatcgaaagcctgatcgtcgaggtcagcgaagacgactccagcgagttcggcatccagtggcaggccggcaacctcggcggcaacggcgtgttcggcggggtcaacttcggccagtcggcgctgaacacggccggcaagaacaccatcgacgtgttgcccaaggggctcaacatcggcctggtggatggcaccgtggacatccccgggatcggcaagatcctcgacctcaaggtgctcgcccgggcgctgaagagccgcggcggcaccaacgtcctgtcgaccccgaacctgctgaccctggacaacgagtcggcgagcatcatggtcggccagaccatacccttcgtcagcggccagtacgtcaccgacggcggcggtaccagcaacaacccgttccagaccatccagcgcgaggacgtcggcctgaagctgaacatccgtccgcagatctccgagggcggcacggtcaagctcgacgtctaccaggaggtcagcagcgtcgacgagcgcgccagcaccgccgccggggtggtcactaacaagcgcgcgatcgataccagcatcctcctcgacgacggccagatcatggtcctcggcggcctgttgcaggacaacgtgcaggacaacaccgacggtgttcccggactctccagcctccccggcgtcggttcgctgttccgctaccagaagcgctcgcggaccaagaccaacctgatggtcttcctgcgtccctacatcgtccgcgacgccgccgccggccgcagcatcaccctcaaccgctacgacttcatccgccgcgcccagcagcgcgtgcagccgcgccacgactggagcgtcggcgacatgcaggctccggtgctgccgccggcgcagcagggcatcccgcaggccgcctacgacttgcgcccgagcccgcggccgctgcgcgcggtaccgctgggcgaggcggcgccgctatga

SEQ ID NO: 5727 - DNA, 711 bp, Pseudomonas aeruginosa
cccgggacgcctgatgcagaccttccgttacgaagccgccgacgcccagggccggatcgagaccggcaccctggaggcggacagccagcgtggcgccctcggccaactgcgcgcccgcggcctgaccccgctggaggtccgcgagcaggctggcggcgggaccgggcaaggggcgggcgcgctgttcgccccgcgcctgtccgacggcgacctggcctgggccacccgccagctggccagcctgctggccgccagcctgccgctggaggcggcgctgagcgccaccctcgaccaggccgagcgcaagcacatcgcccagaccctgagcgccgtgcgcagcgacgtgcgcggcggcatgcgcctggccgacgcccttgccgcacggccgcgggacttcccggaaatctaccgggcgctggtggctgcgggcgaggagtccggcgacctggcccaggtgatggagcgcctggccgactacatcgaggaacgcaacgccctgcgcggcaagatcctcaccgcgttcatctacccggcggtggtcggcgtggtctccatcggcatcgtcattttcctcctcggctacgtggtgccgcaggtggtcagcgccttctcccaggcgcgccaggacctgccggcgctgacccgggcgatgctccaggccagcgacttcgtgcgcgcctggggctggctctgcgccggcgccatcggtag

SEQ ID NO: 5728 - DNA, 528 bp, Pseudomonas aeruginosa
cgcttactggggctggcgcttgtacctgcgcgacccgcaggcgcggctcggctggcaccggcgagtgctgcgcctgcctctgctcggacgcttcgtgctcggggtgaataccgcgcgcttcgcctccaccctggcgatcctcggcagcgctggcgtaccgctgctgcgcgcgctcgatgcggcgcgccagacgctggccaacgactgcctcgcgcaggcggtggaggaggccaccgcgcaggttcgcgaaggtgtctcgctggcctcggcgctgcgcacgcggcaggtgttcccgccgatcctcacccacctgatcgccagcggcgagaagaccggtgcgctgccgccgatgctcgaccgcgcggcgcagaccctgtcgcgcgacatcgagcgccgcgccatgggcatgaccgcgttgctcgagccgctgatgatcgtggtcatgggcggcgtggtgctgaccatcgtgatggcggtgctgatgccgatcatcgagatgaaccaactggtccagtagtccgtgcctga

SEQ ID NO: 5729 - DNA, 2328 bp, Pseudomonas aeruginosa
cggcgcggtgatcgatgtctccggcgcgcaaggcgtgcaggtggcgatggagaccaacagcatcaaggtcaacgtgcgcggcaacgagcagcgcgacgcctcggtcaaccgcgagggcggcggtctgaacagccaggatgtgtgggtcgacgtgcgcgacctggtacgggtgcctgccggcaccaacggctatgccagcgaccgctggtacaccgccggcggcctgctggaggtcggtggctacctgggcacccagggccactcggcgggcgagtggatggcccagggcggcatcgtcagtttcaccggcaacgacgtggtgacccaggccggttcgcagatcaacctgtccggcggaaccctcgatgtgcagggcggctacatccgccagacctggctgaagggctcggacggacgcctctacgaactcgggtcggcgccgggcgacctgctctacgacggcatctaccgcggctacgaggcacacagcgagcgctgggaccagacccgttatttctacaatccgctgatcgcgccgacccagcgctacgagaacggctacatcgtcggccgcgacgccggcagtctggtgatcggcagcgccaatgcgcggctcgacggccaggtggtcggcgacacctaccgcggcgagcggcagaccgaagcgccacaggccggcctggacggctacaaccagtcgcagaatgccgtggcgcgcggcgcacagttggtcgtcgggcgctacaccccctactacgtgaagagcagcggcctgctggagtacgctctcggcgccgatgccggcagcctcaagcaggtggtcatcggtgccggcgaggcggcggccgaggagccgaccctggacgctccggtggccgccgagcgccagggccgcctgagcctggacagcgaactgctcaacggcttccagctgggcggcctgaaggtggcggccggcgagagcatccgcgtcgacggcgcgctgaccctggccaatggcggcgaggcaatcctgttcgccaacgacgtggcgatcgacgccgacatcaccgcccatggcggcagcctgcaggccggcaacgtgttggcgcagatttctccgaacgggacgatcgatggtttcgtcgatgccggccgcgaagacggcatcttgcgcgtgggcgacggcgtacggctggatgccagcggcttgtggagcaacctgctgctggcgccggaggacaacgatacgttggcctaccgcgacggcggacggatttccctgcgcagcggcggcgacctgagcctgggacagggcagtctgctcgacgtgtcgtccggggcggcgctgctggccgacggcaagcgactgggcggtcgcggcggcgacatcgccttgcacgccagtgccgggctggcgcaggccagcgatggccaattgcagttgggcggcacattgaatggtctcggcacgagcggcgccggcacgctgtcgctgcagagcggcaaggtgcggatcggcggcgacgacctcggggatggcagcctgcaactggccgaagatttcttccagcagggcttcgccagctaccgggtggtcggtcgctccggattgacggtagccgaggatgcccaggtgcgggtcgcgcggccggtctaccgtttcgccagcggggccggcgaggtcgcggctggcgaggcgccgcgagaggcgctggaggcctggacaccgccgctgtacctggaggatgccttggccggacgcttgatccaacgcgaaggggcggacctgtacctgcaggcaggcggcgacggcaatatcctcgggcagctcgatcccgccagccagacgctggagctggggcgcggttcgctggtcgaggtcgatccggggcgcgccatcgtcctgcgcggtcccggacagatcaccttggatggcactctgaacgcttggggcggacgcatcgacgtgcgccagcagcagttcggcgcgctcgacgttactcaggacaatcagcccaaggcgcaaggccagccccatgcacgctccatctggattggagagcaggcattgctggatgttgccggccgcgctgtcactgccgtggatgggcgcggtcgccgctatggagaagtgcagtccggcggcagcatcgtcatcggcggcgagatcgatccgggcaaggcgatcgcgacctcggcggatgcgttcgtcatcgtacgccccggtgcacgactggaggcctccggcagccaggcacagctggatgtaccgggactgggaagggttttgctggccggcgacggcgggcgcatcgctctcagttcctacaatgggctgtatcttga

SEQ ID NO: 5730 - DNA, 4647 bp, Pseudomonas aeruginosa
acgcggtgcagcgttacgacgatgcgccctggggcaacgatccggcggccggccgggcggccctaccaggtgatcgaccaggcttacctcgatgcgcggcatgccgagagcagcgcgttcatcgccgcggcgctggccaaccgcgagttgctcgacggcaagctggccggactgaccaatgccacctacgcggatgctttccacctgcgtccaggggtggagatcgtcagcgcaacggcggacggcgacctggtggtgcagggcgatctcgatctgtccggctaccgctacgccagcctcaatccgaacacgccgctgaccgaggtctacggttccggcgaggtcggcgcgctggtgctgcgcgccggcggtgacctgaacctctacggcagtatcaacgacggcttcgcgccgccgccggactcgccggacgacaagggctggatcctcaccccgggggtgcagccgttcggcggcgacctggtggttcccggcccgggcgtggtgctcggcgacggtaccgcgttcctcggcggccgcaccctcaactacgacctgccgatcaagggcaccaccctggccgccggcacccgtctggccaccgaggcagtactcgaacagccctataccctggccgccggcagcgtgctggtagcggacatccacgatgccgccggcaacctgctgtacgccgcgggcagcctgctgcgcgacggggtgacgctggaggtcggcagccggctgggtgccggtaccctgctggcggcaccggccagcgtgcaggcgatgacctggcctgcgggcgtgcccttgccgagcatcctgcgcgaggggcccagcagacccaatgtcctgctgctcaatggagagctggccttggcacgtggttctctgatcccttcgcagaccgaggtggtactggctggcgatgcgcctttcatcgagttgcggcccagcgacggtgtccgccagggacgcaactgggcattggccgagatgctgccggccggtagccagtcctggtccatgcgcctggtcgccggtgccgatctcgcggctgccgacaaccgtctggtgcgtccggactcctcggccagcctgaacctggccgatacgcactatcaggcgaagatcgaacagagctcgggagggctggtgttcaccgatcaggctaccgactgggggatcaccccgggaactccggtcgacgagagcaatgaatggatctgcgggctggggccgtattgtgccgagcctccccgctggacctgggcgcccggcaattacctgggcatgcctgctggtacggcgatcggcgagggcgatctgtggtggtgcagtgtcgatccgtccctgtgtatcgagaatctcggcaaaaccgtggtcacaccgcagaaccagttgttcagtgtgctgcgcaccggcactggcgatcttgacctggccagtgccggtaaccttacgcaatggtcgccgtacggcgtctataccgccggaacgcaggccgccgatgtcgcgacgggattcaatcagcctcgcggtctgttcaatgggtcggtactgggcgccggtggcgcggattacgaagtgctctcaaccagccagtaccaggcctggtatccggaacatggcggcaacctcgatatcgccgttggcggtgatgtggttggcgatcaatgggccgagaaactgacaagtagcgatcccattcgccccttgccccccagcgctgcagtcggcaactggctctggcgccagggcagcgccgatagggaaggagtgccgacggcctggtgggtcaatttcggcagctatgtgcgtggcgcggagggagatgctccctatctggtcggcttcaccggtttcggcactctgggaggcggcaatctcagcatgcgaaccggaggtgatgccggcaatatcgcgccacgcggagatggctcgataccttcgtccggtaaccttaatccgcgcagccagggactggtcttggcggttgccggcactggccggctcacctccgacggcgcgctgcaacttggcggcggcggtgacctgaatgtgagaattggcggggaggtgaacccgagccgggaggcgcgggctacccagacctactcgagttcggggtttgacggtctttacagcggcggcaccattcacgatctgcagggggccctcatcaatctgcgcggttccgcgagcttgtacagtggtgcgctgggaggcatcgatcctcgctacgacactctactgcgggaccccgccgaagtgcgcagcagggatgcgttcagcccgacgctggctagctccacgggtggcctcaccctggtggccggagatactggcatgcgtctggaaacccgtggcgacctggtcctgggtggggtgactgaccccggtagggtgggggtgccgaataccgttggcttcacggctcccgatggcagcgtctaccaagggggtgggatcggttggttcagtctctggactgcacacacctcgatcgatctgtttgcggcgggcggcaacctgacgcccagcacccaattggtcgaggcaaccaacgctattcccatggcaggccgaaacctgtcgcctagcgatgggcgattcatctatccatcgatagtacgtgcggctgccccggaaggaagtatctatctcggtccttccagcggttacatgggaggcgtgagcctgaatgtctcgaccactccctactccttgttactggcaccgtcgctcaacggtgaactggagttgctggctggagactccatttatgccggtggctattcggtgcaacgctcaggtgccgatcctgcgaacctgccatcgatctggacgccggcatttgccggctactccgatgccgcgctgctcaacccgatagcgggcaacggcagtccggacgggaatccggccgtcattggcggattgcctctgttctacttcggccccgatagcgctgcgagcctggcgcgcgatctgcaaccggcgcgtttctatgcgttgacaggagatatcgtcgggctcaatagcggtgcgcagattcgtttcggcgagcaggcggggaaccgcgccgggcaaacctggtatgaaggtgcgggtcccgtctggatgcgcgccgggcgcgacatcgttgcctccggaaccccattgggacagcgtatcagcgctcccagtcagatcagtacggatgcctcgttcaccggcaacctcttcgtccacgacgaccccaacgacctctcgctggtccaggccggccgcgacatcctctacggcaacttcaacgtcgccggccccggtaccctggagatcagcgccgggcgcaacatcctcatggaggaccgcgcagcgatcaccagtctcggcgcggtggtgccgggcgacagccggccgggtgccgatatcgtgctccaggccggcgcggcgggggccgactatcaggccttcctcgagcgctacctggatccggccaacctggcgcaggccggcaccccgctggccgagcagccgggcaaggtggtcaggacctacgaaagcgagttggccaagtggttgaacgagcgcttcggcttcgccggcgacgcggaacaggcccaggcgttcttcgccggcctgcccgccgagcagcagcggatcttcgcccgccaggtgtacttcgccgaactcagggccggcggccgcgagtacaacgaagtcggcggggtacgccagggtagctacctgcgtgggcgcaacgcgatcgccgcgctgttccccgagcgcgatccggcgggcaatccgatcagctacgaaggcgatatcgtcatgtatggcggtgccggcgtgcacaccgacttcggcggcgacatccagttgctcagccccggcgggcgccaggtgttcggtatcgagggcgaggcgccgccgtccaccgcaggtatcgtcacccagggccagggcgatatccaggcctactcgcgggacagcatcctgctcggccagagccgcatcatgaccaccttcggcggcagcatattggcctggtcggcggaaggcgacatcaacgccggtcgcggttcccagaccaccgtggtctacaccccgccgcggcgcatctacgacgcctggggcaacgtcagcctgtcgccacaggtgcccagcaccggcgccggtatcgccaccctcaacccgattcccgaagtggcaccgggcgacatcgacctgatcgccccgctcggcaccatcgatgccggcgaggcgggcatccgggtttccggcaacgtcaacgtggcggcgctgcaggtggtcaacgcggcgaacatccagacccagggccagtccagcggcattccgctggtggcttcggtgaataccggggcgttgacctccgccagcgccgcggcgagttccgcgacccaggcggcggaggacgtcagtcgccagcagcaggccgccgcgcggcagcgcatgccgtcggtgatcacggtgcaggtgctcgggttcggcaacgagcgcctggagccttcgcgcgacggcgccagtcgttcgccgggctacaacccggacagcgccgtgcaggtgctcggcgccggagccctcggcgaacaggcgcgcagccaattgaccgatgaagagcgcggcaacctgatcctgtaa

SEQ ID NO: 5731 - DNA, 1053 bp, Pseudomonas aeruginosa
tttccaacgaacagttcgccgccggcggtgccaccagcgtgcgtggctacctggcggcggagaacaccgccgacgacggctatctgctctcccaggaatggcgtacgccgtccctcggacgcttcctcggcaagcgcgccggcggctacgtcaacgactggcgcttctacgtgttcgccgagggcgcgcaactgcgcctgcaggatgcgctgcccgaacaggacgacgacttcagcctggccagcgtcggcatcggcacccgcgcgcaactcgccgactggctgtccggcagcctcgactgggccttcccgctgctggaagggacgaacaccgacaaacacgactcgcgcctgcatttcagcgtgcaggcgagcttctgacgctgaccccggagtaaccccacatgtatcgcttattgctgacatcgctgatctgcctgggcctgctggccccggccagcgccagtgcctggtggcaggacgactggcagtaccgcaagcaggtctcggtcgataccaccccgcaaggcgcggcgatcaacgagagtctcggtcgcctgccgttgctggtgcgcctgcataccggcaacttcaccttcgacggggtcaacgagaacggctcggacatccgcttcgtcgccgccgacgacaagaccgtgttgcgccaccaggtcgagagcttcgacccgctgatgggcatggccctgatctgggtcgacgtgccgcgggtggagggtggccagcgccaggacatctggatgtactacggcaacgccaaggcgccggagagcggcaacggccagtcggtgttcgacccggactacaccctggtctatcacttcgacggtgcgccgggcactccgccgcgggactccaccgcctacgccaacaatgcgcagaccgccgccggcagtccggtggagggcgtcatcggtcgctccgcgcaactgctgggccagccgctgctgctgccggccagcccatcgctggcggtgagcgccggtggcaccttcagcttcagcggctgggtgcgtcccgaccaactggccggtga

SEQ ID NO: 5732 - DNA, 603 bp, Pseudomonas aeruginosa
tggtccgcggcgacgccacggtgcagtaccagaaggtcatcgaggtcctcgacctgctgcgccgcctggagctgtcccaggtcggcctggtcaccggcaaaccgacctgaggcccgggatgaacatgtccgccgatcccaagcacacccccgagccgaaaaatgccgcgccactgtccatcgacggccgcccggcgaacccgaccctgcgctacctcaagtggggcctcggcgcgctgctgctcgccggcctcgcctggctggtctgggagtgggccaacgacatgagcggcgtgcgccgcgaggcgcccaaggtgccggcgatcatcccgctgccgccaccgcctccgccgccgccggaaaaaccgccggaaccggagcagccggtggaagaggaaaagatcgtcgagccggaaccgcaacccgaactggaggaggtcaagccgcaggaggaagcgccgccgtcgccggccgacgacctggccgacccgatgcagatggatggcgacgcccagtccggctccgacgctttcaacatcggcgccggcaagggcggcgggatggccggttccggcggcggtcgcgccggcaacgccagctatag

SEQ ID NO: 5733 - DNA, 390 bp, Pseudomonas aeruginosa
cggtcccttcggcgaacagtggcaattgcggctcgacgctggcgacggcccagcgcgccttgtgccggtgtccggcgagaccgcgcagggcgccggcatcggccagcaactccagggcccgggcgtcgagcctggcgcgtcggccgagatcgtgcacgtcgaggaacggctgggcctcccggacctgctcgatacgcctggcatcctcctcgcgaaagcctcggatcatccgcaggccgaggcgtatggccggttgcgcctggccgaacggctccaggctgcaatcccaaccgctgtggcggacatccaccgggcgtgtctgcagggtgtggcggcgggcgtcctggagcaactggtcggggctgtagaagcccatcggccaactgttga

SEQ ID NO: 5734 - DNA, 468 bp, Pseudomonas aeruginosa
tcgcggcggatgtcttcgccatcccaccagcccgactcgatccgctccgggccggccagcacggtgggcaaggcctcgccgagggggcgtggctccgccagcagccagccggggcggaggccgcaggctgccggcgattgcgccctgtcgcagctgtgcggccgccagcttcgctccggacggtgttcggcgacggcgctcaggccctgtaccgcctcgtcgcccagccgcgcgcgcaggcgttcccgcaactgttcccagccgagatactgctgtgggcgctcgtcgaacagttcgcggtgctgcggcgtgaaaggaggcagctcgcgggcctccaggcgcacggcatgcacgggggcgggcagttgcagctgttcgagacggccgcgggtcagttcgaagagcatggccgcctcgcgttcggcgctgagcaggccgaccgtgacctggctgtcggcgcgcccgtga

SEQ ID NO: 5735 - DNA, 1062 bp, Pseudomonas aeruginosa
acggtgagatcgacgtgttctccctcggcgccgacgggcagccgggcggcgagggcatcaacgccgacatcggctcctggcagctctgagcgcgccatgaacggtcatcgccagcgcggcatggcgatcatcagcgcgctgctgatcgtcaccgtggtcgcggtcatagccgccggcctgatcgcccgccagagcgcattcatccgcgccctggaaagcgagcagctacgcatccaggccggctggatgctgcgcggcggcctggaatggagccgccagttgctgctcgaggacagccgccgcgacccgctgacccgcctcgaccagcgctgggcgcaaccgatgcgtggcttgcgtctgagcagcgccgaattgccgttcaacggccaactggaagacgagcagggcaagttcaacctgcgcaacctgttggtcgaccagcgccccgatctccaggaacgagcgaacttcgaacgcctcgccggtctgctcggcgtgcgcccgaaggaggcgcggctgatcgtcgagcgggtcctcgcctcctatgcacggctgcccgccgaagcgccgccggccgagacgcaacccgcaggcttcgacagcggccgcgagacttcgccgggcgccgtgttgcgtgcgcttccggcgcgcatgccggcgctcaggcgtctcgacgacctggcgcggctgggcattccgccggcgaccctggagcgcctgcggccctacgtcaccatcctgcccgaaaccacctggatcaacggcaacaccgcgcgcgccgaagtgctcgccgcctgtgtccccggcctcgggctggaccaggcgcggcgggtgctcggcgagcgcgaccggggccgctggttcctcaatcgcggcgacttcgtcaaccgcctgaacatgccgcaattgcaggcgcagtcggtgaaggtcgggatcaccagcgactggttcctgctcaccgcctatgctcggcgcgaccggcaagaggtgcgcctgcaagccctggtgcagcgcaaggccggtgaaagcacggcggtcaactggatgagggtgggctcatga

SEQ ID NO: 5736 - DNA, 1032 bp, Pseudomonas aeruginosa
acctgtacgccgggcaactggccgggcagggccagtccttgcaacggcagagcagtcaacgcgtgcagcaggccttcccggaactgccggtggtgctcgatccgttgcgccaggctcgcgagcgacgcgacgcctatctggccggcaaggccgatggcgatgccgtaccggggctggccgcgctgctgcatggcgccggcgaggcgatgccgttcctcgccggacgcctgcaacgactggactaccacgccggcgaactggacctggagctgctgccgggaccgccaggcggcgatgccgctgcctggcagggcgagttgggcaagcacgggttgcaggccgatgcctccgacaagggctggcaggtgcgcgccatggaagcgccgccagcgccggccgctggcgcggcagacagtggcactgccgaggcggctgccgatgaagatgaataagcgcctggcgggcctactgaataccccggcgcagcgctggagtcccctgctgctgcggctgcaggcctactggcggcaactggcgccgcgcgagcgcaagattctcgccggcggtggcctggcgctatgcctggcgctgacctggcaagtgttcatcgatccgccgctggcgcggatcgagcattggcaagccgagctgccgcgcctgcgtgcgcaggccgcggcggtggacggcgtgttgcgcgaggtcgaggcgttgcgcggtccgaccctgagcggtacggcggacgccgaggcgatccgtcgcagcctgcgcgatcagggactcgacggtttccaactggacgccccgcaaccgggccaatggcaactggacttcgccagcgtgtccggcgaggccttgctgcgctggctggcgcgcagcccggcggcgttgcgcctgagcgtcagcgaggcgcaggtgacgcgtctcgacgctccttccgaggagcgctctggctcttcgagcgagccgtccggcgggctggtgtccgcctcgatccatttgcagtcgtcttccgctcccaaggattccccatga

SEQ ID NO: 5737 - DNA, 600 bp, Pseudomonas aeruginosa
tggtcttcctgcgtccctacatcgtccgcgacgccgccgccggccgcagcatcaccctcaaccgctacgacttcatccgccgcgcccagcagcgcgtgcagccgcgccacgactggagcgtcggcgacatgcaggctccggtgctgccgccggcgcagcagggcatcccgcaggccgcctacgacttgcgcccgagcccgcggccgctgcgcgcggtaccgctgggcgaggcggcgccgctatgagcctgctgccctacgcctgggccaaggcgcagcgcgccttgctgcggccgggcgagcatggcgcgaccctgctggtcagcccgcgcacgcccggctgggcgatcagcgaggtgcgccagcggcatgcgccggccagcctggagagcgtccgcgacgacgagctcgacaccctgctggccagcgcctactccgataccggcagcgccgcggcggtggtcggcgcggcggagagcgaggtcgacctcgaccgcctgatggacgatatccccgaggttaccgacctgctcgacacccaggatggcgcgccggtgatccgcatgatcaacgcgctgctgacccaggccgcgcgcgatga

SEQ ID NO: 5738 - DNA, 2265 bp, Pseudomonas aeruginosa
ggccagcgacatccacatcgagcccttcgagacccattcggtggtgcgctatcgcgtcgacggcgccctgcgcgacgtggtcgcgccgcgcaaggcgctgcacgcggcgctggtgtcgcggatcaagatcatggcgcagctggatatcgccgagaaacgcctgccccaggacggccgcatcgccttgcgggtagccgggcggccgatcgacattcgcgtctccaccgtgcccaccggccacggcgaacgggtggtgatgcgcctgctcgacaagcaggccggacgcctgaggctggagaccctgggcatggctcccggcgtgctggcgccgctggacaacctgatccgccagccgcacggcatcgtgctggtcaccgggcccaccggcagcggcaagaccaccaccctctacgccgccctggcgcggctcgacgccagcaccagcaacatcctcaccgtcgaggacccggtggagtacgacctgccggggatcagccagatccaggtcaacgcgcgcatcgacatgaccttcgccgtagccctgcgggcgatcctccggcaggacccggacatcatcatgatcggcgagatccgcgacctggagaccgcgcagatcgccgtgcaggcttcgctcaccgggcacctggtgctggccacgctgcacaccaacgacgcggtttcggcagtgacgcggctggtggacatgggggtcgagccgttcctgctcgcctcgtcgatgcttggcgtactcgcccagcgcctggtgcggcgcctgtgcacgcattgccgggtcgaagaggacggcggctggcgcgcggtcggctgcccggcttgcaaccagaccggctacagcgggcgcaccggcatccacgaactgttcgtgatcgacgacgagatccgccgcctggtccaccagggccgcgccgagcaggatctccgcgaagccgcccgcgcggccggcatgcgcagcatgcgcgaggacggcgagcgctggatcgccagcggctccaccaccctggaggaaatcctccgcgtgacccgggacgcctgatgcagaccttccgttacgaagccgccgacgcccagggccggatcgagaccggcaccctggaggcggacagccagcgtggcgccctcggccaactgcgcgcccgcggcctgaccccgctggaggtccgcgagcaggctggcggcgggaccgggcaaggggcgggcgcgctgttcgccccgcgcctgtccgacggcgacctggcctgggccacccgccagctggccagcctgctggccgccagcctgccgctggaggcggcgctgagcgccaccctcgaccaggccgagcgcaagcacatcgcccagaccctgagcgccgtgcgcagcgacgtgcgcggcggcatgcgcctggccgacgcccttgccgcacggccgcgggacttcccggaaatctaccgggcgctggtggctgcgggcgaggagtccggcgacctggcccaggtgatggagcgcctggccgactacatcgaggaacgcaacgccctgcgcggcaagatcctcaccgcgttcatctacccggcggtggtcggcgtggtctccatcggcatcgtcattttcctcctcggctacgtggtgccgcaggtggtcagcgccttctcccaggcgcgccaggacctgccggcgctgacccgggcgatgctccaggccagcgacttcgtgcgcgcctggggctggctctgcgccggcgccatcggtagcgcttactggggctggcgcttgtacctgcgcgacccgcaggcgcggctcggctggcaccggcgagtgctgcgcctgcctctgctcggacgcttcgtgctcggggtgaataccgcgcgcttcgcctccaccctggcgatcctcggcagcgctggcgtaccgctgctgcgcgcgctcgatgcggcgcgccagacgctggccaacgactgcctcgcgcaggcggtggaggaggccaccgcgcaggttcgcgaaggtgtctcgctggcctcggcgctgcgcacgcggcaggtgttcccgccgatcctcacccacctgatcgccagcggcgagaagaccggtgcgctgccgccgatgctcgaccgcgcggcgcagaccctgtcgcgcgacatcgagcgccgcgccatgggcatgaccgcgttgctcgagccgctgatgatcgtggtcatgggcggcgtggtgctgaccatcgtgatggcggtgctgatgccgatcatcgagatgaaccaactggtccagtag

SEQ ID NO: 5739 - DNA, 1497 bp, Pseudomonas aeruginosa
tccgccctacgggaggggcctgtgcaagcaggccttcctctcgctgtcatcaacccgtgtggcctctcgccagggctcgggtgcatgtttcagcgaggttgccccgagggcgcgccatggccgtcgcgggccggccgccgggaggcgctcgcggaacctcgcaggtcccgcgaaaaggcccggcgcagagcctgcgaacacccgaggaaaggctgcgaaaacaattcgatgctcccgagattttttccccgatctgtcaccggaacttgcgagttttatccccagcggccccttcgaccggctagggatgcaaagcccggcaagcacggcgccgcctcatgcaagacgacttcctcaacgtaccaacaccacgatgaaaggagattcttcatgttcaagcgctctctgatcgctgcctcgctgagcgtggccgccctcgtatccgcccaagccatggccgtcaccggcggtggcgcttccctgccggccgagctgtacaaaggctccgccgacagcatcctgccggccaacttcagctatgccgtgaccggcagcggcaccggcaagaacgctttcctgaccaacaactcctcgctgttcggcaccaccggtaccgttcactatgctggtagcgactcggtcctgagcggtagcgaactgaccacctacaacagcaactacaacggcacctacggtccgctgatccagatcccgtcggtagccacctcggtcaccgtgccctatcgcaaggacggcaacaccacgctcaacctgaccagcgcccaactctgcgacgccttctccggcgccaagaccacctggggtcaactgctgggcactaccgacagcacgccgatccgcatcgtctaccgcaccggtagcagcggcaccaccgaactgttcacccgccacctgaactcgatctgcccgactcgcttcgccaccaactcgacctttaccaacgcccgtctgccggccggcggtacgttgccgagcaactgggttggcgtcgccgccacttccaccgtggtgtcgaccgtcaaggcaaccaacggttccctcggctatgtcagcccggatgcggtgaacatcaacagcaacgccgaggtttcccgtgtgaacggcaacctgccgacccaggctaacgtttccactgccctgggcagcgtggctccgccggccaacgccgccgaccgtgcggaccccagcaagtgggttccggtgttcaccaatccgagcgccggctactccatcgtcggttacaccaacttcgtcttcggccagtgctacaaggacgccagcgtttccaccgacgtccgcgccttcatcaacaagcactacggtggcactaccaccaacgccgcagttgccgcccatggcttcatcccgctgactccggcctggaagagcgccatcgtgagcgccttctacaccggcaccagcgaaaacctggccatcggcaacaccaacgtctgcaacaccaaaggccgcccgtaa

SEQ ID NO: 5740 - DNA, 297 bp, Pseudomonas aeruginosa
caagtcttcggcccaccctccgccaggccgtctaccagtaacgggcgtcgttgcgggcgcccgaccgacttcatgctcaaggaccccttcgccatgccgtcccgttcgccgtcgtccgcccgttcctcccgcgcgctttacgcgccgcgcctgaagccgctggcccaggccatcgccctgctgctggtcgcagggggcgcccaggccgccgggcagccgttcagcgccgcttggttcgctgccaagggtgtggcgcagggcggcgctgccggggcgccgcgaccgggagcgcagtag

SEQ ID NO: 5741 - DNA, 4941 bp, Pseudomonas aeruginosa
cccgggggcgccgccgccgctggcgcagcagcagcgggtcaaccagcagttgcagcgttcgatggccaacttgaacaacaccgtctccgccatagccgcccagcaggccgcccagtccgccggacgccaggcggcgctgaaccttccgcaggatgttccggacggactcggcgagggcggcctcaaggtcgacgcctcgatgccgttcgagcaggcgtggcagaacgccaagggaccggtgcagacccaggccggcggcaagaccacggtgagcatcgagcagaccgccgacaaggcggtgctcaactgggagaccttcaacgtcggccgcaacaccaccgtggacttccagcagcacgccgactgggctctgctcgccgggtcaacgaccccagcgcgcggcccagccagatccaggggcagatcaaggccgacggcacggtgatgctggtcaaccgcaacggcgtggtgttttccggcagcagccaggtggacgtgcgcaacctgacggtggcggcggcgaacatctcggacgaacagttccgtcagcgcggcctctactacgacaatgccggcagccgtccgaccttcaccgacgcggctggtgccgtgcgcgtggagcagggcgcacagttgcgcacggcagcgccgtccggctcgaccaggggcggcggctacgtcctgctgctcggcagcgaggtggacaacgccggcagcatcgtcacgccgaaggggcagacggtcctgtccgccggcgacaacttcgtcatccgccgtggccagggcaccgacggcaacctgacctccaccacccgcggcaacgaggtgctgccgggcttcgccgccgacagcagtgccggccgggtgcgcaacagcggcctggtgcaggccgccaccggcgatatcagcctcagcggccgcgaggtggagcaggccggcgtattgctttccagcagttcggtggacagccgcggcaccctgcacctgaaggccagcgagcggatcaccctggccgaaggtgccaccagcgcgatcttggtggacagcagcggcagcgccgccctcgacagccagcgcgaggccttgctcaagccgttgaacggctccagtgccgccgtcagccggggcgacgacgaccgccgcgacctgtcgcgggtggagatcgactccgccggcagcgtcgatttccgcgacggctccatcaccctcgccagcggcggccaggtggcggtcaacgctggccagcgcgcgctgttgcgtgacggcgcggtgatcgatgtctccggcgcgcaaggcgtgcaggtggcgatggagaccaacagcatcaaggtcaacgtgcgcggcaacgagcagcgcgacgcctcggtcaaccgcgagggcggcggtctgaacagccaggatgtgtgggtcgacgtgcgcgacctggtacgggtgcctgccggcaccaacggctatgccagcgaccgctggtacaccgccggcggcctgctggaggtcggtggctacctgggcacccagggccactcggcgggcgagtggatggcccagggcggcatcgtcagtttcaccggcaacgacgtggtgacccaggccggttcgcagatcaacctgtccggcggaaccctcgatgtgcagggcggctacatccgccagacctggctgaagggctcggacggacgcctctacgaactcgggtcggcgccgggcgacctgctctacgacggcatctaccgcggctacgaggcacacagcgagcgctgggaccagacccgttatttctacaatccgctgatcgcgccgacccagcgctacgagaacggctacatcgtcggccgcgacgccggcagtctggtgatcggcagcgccaatgcgcggctcgacggccaggtggtcggcgacacctaccgcggcgagcggcagaccgaagcgccacaggccggcctggacggctacaaccagtcgcagaatgccgtggcgcgcggcgcacagttggtcgtcgggcgctacaccccctactacgtgaagagcagcggcctgctggagtacgctctcggcgccgatgccggcagcctcaagcaggtggtcatcggtgccggcgaggcggcggccgaggagccgaccctggacgctccggtggccgccgagcgccagggccgcctgagcctggacagcgaactgctcaacggcttccagctgggcggcctgaaggtggcggccggcgagagcatccgcgtcgacggcgcgctgaccctggccaatggcggcgaggcaatcctgttcgccaacgacgtggcgatcgacgccgacatcaccgcccatggcggcagcctgcaggccggcaacgtgttggcgcagatttctccgaacgggacgatcgatggtttcgtcgatgccggccgcgaagacggcatcttgcgcgtgggcgacggcgtacggctggatgccagcggcttgtggagcaacctgctgctggcgccggaggacaacgatacgttggcctaccgcgacggcggacggatttccctgcgcagcggcggcgacctgagcctgggacagggcagtctgctcgacgtgtcgtccggggcggcgctgctggccgacggcaagcgactgggcggtcgcggcggcgacatcgccttgcacgccagtgccgggctggcgcaggccagcgatggccaattgcagttgggcggcacattgaatggtctcggcacgagcggcgccggcacgctgtcgctgcagagcggcaaggtgcggatcggcggcgacgacctcggggatggcagcctgcaactggccgaagatttcttccagcagggcttcgccagctaccgggtggtcggtcgctccggattgacggtagccgaggatgcccaggtgcgggtcgcgcggccggtctaccgtttcgccagcggggccggcgaggtcgcggctggcgaggcgccgcgagaggcgctggaggcctggacaccgccgctgtacctggaggatgccttggccggacgcttgatccaacgcgaaggggcggacctgtacctgcaggcaggcggcgacggcaatatcctcgggcagctcgatcccgccagccagacgctggagctggggcgcggttcgctggtcgaggtcgatccggggcgcgccatcgtcctgcgcggtcccggacagatcaccttggatggcactctgaacgcttggggcggacgcatcgacgtgcgccagcagcagttcggcgcgctcgacgttactcaggacaatcagcccaaggcgcaaggccagccccatgcacgctccatctggattggagagcaggcattgctggatgttgccggccgcgctgtcactgccgtggatgggcgcggtcgccgctatggagaagtgcagtccggcggcagcatcgtcatcggcggcgagatcgatccgggcaaggcgatcgcgacctcggcggatgcgttcgtcatcgtacgccccggtgcacgactggaggcctccggcagccaggcacagctggatgtaccgggactgggaagggttttgctggccggcgacggcgggcgcatcgctctcagttcctacaatgggctgtatcttgacggctcgttgcgcgccgcagccggcggctcgggagcggcgggcggcagcctggagatcattgcggacgctcccctgtaccagggttttactgtcgtggatgaccgggtattggccatgcgcgagctgatcctgacggcagggcatgccgattcgggattgccgaccttgctgcaaccgggaatggacgattcggctctgcgctatggccagagccgagttgggacgcagtcgctgacgagcggcggattcgaccaactttcattgttcagcaacggtccgctgtcgttcgaggggaacatcgatcttgcgatggggcgcagcctgaatttgtacgcggggacgatagccgccacgggtggtgggccgagcgaggtgaggttgcaggcgccctatgtccgcctttccggcatcgggatgtatgggcagcaggcctctggcgagtttcgtccgcgtctcacgtacgggccgaccgcgacagcggagcaggttcgcttgcaggtttctgccgggcgcctgctggatatcgccgggcgcttgtcattcggtagcgacggggtgatcaatggggtcaacgcagaggctgtccgctatcagcgaccaggtttcgagaaggtaacgctgcgcagcgagggcgacctgcgtttcgctggcgactatccagagaatggcgatccgtcggggcgcttgataacccacggcgatctgcaactgactgcggcccaactctatccggtgacgggagcgagttcgaccctctatgccgggtatggactggatgagggggggcaggctgtcttcgatgccgaacggcatttggctatcgaacgtagcggcgagtccttgccggacactccgctgtcggtattcggcagtctggcgttcatggcatcgaatatcgagcaggggggcgtggtgcgtgcgccgctggggctcatccagttcggcagcaatctggatcgtgccccgggcacggtaaggttgttgccgggtagcctgacctcggttagcggcgctgagctggtcatgccctatggaggcacgaccgatgggatcaactatctggtcaaccaggtccccattcaactgaccggtgccgggggcgctctcgctgctgggacactggttgcgggagtcggcctttatgccagcgaggtcgatgtgcaacagggcgcgcggctggacctgtccggcggcggcgaactcgcgggggctggattcatctccggcagagggggttcgaccgatgcgcgttttcatcccctggtgcagcaggacaatgatgggttccgtctgccggagctgtccagcaacccggtgtatgccatcgtgcctggacaccagggccgttag

SEQ ID NO: 5742 - DNA, 585 bp, Pseudomonas aeruginosa
atacagctggggtggcgacctgctgctgagcagtcgcgccggcgacatccgccaggccgccggttcgctgatcgacctgtcggcgcgcaacaaccgcggcggtaccctgagcgccgtggcgttggccgaggacgccgggatggtggacctgcagggccgcatactgggtggcgccagcggcgactacgatgccggcggcacccgcgtgccgttcctcggtggcgagctggagatccgcgcccagcgcctgggcgatggcggcagcctgagcgagcagttcaccgccttgaaccagcgcctgaaccagggcgaggtcttcggcgcgcggcgcttccagctcaagcaaggcgacctgcagatcggcgacggcctgaaggcgcatcgcatcgaggtgtccctcgacaatggccagctcggcgtgagcggaacggtggacgccagcggcgcgcaggtcggcgagatccgcctggccggtggccgcggcctgagcctgggcggcaacgcgctgctggatgcgcatgggagcctgctgcggcgcgacagctacgggcagatcatcgacagcccgaaccgggcgatggttga

SEQ ID NO: 5743 - DNA, 549 bp, Pseudomonas aeruginosa
caggagatatcgtcgggctcaatagcggtgcgcagattcgtttcggcgagcaggcggggaaccgcgccgggcaaacctggtatgaaggtgcgggtcccgtctggatgcgcgccgggcgcgacatcgttgcctccggaaccccattgggacagcgtatcagcgctcccagtcagatcagtacggatgcctcgttcaccggcaacctcttcgtccacgacgaccccaacgacctctcgctggtccaggccggccgcgacatcctctacggcaacttcaacgtcgccggccccggtaccctggagatcagcgccgggcgcaacatcctcatggaggaccgcgcagcgatcaccagtctcggcgcggtggtgccgggcgacagccggccgggtgccgatatcgtgctccaggccggcgcggcgggggccgactatcaggccttcctcgagcgctacctggatccggccaacctggcgcaggccggcaccccgctggccgagcagccgggcaaggtggtcaggacctacgaaagcgagttggccaagtggttga

SEQ ID NO: 5744 - DNA, 438 bp, Pseudomonas aeruginosa
acgagcgcttcggcttcgccggcgacgcggaacaggcccaggcgttcttcgccggcctgcccgccgagcagcagcggatcttcgcccgccaggtgtacttcgccgaactcagggccggcggccgcgagtacaacgaagtcggcggggtacgccagggtagctacctgcgtgggcgcaacgcgatcgccgcgctgttccccgagcgcgatccggcgggcaatccgatcagctacgaaggcgatatcgtcatgtatggcggtgccggcgtgcacaccgacttcggcggcgacatccagttgctcagccccggcgggcgccaggtgttcggtatcgagggcgaggcgccgccgtccaccgcaggtatcgtcacccagggccagggcgatatccaggcctactcgcgggacagcatcctgctcggccagagccgcatcatga

SEQ ID NO: 5745 - DNA, 609 bp, Pseudomonas aeruginosa
gtattgatggaaagttactcgaaagtcggtatgcaggaacttgaccagcgcctatcgaagatcgtcgaagccgcacgcaagaaaccggtatcggtttatcgatatggggcgccatgggtctggatagtgtcccaggaagattggcagggtgcgctcaaggaagtgtccagctatatgccgccgggacattccctggcgttgctgaaaccgcaaatagaaagtctccttggcgaagaggcgaaagtcctctcggcgctcgcccgcgaacatggcatgcagttggccccggagccgctgatccacgcgctgctgctgcaactgctgtacgcgattcccagcgagcagcagttgtacgagcaattgaactacaacctgctgtatcgctggttcgtcggcctggaaatgaagcagaagatctggaattttccggttttcgtcagcgatataaccgtcctgctgaacagcgcggaggcggtaaggataataggcaggattatcggggaagtgatttccggggatctcatgcagatgccggagttctccctgaacttcgccttgttgcatacatggcaagcgcgccatggcggagcgcgacggctgaatatctag

SEQ ID NO: 5746 - DNA, 1686 bp, Pseudomonas aeruginosa
aacaataagtcccgatggaacttcgggggaccgtgtgaagcgttcgctgttcaattgtgcgcacccgtttcgccagcgctggtcgatcggttgcctggctgtcgcattgtcgtgcgcttcgctggccgacgaggcccctcccgccgcggcgggagccgagacccagcgtctggtggacatcaacgagtacgtggtacgcggcaacaccgtgctggacaaccgcgccatcgaggcggcggtgtatcccttcctcggaccgcagcgcagcctgggcgacatcgagggggcgcgcgatgcgctgcaggccgcctaccaggagaagggctaccagtcggtctacgtcgagctgccggagcagcaggtgagcggcggggtggtctacctgcaggtcaccgagaccactgtcggtcgcgtccgggtggtcggcgccaagcactattcgccggtggagttgcgcgaggaagtgccggccctggaggagggcaaggtgcccgacttcgcccaggtccagcgcgagctggcgcaggtcaaccgcacccccggccgccaggtgctgccgatggtgcgcgagggccagcggcccggcaccatggacgtcgacctgcaggtggaagacaagaatccctggcacgccagcatcggcctgaacaacgactacagcgccgacacccgtcacttgcgctcggtggtttcgctgggctacgacaacctctggcaactcggccacgccatctcgctgacctatttcaccgcgccgcaggaccaggacaacgccaaggtctggtccggctcctataccgcgccgctgagccagcgctggagcgtgcagctgtccggctaccagtccgacagcgacgtggccacggtgggcagcatgaatgtggtcggccagggccattcctatggcgtggcggcgatctacagcctgccggtgaccggcctctggtcgcactcgttctccttcggcgtcgacttcaaggacttcgaggaacagatccggatcggcggcaacaacgacagggtgccgatcaagtacgccccgctgaccctcggctacaacggtttccgctacaccgaacgttcccagttggcccttggcctgagcctggtggccggtaccggcagtctcctcggctacggcgacgacgacgaggaattcgaccgcaagcgttatcgcgccaagtccggcttcggcgtgctcaagggcgatctcaaccacaccctgaccttcggcggcgactggcaggtggcgaccaaggcggccttccagctcgcctccgggccgctgatttccaacgaacagttcgccgccggcggtgccaccagcgtgcgtggctacctggcggcggagaacaccgccgacgacggctatctgctctcccaggaatggcgtacgccgtccctcggacgcttcctcggcaagcgcgccggcggctacgtcaacgactggcgcttctacgtgttcgccgagggcgcgcaactgcgcctgcaggatgcgctgcccgaacaggacgacgacttcagcctggccagcgtcggcatcggcacccgcgcgcaactcgccgactggctgtccggcagcctcgactgggccttcccgctgctggaagggacgaacaccgacaaacacgactcgcgcctgcatttcagcgtgcaggcgagcttctgacgctgaccccggagtaa

SEQ ID NO: 5747 - DNA, 1854 bp, Pseudomonas aeruginosa
ccccacatgtatcgcttattgctgacatcgctgatctgcctgggcctgctggccccggccagcgccagtgcctggtggcaggacgactggcagtaccgcaagcaggtctcggtcgataccaccccgcaaggcgcggcgatcaacgagagtctcggtcgcctgccgttgctggtgcgcctgcataccggcaacttcaccttcgacggggtcaacgagaacggctcggacatccgcttcgtcgccgccgacgacaagaccgtgttgcgccaccaggtcgagagcttcgacccgctgatgggcatggccctgatctgggtcgacgtgccgcgggtggagggtggccagcgccaggacatctggatgtactacggcaacgccaaggcgccggagagcggcaacggccagtcggtgttcgacccggactacaccctggtctatcacttcgacggtgcgccgggcactccgccgcgggactccaccgcctacgccaacaatgcgcagaccgccgccggcagtccggtggagggcgtcatcggtcgctccgcgcaactgctgggccagccgctgctgctgccggccagcccatcgctggcggtgagcgccggtggcaccttcagcttcagcggctgggtgcgtcccgaccaactggccggtgaacaggtcctgctgtcgcgccgcgaaggcggcaacgccctgttggtcggcctggcccagggcgcgcccttcgtcgagctgaacggtcagcgcgctgccgccagccaggccctggcgcaggggcaatggcagcatctggcgctggtcgccgacggtacccggctggcgctgtatctcggggggcgcgaagtcgccagcctggcggcggcgctgccggcgttcagcggtgcgatcgccatcggcgcggaaggccaggccgcgcctgcggtcgccaccgaagcggcaagcggggaaggtgaggcgagcgccgcggcgccgaccctgcaacccttccagggcgccatcgacgagttgcgcctgtcgaagatcgcccgcccggcggcgctgctcctcgccgacgccaccgcccagggcgccgagtcgcgcctggtggcctacggggtcgacgagaagcagtccggcttcggcttcggcaagctcggcttcctgctcaacgcagtgccgctggatgcctgggtgatcatcgcgatcctggcgctgatgatggtccagtcgtgggtcatcatgtaccgcaagaaccagaacgtcggccgtgtcagtcgcgccaacgggctgttccgcgagcgcttcgccgaggtcggcacgcgcctggaactgctcgccgacgaccgcgagctggccgcccgcctgcaacactcctcgctgtggcgcctgtaccaggtggcggtgaaggagatccgcacccgccgcgagcagggcgccgacacctcttccgtctccgcggccaccatcgaggcgatccgcgcctccatggacggcgtgcgcaccaaggagaaccagcagctcggctcgcgcctgtcgagcctgtccaacgccatcgccggcggcccctacatcggcctgctcggcaccgtgctggggatcatggtggtgttcctcggcaccgccatggccggcgacgtcaacatcaatgccatcgccccgggcatgggcgccgccctgctggccacggccatgggcctgttcgtcgcgatccccgcgttgttcggctacaaccgcctggtcacgcggaacaaggaagtcagcgcggacatgcgggtgttcgtcgacgagttcgtcacccgcctcgccgaggtgcatggcgaaagccagctcagcgaagtggcccatggtcgcaacggccagccgttgccggcctga

SEQ ID NO: 5748 - DNA, 1143 bp, Pseudomonas aeruginosa
  unsure (1125): Identity of nucleotide at the above locations are unknown.
cgacgacggcgccgtcgacagcatcaacatcaccccgctggtggacgtgctgatggtggtgctggtgatgttcatcctcaccgccaccgcccaggtcgccgggatccagatcaacctgccgaaggccagtgccaccgtggcgctgtcgcagcccaagaccaaggcgatctcggtgaacgacgccggccaggtgttcctcgacgcctacccggtgaccctgcccgagctggaggaccgcctgcgtacggagaaggccctcaaccccgacttcccggtagtggtccgcggcgacgccacggtgcagtaccagaaggtcatcgaggtcctcgacctgctgcgccgcctggagctgtcccaggtcggcctggtcaccggcaaaccgacctgaggcccgggatgaacatgtccgccgatcccaagcacacccccgagccgaaaaatgccgcgccactgtccatcgacggccgcccggcgaacccgaccctgcgctacctcaagtggggcctcggcgcgctgctgctcgccggcctcgcctggctggtctgggagtgggccaacgacatgagcggcgtgcgccgcgaggcgcccaaggtgccggcgatcatcccgctgccgccaccgcctccgccgccgccggaaaaaccgccggaaccggagcagccggtggaagaggaaaagatcgtcgagccggaaccgcaacccgaactggaggaggtcaagccgcaggaggaagcgccgccgtcgccggccgacgacctggccgacccgatgcagatggatggcgacgcccagtccggctccgacgctttcaacatcggcgccggcaagggcggcgggatggccggttccggcggcggtcgcgccggcaacgccagctatagccagtacctggcctacgccttccagcgcctgctgcgggacaacccggagctgcgcaacctggcgttccgcctgcaggcggagatctggctgagttcctcgggggatatcacccgggccgaactgacccgctccagcggcgaccccgagaccgaccagaaggtgctggccgcgctgcgcgccgccggccgcctggaagaacgcccgccggcttcgctgaccctgccggtgcgcatctccctgcanggcaagcggccgggatga

SEQ ID NO: 5749 - DNA, 2115 bp, Pseudomonas aeruginosa
  unsure (1913),(1926): Identity of nucleotide at the above locations are unknown.
aggggtcaggtcatgcaggcgccctgcgatgacgtggcgcacctcgccggaggactccaggatgccctccacctgcagcagccgggactcgaggaatggccgcctctgccgttcggcgaggtcgtgccggaccaccacgttgagcatgccgaactcgtcctccagggtgatgaaggtaatgccgctggcggtctgtgggcgctgccggccgaccaccaggccggcgacccgtatcggtcgtccatgtcccagtttcgccagttcgcgggagtcgcggcagcggcaggccttgagctgtccacgcaagagtttcagcggatgcgggccgagggtggtgccgaggagagcgtaatcgctcagcagttcctcgccgcgcgaaggcagcggcaggctgaccgtggtttcttcgatgacggtcccttcggcgaacagtggcaattgcggctcgacgctggcgacggcccagcgcgccttgtgccggtgtccggcgagaccgcgcagggcgccggcatcggccagcaactccagggcccgggcgtcgagcctggcgcgtcggccgagatcgtgcacgtcgaggaacggctgggcctcccggacctgctcgatacgcctggcatcctcctcgcgaaagcctcggatcatccgcaggccgaggcgtatggccggttgcgcctggccgaacggctccaggctgcaatcccaaccgctgtggcggacatccaccgggcgtgtctgcagggtgtggcggcgggcgtcctggagcaactggtcggggctgtagaagcccatcggccaactgttgatcaaggcgcaggcgaaggccgccggctcgtgacgtttcagccaactgctggcgtaggtgagcagggcgaagctggcggcgtgggattcagggaaaccgtagctgccgaagcctttgatctgctcgaagatgcgcgctgcgaagtcggcctcgtagcccttggcgagcatgccccgggtcagccgctcgcggtggtgttccaggccgccatgacgcttccaggcggccatcgaacgacgcagttcgtccgcctcgcccggcgtgtagtcggcggcgacgatcgccagttccatgacctgttcctggaacaacgggacgcccagggtacgttcgaagaccttctccagttcggccgatggataggccaccggctcttcaccgtttcgccggcgcaggtaaggatgcaccatgtcgccctggatcggccccggccggacgatggcgacctggatcaccaggtcgtagaacttctgcgggcgcaggcgtggcagcatggccatctgtgcgcgcgattcgatctggaacacaccgatggtatcggcgcggctgatcatttcgtaggtggccgggtcttcgctcgggatactggcgatgctcaaccgcttgccgccgcgcagcgcgtggatcaggtcgaagctgcggcgcagggcgctgagcatgcccagggcgaggacgtcgaccttgagcaggccgaccgcgtcgagatcgtccttgtcccactggatcaccgtgcgctcggccatgctggcattctccaccgggaccagggtgtccaatggctgttcggagatgacgaagccgccggggtgctgcgagaggtggcgcggaaaaccgatcaactcgtcggtcagggccagcacccggcgcaggatcggactctgcggatcgaagccggcctcttccaggcgttcggcgctgggggcctggtcgctccagcggccgcagcagttggccaggacgtcgacctgctcgggcggcagacccagggccttggctacgtcgcgcaccgcgccggcgccgtggtaggtgctgaccaccgcggtcagcgccgcgcgctggcgtccgtagcgtgtgaaaacgtacgggatgacctcctcgggccccctcgtgntaaaaaatccacntctatttccggtggttcgttgcgctcgcgggaaaggaagcgctcgaacagcaggttggtccggtccgggtccaactcggtgatgccgagggcgaagcacactgccgagttggccgccgagccgcggccctggcaaaggattttccggccccgggcgaaggcgacgatgtcctgcacggtgaggaaatag

SEQ ID NO: 5750 - DNA, 1278 bp, Pseudomonas aeruginosa
ttcggactggaatccgttgatgtcgatcctcggggtggcaaggtcgtgcgcagtgtcgttgctcggtctcggcatgctgctgccggcgtccggcgccgtgccgggcgatggcggcaggccgccgttgcgcctggcggtgcacgcgttcgatattcctccgcagagcctggcatcggcgctggtgacctacagcggggtgacgggaatggcggttctggtggatggcgagctggctcgtggacggcgctcggcccgcttgcaggggcgcttcaccgccagcgacgccctgacccgactgctcggcggaaccggcctgatggcgcgctacaccagccaggaagcgttcaccctgctgccggcgcaggccgtcaggaacgctgcgccgctgccggcagagatgccgaaggtcgagcagccgctggatcggcgctacgcgggagcggtccaggcggcgctggaagaacagttgtgtcgctcgccgcgcactcgtccgggtacctatcgcgcggtgctgcaactctggatcggtcgcttcggcgaggttcgccacagtcgcctgctcggttcgaccggcgacccgcagcgggacagcgccctggtggaaagcctgcgcggcgtgcgggtgatgcaggcgacgcccgctacgctggcccagccgctgaccatcctgttgctgccgaagacgacgggcaaggccatggaatgcaagctgacggagggagtgggagggtcatgagcgattcgcggcaaagcgcgatggtgaagctgttcctcgcctcctacgacgacttcaaggcgcgcctgaaacggcgcctgggctccgaggacctggcgtgcgacgtgctgcacgaaacctacctgagagtcgaccggctggatgatgccctggaggtcaagaagccccaggcctacctgttccgcattgccctgaacattgccgccgaccgccgcgagggcgacgcccgcctgctcaccggggaggaggtggcggaactgttgcaggtggccgacgaaggcctcgacccggagcgtatcgtcggcggtcacgccgagatccgtcgcctgctggaggcgctctgcgaactgccggcgcggcgtcggcagattctcatcgcctcgcgcctggaagagacgccgcatgcggaaatctcccgtcgcttcggcatttccacccgcaccgtggagaaggaactcaaggccgccctgtggttctgcgcggagcgcctggaaagaaaagtcatccagaggttcggtcccggggccggaaaaccgtcataa

SEQ ID NO: 5751 - DNA, 1023 bp, Pseudomonas aeruginosa
gcaggtggaaaaccgccgccatatccctcccatgagccattccggtgtccgtacagcacagtcatgacagcctcagactccgccgccgatgaaaccggcgaccttcgccccgaagcgcacgcctgggtgatcagcctgacctccggacgcgtcacccagggcgacgcgcgggccttccgccagtggtgtgcgcgcagcccgcaacacctgcgagcgttcgtcgaggcgcgcgatctctggcaggcactcggcagtgccgccgctctgccgctggagtcgccggccgtggcgcagatcgcgccgaggcgtttcggtcgtcgctggttcgtcggcggtgcgctggccgcctcggtggcgttgttcgtcttgcgcccgtcgctgctcgaccatggcctgggcggcgccgactacgtcacggcggtcggcgagcaacgccaggtgcaggtgagcggcgagacgcggatcgagatgaacacccgcacccgcctgaacgtgcggcgcaatcaagagcagcaggaaaccatcgaactgctcggcggcgaggccgagatcatcgccagccacccgccgcagagcagcctgcgggtgatggccgggagcgcctggctgagcgccagccgggcccgcttcaatgtgcgcagcagcggtgacgtctgcgtggtgacctgcctggagggcagcgtgcggctcgaacacctcggccagcgcctggacctccaggccggccagcagctgaccttcgacgagcgacgcaacggtccgccggtgcctttcgacgttgccgaggtgatggcctggcgcgagcgcatgctggtgttcaacgacgtaccgttggccacggtgatcgacgaaatcaaccgctaccgtcccggcatgctcctgctgctggacaaggcccttggccgacgtcgggtccaggcccgtttcagcctcgatcaactggccgacgtggcgaccctgatccgcgatgcctatggcatcgaggtcacccgcctgccgggcggggtggtgctgctcggctga

SEQ ID NO: 5752 - DNA, 489 bp, Pseudomonas aeruginosa
gctggtgccggggcgccgttcgtggcgcccgtcgcccatacgccaggagagcccgccatgccggccatgccccgtatcgatccgccccgcctggtccagttcgccgccgtgctggcgatcctcgccggcctgctgttctggggctatctgttgctggcgccgattcccggcgtggtccaggccgaggtcgccgacgttccgccgcccagcggcgaggacgccgctcaacgctggttcgcggcgccttccggtgaggtagaggtgcaactggcgggattgatcagcggtggtcccgcggcgatcgccatcctctcggtgaacggcgcgccggcccaggcctatcgcgagggcgaggtcctggcacgtgcggcgaaggtgcggcggatcgaggccgacgcggtgctcatcgagcagaacggcgaggttcgccgggtggccatgcagcggctcgccgaaccgccgccgctggctaccctcaagcgcggttga

SEQ ID NO: 5753 - DNA, 450 bp, Pseudomonas aeruginosa
gggtgggctcatgaaggccgcctggcgttgcctgctgccgccgctgaacgagttcgccgaggcggcgccgctgcattgtttgcgcctggatgcgcgcggcgcggtgcaggaacgaatcgaggtctcgctcgcggaactggcgcggcggcgccagggattgccggtggcgctgttcctgcatccgcgcgattgccgcctggtcagtctcgaactgccggcgctgcctgcggcgaagctcgccgccgcggtgaactgcgcggccgaggcgctggtcctcggcgatccggcgcagctacgcctggcccacggcccgcgcggtgccgacgggcgcctgaccttggggtggctggaggcgtcggcgctggcctcgctggagcaggccgtgcagcggctgcggctcgacgtgcgggaggtgcaggccgcgccgttcctcctgccgttgcgcgatga

SEQ ID NO: 5754 - DNA, 666 bp, Pseudomonas aeruginosa
ggtcccgcaggagttgcggctgttctggctgggcgagcgtccggcgtggcgctccgcagccctggagcgggccgagatgctggacgaagcgctgcgctggagcgggcccgccagtccgtggggattggcgctgaaagcgccggcgacgagcgccggcaacggcacctggaagatgcccctgttctgcgctgccctggccttgctggtgtgggtcgccggtctgaacctgtacgccgggcaactggccgggcagggccagtccttgcaacggcagagcagtcaacgcgtgcagcaggccttcccggaactgccggtggtgctcgatccgttgcgccaggctcgcgagcgacgcgacgcctatctggccggcaaggccgatggcgatgccgtaccggggctggccgcgctgctgcatggcgccggcgaggcgatgccgttcctcgccggacgcctgcaacgactggactaccacgccggcgaactggacctggagctgctgccgggaccgccaggcggcgatgccgctgcctggcagggcgagttgggcaagcacgggttgcaggccgatgcctccgacaagggctggcaggtgcgcgccatggaagcgccgccagcgccggccgctggcgcggcagacagtggcactgccgaggcggctgccgatga

SEQ ID NO: 5755 - DNA, 1068 bp, Pseudomonas aeruginosa
cgagacgccgaaggtccccggcgtgcccccggccgacgaggaagtcggccggccgctgagcagtgtccgctccggtgcgccgttgcgcagcgccgacgtccgcgagcggccccaggccgagcaagcccgccgcgcgctgagtgccgggcgcggcgtagcgcgctccggtgccgtggctccggtctcagcggcagcggccgaactcggcgagcagccggtcagcctgaatttcgtcgataccgaggtggaagcggtggtgcgcgcgctgtcgcgcgccaccggccggcagttcctggtcgacccgcgggtgaagggcaagctgaccctggtttccgaaggccaggtgccggcgcgcaccgcctaccgcatgctcaccagcgccctgcgcatgcagggcttcagcgtggtcgacgtcgacggggtcagccaggtggtgccggaggccgacgccaagctgctcggcgggccggtctacggcgccgaccggccggcggccaacggcatggtcacgcggaccttccgcctgcgctacgagaacgcggtgaacctgatcccggtgctgcgcccgatcgtcgcgcagaacaacccgatcaatgcctatccggggaacaacaccgtggtggtcaccgactacgcggaaaacctcgaccgggtcgccgggatcatcgccagcatcgacatccccagcgccagcgacaccgacgtggtgccgatccagaacggcatcgcggtggacatcgccagcaccgtctccgaactgctcgacagccagggcagcggcggcgccgagcagggccagaagaccgtggtgctcgccgacccacgctccaacagcatcgtgatccgctcgccgagccccgagcgcacgcaattggcgcgcgacctgatcggcaagctggacagcgtgcaaagcaatcccggcaacctccatgtggtctacttgcgcaacgcccaggcgacccgcctggcccaggccctgcgcgggctgatcaccggcgacagcggcggcgagggcaacgagggcgaccagcagcgcgcgcgcctgagcggcggcggcatgctcggtag

SEQ ID NO: 5756 - DNA, 1827 bp, Pseudomonas aeruginosa
caagcgcgcgatcgataccagcatcctcctcgacgacggccagatcatggtcctcggcggcctgttgcaggacaacgtgcaggacaacaccgacggtgttcccggactctccagcctccccggcgtcggttcgctgttccgctaccagaagcgctcgcggaccaagaccaacctgatggtcttcctgcgtccctacatcgtccgcgacgccgccgccggccgcagcatcaccctcaaccgctacgacttcatccgccgcgcccagcagcgcgtgcagccgcgccacgactggagcgtcggcgacatgcaggctccggtgctgccgccggcgcagcagggcatcccgcaggccgcctacgacttgcgcccgagcccgcggccgctgcgcgcggtaccgctgggcgaggcggcgccgctatgagcctgctgccctacgcctgggccaaggcgcagcgcgccttgctgcggccgggcgagcatggcgcgaccctgctggtcagcccgcgcacgcccggctgggcgatcagcgaggtgcgccagcggcatgcgccggccagcctggagagcgtccgcgacgacgagctcgacaccctgctggccagcgcctactccgataccggcagcgccgcggcggtggtcggcgcggcggagagcgaggtcgacctcgaccgcctgatggacgatatccccgaggttaccgacctgctcgacacccaggatggcgcgccggtgatccgcatgatcaacgcgctgctgacccaggccgcgcgcgatgaggccagcgacatccacatcgagcccttcgagacccattcggtggtgcgctatcgcgtcgacggcgccctgcgcgacgtggtcgcgccgcgcaaggcgctgcacgcggcgctggtgtcgcggatcaagatcatggcgcagctggatatcgccgagaaacgcctgccccaggacggccgcatcgccttgcgggtagccgggcggccgatcgacattcgcgtctccaccgtgcccaccggccacggcgaacgggtggtgatgcgcctgctcgacaagcaggccggacgcctgaggctggagaccctgggcatggctcccggcgtgctggcgccgctggacaacctgatccgccagccgcacggcatcgtgctggtcaccgggcccaccggcagcggcaagaccaccaccctctacgccgccctggcgcggctcgacgccagcaccagcaacatcctcaccgtcgaggacccggtggagtacgacctgccggggatcagccagatccaggtcaacgcgcgcatcgacatgaccttcgccgtagccctgcgggcgatcctccggcaggacccggacatcatcatgatcggcgagatccgcgacctggagaccgcgcagatcgccgtgcaggcttcgctcaccgggcacctggtgctggccacgctgcacaccaacgacgcggtttcggcagtgacgcggctggtggacatgggggtcgagccgttcctgctcgcctcgtcgatgcttggcgtactcgcccagcgcctggtgcggcgcctgtgcacgcattgccgggtcgaagaggacggcggctggcgcgcggtcggctgcccggcttgcaaccagaccggctacagcgggcgcaccggcatccacgaactgttcgtgatcgacgacgagatccgccgcctggtccaccagggccgcgccgagcaggatctccgcgaagccgcccgcgcggccggcatgcgcagcatgcgcgaggacggcgagcgctggatcgccagcggctccaccaccctggaggaaatcctccgcgtgacccgggacgcctga

SEQ ID NO: 5757 - DNA, 1185 bp, Pseudomonas aeruginosa
gcgaatcgatacgaggaccggcagccctatggctgccggtcttttttcttgtggggaacccaggaggttttcatgctcaagccaatgtttggcgtcgttgctctgacgctcttgaccagtcatacaacgctgggcgctacggtgaccggcggtggtgcttccatgccggccaagttgtacaaaggttctgccgacagcatcctgccaatcaacttcagctatgccgcaagcggcagcggcattggcaagaccgctttcctgatgaataaccccatgctgcttggcgctactaccggcaccgtccactacattggtagtgactcgatcttgagtagcagcgaactgagcgcctattcaaccaactatagaggcgcatatggtccactgatccagattccattggcgggtaccgcagtaaccattccttacaagaagcccgatattaccgacctgaacctgaccagtgcccagctctgcgatgccttttccggcgccaaggtcacttgggggcaactattggggaaccccgccgaccgtacgccgattcgtatcgtctaccagcggggcggcagtggagccaccgagttgctgacccgccacctgaactcggtctgcccgactcgcttcgccaccaactcgatcttcacgaacgcccgtctgccggccggcggtgcgctgccgagcaactgggtggcagtacagccttatgaaagtgtcaggaatgccgtcgacaatgtgtcaggctcgatcggctatgaggggcctgatggtgtggacctgagcgacaattcaaagatcgcgcgagtgaatggcttgctccctactctagccaatcgcgtgatcgctgttcgtagcgtggctccgccgggtgtcgctgcagatcgcgccgatccgagcaagtggataccggtcttcgtcaacccgaacgcaggctactccatcgtcggctataccaactttgtctttggccagtgctacaaggatgccactgttgccgccgacctgcgtgccttccttacccagcattatggcggcaccactacaaatagagcggtagctgaccaccgtttcgtacccctggtcgcttcctggaagagcgccatcatgagcgccttcatcactggtaccagcgaaaatctcgcgatcaacaatccctccgtctgcaacggcaaagggcgtccatga

SEQ ID NO: 5758 - DNA, 588 bp, Pseudomonas aeruginosa
agccgctggcccaggccatcgccctgctgctggtcgcagggggcgcccaggccgccgggcagccgttcagcgccgcttggttcgctgccaagggtgtggcgcagggcggcgctgccggggcgccgcgaccgggagcgcagtagcccgggggcgccgccgccgctggcgcagcagcagcgggtcaaccagcagttgcagcgttcgatggccaacttgaacaacaccgtctccgccatagccgcccagcaggccgcccagtccgccggacgccaggcggcgctgaaccttccgcaggatgttccggacggactcggcgagggcggcctcaaggtcgacgcctcgatgccgttcgagcaggcgtggcagaacgccaagggaccggtgcagacccaggccggcggcaagaccacggtgagcatcgagcagaccgccgacaaggcggtgctcaactgggagaccttcaacgtcggccgcaacaccaccgtggacttccagcagcacgccgactgggctctgctcgccgggtcaacgaccccagcgcgcggcccagccagatccaggggcagatcaaggccgacggcacggtga

SEQ ID NO: 5759 - DNA, 3390 bp, Pseudomonas aeruginosa
ccggtgccgggggcgctctcgctgctgggacactggttgcgggagtcggcctttatgccagcgaggtcgatgtgcaacagggcgcgcggctggacctgtccggcggcggcgaactcgcgggggctggattcatctccggcagagggggttcgaccgatgcgcgttttcatcccctggtgcagcaggacaatgatgggttccgtctgccggagctgtccagcaacccggtgtatgccatcgtgcctggacaccagggccgttagtgcgccattgggcggcgaggcgggcgccatccagccgttggtcgggcaacaggtcaccatcgggggtggcgttcccggcctggccgccggtacctacaccttgctgccttcgacctatgccctgttgccgggcgctttccgcgtcgagatcaacggtctggcggggcaaggcgcgcccatggcgacgcaggggttgcgcaatggctcctgggcgacgtccgggcagttgtcgattgccggcacgtccatccgcgacagtctgagccgtcaggtcatcctgtcttccgccgatacgctgcgccgctactcgcagtacaacgaaatgagctatgcggatttcattcgcgccgatgccgcgcgcaagaacatccccagagcgatgttgccagtggatgccagatccctctacctgggattgcgcgcggatgaggagcttcgggaaaacgccctgagcttcgaggggaaggtcgacttcacgccggaagaaagcggatatggcggcagcctcatcgtggatgccgaggcgggcatcgagattctgcctgaaggtgggctgcccgactccgatttcgctggcgtgtcgttggttgcggacgatctgaatgcaataggcgccagccgtatcgccattggcacgctgccctacgtcgaatacggcgagcaaggaaacttcgtccagttcggcgggagcaaccggctctttcccgttgtgctgcgaaagggcgcgcacctttccgcaccggaggtgatcattggcagggatatcacccttgaaggcgggagtggcatcagcactctggggaaaggcaagactgcatacgattcgtccgatggtttcatctatcaacccggcggccgtaacctgctgctcttgtccaacggatggctgaacctgctggcacccgcagcggatagctcgttaccggttcgtctcggaggttgtgcggaaggggcgggctgcgccgacaccgaactctattcggagggcactctgggtatcgccaccaatggtacggtgacgtttggcgacaacgttcgttacgggacacgcaatctcagcctggcgctgagtacgatcaatatcggctccagccagtcgctggccgacgcggccgctcgcggcgtgttgccgaacggcctggcgctggaccagacggtgctccagcgcctgctgcgcggcgagcgcggggcgggtattccggccctggaaaacctgattctcagcgcccgcgacgcggtcaacatgtacggtagcgtcagcctcgacacctacgacccggccaccggcaaatccagcctggccaacctggtgctgggcaccccggccatctacggccatggcaccggcgaggatgtcgccagcattcgcaccgccagcctggtctggagcggctccagccagccggctgcggcaccggtcaccggcggcgccggtagcggcagcggaaccctgcgggtggacgccgagcgcatcaccctgggctacggcgcgaatacccagccggccggcgagaccgacgaggcgcgcctggcgctgggcttcgccgaggtgcaactgaacgccagcgagcggatcagcgccaaccacaagggcagcttgcgggtctaccagcgcctggacggctacgtcgccggcgaaggcttgcactacagcggcggcgacctgcgcctgagcacgccgttgctgaccggcgaggccggttcgctgagtcggatcagcagtggcggtagcctcagcctggcggctccggcgggcgctgccgcggtgaccttcgacagcggcaccgccgggcttggtgccgagttgtccctcagcgcccgcgagatccgcctggatagcgcggtctcgctacccagcggcaagctgagcctgagcgccgaagacgacctggagctgggcgatggcgcgcgcatcgacctggccggacgcaaggccagcttcaacgatgtggataaatacagctggggtggcgacctgctgctgagcagtcgcgccggcgacatccgccaggccgccggttcgctgatcgacctgtcggcgcgcaacaaccgcggcggtaccctgagcgccgtggcgttggccgaggacgccgggatggtggacctgcagggccgcatactgggtggcgccagcggcgactacgatgccggcggcacccgcgtgccgttcctcggtggcgagctggagatccgcgcccagcgcctgggcgatggcggcagcctgagcgagcagttcaccgccttgaaccagcgcctgaaccagggcgaggtcttcggcgcgcggcgcttccagctcaagcaaggcgacctgcagatcggcgacggcctgaaggcgcatcgcatcgaggtgtccctcgacaatggccagctcggcgtgagcggaacggtggacgccagcggcgcgcaggtcggcgagatccgcctggccggtggccgcggcctgagcctgggcggcaacgcgctgctggatgcgcatgggagcctgctgcggcgcgacagctacgggcagatcatcgacagcccgaaccgggcgatggttgagctgagttccggcagcggcaccttggtcctggccagcggcgcgcgcatcgacctgcgccatggcaccgcggcgccagcggaacaggttgatggcgtcgcccgtggcacgttggagttgaacgcgccacgcctgggcggggtcagcgccggcgacatcgccatcgatgccagcggcgcgctggacatccgcggcgccggcagcatcgccctgaacgcggtgcagcgttacgacgatgcgccctggggcaacgatccggcggccggccgggcggccctaccaggtgatcgaccaggcttacctcgatgcgcggcatgccgagagcagcgcgttcatcgccgcggcgctggccaaccgcgagttgctcgacggcaagctggccggactgaccaatgccacctacgcggatgctttccacctgcgtccaggggtggagatcgtcagcgcaacggcggacggcgacctggtggtgcagggcgatctcgatctgtccggctaccgctacgccagcctcaatccgaacacgccgctgaccgaggtctacggttccggcgaggtcggcgcgctggtgctgcgcgccggcggtga

SEQ ID NO: 5760 - DNA, 639 bp, Pseudomonas aeruginosa
cctgaacctctacggcagtatcaacgacggcttcgcgccgccgccggactcgccggacgacaagggctggatcctcaccccgggggtgcagccgttcggcggcgacctggtggttcccggcccgggcgtggtgctcggcgacggtaccgcgttcctcggcggccgcaccctcaactacgacctgccgatcaagggcaccaccctggccgccggcacccgtctggccaccgaggcagtactcgaacagccctataccctggccgccggcagcgtgctggtagcggacatccacgatgccgccggcaacctgctgtacgccgcgggcagcctgctgcgcgacggggtgacgctggaggtcggcagccggctgggtgccggtaccctgctggcggcaccggccagcgtgcaggcgatgacctggcctgcgggcgtgcccttgccgagcatcctgcgcgaggggcccagcagacccaatgtcctgctgctcaatggagagctggccttggcacgtggttctctgatcccttcgcagaccgaggtggtactggctggcgatgcgcctttcatcgagttgcggcccagcgacggtgtccgccagggacgcaactgggcattggccgagatgctgccggccggtag

SEQ ID NO: 5761 - DNA, 192 bp, Pseudomonas aeruginosa
ggaaaacggaattcagtggtgaaaggcagggacgggaacgaaaggaatcggccatttcccggttgcgctgaccggttgctggaaatgagcgtgtcgttcgagcaagacgcgttccgctctgaaacaagagaacagtatccgctaacggccgtggtcacaccggtgaatacggcgaaggacggtgagtattga

SEQ ID NO: 5762 - DNA, 1761 bp, Pseudomonas aeruginosa
gggcgggcgccgtttttaacaggttgttcatgcgtcgccgctagtttgttgtctttcacagaactgttcgatgaacggacttgttgcattagaacaataagtcccgatggaacttcgggggaccgtgtgaagcgttcgctgttcaattgtgcgcacccgtttcgccagcgctggtcgatcggttgcctggctgtcgcattgtcgtgcgcttcgctggccgacgaggcccctcccgccgcggcgggagccgagacccagcgtctggtggacatcaacgagtacgtggtacgcggcaacaccgtgctggacaaccgcgccatcgaggcggcggtgtatcccttcctcggaccgcagcgcagcctgggcgacatcgagggggcgcgcgatgcgctgcaggccgcctaccaggagaagggctaccagtcggtctacgtcgagctgccggagcagcaggtgagcggcggggtggtctacctgcaggtcaccgagaccactgtcggtcgcgtccgggtggtcggcgccaagcactattcgccggtggagttgcgcgaggaagtgccggccctggaggagggcaaggtgcccgacttcgcccaggtccagcgcgagctggcgcaggtcaaccgcacccccggccgccaggtgctgccgatggtgcgcgagggccagcggcccggcaccatggacgtcgacctgcaggtggaagacaagaatccctggcacgccagcatcggcctgaacaacgactacagcgccgacacccgtcacttgcgctcggtggtttcgctgggctacgacaacctctggcaactcggccacgccatctcgctgacctatttcaccgcgccgcaggaccaggacaacgccaaggtctggtccggctcctataccgcgccgctgagccagcgctggagcgtgcagctgtccggctaccagtccgacagcgacgtggccacggtgggcagcatgaatgtggtcggccagggccattcctatggcgtggcggcgatctacagcctgccggtgaccggcctctggtcgcactcgttctccttcggcgtcgacttcaaggacttcgaggaacagatccggatcggcggcaacaacgacagggtgccgatcaagtacgccccgctgaccctcggctacaacggtttccgctacaccgaacgttcccagttggcccttggcctgagcctggtggccggtaccggcagtctcctcggctacggcgacgacgacgaggaattcgaccgcaagcgttatcgcgccaagtccggcttcggcgtgctcaagggcgatctcaaccacaccctgaccttcggcggcgactggcaggtggcgaccaaggcggccttccagctcgcctccgggccgctgatttccaacgaacagttcgccgccggcggtgccaccagcgtgcgtggctacctggcggcggagaacaccgccgacgacggctatctgctctcccaggaatggcgtacgccgtccctcggacgcttcctcggcaagcgcgccggcggctacgtcaacgactggcgcttctacgtgttcgccgagggcgcgcaactgcgcctgcaggatgcgctgcccgaacaggacgacgacttcagcctggccagcgtcggcatcggcacccgcgcgcaactcgccgactggctgtccggcagcctcgactgggccttcccgctgctggaagggacgaacaccgacaaacacgactcgcgcctgcatttcagcgtgcaggcgagcttctga

SEQ ID NO: 5763 - DNA, 438 bp, Pseudomonas aeruginosa
acggtcagcgcgctgccgccagccaggccctggcgcaggggcaatggcagcatctggcgctggtcgccgacggtacccggctggcgctgtatctcggggggcgcgaagtcgccagcctggcggcggcgctgccggcgttcagcggtgcgatcgccatcggcgcggaaggccaggccgcgcctgcggtcgccaccgaagcggcaagcggggaaggtgaggcgagcgccgcggcgccgaccctgcaacccttccagggcgccatcgacgagttgcgcctgtcgaagatcgcccgcccggcggcgctgctcctcgccgacgccaccgcccagggcgccgagtcgcgcctggtggcctacggggtcgacgagaagcagtccggcttcggcttcggcaagctcggcttcctgctcaacgcagtgccgctggatgcctgggtga

SEQ ID NO: 5764 - DNA, 900 bp, Pseudomonas aeruginosa
aggagatccgcacccgccgcgagcagggcgccgacacctcttccgtctccgcggccaccatcgaggcgatccgcgcctccatggacggcgtgcgcaccaaggagaaccagcagctcggctcgcgcctgtcgagcctgtccaacgccatcgccggcggcccctacatcggcctgctcggcaccgtgctggggatcatggtggtgttcctcggcaccgccatggccggcgacgtcaacatcaatgccatcgccccgggcatgggcgccgccctgctggccacggccatgggcctgttcgtcgcgatccccgcgttgttcggctacaaccgcctggtcacgcggaacaaggaagtcagcgcggacatgcgggtgttcgtcgacgagttcgtcacccgcctcgccgaggtgcatggcgaaagccagctcagcgaagtggcccatggtcgcaacggccagccgttgccggcctgaggagaacgccatggcttccgtgaacagcagccacgacgatgacgacgacggcgccgtcgacagcatcaacatcaccccgctggtggacgtgctgatggtggtgctggtgatgttcatcctcaccgccaccgcccaggtcgccgggatccagatcaacctgccgaaggccagtgccaccgtggcgctgtcgcagcccaagaccaaggcgatctcggtgaacgacgccggccaggtgttcctcgacgcctacccggtgaccctgcccgagctggaggaccgcctgcgtacggagaaggccctcaaccccgacttcccggtagtggtccgcggcgacgccacggtgcagtaccagaaggtcatcgaggtcctcgacctgctgcgccgcctggagctgtcccaggtcggcctggtcaccggcaaaccgacctga

SEQ ID NO: 5765 - DNA, 408 bp, Pseudomonas aeruginosa
gcggcgtgcgccgcgaggcgcccaaggtgccggcgatcatcccgctgccgccaccgcctccgccgccgccggaaaaaccgccggaaccggagcagccggtggaagaggaaaagatcgtcgagccggaaccgcaacccgaactggaggaggtcaagccgcaggaggaagcgccgccgtcgccggccgacgacctggccgacccgatgcagatggatggcgacgcccagtccggctccgacgctttcaacatcggcgccggcaagggcggcgggatggccggttccggcggcggtcgcgccggcaacgccagctatagccagtacctggcctacgccttccagcgcctgctgcgggacaacccggagctgcgcaacctggcgttccgcctgcaggcggagatctggctga

SEQ ID NO: 5766 - DNA, 1287 bp, Pseudomonas aeruginosa
tttaggttgcattttaaaaccaaaattcctagcctccgctttagtttcatattgaaaccttacggagcgcttcgcatgccatcctcgccatcctccctcccctccgcgctggtgctgctgttcgccgtcgcctgcggtctcagcgtggccaacgtctattacgcccagccgctgctggacgtcctcggtgccgagttcgccatcggccaggccggggtcggcctgctgttcggcgcgacccaggccggttgcgccctggcgctgctgctggtggtgccgctgggcgacctgctggagcggcgccggctgatgttcgtccagctcctgctgctggtgctgtcgctgctgctggtgggcttcgccggcgataccctcggcctggcgctggggctgctcggactgggcctgctcggcaccgccatgacccagggactgctggcctacgccgcggcgctggcggcgcctggcgagcgcgggcgggtggtcggcgcggcgcagggcggcgtggtgataggcctgctgctggcgcgcagcctggccgggctgctcgccgacctcggcggctggcgcagcgtctacctggtctcggcagcgagcatgggcgggctcggcctgctgctctggcgggtactgccggcggcgccgagcaacgaactggggctgacctaccggcaactgctcggctcgatgttcgacctgctggcgagccagcgcgtgctgcaggtgcgcggcctgctcgggctgttgatgttcgccgccttcggggtgttctggagcagcctggtattgctgctcggcgcgccgccgcattcgctgtcgcacagcgccatcggcgccttcggcctggtcggcgcgctcggcgcgctgggcgcggcgcgggccggcagcctggccgatcgcggccacgcccaggcgctcagcggcggcgccctgctgctgttgctgctgtcctggctgccgctcgccctcggcgcgcattcgctggcggcgctgattctcggcgtgctgctgctcgatctcgccggccaggcgatccatgtgctcaaccagagcctggtcttcgccatcgacccgcgcgcccacagccgcctggtgggttgctacatgctgttctacgccgccggcagcggcctcggcgccagcgccggcaccgccatgtacgcctgggccggctgggacgcggtgagcctgctcggcgcggcgatcagcctggcggccctggcgttctggtggttcacccgtggcgttggcggcgaagcgcgtacggcctgcgccaacggcgcctga

SEQ ID NO: 5767 - DNA, 1986 bp, Pseudomonas aeruginosa
ccggcgcggcaatcgcaccggggtgatcgcccatgccaagaccctgacctcggtcgccccgcgcggcttcatcgccaccgacggcatcggtaccttcaccttcacgccaccctcggagttgttcacctcgcgcgaatgggacgtgatctacctgctgctttccggcctctcggaaaaagaaatagccgaacagatcagccgctccctgagtaccgtcaagttccacaagagcaacatcttccagaaggtcggttgcagttgcatcggcgccttcaaggcactcgcccggcaaaagaagtggaacttctatatcccgccgaccttcgccagcgccaagtacatcatcaatcactagtcgcgcctcgcgagagccttcggcgtgccgggcgacgcttttgccggcgaaaccgagcggttcgaatggacaaggacaacagcatgtctcgaaacaatccttcgcgtcattcaatactcgtcacttccaacataaacgcggccaatgatgcgaatcgtctttccgagctttgtcgacaactggaaatacgcggctatcgactcttccaggcgccaagccgcaaggtcgccctggattttctcggcaacgccgcgcaccccgccggcatcctcctgctcgtcgcggagccgacaggcgagaacgaagccgcacaattagcggcgctcgatgacttccgccaggtcgcgccgtccatcccgctgttcctgttgtttcgtcaactgcgcatcgagcagttgtccagccagctactggacgaggtccagggatgcttcaacctggccgccggccccgcacgcttcatcgccgagcgcatcgacagcgacctgcgtgaatggcgcgccccggcgggccccaggcggctgcgcgactatgccccgccggtcccgcgcacgccggtgagcgcccgctacaacggccgcgcacgcctcgatctggcgccggccaagcagtggcggatcggctcggagagcaccgcggagcacctggcgacgccgctgaacgacctctccacggcctaccgcaagacgtccgcaggagccccggcggcgcacgccggcgacatcgccgaggcctttcgccgggcgctctgggaagccgccgcgcggctcgccagggaggatggcgatacgtggttcttcgagatactgcggggcaacccggggcctggcatcgaggccggccgggagacgccggcgaagcgctggcacgggctcgccgagacactcgacagcagtcctctgctggacccgctgcgcgtcgccctgagcgcccccggcctcgattcgcgcggtcgcccggccagcttcggagtacccgccgcggtggtctgccgctacctgcgccggcacggcatcgccccgttgcgcaccggcgactatcgcttcctgctgctgtttccccagggcgccagggcggaacacgcgcagccgctggtggacaggctgtgcgaattcaaacgccggcacgacgacaatgcgccgctgaagcaggtgttgccggagttgctcgacagctcgccgctgtaccgctacatcggcctgcgcgaactctgcgcgatgatccacgaagccagcctgcggctgcacctgaccgccctcgccgacgccgccgccagggctgccggccacgccgcgctggcgccggccacggtctatgggcacctggtcagggacgaaaccgaagcggtggcgatcgacaggctcggcggccgtgtggtcgccagcctggtcggcgtccatccggcggccgcgccgctgctgttgcccggcgaacgggtggccgatgaatcgccggcgctgatcgactacctgctggccttgcaggccttcggcgagcactttcccggtttcgctcccgagttgcagggcatcgagatcgatgagcgcggccgctaccgggtccgttgcgtcaggccggccgccctcgcccgcggctccggcctgcgcctggccacgcgccggccggactga

SEQ ID NO: 5768 - DNA, 1539 bp, Pseudomonas aeruginosa
gttccaggcgctggacgaaggcctggaggatgcgccggtagagttcgtcgccgagctggcccgtcctcgacgccggcatcgatattcgggttgtcgttgacctcgatgaccagcaccttgtcgccggcctgcttcaggttccaccccgtagaggccgtcgccgatcagcccggcggcctccagggccagctccagcaccgccggcggcacctgctccagcggcacggcgcggcactcgccgttgacgtcctgcccgtcggccttgtggttgtagatctgccagtggccgcgcgacatgaagtactggcaggcgtacagcggttggcggtcgagcacgccgatgcgccagtcgtactcggtgtagaagaactcctgggccagcaacaggaccgagcgctcgaacagctcgctcgccgccgccagcagttcgctgtcgtcgttgaccttgaccacgccacgggagaagcagccatcgggaatcttcagcaccagcgggaagcccaggcgccgggccacccgctgccagtcctgcgggcgttccttgtagaggatctcggtgagcggcatgcccagttgccggcaaccaagcaggtcggccaggtagaccttgttggtgcagcgcaggatcgatgccgggtcgtccatcaccaccaggccttcgcgctcggccttctcggcgaagcgataggtatggtggtcgacccgggtggtctcgcggatcagcagggcgtcgaactcggccaggcgcgcgtagtccttgcgtccgatcagttcgacgtcgatgccgaggctggcgccgacccgtacgaagttggccagcgcctgcgggttggacggcggcagcgcttcgtcgggatcgtggaggatcgccatgtcgtagcgtgccacccgccgcgaacgcggcatgcgccaggcgcgccggctgaaaccgtcgagggcatcggcgaagacatcctcctggtcgctgcgcaagcggttcagcacgccagggcgcacgccctcgatatgccagccctgctggcgacggaactccaccagcaggatcggacagggaaaggcttcgaacaactggcgcgcgaggtcggccagcggctcgaactcggtatggccgaaatacagggtcagggtgaagccgtcggtggcgccatagggcgtacggcacagcgccttgtccagggccttgtcgaggccacccagggccagcccgtacaccgacttgcgagccagttcgctgatgcagcgcagcgacgggatcacccggtggccacgggcctcggccagcagcgaacagtattagccgaggccgaggtacttgtagccgcggcacaggttgatcatctgcacgcggcggccgccgtggtcgtgcgccgattgctcgaggtattcctgggcggtgagtacttcctcgctgggcaggtaggaggcccagtcctcgcgtcgctcgacgacgatcatcaggcggctgccgaggtcggcgagagccggcggtcggggttgctcgacgggggtcatgcggagcgacccgtcgagggtggctaa

SEQ ID NO: 5769 - DNA, 1233 bp, Pseudomonas aeruginosa
catgagtggcggtatcctctgaatgacggtacctgccgttctagacctgccggcgcctcctgtcgcgcctcgttacgcaagctttacgagcgccgccgccagacgccggcgcggcaaccggccagggccgccgggtaccgcgccgcgagtgccgaggagcatttttacgctggcgttgcgcgctcgtcaggccaggctgtcgagcaccccgccgtcgacccgcagggccgcgccggtggtcgccgaggcctgggtcgagcaggtgtagaccaccaggttggcgacttcctcgggcgtcgccaggcgctggatgatcgaactggaacggtgctgccggacaaaggcggtgccggcctcttctatgctctgcccggccttctgcgcatcctcgcggagcatctcggcgacgccttcggtgagggtcggtccgggcagcaccgcattcaccgtcaccccggtgccggccaggcgcttggccaggccgcgcgacaccgagaggttggcggtcttgctgaagccgtagtggatcatgtccgccgggatgttcaacgccgattccgaagacaggaacaccactcgcccccaaccccgctcgaccattcccgggacgtaggcgcgggccaggcgtaccccggacatcacgttgacctcgaagaagcggctccactcggcgtcctcgatgtcgaagaagtccttcagctcgaagatgcccaggttgttgaccaggatgtccgccttcggctcggccgcgacgaaggccgcgcagccttccgccgtgcccaggtcgccggcgacgccgcgtatcctggcatccggctggccgttccggatcgccgcgatcgcacggtccaccgccgcctggctgcgtccgttgaccaccacggtggcgccggcggcggcgaggccgctggcgatggcgaagccgatgccggcggtggaaccgctgacgattgccagtttgtcgctcagatcgatctgcatgggagtctcctgtcgagtgacgaaccgctcaggaacgcggctcggggaacagacgacagcctagaccagccagcgttccgtgcccgccctgggcctcagagacgcaggccgaggttgatcatcgccgccgaattgccgagcagcaccagctcgctgcccagcgggccgaagcgaacgcccaccgaggggatgatcgccggcgcgacgccgaagcggttcagcgggatcttgtcgcggtattcgccgcgatag

SEQ ID NO: 5770 - DNA, 2007 bp, Pseudomonas aeruginosa
gctggcatgcatcctgccactacactgttcggcaagcacgatactctcgtggcttcccccgccggggaaaaccgcgaaacaccctgtcccggagaggccaggcgctcgcggctcaataaaaatcaaaacaagtcgaggaagaaattcatgcgtatcgctcccagtctgctgagcaccgccatcgtggccgctctgttgtccgctccggtcgtcgctgacgagctcaccggcacgctgaagaagatcaaggacaccggcaccatcaccctcggtcaccgtgacgcttcgattcccttctcctacctcggcaccgagccgggcaagccgatcggctactcccacgacctgcaactgaaagtggtcgaggcggtgaagaaggaactcaacctccccgagctgaaggtccgctataacctggtcacctcgcagacccgcatcccgctggtgcagaacggcaccgtggacatcgagtgcggctccaccaccaacaacgaagagcgccagaagcaggtcgacttctccgtcggcatcttcgaggtcggcacccgcctgctgtcgaagaagaccgccaacatcaaggacttcgacgacctcaagggcaagaacgtggtgaccaccgccggcaccacctccgagcgcctgctcaaggccatgaacgcggacaagaagatgggcatgaacatcatctccgccaaggaccacggcgagtccttcatgatgctcgaatccggccgcgcggtggccttcatgatggacgacgcgctgctctacggcgaaatggccaaggccaagaagccggacgactgggtcgtcggcggcaccccgcagtccttcgagatctacggctgcatggtgcgcaagggcgacgcggcgttcaagaaagtggtcgacaaggccatcaccgatacctacgccctccggcgaggtcaacaagatctacgacaagtggttcacccagccgatcccgccgaagggcctgaacctcaacttccccatgagcgaagagctgaagaagctgatcgccagcccgaccgacaaggccgccgagcagatgtaacgagcgcctggcgttcctcccggagcgccagcgcttcgcgcgtcgcccccgcctcgcagcggggcctcggggacgcggggaggggcctgcccctccccagccgtctcccccggaagagcagcgccgccggcccgcacggccgcgccggcgcctgccttccccgccagtgtctgcaaccgattgaaccgaggggaaaccccaacatgaattacaactgggactggggcgtgttcttcaagtccaccgggatcggcagcgaaacctacctcgactggtacatcgccggtctgggctggaccatcgccatcgccctggtcggctggatcatcgccctggcgctgggctcgctgctcggcgtcatgcgcaccgtgccgaaccgcctggtatcggggatcgccaccgcctacgtggaaatcttccgcaacgtgccgctgctggtgcagctgttcatctggtacttcctggtacccgacctgctgcccgagggcctgcagacctggttcaagcaggacctcaacccgactacctcggcctacctcagcgtggtcgtctgcctcggcctgttcaccgccgcgcgggtctgcgagcaggtgcgcaccggcatccaggcgctgccctacgggcagacctcggcggcccgcgcgatgggcttccgcctgccgcagatataccgccacgtgctgctgccgcaggccttccggatcatcatcccgccgctgacctcggagttcctcaacatcttcaagaactcctcggtggcgtcgctgatcggcctgatggagctgctggcgcagaccaagcagaccgccgagttctccgccaacctgttcgaggccttcaccctggccacgctgatctacttcacgctgaacatgagcctgatgctgatcatgcgcctggtggagagaaaggtcgccgtaccgggcctgatctccgtaggaggtaaatga

SEQ ID NO: 5771 - DNA, 807 bp, Pseudomonas aeruginosa
ccgtatgatttccatcaagaatgtcagcaagtggtatggcgacttccaggtcctgaccgactgctccaccgaggttgcgaaaggcgaagtggtggtggtctgcgggccgtcgggctcgggcaagtcgaccctgatcaagtgcgtcaacgcactggaacccttccagaagggcgacatcgtcgtcgacggcacctccatcgccgatccgaagaccaacctgcccaagctgcgctcgcgggtcggcatggtgttccagcatttcgagctgtttccccacctgagcatcaccgagaacctgaccatcgcgcagatcaaggtactcggccgcagcaaggaagaagccaccaagaagggcctggccctgctcgagcgcgtcggtctcaaggagcacgcgcacaagcaccccggccagctctccggcggccagcagcagcgcgtggcgatcgcccgcgcgctggcgatggacccggtggtgatgctgttcgacgagccgacctcggcgctcgacccggaaatggtcaacgaagtgctcgacgtgatggtccagttggcccacgaaggcatgaccatgatgtgcgtgacccacgagatgggcttcgcgcgcaaggtcgccaaccgggtgatcttcatggaccgcgggcagatcgtggaagactgcgagaaggaggagttcttcggcgacgtcagcgcccgctccgaacgtgcccagcagttcctcgccaagatcctcccgcactgatgtacccgccctcgccggcccgcccggcgggggcctgctccaccctcgcctgcgataacaataaatag

SEQ ID NO: 5772 - DNA, 1683 bp, Pseudomonas aeruginosa
ggaaagcccatgcaacctgtgctcttcagaaccctgtccctcggcgtcgccattgccgccgcatcctcctcggccttcgccgccacgctcgacggcggcgccgtcgccgcgcccgacgagtacggcgccaaggtcgccgcgcagatcctcaaggccggcggcaacgcggtggacgccgcggtggccaccgccttcaccctggcggtcacctaccccgaggccggcaacatcggcggcggcggcttcatgaccctgtacatggacggcaagccgtacttcctcgactaccgcgaggtggcgccgaaggccgcgagcaagaccatgtacctggacgacaagggcgaggtgatcgagaacctcagcctggtcggcgccaaggccgccggcgtgccgggcaccgtgatgggcctctgggaagcccacaagcggttcggcaagctgccctggagcgagctgctgaccccggccatcggctacgcgcaaaagggcttcaaggtcgccgacaagcagttccagtaccgccaggacgccgtcgccctgttcaacggcaagaccaacttcggcgactacttcggccacatgaaggccggcgaggcgttcctccagccggacctggcgaagaccctggagcgtatcgccgacaagggcccggacgagttctacaaaggccataccgccgacctgctggtggcacagatgcagcaggacaagggactgatcacccaccaggacctcgccgactacaaggtcaggtggcgcgaaccgatgcgcgtcgactggcagggcaacacgctctataccgcgccgctgccaagctccggcgggatcgccctggcccagttgctgggcatcaaggaaaaccgtgccgccgacttcaagggcgtcgagctgaactccgcgcgctacatccacctgctggcggagatcgagaaacgcgtgttcgccgaccgcgccgactacctcggcgacccggacttctccaaggtcccggaggcgcgcctgaccgatccggcatacctgaagcagcgtgccgccgaggtcaatccgacggcgatctcgccgaccgagaaggtccgtcccggcctggagccgcaccagaccacgcacttctccatcgtcgacgccgacggcaacgcggtgagcaacacctacaccctcaactgggacttcggcagcggcgtggtggtcaagggcgctggcttcctgctcaacgacgagatggacgacttcagcgccaaaccgggcgtggccaacgccttcggcgtggtcggcagcgacgccaacgccatcgagccgggcaagcgcatgctctcctcgatgagcccgagcatcgtcacccgcgacggcaaggtcagcctggtggtcggcactcccggcggctcgcggatcttcacctcgatcttccaggtgctgaacaacatctacgacttccacctgccgctggagaaggccgtggccgcgcagcgcgtgcaccaccagttgctgcccaaggacacgatctactacgacgcctacgcgccgctcgccggcaaggtcgccgaggagctgaaggcgatgggctacaccctggaggaccagggctggaacatgggcgatatccaggccatccgcgtcgacggcaaggccctggagaccgcctccgatccccgtggccgcggcgtcggcctggtggtgaaaccctga

SEQ ID NO: 5773 - DNA, 2748 bp, Pseudomonas aeruginosa
cgacgacgtcgacggcatcgtgatcacccacggtaccgacaccctggaagagaccgcctacttcctgaccctggtcgagcacaccgagaagcctatcgtggtggtcggctcgatgcgcccgggcaccgcgatgtccgccgacggcatgctcaacctgtacaacgccgtggcggtggccggcgacaagtcggcacgcggcaagggcgtgctgatcaccatgaacgacgagatcctctccggccgcgacgcgagcaagatggtcaacatcaagaccgaagcgttcaagagcccgtggggcccgctgggcatggtggtcgagggcaagagctactggttccgcgcaccggtgaagcggcacacggtgaactccgagttcgacatcaagcagatctccgcgctggctccggtggaaatcgcctacagctacggcaacgtcagcgacaccgcctacaaggccctggcccaggccggcgccaaggcgatcatccatgccggcaccggcaacggctcggtgcccgcgcgcgtggtgccgaccctgcaggaactgcgcaagcagggcgtgcagatcatccgctcctcgcacgtcaatgccggcggcttcgtcctgcgcaacgccgagcagccggacgacaagaacgactggatcgtcgcccacgacctgaacccgcagaaggcgcgcatcctggccgcggtcgcgatgaccaagacccaggacagcaaggagctgcaacggatcttctgggaatactgagtgaacccttccggcgccgcctgccggccgtgccggaaaaccgcccgctccgccgcccatcgtggcggcgggctggcctatccgcgacgactgtgatggaatcccccgacccgccctgcagcgtacctccgtcactgaccgtgaagccccgcctcgtccgccagttgctgctccccattcccctgctcctgctgatgctcggcttcggctacggcggctaccggatcagcgagagcgccggcatccgtgccctcgccgagaatggcgaacgccagctggagctgcatgcacggacggtcgagagcgagatcagcaagtacacctacctgcccagcctgctggagctggagcgcagcgtcagtcacctgctcaccgacccgacgccataccggcgcaaccaggtcaacgcctacctcgaaggcctcaaccgccgcgccggcagccgcgcggtgtacctgctggacaccaacggccgggtcctggccaccagcaactggagcgacccggacagctacctcggcgaggacctgtcgttccgcgcctactggcaggacgcgatgaagggcaagccgggccgcttctacggcatcggcagcacccgcggcgagccgggctactacctggcccacggcctggtccacggcggccggatcatcggcgtggcggtagtcaaggtgaagatggacgccctcgaggaacgctgggagaaggcgcgcctggaagccttcgtcagcgacgagaacggcatcatcatcctctccagcaaccccgccctgcgcctgaaggcggtgcgctccctgagcgccgacgacaaggagcgcctggcgcgcagcatgcagtactactggtgggcgctgaacgagtggcaaccgctgcagcgcgagccgctggccgccggtgtggagaagctcagcttccccgccgatgagcagcatccgcgcggcgaagcggtcacctacctggcgcagacccgcgcgctgaacgacacaccgtggaacctgaccctgctcagcccgctggaagacctgcgccgcgacgcggtgcgcaacggcatgctggccgccatcggtttcgccctcctggcattcctgctgatcgcctggaacgagcggcgcaaggtactcgccacccgcctcgccgcgcgcgaggcgctgcaacgggccaacggcgagctggaagtgaagatcgccgaacgtaccgccgacctgcaggccagcaacgcacgcctgaccgccgagatccacgagcgccagcaggccgaggacaccctgcgcaaggcccaggacaaactggtccaggccggcaagctggcggtgatcgggcagatgtccaccagcatcgcccacgaactcaaccaaccgctggcggcgctgcgtacgctgtccggcaacaccgtgcgcttcctccagcgcggcaagctggagaccgccagcaccaacctcgccaccatcaacgaactggtcgaccgcatgggccgcatcaccgccagcctgcgtgccttcgcccggcgcagcgacgacgccggccaggccagcctggccaaggcggtggacgcggcgctgctgatcctgcacgggcgcctggagcaggacccgccgaccctgcaccggcatttcgacgacgtgcgcctgggcatcgaccagacccgcctggaacagatcctggtcaacctgctggccaacgccctcgacgccatgagcgggcaggccgaccgccagctctggctggaaggccggcgcgaggaggagcgctacgtcctgcgcgtgcgcgacaacggccccggtatcccgccggcggcgcgcgtccacctgttcgaaccctttttcaccaccaagcccggcgaacatggcctgggcctcggcctgaccctctcggccagcatggccaccgccgccggcggcagcctcagcgtgcagcaccccgaaagcggcggaaccgcattcgagctgagcctgtccctggttcccgattccccgactgcgagtcccgcccgatga

SEQ ID NO: 5774 - DNA, 207 bp, Pseudomonas aeruginosa
agaagtacggcctgcaataggccggagcgccctcttcgccctgcccgcctggcgcagggcgcgatgcttcatccgacatttctcacccgcctgcgattccgctcggcggataacgccgggggcgttattcgccctacccgcctgacgcagcgcgtcataggccattcctcctccctcggtgcgcccgcgctatccgggcattcatga

SEQ ID NO: 5775 - DNA, 1335 bp, Pseudomonas aeruginosa
attgaactcaagtgtcattttccccggcagctgtttttcgcacgaatcgttccgccaataatgcgcccaccttcttccagtacgccgcgccgcggccggcctcacgagcgagatcgccatcatgctgttcagcccctatgcccttggccacctgaccctccccaatcgcatcgtcatgccgccgatgacccgttcccgcgccgccagtggcgaagtcgccaccgcgctgatggccgagtactacagccagcgcgccggcgccggcctgatcgtttccgaaggcacccagatcagccggcagggccagggctacgcctggacgccgggcatccacagcgccgagcaggtcgccggctggcgccaggtcaccgacgcggtgcacgccgccggcgggcgcatcttcgcccagctctggcacgtcggcagggtctcgcacacctcgctgcaaccgggcaacgccgccccggtgtcctcctcggcgctggtggccgaaggcgtgaaggtcttcgtcgatccccagggccgcggagcgcaggccggcggcggcgagatggtccagcactcggcgccgcgcgcactggccgtggaggaaatccgggagatcgtcgccgactatgcccaggccgcacgcaacgccctcgacgccggcttcgacggggtcgaactgcacggcgccaacggctacctgatcaaccagttcatcgactcccaggccaatgcgcgcaacgaccaatacggcggctcgctggagaaccgcctgcgcttcctccgcgaagtcgccgaggcggtcaccgcggtggtcggcagggagcgcatcggcgtgcgcctggcgccgctgaccaccctgcagggcgcggtcgacgacaccccgcaagccacctacctggccgcggcgcggctactggacgagatcggcgtggcctacatccacatcgccgaggccgactgggaagacgccccggccatgccggcggcgttcaaggaagcgttgcgcatcgtctaccgtggcagcctgatctactccggcatgtacaccaaggcgcgcgccgaggaagccctggccaggggctgggccgacctggtcggcttcggccggccgttcatcgccaaccccgacctgccctaccgcctggagcacgacctggcgctggccgacggcgaccgctcgacctacttcggtggcggcgccgccggctacaccgactacccgagcctaccgcaggcggccggttgaaacccctagccgaccggaccgcgagcgcgcggccggttggcgaaacatgccgccacaacctcgcctttggtcgactagaacccacggctggcgggacctag

SEQ ID NO: 5776 - DNA, 300 bp, Pseudomonas aeruginosa
actcaattcgccagatattcattattaataggcctgatttcctggacaggggggaccaccgatagcatcgaggaacatttcgaggaatccgccatgagcaagtccctgatcgtctccctggccgccagcctggtcgtcctggccggttgcgccaacccgccgcgcagcgtcgaacgcccctacagcgacgccgaaatcaagtcctacgccctcgacagcctggagcgcagcgacctctcgccgaagcgcctcgaccagtaccgcagcgtgctcggcacgccgcaccggcagaccctgtag

SEQ ID NO: 5777 - DNA, 1554 bp, Pseudomonas aeruginosa
gcgcacatggaatggatagctgacccgactgcctggctcggcctggcgaccctgatcgtgctggagatcgtcctcggcatcgacaacctggtgttcatcgcgatcctcgccgacaagctgccgccgcacctgcgcgaccgcgcccgggtcctcggcctgtcgctggcgctgctgatgcgcctgggcctgctggcgagcatctcgtggatggtgaccctcaccgagccgctgttcgaggtattcggcaagagcttctccggccgcgacctgatcatgctgttcggtggcgtgttcctgctgttcaaggccaccatggaactgcacgaacgcctcgaaggccatgtcgcccagcacgccggcaacaagacctacgcgctgttctggccgatcgtcgcgcagatcgtggtgctcgacgcggtgttctcgctcgacgcggtgatcaccgcggtgggcatggtcgagcatctggaagtgatgatgatcgcggtgatcgtctccatcggcctgatgatcgtcgccagcaagccgctgacccgcttcgtcaatcgtcacccgacggtgatcatgctgtgcctaggcttcctgatgatgatcggcttcagcctgaccgccgagggcctgggcttccatatcccgaaaggctacctgtacgcggccatcggcttctcgatcctcatcgaggtgttcaaccaggtcgcccgcaagcgccgcaagaagagcctgcagggccaccgcccgctgcgcgcgcgtaccgcccatgcggtgctgcgcctgctcggcggccagcgcctggaggccgacgaggtcggcgaggaagtcgccgacctgttcgaggagggcgacgaccaggtggtcttcgaccgccgcgagcgggtgatgatcagcggcgtgctgcaattggccgagaagcccatccgcagcctgatgacggtacgcgccgaggtcgactgcatcgacctcgacagcggccgcgaggcgatccgcgcggcgctgctcgaatcgtcctactcgcgcctgccgctggtgcgcgacgggcgcgtcgaggagccgctgggctacgtgcacaagaaggaactgctcaaggagcagctcgccggcgcccagccggatctggaaagcctggcccgccagccgctcaacctgttgcaggactgctcgatcctcaacgccctggagcagatgcgcgaggcctcgacccacgtggccttcgtggtcaacgagttcggcgagttcatcggcctgctgaccctgaccgacattctcgaatccatcgccggcgagctgcccgacgccagtgagatcgacggtccggacgtggtcgaggagaacgacggctatctggtcagcggtgccatgaacctcagccaggtgcgtcgacgcgtggggttcgacgcgcgcgccacggaggactaccagaccctcgccgggctggtgatgagcctgctcgaccgcctgccggtgatcggcgaccgcctgcagtggcaggactgggaactgcgggtggtggaagtggaagaacgccgggtgacccgggtcctgctgcgcaggggctga

SEQ ID NO: 5778 - DNA, 1611 bp, Pseudomonas aeruginosa
tgtcgagggtttccacccgcagcggaacgccacgccgcccggcctcttcgcgcaggtcggcggcctgcccggcgccgcgcacgccggcgatcgtccgatggccgcgggcggccaggcgcaacgccacttcccgaccgaagccgctgccggccccggtcaccaggattcgcttctgtttcatctcgattacctctggattgttgccatggccacggcggcctcggcgatggattggtcctgggccgcgctggcgccggagacgccgacgccacccaggcaggaaccgccggcatcgcccagcggcatgccgccggcgaagcaggccagcccgccgttgctctgctcgatgctccacaacggctggcccggcccggcgagtcggcccagctcgccgctgggcaggcggaacagcgcggcgctgcgcgccttgcgctgggccaggtcgatggcaccgggaacgctgtcgtccatccgtacgaacgccagcaggttggcatgggcgtcgaccaccgcgacgcagaccgccaggcgctgccgctgcgcttcggcaatggccgccgcgatgcagcgttgggcatgttgcagagacaggtgggtagacatggccggcgtcctcatcgagtgcttgcgggccagtctagaaaggtcgaagctttaacagaaccggccttctcctacgtagactttcaagtttttctaacaatgaatcgacgcgatcccctcgccggcctgcacgtcttcaggcaggtcgccgacaccggcagcttcacccgcgccgccgccctgctcggggtgacgccggcagcggtgagccaggcgatcaaccaactggaagccgagctgcgtctcaagctgttccaccgcaccacccgcggggtcagcctgagcgaggccgggcagcgctaccacgaacagaccgaacagccctaccgcgacctggtgcgcgcccgcgaagcgctcggcgaaagcctcgcggaaccctccgggcagctgcgcatcagcgccctgcacctggcgaagaacctggtgatcgcaccgatgctcaacgagttcgtgcgacgctacccgaaggtacaactggagatccgctacgaggaccagttggtggatatcgtcagggaacgactggatgccggcatccgcctggccgacgccctgcagccgggcatggtcggggtgcaactgacagcgccgctggcgtgcctgctggtggccactccggcctacctcgccgagtacggtacgccggccagcgtcgccgacctcgatgggcatgccgccgtgcgcttccgtttcccgcgcagcggccgcctgcacaagtggcgcttgcgggaagacgggcgggaactggaagtggacctgccggcacgcttcgtcagcaccgacaccgaggcgatcatcgaggcggcccgcgccggcgcagggatcgcccaggcattcatccgcgagcgggtcgccgcggacctcgccgccgggcgcctggtggaagtgctgcctggcagttgcctgccgctgccgccgatgtggctgtattacctgaaccgccgccacgtaccggccaagctgcgcgccttcatcgaactgctacgcgagtggcggcagccggcctga

SEQ ID NO: 5779 - DNA, 2190 bp, Pseudomonas aeruginosa
acctcagcggcccttgccggccggccccggccggctcagcaggaggtcgtccggtccgtcgatctcgatgaagcgaccgctttccagcgcctcctccagcggcgtgccggcgagcacgtcggccttgcgcagggcgcgggagaaacgcaggtcggcgctggcctcgaccttcgccaacggcacctggtaggtcttgaacgcaccgtagcggaagccttcgctgggcatcatcccttcctgccccagcaggtaggcggacactcccagttcgccgctgtcggcgtcgatcatcgccaccaccttccagaactccagcggcacctgcacgccctggtagagcggatcgtcgtcgcggaacaccgggccggtgaacaccgagatgcggaagccctcgctcctggcgttctgcagcacgtagtcctccagcgacagccagctgcgctggttgagctgcgccacctggggcaccgcgttggtgtagacgaaggtgtcgtcctcagcctgccgggcgacggcatcgctgtcgccccagccgggatcctcgcgacgcaccatgtggcccttgtcgaacgaagccgggccgtagaagtccttgtgtccgacctgcgcggccgcctcgatgcgcgggtcgaagccccaggaatccttgcgcttgagcgaacgcttgagcgcgccgtcgatattcaccgcggtgaggatcggcaagcgccggctggcgctcatcaccaccgagaaatgcagatagtccaggcgcgtgcccttgcccaccggcagcacctggtggctcttgcccggcttgggcaaggccgccttcggcccgaggaaggcctcgtcgaaacccttgcgctcggccaggtcggcgacgctgcgctgcttttcctggaagcgcggcacgccgcgcttcagctccgccccggccaccggcacccaggcgcgacgcgccagcaggctgcggatcacgctggccttcaccgcatagttggtcttgcggaactggccgccgaagtgcaggccgaccacctcgccgccgtcgatcgaaagcaccgccgagccggaattgccgcccagggtcgagcagtcgtgggtcaggtaccaggcgtcatggggcaatcccacgacttcgccgggagcgaagcgcttgacgtcgtagatgttgccgaagatatcttccatcgccccggcgtcgttgcggctgtcgcgcgccggatagccgaccaccgccaccgcctggcgcggctcggcatcctggcgcgcgaggaccagcggcggcggcagcaagtcgcccttcactacctggaggatcgccatgtccggcgcctcggagacgtccggggcgatccacaggacccgcgcgatcacatgctcgtcgctttccggctggcggtattcctcgcggaagtccacgcgggtgcgcacctgcttgccggcctggttgagacggaagcggaacaggctgccctggcgttcggcgaacaggctggcgacatgccggttggtgacgatcaggtcgtcctcgatgcgccagccggtaccgcaccagtccatgctgtcgtggtcgatcagttccagccgaccgaccgagcggatcggcgtggccagcgcggcgcgatgcttcttcaggcgctgctccaggccggccagcggcgcttcgtcgaagataccgttcttcaccagcagcaccggccggctcttgagcaggacgatcgcctcgctgaagcgccgcgagtcgaagaacgaggcgtcggattccggcgacacgctcttgcccaggtggtcggcgatctgctcgcggctggcgttgtacgccggcacgttgctccactcaccgcgggcggcgaggtgggcgagttcctcgcgggtgcccttttccttcagtaccgagcagacccgcagttcttccggcgtggcccgccgggggttgcgcttgcgcatggccatgtccctcgctgggcggatatccctggcaggagtctagccgagggacatgacagggccatgtcccgttggcgcaccgccgcgccgctcaaccggcgaacagccggtaggccgggttgtgggtttcctcccagtacggatagccgatggcttgcaacgccgcctccagctcgccgcgctcctcgtccggcacctgtaatccggccagcacccgaccgtcggcggcgccgtggttgcggtagtggaacaggctga

SEQ ID NO: 5780 - DNA, 516 bp, Pseudomonas aeruginosa
gggtcgaggcgctcatcggctggcctccgcgctcgccgccaccgaggccagcaggtcggtgccgtaggagttgtccaccgcgcagcgccactggccatcggcctcctggcggaacacgtaggtggcccgacgttgcaggcgtccggccttcgactcgatcaccgcctcggccatgaccagcgccgtatctcccgcctcgatcacccgcaggtcgtgctggcgcactcgcaggctgtgctcgaagtgccgggcgatggcgtcgaacgcctggcggatctgcgccttgccgcaggcgttgaggcccggcttgaccaccagggtggcgtcgtcgcaatagaaatccatcagggcatcgaactgcccggcattgatcagggcgtcggcccggccaacgaggttctggagggtctggtgctgcatgctgttctcccggttcggtggttttggcccaggagacagaacgaagaacccgcctcgagggcgggttcggagtggacgctggctaacccgccatag

SEQ ID NO: 5781 - DNA, 1071 bp, Pseudomonas aeruginosa
ccaacggcagagtcccggaacagagggctcgccgcgcggcccttctgccaggcggcgaccgcatccctgccatcgcgcagacaaaaaaaaagccccgccaatcgaccggcggggctttccctaaagcgtgtcgcctcagaacagcgaggcgaccagatgggtggcgggcgccacctggaagtcgatggacatcatcacgctcagcgcggtgatggcgacgatggagaaggcgaacagcttgcgcgcccagacccggtcgtcggcggtccagtagccggtcagggcgatggccagccaccacaggctcaccgccaccgccaccagcaggtagccgtagccggcgtagccgcccaagcacaaggcgagggtcgccgccatgaaggcgaggatgtagagcacgatgtggatcttggtcaccgcgatgccgcgcgccaccggcagcaccgggatgccagccgcctcgtagtccttcaggcggaagatggcgatggcataggagtgcggcatctgccacaggcagaagatcgccagcagcgaggcggcgccggcgtcgaactggccgctcaccgcgcagtagccgaccaccggcggcatcgccccggagaggctgccgaccagcgtgccgtactgcgaacgacgcttgaaccacaggctgtacaggccgacgtagacgaagtagccgaagccggccagcgcggtggtcagcgggttggtccgccaccacagcaggccgaagccggcgaccccgaggaccaggccgtgggccagggcagccttcagcgagatctgcccggtcacggtgacccgcccgcgggtccgctccatgtgccggtcgatgtcgcggtcgatgcagttgttcagcacgcacccactggcgaccaccagcgacaggccgatgaccgtggccagcaacagcatcggctcgacgctgccgcgggcggcgaggaagtatccccccgccaccgcgatcaggttgccgaagatgattcccggcttggccaccaggagatagcgtttcagcttcacgtcatggccctcagggcatcggcatcatcagcatgtcggcgctga

SEQ ID NO: 5782 - DNA, 2115 bp, Pseudomonas aeruginosa
ggatcaccgagagcacgaagccgatcgcgtaggaacccaggctgccgtggccggcgccgtggttgtcgtgtgcagcgctgctcattacagggcccccatcaggtagacgacggtgaagacgcagatccagacgatgtcgaggaagtgccagaacaggctcaggcacatcatccgggtgttgttctgcgcggtgaggccgcgggtccagatctgcgccatcagcaccagcatccacagcagaccggcgctgacgtgcaggccgtgcatgccgaccagggtgaagaaggacgacaggaaggcgcttcggctcgggccgaaaccttcggcgatcaggtggtggaactcgttgatctccatcccgatgaacgcggcgccgagcaggaaggtgaccccgagccaggcgatcgcctggcccttggcgcccttgtgcgcagagagcatggccaggccgtaggtgcagctggaaaccagcaggatggcggtttccaccagcacgtagggcagctcgaagatgtccttgccgctggggccgccggcggtgtggtgaaccagcaccgcgtaggtggcgaagacgctggcgaacagcacgcagtcggtcatcaggtagagccagaaaccgaatacggtgttgccgccgctatcgtgtgcatgatcgtggtcgtggcccacttcgtgggcgtcggccagatgcttgttcaatactgccgtcgacatggttcagacctgcttggcgagttgctggaaacgggcgctttcgatcttctcgatctcttcgggctggacgtagtagtcgacgtcctggttgtagctgcgcacgatgaaggagccgatcatgccgacgaagccgaccgccatgagccaccagatatgccagatggcggcgaagccgaagacgaaggcgaacacggcgatggagaagcccgcggcggtgttcttcggcatgtggatcggctggtaggccggcagcttgcggtaggcggtgccggccttcttcatgtcgtggaaggcatccacgtcctgtaccttcggcagctcggcgaagttgtagaacggcggcggcgaggaagtggcccattccagggtgcggcattcccacgggtcgccattgacgtcggccagttgcttgcggttgcggaccgagacgaacagctggatcagttggcaggcgatgccgcagaagatcagcacggcgccgaagaacgcgaccaccaggtagggcttccacagcgggttgtcgtagtggttcaggcgacgggtcatgcccatgaagccgaggatgtagagcggcatgaaggccatgtagaagcccaccagccagcaccagaaggaacgcttgccccacttctcgtcgagggtgaagccgaacgctttcgggaaccagaaggcgaagccggccaggtagccgaataccgcgccgccgatgatggtgttgtggaagtgggcgatcaggaacaggctgttgtgcagcaggaagtccgcgcccgggatggccagcaggacgccggtcatgccgccgatggtgaaggtcaccatgaagcccagggtccacaggatcggcgtgctgaagcgcaggcggcccttgtagatggtgaacagccagttgaacagcttcaccccggtggggatcgagatcagcatggtggccacgccgaagaagccgttgacgtcaccgcccgaacccatggtgaagaagtggtgcagccacacggtgaagccgaggaaggtgatcgcggcgctggcccagaccatcgacttgtagccgaacatgcgcttgccggcgaaggtcgcggtgacctcggagaagataccgaaggccggcaggatcaggatgtacacctcgggatggccccaggcccagaagaggttgatgtacatcatggcgttgccgccgagctcgttggtgaagaagtgcatgtccaggtagcggtcgagcgacagcaggcccagcgcagcagtgaggatcgggaacgaggcgacgatcaggatgttggcgaaggtgcaggtccaggtgaagatcggcatctgcatcagcttcatgcccggggcacgcatcttgaacacggtgaccaggaagttgatccccgtgagcaacgtgcccatcccggatatctgtag

SEQ ID NO: 5783 - DNA, 1995 bp, Pseudomonas aeruginosa
cgcccagatgtagtagtccacccctaccccggggctataggccagctccgacagcggcggataggccacccagccggtacgggcgaattcgcccaggcccagcgacacgttgaccagcatggcgctgaccacgagcagccagaagctcagcgagttgaggaaggggaacgccacgtcgcgcgcgccgatctgcagcggcacggccaggttcatcaggccggtcatgaacggcatggccatgaagatgatcatgatcacgccatgcgcggtgaagatctggtcgtagtgctccggcggcaggtagccgtggttggcgccttcggccagggccagttggccgcgcatcatgatcgcgtcggcgaagccgcggaccagcatgaccagggcgacgacgatgtacatcacgccgatcttcttgtggtcgaccgaggtcagccactcggtccacaggtaggtccacttgcggtagtaggtgatcgcaccgaccacgccgaggcccagcagggcgacgacggccagtgtgaccatgacgatgggctcgtggtaaggcacggccgagagtgtcagtttcccgaacatctgcgcttactcctgggtactcggttgcatgtgcatgtccttcatgtctttcatgccctgcatggcttgcatgtccatgtcctgcatgtcgtgaccggtcatggcggcttcgtgctcagccccggcgtgctcgccgtgcgcggcacccttggcgtcgccgtggtgctcgtacttggtgaggatgtggccaaacagttccgggctgaccgaagagaagtaggtcggcggaacgttctcgctcggcttgaccagttccggataggtgccgatcgacaggcttgccggtgccgccttgaccttggcgacccagtcctggaagccctgctcggaggtggcgatggccttgaagcgcatgccggagaaaccgccgccgctgtagttcgcggagataccgtcgaacacgccttcttcgttggcgatcaggtgcagcttggtcatcatcccggccatcgagtagatctggctgcccagctgcgggatgaagaacgagttcatcaccgaatccgaggtgatctggaaattcaccggggtgtctttcgggaaggcgatctcgttgaccgtggcgataccctgctccgggtagatgaacaaccacttccaatccagcgaaacggcctggatggtgaccggcttgacctcggagtccagcggacggtacgggtcgagcttgtgggtgctttcccaggtgatccagccgaggatcgcgatgatcacgcagggcaccagccagaccaccgcctcgatgcggttggaatggtgccagtccggcttgtactcggcctgggtgttcgaggcgcggtacttccaggcgaacgccagggtcatcacgatcaccgggatgaccacgatcagcatcagcagggtcgcggtaatgatcagggtgcgctcgtccatgcccacctgccctttcgggttgaacagggtcatgtcgcagccgccgagcagcagcgcgggcgccagggaaagccatttcaatgcggcaaacgggtttgctttggtcatcttccggccttaatcgatggaaggagcgagtggtcgctcatggatgtctccttgcaaggcttgtggcggagaccgctggcttcagccagttccagacatgcagtcgccgccggggtacggaacggccattgcccggccacgggagaaggcaagcggatacctttcccgattccggtggcggactcgttccacgcgctgagtcgttccttgatgaacagcgttttcgaagctgtgccggaagaggccaagggcggccaaggcacgtgcatgcctgggcgagaaggattgcccttcccgccgggtgatcaggtcgcagttatcggtcggctatttgttgtgcaacaggcaaggcaggaacccatttatcgcgatgcggagcagagactcgcgcgacgctcgttggaccgaaactga

SEQ ID NO: 5784 - DNA, 552 bp, Pseudomonas aeruginosa
cccgagagtcagtgtctatcggcctgcaactgtacccctgccgttcgtccagatgcgccaactgtatccgccgccgggccggcgctaacgcgcaggcgccagagcagcgcggcggccagcagggcgctggctccggccaccagcatagccagacggaagccctcggccagcgcggccggcagctcggcgtcgagccccgccagggaaccaggcaagcgatgggacgtgaccgcctgggtggcgagccgttgcgcatcggcaatccccagcccctccagccgatcgcccaggacgacgatcgcccgcccgctcagcagcgctcccagcaacgcgatgccgacggccatgccggcctggcgcagggtattcatggtcgccgaggccatcccggaacgctcgcgggccacgctcgccatgaccgccagaccggtgccgggaacggccaggcccatgcccaggccgagcgccaccagcaacaggccgacccagggatacgcggttcccgtaccgcaagcggccagcgccagcatggccaggccgatcaccaggtag

SEQ ID NO: 5785 - DNA, 426 bp, Pseudomonas aeruginosa
gtcaacgcccccagccagaccacgctgagcagctgccccagaggatcgaaggcggcgtgctcggggtgcgcggtttcctcgatgccccacaggcccagggcgagcgccagcaggccgagcggcaggttgatcaggaagatgctctgccagccggcgtgctccaccagcaggccgccgagcagcgggccgaggatcagcgacagcgcgctgaaggaggtccagccgccgatcacctgggcgcgctggccgggatcgtggaaagcctgggtaaggatcgacagcgcgccgggtatcaacagcgccccggcgatgccctggaccgcgcgtccgaacagcagcagcgccagcgaggtggccagcgcgcagagcagcgaaccgaagctgaacaggccgaccccgagcagccaggtgagcttgcgaccgtag

SEQ ID NO: 5786 - DNA, 1383 bp, Pseudomonas aeruginosa
cgtgaaagcggcggcgaacaggaagcagtggacgaaggccgcggggtcggccagcgcctgcaacaggttgagcaacccaccgagcacggccatgcccaggcagaacgccagttgccgattgatgttccacaaggcgctggcatggcccatgcgcgccgccgggacgtcgagcaaggccatgccctgtgccgcgctgctacacaggctgccgccgaatcccatggtcgcgtaggcccccgccagttgccagaagccgctcccctccccgcttcgagccagccacagcaggccgccggcctgtatcgccatgcccgccagcagcaaggatttcggcccccagcgattgaagcgtcgccgggtcaggccgatggccaggccggccgccagcgcccagggcagcatcagcgcaccggcacggctcgcgctgaggccgagggggccttgcagatagagcatggcgaccaggttggcgcccatgaaggctcccggcacgcagagatagaccagcatcgccgtacgcagcaatggcgcctccagcaagccaaggtcgagcagcgcgtcggtacgagcgcgcccgtcacgccagtagcagcagcccagcacgcaggccagcagcgccaggagcaggccacgcccgccgccgccgggcgatcccagccaggcgagcgccaccagcagcgtggccagcgccgccgagccgagcagcaggccgcgcaggtccaggcgctgcgccgcatgcttgtgcctgggcagccagcgcatcgccagggccagcaccagcagcgccggcgccacgctggcgaagaagatcccacgccaggacaggctgtccaccagccagccgccgagggcaggcgccacggcgggaacgatcagcgccaccagcatcacccgtgcggtcaggccggcccgtgccgacgccgggacattccgataggccatggcctggccgagggggatcagcaacccgccggccaacccctggcacaggcgccagacgatcaacgtcgccgccgatccagccaggccgcaacccagcgaagcgctggcgaaaccggccagtgccagcagcatcagtcgccgttctcccaggcgcgaagcgagccagacgctcaacggaatcaccagggtcaagccgagcaggtaggtgttgccgatccacgccagggtcgccaccgaagcgccaagggaacgcccgatgtccggataggcgacgctggcgatgaagatgttcaccaggtccagggcgaaccccagcaggtacaaagtggccaggcgggacggttgattcatgggcgctccggaggtttgccggggagcatagcgaggcgctcgcgctatctggagaggctaatcgcgcatagactgtcaaatcgaatttga

SEQ ID NO: 5787 - DNA, 192 bp, Pseudomonas aeruginosa
aggtgctcgacgaggcgcgcctggccatcgacgacgcccgcgccgagcatggcgaactgcgtggcagcctgcgcgtcaccaccacccaggaatacggcctgcgccaactggtgccggccctgcaggcattcgcccggctgcacccggcgttgcaggtacaattgtcgacctcatcgctgcatgccgacctga

SEQ ID NO: 5788 - DNA, 789 bp, Pseudomonas aeruginosa
  unsure (545): Identity of nucleotide at the above locations are unknown.
ttggcgaacgcttcgacgtcgccatccgcctggggcgcctggaggactccacccaccatgcggtgcaactggccagcttcgaggtcctggcggtggccagcccggcctgcctggcggcgctcggcgaaccgccgccgaccgacctggagagtctggagcgcctgcagaatctcggtcacagccggctggcggactccctgccctggcaagtacgcgcccccgacggcgccctgcgcagctaccgcggaccgcgccatcccatgctgctggccgacaacgccgcggccctgcgcgcctttgccctcgacggcctgggtatcgccgtgctgccggactggctggtgcaggccgacttgcgctgcggcgcactgcaacgcctgctggcggacacgggtttccgctccagggcgtgcatgccgtttatccgccgacccgccacctgccgtcgaaggtccgcgcgttcatcgacttcctcaagactcgcctggggcacccggacgccggttagaaaaccgaggccgccgtggtttgtcgccctttgtatntcctctacctcgatctgttctccttcggcttctctttggatcctgtgcatgcctcctatttgctgggactttttggttgtcttcgattacggcggtatctgctgttactcgttctcttattctaactggtcggtcaatatcgttcgggttcgtctggatgctgtctgctatctctttggtccagctcctctttatgctgctcgcggttatctacgattatgccttggctcgcgtgcttctctaa

SEQ ID NO: 5789 - DNA, 696 bp, Pseudomonas aeruginosa
ccaatgacgctattggatatcgaaaagctgctggacatgactcaccacatgtcggtgcacattcccatcgaactgatcatttcctgggagcagagcgaagaggcctggagtgtgaaagacaactgtctcaacttcgtctatgtcaatcgtcgctataccgaactgatcaccccgcggttcggccagaagaactccctgctgtcccccttcagtgccagcatcgaagagcacgacaagctggtcatccagaccggcaagcgcatcgaggccctggcgctgctcaggccggacgatcatccggcgccctgctgcctgtatttcgaacgcatgccgctgtatgaccggcgcggcaatcgcaccggggtgatcgcccatgccaagaccctgacctcggtcgccccgcgcggcttcatcgccaccgacggcatcggtaccttcaccttcacgccaccctcggagttgttcacctcgcgcgaatgggacgtgatctacctgctgctttccggcctctcggaaaaagaaatagccgaacagatcagccgctccctgagtaccgtcaagttccacaagagcaacatcttccagaaggtcggttgcagttgcatcggcgccttcaaggcactcgcccggcaaaagaagtggaacttctatatcccgccgaccttcgccagcgccaagtacatcatcaatcactag

SEQ ID NO: 5790 - DNA, 306 bp, Pseudomonas aeruginosa
tggacgacgcgctgctctacggcgaaatggccaaggccaagaagccggacgactgggtcgtcggcggcaccccgcagtccttcgagatctacggctgcatggtgcgcaagggcgacgcggcgttcaagaaagtggtcgacaaggccatcaccgatacctacgccctccggcgaggtcaacaagatctacgacaagtggttcacccagccgatcccgccgaagggcctgaacctcaacttccccatgagcgaagagctgaagaagctgatcgccagcccgaccgacaaggccgccgagcagatgtaa

SEQ ID NO: 5791 - DNA, 513 bp, Pseudomonas aeruginosa
attacaactgggactggggcgtgttcttcaagtccaccgggatcggcagcgaaacctacctcgactggtacatcgccggtctgggctggaccatcgccatcgccctggtcggctggatcatcgccctggcgctgggctcgctgctcggcgtcatgcgcaccgtgccgaaccgcctggtatcggggatcgccaccgcctacgtggaaatcttccgcaacgtgccgctgctggtgcagctgttcatctggtacttcctggtacccgacctgctgcccgagggcctgcagacctggttcaagcaggacctcaacccgactacctcggcctacctcagcgtggtcgtctgcctcggcctgttcaccgccgcgcgggtctgcgagcaggtgcgcaccggcatccaggcgctgccctacgggcagacctcggcggcccgcgcgatgggcttccgcctgccgcagatataccgccacgtgctgctgccgcaggccttccggatcatcatcccgccgctga

SEQ ID NO: 5792 - DNA, 1407 bp, Pseudomonas aeruginosa
gaggtaaatgatggacttcagtggaatcgttcccgccctgccgagcctctgggaaggcatgctgatgaccctcaagctgatggtcctcggcgtcctcggcggcgtcgcgctgggtaccgtgctggcgctgatgcggctgtcgcacagcaagttgctgtcgaacatcgccggcttctacgtcaactacttccgctcaatcccgctgctgctggtgatcacctggttctacttcgcggtgcccttcatcctgcgctggatcaccggcgaggacaccccggtgggggcgttcacctcctgcctggtggccttcatgatgttcgaggcggcctactactgcgagatcgtccgcgccggcatccaggccatcccgaaaggccagatgggcgccgcccaggcactgggcatgacctacgggcagaccatgcgcctggtgatcctgccgcaggcgttccgcaagatgaccccgctgctgctgcaacagagcatcatcctgttccaggacacctcgctggtctataccgtcggcctgatggacttcctcaattcggcccgttcgcgcggcgacatcatcggccaggccaacgagttcctgattttcgccggcctggtctacttcgtcgtaagcttcaccgcctcgttcgccgtcaaacgtctgcagaaaaggttaaccgtatgatttccatcaagaatgtcagcaagtggtatggcgacttccaggtcctgaccgactgctccaccgaggttgcgaaaggcgaagtggtggtggtctgcgggccgtcgggctcgggcaagtcgaccctgatcaagtgcgtcaacgcactggaacccttccagaagggcgacatcgtcgtcgacggcacctccatcgccgatccgaagaccaacctgcccaagctgcgctcgcgggtcggcatggtgttccagcatttcgagctgtttccccacctgagcatcaccgagaacctgaccatcgcgcagatcaaggtactcggccgcagcaaggaagaagccaccaagaagggcctggccctgctcgagcgcgtcggtctcaaggagcacgcgcacaagcaccccggccagctctccggcggccagcagcagcgcgtggcgatcgcccgcgcgctggcgatggacccggtggtgatgctgttcgacgagccgacctcggcgctcgacccggaaatggtcaacgaagtgctcgacgtgatggtccagttggcccacgaaggcatgaccatgatgtgcgtgacccacgagatgggcttcgcgcgcaaggtcgccaaccgggtgatcttcatggaccgcgggcagatcgtggaagactgcgagaaggaggagttcttcggcgacgtcagcgcccgctccgaacgtgcccagcagttcctcgccaagatcctcccgcactga

SEQ ID NO: 5793 - DNA, 1182 bp, Pseudomonas aeruginosa
aaccctgacaggacggcgggcggccgacgccgcccgcgcctgattgcgtgcaacgacgataaccctaccaacctaccgacacgagatatcgccatgaagccattgctccacgcgttcgcccccggtgttatggccctgatgctcctgctgccgcaggccgcccaggccaaggaagtcgcaccgcaacagaaactgtccaacgtggtcatcctggccaccggcggcaccatcgccggcgccggcgccagcgccgccaacagcgccacctacaccgccgccaaggtgccggtcgaccagttgctggccagcgtgccgcagctcaaggacatcgccaacgtccgcggcgaacaggtgttccagatcgcctcggaaagcttcaccaacgagaacctgctggaactgggcaagaccgtcgccaagctggccgatagcgacgacgtcgacggcatcgtgatcacccacggtaccgacaccctggaagagaccgcctacttcctgaccctggtcgagcacaccgagaagcctatcgtggtggtcggctcgatgcgcccgggcaccgcgatgtccgccgacggcatgctcaacctgtacaacgccgtggcggtggccggcgacaagtcggcacgcggcaagggcgtgctgatcaccatgaacgacgagatcctctccggccgcgacgcgagcaagatggtcaacatcaagaccgaagcgttcaagagcccgtggggcccgctgggcatggtggtcgagggcaagagctactggttccgcgcaccggtgaagcggcacacggtgaactccgagttcgacatcaagcagatctccgcgctggctccggtggaaatcgcctacagctacggcaacgtcagcgacaccgcctacaaggccctggcccaggccggcgccaaggcgatcatccatgccggcaccggcaacggctcggtgcccgcgcgcgtggtgccgaccctgcaggaactgcgcaagcagggcgtgcagatcatccgctcctcgcacgtcaatgccggcggcttcgtcctgcgcaacgccgagcagccggacgacaagaacgactggatcgtcgcccacgacctgaacccgcagaaggcgcgcatcctggccgcggtcgcgatgaccaagacccaggacagcaaggagctgcaacggatcttctgggaatactga

SEQ ID NO: 5794 - DNA, 615 bp, Pseudomonas aeruginosa
gcctgtccctggttcccgattccccgactgcgagtcccgcccgatgaacgagccgctttccgtcctgatcgtcgaagacgatccgcatgtcttgctcggctgccagcaggcgctggagctggaggacatcccctgcatcggcgtcggcagcgccgaggaggcgctgcaacgggtcgaccgcgacttcgccggcatcgtcgtcagcgacatccgcctgcccggcatcgatggcctgaccctgctggagcgtctcaaggccctcgacccgagcctgccggtggtgctgatcaccggtcacggcgacatctccatggcggtacaggcgatgcacgccggcgcctacgacttcatggagaagcccttctctccggaacgcctggtcgaggtcgcccgccgcgccctggagcagcgcgggctggcccgcgaggtcagcgcgctgcgtcgccagttggccggccgccaggacctggcgcaacggatcatcggccgctcgccggcgatccaggcgttgcgcgagctgatcgccaacgtcggcgacacctcggccaacgtgctgatcctcggcgagaccggcacgggcaaggagctggtggcgcgttgcctccacgactatag

SEQ ID NO: 5795 - DNA, 879 bp, Pseudomonas aeruginosa
ccggcgccaccagcatgccttcgtcgcgctgaactgcggcggcctgccggagaacctgttcgacagcgagatattcggccacgaggcgcacgccttcaccggtgccaacaagcggcggatcggcaagatcgagcatgccaacggcggcacgctgttcctcgacgagatcgagagcatgccggtcaacctgcagatcaagctgctgcgggtgttgcaggaacacaccctggaacgcctcggctcgaaccagtcgatcccggtggactgccgggtgatcgcggcgaccaaggcagacctcgccgccatgggcaagagcggccagttccgcagcgacctttactaccggctcaaaatagtgagcctggaactgccggcgctgcgcgaccgccgcgaggacatcctgctgctcttcgaacacttcctccagcagtcctcgctgcgcttcgaccgccccgcgccggaactcgaccgtgccaccgtggccagcctgatggcccacgactggccgggcaacgtacgcgaactgcgcaacgtcgccgaacgcttcgccctcggcctgccggtgttcaacaagggcggccaggccgtacagaccggcggcccgcgcttcgccgaagcggtggaggcattcgagaaggccctgctcggcgacgccctggcccgccaccacggcaacctgacccaggccagccaggacctgggcatggccaagaccacgctgttcgacaaggtgaagaagtacggcctgcaataggccggagcgccctcttcgccctgcccgcctggcgcagggcgcgatgcttcatccgacatttctcacccgcctgcgattccgctcggcggataacgccgggggcgttattcgccctacccgcctga

SEQ ID NO: 5796 - DNA, 1173 bp, Pseudomonas aeruginosa
tgcgcccaccttcttccagtacgccgcgccgcggccggcctcacgagcgagatcgccatcatgctgttcagcccctatgcccttggccacctgaccctccccaatcgcatcgtcatgccgccgatgacccgttcccgcgccgccagtggcgaagtcgccaccgcgctgatggccgagtactacagccagcgcgccggcgccggcctgatcgtttccgaaggcacccagatcagccggcagggccagggctacgcctggacgccgggcatccacagcgccgagcaggtcgccggctggcgccaggtcaccgacgcggtgcacgccgccggcgggcgcatcttcgcccagctctggcacgtcggcagggtctcgcacacctcgctgcaaccgggcaacgccgccccggtgtcctcctcggcgctggtggccgaaggcgtgaaggtcttcgtcgatccccagggccgcggagcgcaggccggcggcggcgagatggtccagcactcggcgccgcgcgcactggccgtggaggaaatccgggagatcgtcgccgactatgcccaggccgcacgcaacgccctcgacgccggcttcgacggggtcgaactgcacggcgccaacggctacctgatcaaccagttcatcgactcccaggccaatgcgcgcaacgaccaatacggcggctcgctggagaaccgcctgcgcttcctccgcgaagtcgccgaggcggtcaccgcggtggtcggcagggagcgcatcggcgtgcgcctggcgccgctgaccaccctgcagggcgcggtcgacgacaccccgcaagccacctacctggccgcggcgcggctactggacgagatcggcgtggcctacatccacatcgccgaggccgactgggaagacgccccggccatgccggcggcgttcaaggaagcgttgcgcatcgtctaccgtggcagcctgatctactccggcatgtacaccaaggcgcgcgccgaggaagccctggccaggggctgggccgacctggtcggcttcggccggccgttcatcgccaaccccgacctgccctaccgcctggagcacgacctggcgctggccgacggcgaccgctcgacctacttcggtggcggcgccgccggctacaccgactacccgagcctaccgcaggcggccggttga

SEQ ID NO: 5797 - DNA, 1338 bp, Pseudomonas aeruginosa
cccgggtcctgctgcgcaggggctgagcgaagcggcggccgccgatccggccgccgtcctccccggcgcagcggcagaccgctacaggcggcgctgccaggcctgcgcctgctcgtccttcaccacctcgacgaaagcttccggcaacagggtgcggaacgggccttcgtcagcctcggccagctcgaccatccgcgcgatcatttcctccggatcgtactgctcgaagggaaagcgcacgccgctgtggtcggtgaagtggcgctgcgggtcgtaccagcgtttccaggtttccatcatgcgatcgttgaagccggtctggtacgggccgggattgatggtgccaacctggatgccgaacggcttcagttcggcatgcagggcctcggcgaaggcctccagggcatgcttggaggcgcagtaggggccggtatagggtccggtgatcaagccggcgatggacgacacgaagagcaccttgccgccacgcttctgctcgaccatgcgccggacgaaaccctgggtcagttccaggttggcgaacacgttggtctcgaacagcgcgcgcaccagttccagcgggatctccgcgctggccccggcttcggcgctgccggcgttgttcagcagcacgtcgatatcccattcccaggcgcgttcgcgatcggcggcgacgttgatgtcgagggtttccacccgcagcggaacgccacgccgcccggcctcttcgcgcaggtcggcggcctgcccggcgccgcgcacgccggcgatcgtccgatggccgcgggcggccaggcgcaacgccacttcccgaccgaagccgctgccggccccggtcaccaggattcgcttctgtttcatctcgattacctctggattgttgccatggccacggcggcctcggcgatggattggtcctgggccgcgctggcgccggagacgccgacgccacccaggcaggaaccgccggcatcgcccagcggcatgccgccggcgaagcaggccagcccgccgttgctctgctcgatgctccacaacggctggcccggcccggcgagtcggcccagctcgccgctgggcaggcggaacagcgcggcgctgcgcgccttgcgctgggccaggtcgatggcaccgggaacgctgtcgtccatccgtacgaacgccagcaggttggcatgggcgtcgaccaccgcgacgcagaccgccaggcgctgccgctgcgcttcggcaatggccgccgcgatgcagcgttgggcatgttgcagagacaggtgggtagacatggccggcgtcctcatcgagtgcttgcgggccagtctagaaaggtcgaagctttaa

SEQ ID NO: 5798 - DNA, 1488 bp, Pseudomonas aeruginosa
tccggccagcacccgaccgtcggcggcgccgtggttgcggtagtggaacaggctgatgttccagcgcgagccgagcttgtcgaggaagttcagcaaggccccggggcgttcgggaaactcgaagcggaacagccgctcgcggcgcacctcggtaccgtggccgccgaccatgtggcggatgtgcagcttggccatctcgttgtcggtcaggtcgagtaccgggaagccctgctcgcgcaggccggcgagcaggtcggcgcggctgtcggtgagcggatgggtctgcacgccgacgaacaggtgggcctggcggtcgctgtggtagcggtagttgaactcggtgatctggcgccggcccagcgccgcgcagaaggccttgaagctgcccggccgctcggccacggtgacggcgatgatcgcttcgcgctgttcgcccagttcggcgcgctcggcaacgtggcgcaggcggtcgaagttgatgttggcaccggagtcgatggccaccagggtctgcccctcggtgcgttcgcgggccacgtacttcttgatccccgctacggccagggcgccggccggctcggtgatcgaacgggtgtcgtcgtagatgtccttgatcgccgcgcagatttcgtcgctgccgacggtgatcacctcgtcgacatggtccttgcagacctcgaagttgcaagcgccgatctgcgccaccgccaccccgtcggcgaacagcccgacctggcccagcaccacccgttcgccggcggccagcgccgcctgcaggcagttggaatcctccggctcgacgccgatcacgcgaatatccggacgcaggtgcttgacgtaggcggcgatcccggcgatcaggctgccgccgccgaccggcacgaagatcgcgtcgaggcggccgctgtgctggcggaggatctccatcgccaccgtgccctgtccggcgatcacgtccggatcgtcgtagggtgggacgaaggtcatgccttcgcgctcggccagttgcagggcatgggccagcgcatcggggaaggcgtcgccgtgcagcaacgcctcgccgccgcgcgccagcacgcccttgaccttgagctcgggagtggtgcgcggcatcacgatcaccgcccgcacgcccaggcgctgcgccgccagggccaggccctgggcatggttgccggcggaggcggtgatcaccccgcgggccttctgctcgtcgctcaggcgcgcgacacgggtgtaggcgccgcggatcttgaaggagaacaccggctgcaggtcctcgcgcttgagcagcacccggttgcccaggcgctgggacaactgcggcgcgacctgcaagggggtttccacggcgacgtcgtacaccggcgcggccaggatgctttccacgtagccggccagcaggggtttgcttgcgctgagggtcgaggcgctcatcggctggcctccgcgctcgccgccaccgaggccagcaggtcggtgccgtag

SEQ ID NO: 5799 - DNA, 1440 bp, Pseudomonas aeruginosa
gggcgtgctccgcgaggtgccgtcgatccagtcgtagcgcaggcccaggctgaggtcccagcgctcgtccagggcgatggtgtcgaaggcgtacagcgccttgacctccagttcggtccggttgcgcgcgctgtcgcgcttgtcggtggggccgttccagtagcccggcgggttgtgcaggtcgaagccgttggccgggtagaacttgcccaggttgtaggagtaggtggtgcggtcgtaggtctcgcgggacagctcgaagccgccgatcagcgtatgcgccaggccgaaggtatcgaagcggccggtgaggttggtctggttgatccacatccgcgtcttcgaatcgcgcccgtaggcttgcggtcccgccggcaggtagcgacccggcggcaggcccttctggttgacgtgggaggcggagatcaccgtgtcccgatgcaggtgggaatagcggatgaggttctgcaactggaagtcgtcgctgaaatcgtgttcgagcttgagggtggcgacgtcgttgtcgatccgttcctcgtccaggttgcgccagccgaaataatcgtggcggctgacgccgtccagcttgcgcccgttcagcgccggcacgccatagtcgggaaggttgtcgtcgcgctggtggaagtagctcagggtcaggcgggtcggggtgtccaggccgaaggtcagggatggcgcgatgccccagcgctgcttgtcgatctgttcgcgcccggcgacgtcgttgtggtgggccatgaggttgaggcggaaggcggtcgattcgccaagcccttccagcggctggttggtgtccagggtcaggcgccggtagcggtccgtgcccagcccggcgcccaggtgggtgaaggcttcggccttgggctgcttgctgaccatgttgatgctgccgccgctggtgccggcgccgccgaacaccgagttcggtcccttgatcacttccaccgcctccaggttgaacaggtcgctgcggctggtctgggcgctgtcgcgcagcccgtccacctgcatgttggcgttggcgctgaagccgcggatgttgatgctgtcgccggaaccgccgccgccctcgccggcgttgaaggtgatgccggagacgttggacagcacctggcgcaggctcagggcgttctgctcctggatcaccttttgcggcaccaccgtgacggtctgcggggtatccagcagcggcacggcgtacttggccgaggccgagcgttcgaccctggacgaggcctgctcgccggtgaccgtgtcggctcccagttccaggggatcgtccttgcgcgccgcgtcctcggccagggccggcgaggagcaggcggccatcaacagcatcagcggcgccagcgggcgtttggtgggcaagggggacggctcgttgcgacgatccatgaagtactccatcttggttattga

SEQ ID NO: 5800 - DNA, 216 bp, Pseudomonas aeruginosa
agtagggcttttacctgcctgcgacaggttgtcgcaggccataccctagcacaacagttggaatacgcgaatattcttcgcttcgagcagcataacgcaaggaaatcgcccccgcgccagcatcgtgacccgagagtcagtgtctatcggcctgcaactgtacccctgccgttcgtccagatgcgccaactgtatccgccgccgggccggcgctaa

SEQ ID NO: 5801 - DNA, 528 bp, Pseudomonas aeruginosa
ccgccagaccggtgccgggaacggccaggcccatgcccaggccgagcgccaccagcaacaggccgacccagggatacgcggttcccgtaccgcaagcggccagcgccagcatggccaggccgatcaccaggtagcccagcaccagcaggcgtcgcagcggtacgtgccgctgcaaccggccgaacagcatggacagtgcgcccatggcgaggaactgcggcgccaggtagaagccggcctgctgcgccgaggcaccctgcacctgctggaagaacagggagaggaagaacaggctggcgtagccggaaaaaccgaggacgaacgaggccaggttgcagacggcgaacccggcctggcggaacaaccccaggggcagcagcggtcgggcggtccgccgctcgacgaagaggaagccaagcaggccgaccccggccaggagcagcgccggccaggccgtgggagacaaccagccgccctctcccgcggcgatcagggcgtaggtcaacgcccccagccagaccacgctga

SEQ ID NO: 5802 - DNA, 735 bp, Pseudomonas aeruginosa
tccattgaccgacggtcagtcaataaatatcgcgaaacattctcatcttcctgtcatgcctcgtcttcccctccacgctcttttacactgcggccaacccaaccaccggacccgcgctccatgcccgatcgccacgccgaacagcctgcccgccaaccgcgcaccaagcctgctgaggttcgtctcgaggaactgatggcggcggcgcagcaactgttcctagacaagggtgtggacgccaccaccatcagcgacatcgtcgctgccgcgggggtcgccaagggtaccttctatcactacttccaagccaaggccgacatcctcctggccctacgcgagcgcttcacccaggctttccagcagcgcatcgcgaatgccgtcgaggcctgtccggcgaacgaccatcccggccgcctgcgcgcctggaccgagagcggcctggcgggctacctggagggctaccggctgcacgatgtggtctacagcgagcaccatcaccaccagcgcggcaaccaggagcgcgaccgcgtgctggagcaattggcggagctactggagaacggcgcggcggccggcgcctggccgctgcgcaacccacggctgaacgccctgctgctctactccgggctgcatggcgccgccgacgacgccatcgccggcggccgcctggatacccagccgctggccggcgaactcgccgatgccttcctgcgcctgctcggtgccagcgactga

SEQ ID NO: 5803 - DNA, 957 bp, Pseudomonas aeruginosa
tcgcgcatagactgtcaaatcgaatttgacaatagggtcgccttccatggtcagcctcgaccgcttcgaaacctttcgcgccgtggtcgactgcggttccctcagcgccgccgccgacaccctcggccagacgcgtgcggtagtcagcttcaacctcaagcggctggaggccgagctgggcgtttctctgctcagccgcagcacccggcggatggccctgaccgatgctggcgaacgcttctaccagcgctgcgtgaaggtgctcgacgaggcgcgcctggccatcgacgacgcccgcgccgagcatggcgaactgcgtggcagcctgcgcgtcaccaccacccaggaatacggcctgcgccaactggtgccggccctgcaggcattcgcccggctgcacccggcgttgcaggtacaattgtcgacctcatcgctgcatgccgacctgattggcgaacgcttcgacgtcgccatccgcctggggcgcctggaggactccacccaccatgcggtgcaactggccagcttcgaggtcctggcggtggccagcccggcctgcctggcggcgctcggcgaaccgccgccgaccgacctggagagtctggagcgcctgcagaatctcggtcacagccggctggcggactccctgccctggcaagtacgcgcccccgacggcgccctgcgcagctaccgcggaccgcgccatcccatgctgctggccgacaacgccgcggccctgcgcgcctttgccctcgacggcctgggtatcgccgtgctgccggactggctggtgcaggccgacttgcgctgcggcgcactgcaacgcctgctggcggacacgggtttccgctccagggcgtgcatgccgtttatccgccgacccgccacctgccgtcgaaggtccgcgcgttcatcgacttcctcaagactcgcctggggcacccggacgccggttag

SEQ ID NO: 5804 - DNA, 1329 bp, Pseudomonas aeruginosa
tttcatattgaaaccttacggagcgcttcgcatgccatcctcgccatcctccctcccctccgcgctggtgctgctgttcgccgtcgcctgcggtctcagcgtggccaacgtctattacgcccagccgctgctggacgtcctcggtgccgagttcgccatcggccaggccggggtcggcctgctgttcggcgcgacccaggccggttgcgccctggcgctgctgctggtggtgccgctgggcgacctgctggagcggcgccggctgatgttcgtccagctcctgctgctggtgctgtcgctgctgctggtgggcttcgccggcgataccctcggcctggcgctggggctgctcggactgggcctgctcggcaccgccatgacccagggactgctggcctacgccgcggcgctggcggcgcctggcgagcgcgggcgggtggtcggcgcggcgcagggcggcgtggtgataggcctgctgctggcgcgcagcctggccgggctgctcgccgacctcggcggctggcgcagcgtctacctggtctcggcagcgagcatgggcgggctcggcctgctgctctggcgggtactgccggcggcgccgagcaacgaactggggctgacctaccggcaactgctcggctcgatgttcgacctgctggcgagccagcgcgtgctgcaggtgcgcggcctgctcgggctgttgatgttcgccgccttcggggtgttctggagcagcctggtattgctgctcggcgcgccgccgcattcgctgtcgcacagcgccatcggcgccttcggcctggtcggcgcgctcggcgcgctgggcgcggcgcgggccggcagcctggccgatcgcggccacgcccaggcgctcagcggcggcgccctgctgctgttgctgctgtcctggctgccgctcgccctcggcgcgcattcgctggcggcgctgattctcggcgtgctgctgctcgatctcgccggccaggcgatccatgtgctcaaccagagcctggtcttcgccatcgacccgcgcgcccacagccgcctggtgggttgctacatgctgttctacgccgccggcagcggcctcggcgccagcgccggcaccgccatgtacgcctgggccggctgggacgcggtgagcctgctcggcgcggcgatcagcctggcggccctggcgttctggtggttcacccgtggcgttggcggcgaagcgcgtacggcctgcgccaacggcgcctgagccggcttcaatcgagttcgcgcaggcgctgctcgatgaagcgccgctccggctcctggcgcgccagggccagcgccgcgcggtag

SEQ ID NO: 5805 - DNA, 594 bp, Pseudomonas aeruginosa
ggaatccgggcctcgcggatcttgttcttggcccgcacgatgcgttgggcgatggcgctgggcgcggcgaggaaggcgcgggcgatctcctcggtgcgcaggtcgcagacctcgcgcagggtcagcgccacctgtgcctcgggggtcagcgccgggtggcagcaggtgaagatcaggcgtagccggtcgtcttccaccgcatcgccctcctccgccggcgcctcggcctgctcttccagttgctcggcgagcagtcgctgcgaggcgtcgaagcgcgctcgccggcgcaggttgtcgatggccttgaagcgcccagcggaaaccagccaggcgcgcgggttgcgcgggataccgtcgcgcggccactgctcgacggcggcgatgaaggcgtcgtgcaaggcctcctcggccagctcgaaatcgccgagcaggcggacaagggtcgccagcacgcgccgcgactcctcgcggtacagcgcctcgatgcggctgcgcaacggctcgccgtgctccctcaatggctggcctgcgcatggcagcaggcgcttttcggcgcctcgtcgtagcggtcgtggtgacgcagccagtccatga

SEQ ID NO: 5806 - DNA, 1005 bp, Pseudomonas aeruginosa
ggtcgcgcgcctcgatcaggtagaagccaccgagttgctccttggtctcggcgaacggcccgtcggtcatcgccagccgcccgccctggtggcgcagggtggtggcggtctgcaccgactgcagggcgtgcgaggcgatgtagtggccggccttgcccaactggtcggagtaggtcatgcactcgtcgacgatggcggcaagctcctcggccggcacggcggccagcttcgcttcgtcgaaatagatcaggcagaggtatttcatggcggtgggctcctggtgcggatcgacgatccgttcgttcggtagtcgcccggcgagggcgcctttcgacagcggcggggaaaaaagcccgcggcgcggacgaacggtcggcgctcgccgtggaacgctgccgaccgcagcacaagcctagacccgcccggccaccgggcgcgggccgtcggtcagggctggcgcggtgcgtagggattcaggcggggatcgcgcagcgggctttcccgggtcggcccgggatcgtcctggcgcaggcggagactgccgttgccgatcttcaagccgtccttggtcgtcgcctccccgtcggcgctggccgcgtcgctgcccggcaggtccggctcggcggcctccggttgcggctgtggcgcgctgcccatgggcgacggcgcgaccggcggcgcggcgggcaaggctgccggcagctcgtccggcaggggcgcggcgagggtcggttggcccaggccggcgagcaccatggccaggagcaggaaaagcacacgcgacatgacaaagcctcgataggcctcgggacttccaccatagccgcgcaacggccccggcgagcgaagtacggaccagcggcatcgcgcattggaaaaagggaattcctggaattgttcgataggaccctggccacctccgtcagctgtcaatcgacttttcgaacaacgcgcccgccccctattagaacagcgcaaaaaaactcgatcaaaagtacagcctga

SEQ ID NO: 5807 - DNA, 954 bp, Pseudomonas aeruginosa
atggcgcgccccggcgggccccaggcggctgcgcgactatgccccgccggtcccgcgcacgccggtgagcgcccgctacaacggccgcgcacgcctcgatctggcgccggccaagcagtggcggatcggctcggagagcaccgcggagcacctggcgacgccgctgaacgacctctccacggcctaccgcaagacgtccgcaggagccccggcggcgcacgccggcgacatcgccgaggcctttcgccgggcgctctgggaagccgccgcgcggctcgccagggaggatggcgatacgtggttcttcgagatactgcggggcaacccggggcctggcatcgaggccggccgggagacgccggcgaagcgctggcacgggctcgccgagacactcgacagcagtcctctgctggacccgctgcgcgtcgccctgagcgcccccggcctcgattcgcgcggtcgcccggccagcttcggagtacccgccgcggtggtctgccgctacctgcgccggcacggcatcgccccgttgcgcaccggcgactatcgcttcctgctgctgtttccccagggcgccagggcggaacacgcgcagccgctggtggacaggctgtgcgaattcaaacgccggcacgacgacaatgcgccgctgaagcaggtgttgccggagttgctcgacagctcgccgctgtaccgctacatcggcctgcgcgaactctgcgcgatgatccacgaagccagcctgcggctgcacctgaccgccctcgccgacgccgccgccagggctgccggccacgccgcgctggcgccggccacggtctatgggcacctggtcagggacgaaaccgaagcggtggcgatcgacaggctcggcggccgtgtggtcgccagcctggtcggcgtccatccggcggccgcgccgctgctgttgcccggcgaacgggtggccgatga

SEQ ID NO: 5808 - DNA, 567 bp, Pseudomonas aeruginosa
cctggtcacctcgcagacccgcatcccgctggtgcagaacggcaccgtggacatcgagtgcggctccaccaccaacaacgaagagcgccagaagcaggtcgacttctccgtcggcatcttcgaggtcggcacccgcctgctgtcgaagaagaccgccaacatcaaggacttcgacgacctcaagggcaagaacgtggtgaccaccgccggcaccacctccgagcgcctgctcaaggccatgaacgcggacaagaagatgggcatgaacatcatctccgccaaggaccacggcgagtccttcatgatgctcgaatccggccgcgcggtggccttcatgatggacgacgcgctgctctacggcgaaatggccaaggccaagaagccggacgactgggtcgtcggcggcaccccgcagtccttcgagatctacggctgcatggtgcgcaagggcgacgcggcgttcaagaaagtggtcgacaaggccatcaccgatacctacgccctccggcgaggtcaacaagatctacgacaagtggttcacccagccgatcccgccgaagggcctga

SEQ ID NO: 5809 - DNA, 762 bp, Pseudomonas aeruginosa
accgaggggaaaccccaacatgaattacaactgggactggggcgtgttcttcaagtccaccgggatcggcagcgaaacctacctcgactggtacatcgccggtctgggctggaccatcgccatcgccctggtcggctggatcatcgccctggcgctgggctcgctgctcggcgtcatgcgcaccgtgccgaaccgcctggtatcggggatcgccaccgcctacgtggaaatcttccgcaacgtgccgctgctggtgcagctgttcatctggtacttcctggtacccgacctgctgcccgagggcctgcagacctggttcaagcaggacctcaacccgactacctcggcctacctcagcgtggtcgtctgcctcggcctgttcaccgccgcgcgggtctgcgagcaggtgcgcaccggcatccaggcgctgccctacgggcagacctcggcggcccgcgcgatgggcttccgcctgccgcagatataccgccacgtgctgctgccgcaggccttccggatcatcatcccgccgctgacctcggagttcctcaacatcttcaagaactcctcggtggcgtcgctgatcggcctgatggagctgctggcgcagaccaagcagaccgccgagttctccgccaacctgttcgaggccttcaccctggccacgctgatctacttcacgctgaacatgagcctgatgctgatcatgcgcctggtggagagaaaggtcgccgtaccgggcctgatctccgtaggaggtaa

SEQ ID NO: 5810 - DNA, 669 bp, Pseudomonas aeruginosa
atgatggacttcagtggaatcgttcccgccctgccgagcctctgggaaggcatgctgatgaccctcaagctgatggtcctcggcgtcctcggcggcgtcgcgctgggtaccgtgctggcgctgatgcggctgtcgcacagcaagttgctgtcgaacatcgccggcttctacgtcaactacttccgctcaatcccgctgctgctggtgatcacctggttctacttcgcggtgcccttcatcctgcgctggatcaccggcgaggacaccccggtgggggcgttcacctcctgcctggtggccttcatgatgttcgaggcggcctactactgcgagatcgtccgcgccggcatccaggccatcccgaaaggccagatgggcgccgcccaggcactgggcatgacctacgggcagaccatgcgcctggtgatcctgccgcaggcgttccgcaagatgaccccgctgctgctgcaacagagcatcatcctgttccaggacacctcgctggtctataccgtcggcctgatggacttcctcaattcggcccgttcgcgcggcgacatcatcggccaggccaacgagttcctgattttcgccggcctggtctacttcgtcgtaagcttcaccgcctcgttcgccgtcaaacgtctgcagaaaaggttaaccgtatga

SEQ ID NO: 5811 - DNA, 1722 bp, Pseudomonas aeruginosa
atagggaaagcccatgcaacctgtgctcttcagaaccctgtccctcggcgtcgccattgccgccgcatcctcctcggccttcgccgccacgctcgacggcggcgccgtcgccgcgcccgacgagtacggcgccaaggtcgccgcgcagatcctcaaggccggcggcaacgcggtggacgccgcggtggccaccgccttcaccctggcggtcacctaccccgaggccggcaacatcggcggcggcggcttcatgaccctgtacatggacggcaagccgtacttcctcgactaccgcgaggtggcgccgaaggccgcgagcaagaccatgtacctggacgacaagggcgaggtgatcgagaacctcagcctggtcggcgccaaggccgccggcgtgccgggcaccgtgatgggcctctgggaagcccacaagcggttcggcaagctgccctggagcgagctgctgaccccggccatcggctacgcgcaaaagggcttcaaggtcgccgacaagcagttccagtaccgccaggacgccgtcgccctgttcaacggcaagaccaacttcggcgactacttcggccacatgaaggccggcgaggcgttcctccagccggacctggcgaagaccctggagcgtatcgccgacaagggcccggacgagttctacaaaggccataccgccgacctgctggtggcacagatgcagcaggacaagggactgatcacccaccaggacctcgccgactacaaggtcaggtggcgcgaaccgatgcgcgtcgactggcagggcaacacgctctataccgcgccgctgccaagctccggcgggatcgccctggcccagttgctgggcatcaaggaaaaccgtgccgccgacttcaagggcgtcgagctgaactccgcgcgctacatccacctgctggcggagatcgagaaacgcgtgttcgccgaccgcgccgactacctcggcgacccggacttctccaaggtcccggaggcgcgcctgaccgatccggcatacctgaagcagcgtgccgccgaggtcaatccgacggcgatctcgccgaccgagaaggtccgtcccggcctggagccgcaccagaccacgcacttctccatcgtcgacgccgacggcaacgcggtgagcaacacctacaccctcaactgggacttcggcagcggcgtggtggtcaagggcgctggcttcctgctcaacgacgagatggacgacttcagcgccaaaccgggcgtggccaacgccttcggcgtggtcggcagcgacgccaacgccatcgagccgggcaagcgcatgctctcctcgatgagcccgagcatcgtcacccgcgacggcaaggtcagcctggtggtcggcactcccggcggctcgcggatcttcacctcgatcttccaggtgctgaacaacatctacgacttccacctgccgctggagaaggccgtggccgcgcagcgcgtgcaccaccagttgctgcccaaggacacgatctactacgacgcctacgcgccgctcgccggcaaggtcgccgaggagctgaaggcgatgggctacaccctggaggaccagggctggaacatgggcgatatccaggccatccgcgtcgacggcaaggccctggagaccgcctccgatccccgtggccgcggcgtcggcctggtggtgaaaccctgacaggacggcgggcggccgacgccgcccgcgcctga

SEQ ID NO: 5812 - DNA, 2391 bp, Pseudomonas aeruginosa
gcagcatccgcgcggcgaagcggtcacctacctggcgcagacccgcgcgctgaacgacacaccgtggaacctgaccctgctcagcccgctggaagacctgcgccgcgacgcggtgcgcaacggcatgctggccgccatcggtttcgccctcctggcattcctgctgatcgcctggaacgagcggcgcaaggtactcgccacccgcctcgccgcgcgcgaggcgctgcaacgggccaacggcgagctggaagtgaagatcgccgaacgtaccgccgacctgcaggccagcaacgcacgcctgaccgccgagatccacgagcgccagcaggccgaggacaccctgcgcaaggcccaggacaaactggtccaggccggcaagctggcggtgatcgggcagatgtccaccagcatcgcccacgaactcaaccaaccgctggcggcgctgcgtacgctgtccggcaacaccgtgcgcttcctccagcgcggcaagctggagaccgccagcaccaacctcgccaccatcaacgaactggtcgaccgcatgggccgcatcaccgccagcctgcgtgccttcgcccggcgcagcgacgacgccggccaggccagcctggccaaggcggtggacgcggcgctgctgatcctgcacgggcgcctggagcaggacccgccgaccctgcaccggcatttcgacgacgtgcgcctgggcatcgaccagacccgcctggaacagatcctggtcaacctgctggccaacgccctcgacgccatgagcgggcaggccgaccgccagctctggctggaaggccggcgcgaggaggagcgctacgtcctgcgcgtgcgcgacaacggccccggtatcccgccggcggcgcgcgtccacctgttcgaaccctttttcaccaccaagcccggcgaacatggcctgggcctcggcctgaccctctcggccagcatggccaccgccgccggcggcagcctcagcgtgcagcaccccgaaagcggcggaaccgcattcgagctgagcctgtccctggttcccgattccccgactgcgagtcccgcccgatgaacgagccgctttccgtcctgatcgtcgaagacgatccgcatgtcttgctcggctgccagcaggcgctggagctggaggacatcccctgcatcggcgtcggcagcgccgaggaggcgctgcaacgggtcgaccgcgacttcgccggcatcgtcgtcagcgacatccgcctgcccggcatcgatggcctgaccctgctggagcgtctcaaggccctcgacccgagcctgccggtggtgctgatcaccggtcacggcgacatctccatggcggtacaggcgatgcacgccggcgcctacgacttcatggagaagcccttctctccggaacgcctggtcgaggtcgcccgccgcgccctggagcagcgcgggctggcccgcgaggtcagcgcgctgcgtcgccagttggccggccgccaggacctggcgcaacggatcatcggccgctcgccggcgatccaggcgttgcgcgagctgatcgccaacgtcggcgacacctcggccaacgtgctgatcctcggcgagaccggcacgggcaaggagctggtggcgcgttgcctccacgactatagccggcgccaccagcatgccttcgtcgcgctgaactgcggcggcctgccggagaacctgttcgacagcgagatattcggccacgaggcgcacgccttcaccggtgccaacaagcggcggatcggcaagatcgagcatgccaacggcggcacgctgttcctcgacgagatcgagagcatgccggtcaacctgcagatcaagctgctgcgggtgttgcaggaacacaccctggaacgcctcggctcgaaccagtcgatcccggtggactgccgggtgatcgcggcgaccaaggcagacctcgccgccatgggcaagagcggccagttccgcagcgacctttactaccggctcaaaatagtgagcctggaactgccggcgctgcgcgaccgccgcgaggacatcctgctgctcttcgaacacttcctccagcagtcctcgctgcgcttcgaccgccccgcgccggaactcgaccgtgccaccgtggccagcctgatggcccacgactggccgggcaacgtacgcgaactgcgcaacgtcgccgaacgcttcgccctcggcctgccggtgttcaacaagggcggccaggccgtacagaccggcggcccgcgcttcgccgaagcggtggaggcattcgagaaggccctgctcggcgacgccctggcccgccaccacggcaacctgacccaggccagccaggacctgggcatggccaagaccacgctgttcgacaaggtgaagaagtacggcctgcaatag

SEQ ID NO: 5813 - DNA, 1275 bp, Pseudomonas aeruginosa
cccgactgcctggctcggcctggcgaccctgatcgtgctggagatcgtcctcggcatcgacaacctggtgttcatcgcgatcctcgccgacaagctgccgccgcacctgcgcgaccgcgcccgggtcctcggcctgtcgctggcgctgctgatgcgcctgggcctgctggcgagcatctcgtggatggtgaccctcaccgagccgctgttcgaggtattcggcaagagcttctccggccgcgacctgatcatgctgttcggtggcgtgttcctgctgttcaaggccaccatggaactgcacgaacgcctcgaaggccatgtcgcccagcacgccggcaacaagacctacgcgctgttctggccgatcgtcgcgcagatcgtggtgctcgacgcggtgttctcgctcgacgcggtgatcaccgcggtgggcatggtcgagcatctggaagtgatgatgatcgcggtgatcgtctccatcggcctgatgatcgtcgccagcaagccgctgacccgcttcgtcaatcgtcacccgacggtgatcatgctgtgcctaggcttcctgatgatgatcggcttcagcctgaccgccgagggcctgggcttccatatcccgaaaggctacctgtacgcggccatcggcttctcgatcctcatcgaggtgttcaaccaggtcgcccgcaagcgccgcaagaagagcctgcagggccaccgcccgctgcgcgcgcgtaccgcccatgcggtgctgcgcctgctcggcggccagcgcctggaggccgacgaggtcggcgaggaagtcgccgacctgttcgaggagggcgacgaccaggtggtcttcgaccgccgcgagcgggtgatgatcagcggcgtgctgcaattggccgagaagcccatccgcagcctgatgacggtacgcgccgaggtcgactgcatcgacctcgacagcggccgcgaggcgatccgcgcggcgctgctcgaatcgtcctactcgcgcctgccgctggtgcgcgacgggcgcgtcgaggagccgctgggctacgtgcacaagaaggaactgctcaaggagcagctcgccggcgcccagccggatctggaaagcctggcccgccagccgctcaacctgttgcaggactgctcgatcctcaacgccctggagcagatgcgcgaggcctcgacccacgtggccttcgtggtcaacgagttcggcgagttcatcggcctgctgaccctgaccgacattctcgaatccatcgccggcgagctgcccgacgccagtga

SEQ ID NO: 5814 - DNA, 843 bp, Pseudomonas aeruginosa
ggtccggtgatcaagccggcgatggacgacacgaagagcaccttgccgccacgcttctgctcgaccatgcgccggacgaaaccctgggtcagttccaggttggcgaacacgttggtctcgaacagcgcgcgcaccagttccagcgggatctccgcgctggccccggcttcggcgctgccggcgttgttcagcagcacgtcgatatcccattcccaggcgcgttcgcgatcggcggcgacgttgatgtcgagggtttccacccgcagcggaacgccacgccgcccggcctcttcgcgcaggtcggcggcctgcccggcgccgcgcacgccggcgatcgtccgatggccgcgggcggccaggcgcaacgccacttcccgaccgaagccgctgccggccccggtcaccaggattcgcttctgtttcatctcgattacctctggattgttgccatggccacggcggcctcggcgatggattggtcctgggccgcgctggcgccggagacgccgacgccacccaggcaggaaccgccggcatcgcccagcggcatgccgccggcgaagcaggccagcccgccgttgctctgctcgatgctccacaacggctggcccggcccggcgagtcggcccagctcgccgctgggcaggcggaacagcgcggcgctgcgcgccttgcgctgggccaggtcgatggcaccgggaacgctgtcgtccatccgtacgaacgccagcaggttggcatgggcgtcgaccaccgcgacgcagaccgccaggcgctgccgctgcgcttcggcaatggccgccgcgatgcagcgttgggcatgttgcagagacaggtgggtag

SEQ ID NO: 5815 - DNA, 1041 bp, Pseudomonas aeruginosa
aaaggtcgaagctttaacagaaccggccttctcctacgtagactttcaagtttttctaacaatgaatcgacgcgatcccctcgccggcctgcacgtcttcaggcaggtcgccgacaccggcagcttcacccgcgccgccgccctgctcggggtgacgccggcagcggtgagccaggcgatcaaccaactggaagccgagctgcgtctcaagctgttccaccgcaccacccgcggggtcagcctgagcgaggccgggcagcgctaccacgaacagaccgaacagccctaccgcgacctggtgcgcgcccgcgaagcgctcggcgaaagcctcgcggaaccctccgggcagctgcgcatcagcgccctgcacctggcgaagaacctggtgatcgcaccgatgctcaacgagttcgtgcgacgctacccgaaggtacaactggagatccgctacgaggaccagttggtggatatcgtcagggaacgactggatgccggcatccgcctggccgacgccctgcagccgggcatggtcggggtgcaactgacagcgccgctggcgtgcctgctggtggccactccggcctacctcgccgagtacggtacgccggccagcgtcgccgacctcgatgggcatgccgccgtgcgcttccgtttcccgcgcagcggccgcctgcacaagtggcgcttgcgggaagacgggcgggaactggaagtggacctgccggcacgcttcgtcagcaccgacaccgaggcgatcatcgaggcggcccgcgccggcgcagggatcgcccaggcattcatccgcgagcgggtcgccgcggacctcgccgccgggcgcctggtggaagtgctgcctggcagttgcctgccgctgccgccgatgtggctgtattacctgaaccgccgccacgtaccggccaagctgcgcgccttcatcgaactgctacgcgagtggcggcagccggcctgaacctcagcggcccttgccggccggccccggccggctcagcaggaggtcgtccggtccgtcgatctcgatga

SEQ ID NO: 5816 - DNA, 447 bp, Pseudomonas aeruginosa
ggatcggcaagcgccggctggcgctcatcaccaccgagaaatgcagatagtccaggcgcgtgcccttgcccaccggcagcacctggtggctcttgcccggcttgggcaaggccgccttcggcccgaggaaggcctcgtcgaaacccttgcgctcggccaggtcggcgacgctgcgctgcttttcctggaagcgcggcacgccgcgcttcagctccgccccggccaccggcacccaggcgcgacgcgccagcaggctgcggatcacgctggccttcaccgcatagttggtcttgcggaactggccgccgaagtgcaggccgaccacctcgccgccgtcgatcgaaagcaccgccgagccggaattgccgcccagggtcgagcagtcgtgggtcaggtaccaggcgtcatggggcaatcccacgacttcgccgggagcgaagcgcttga

SEQ ID NO: 5817 - DNA, 273 bp, Pseudomonas aeruginosa
ttgaactcggtgatctggcgccggcccagcgccgcgcagaaggccttgaagctgcccggccgctcggccacggtgacggcgatgatcgcttcgcgctgttcgcccagttcggcgcgctcggcaacgtggcgcaggcggtcgaagttgatgttggcaccggagtcgatggccaccagggtctgcccctcggtgcgttcgcgggccacgtacttcttgatccccgctacggccagggcgccggccggctcggtgatcgaacgggtgtcgtcgtag

SEQ ID NO: 5818 - DNA, 432 bp, Pseudomonas aeruginosa
ccccgagccaggcgatcgcctggcccttggcgcccttgtgcgcagagagcatggccaggccgtaggtgcagctggaaaccagcaggatggcggtttccaccagcacgtagggcagctcgaagatgtccttgccgctggggccgccggcggtgtggtgaaccagcaccgcgtaggtggcgaagacgctggcgaacagcacgcagtcggtcatcaggtagagccagaaaccgaatacggtgttgccgccgctatcgtgtgcatgatcgtggtcgtggcccacttcgtgggcgtcggccagatgcttgttcaatactgccgtcgacatggttcagacctgcttggcgagttgctggaaacgggcgctttcgatcttctcgatctcttcgggctggacgtagtagtcgacgtcctggttgtagctgcgcacgatga

SEQ ID NO: 5819 - DNA, 1863 bp, Pseudomonas aeruginosa
cacaacagttggaatacgcgaatattcttcgcttcgagcagcataacgcaaggaaatcgcccccgcgccagcatcgtgacccgagagtcagtgtctatcggcctgcaactgtacccctgccgttcgtccagatgcgccaactgtatccgccgccgggccggcgctaacgcgcaggcgccagagcagcgcggcggccagcagggcgctggctccggccaccagcatagccagacggaagccctcggccagcgcggccggcagctcggcgtcgagccccgccagggaaccaggcaagcgatgggacgtgaccgcctgggtggcgagccgttgcgcatcggcaatccccagcccctccagccgatcgcccaggacgacgatcgcccgcccgctcagcagcgctcccagcaacgcgatgccgacggccatgccggcctggcgcagggtattcatggtcgccgaggccatcccggaacgctcgcgggccacgctcgccatgaccgccagaccggtgccgggaacggccaggcccatgcccaggccgagcgccaccagcaacaggccgacccagggatacgcggttcccgtaccgcaagcggccagcgccagcatggccaggccgatcaccaggtagcccagcaccagcaggcgtcgcagcggtacgtgccgctgcaaccggccgaacagcatggacagtgcgcccatggcgaggaactgcggcgccaggtagaagccggcctgctgcgccgaggcaccctgcacctgctggaagaacagggagaggaagaacaggctggcgtagccggaaaaaccgaggacgaacgaggccaggttgcagacggcgaacccggcctggcggaacaaccccaggggcagcagcggtcgggcggtccgccgctcgacgaagaggaagccaagcaggccgaccccggccaggagcagcgccggccaggccgtgggagacaaccagccgccctctcccgcggcgatcagggcgtaggtcaacgcccccagccagaccacgctgagcagctgccccagaggatcgaaggcggcgtgctcggggtgcgcggtttcctcgatgccccacaggcccagggcgagcgccagcaggccgagcggcaggttgatcaggaagatgctctgccagccggcgtgctccaccagcaggccgccgagcagcgggccgaggatcagcgacagcgcgctgaaggaggtccagccgccgatcacctgggcgcgctggccgggatcgtggaaagcctgggtaaggatcgacagcgcgccgggtatcaacagcgccccggcgatgccctggaccgcgcgtccgaacagcagcagcgccagcgaggtggccagcgcgcagagcagcgaaccgaagctgaacaggccgaccccgagcagccaggtgagcttgcgaccgtagcggtcgctcagcggtccggaagacagcatgaaggcgctcaggcacagcgcataggcgtcgaccacccactgcaggccggccaggtcggtatccagggcgtactgcagcgtcggcagggcgaggttgacaatgctgatgtcgagcgaggcgatgaaggttcccaggtaaatggcggcgaccagggcgacacgacgcgaagggtacatgggagtactcctatgagagggcgctggcccaggaataatccattgaccgacggtcagtcaataaatatcgcgaaacattctcatcttcctgtcatgcctcgtcttcccctccacgctcttttacactgcggccaacccaaccaccggacccgcgctccatgcccgatcgccacgccgaacagcctgcccgccaaccgcgcaccaagcctgctgaggttcgtctcgaggaactga

SEQ ID NO: 5820 - DNA, 747 bp, Pseudomonas aeruginosa
aggctcccggcacgcagagatagaccagcatcgccgtacgcagcaatggcgcctccagcaagccaaggtcgagcagcgcgtcggtacgagcgcgcccgtcacgccagtagcagcagcccagcacgcaggccagcagcgccaggagcaggccacgcccgccgccgccgggcgatcccagccaggcgagcgccaccagcagcgtggccagcgccgccgagccgagcagcaggccgcgcaggtccaggcgctgcgccgcatgcttgtgcctgggcagccagcgcatcgccagggccagcaccagcagcgccggcgccacgctggcgaagaagatcccacgccaggacaggctgtccaccagccagccgccgagggcaggcgccacggcgggaacgatcagcgccaccagcatcacccgtgcggtcaggccggcccgtgccgacgccgggacattccgataggccatggcctggccgagggggatcagcaacccgccggccaacccctggcacaggcgccagacgatcaacgtcgccgccgatccagccaggccgcaacccagcgaagcgctggcgaaaccggccagtgccagcagcatcagtcgccgttctcccaggcgcgaagcgagccagacgctcaacggaatcaccagggtcaagccgagcaggtaggtgttgccgatccacgccagggtcgccaccgaagcgccaagggaacgcccgatgtccggataggcgacgctggcgatga

SEQ ID NO: 5821 - DNA, 1248 bp, Pseudomonas aeruginosa
  unsure (984): Identity of nucleotide at the above locations are unknown.
actgtcaaatcgaatttgacaatagggtcgccttccatggtcagcctcgaccgcttcgaaacctttcgcgccgtggtcgactgcggttccctcagcgccgccgccgacaccctcggccagacgcgtgcggtagtcagcttcaacctcaagcggctggaggccgagctgggcgtttctctgctcagccgcagcacccggcggatggccctgaccgatgctggcgaacgcttctaccagcgctgcgtgaaggtgctcgacgaggcgcgcctggccatcgacgacgcccgcgccgagcatggcgaactgcgtggcagcctgcgcgtcaccaccacccaggaatacggcctgcgccaactggtgccggccctgcaggcattcgcccggctgcacccggcgttgcaggtacaattgtcgacctcatcgctgcatgccgacctgattggcgaacgcttcgacgtcgccatccgcctggggcgcctggaggactccacccaccatgcggtgcaactggccagcttcgaggtcctggcggtggccagcccggcctgcctggcggcgctcggcgaaccgccgccgaccgacctggagagtctggagcgcctgcagaatctcggtcacagccggctggcggactccctgccctggcaagtacgcgcccccgacggcgccctgcgcagctaccgcggaccgcgccatcccatgctgctggccgacaacgccgcggccctgcgcgcctttgccctcgacggcctgggtatcgccgtgctgccggactggctggtgcaggccgacttgcgctgcggcgcactgcaacgcctgctggcggacacgggtttccgctccagggcgtgcatgccgtttatccgccgacccgccacctgccgtcgaaggtccgcgcgttcatcgacttcctcaagactcgcctggggcacccggacgccggttagaaaaccgaggccgccgtggtttgtcgccctttgtatntcctctacctcgatctgttctccttcggcttctctttggatcctgtgcatgcctcctatttgctgggactttttggttgtcttcgattacggcggtatctgctgttactcgttctcttattctaactggtcggtcaatatcgttcgggttcgtctggatgctgtctgctatctctttggtccagctcctctttatgctgctcgcggttatctacgattatgccttggctcgcgtgcttctctaagtttcgtgtctgtctgttga

SEQ ID NO: 5822 - DNA, 1416 bp, Pseudomonas aeruginosa
cctctccagatagcgcgagcgcctcgctatgctccccggcaaacctccggagcgcccatgaatcaaccgtcccgcctggccactttgtacctgctggggttcgccctggacctggtgaacatcttcatcgccagcgtcgcctatccggacatcgggcgttcccttggcgcttcggtggcgaccctggcgtggatcggcaacacctacctgctcggcttgaccctggtgattccgttgagcgtctggctcgcttcgcgcctgggagaacggcgactgatgctgctggcactggccggtttcgccagcgcttcgctgggttgcggcctggctggatcggcggcgacgttgatcgtctggcgcctgtgccaggggttggccggcgggttgctgatccccctcggccaggccatggcctatcggaatgtcccggcgtcggcacgggccggcctgaccgcacgggtgatgctggtggcgctgatcgttcccgccgtggcgcctgccctcggcggctggctggtggacagcctgtcctggcgtgggatcttcttcgccagcgtggcgccggcgctgctggtgctggccctggcgatgcgctggctgcccaggcacaagcatgcggcgcagcgcctggacctgcgcggcctgctgctcggctcggcggcgctggccacgctgctggtggcgctcgcctggctgggatcgcccggcggcggcgggcgtggcctgctcctggcgctgctggcctgcgtgctgggctgctgctactggcgtgacgggcgcgctcgtaccgacgcgctgctcgaccttggcttgctggaggcgccattgctgcgtacggcgatgctggtctatctctgcgtgccgggagccttcatgggcgccaacctggtcgccatgctctatctgcaaggccccctcggcctcagcgcgagccgtgccggtgcgctgatgctgccctgggcgctggcggccggcctggccatcggcctgacccggcgacgcttcaatcgctgggggccgaaatccttgctgctggcgggcatggcgatacaggccggcggcctgctgtggctggctcgaagcggggaggggagcggcttctggcaactggcgggggcctacgcgaccatgggattcggcggcagcctgtgtagcagcgcggcacagggcatggccttgctcgacgtcccggcggcgcgcatgggccatgccagcgccttgtggaacatcaatcggcaactggcgttctgcctgggcatggccgtgctcggtgggttgctcaacctgttgcaggcgctggccgaccccgcggccttcgtccactgcttcctgttcgccgccgctttcacgctattgcctctgccgtgggtgaggcgtatcgattccgccggggttcgcgccctggtccagacctga

SEQ ID NO: 5823 - DNA, 1476 bp, Pseudomonas aeruginosa
gagtactcccatgtacccttcgcgtcgtgtcgccctggtcgccgccatttacctgggaaccttcatcgcctcgctcgacatcagcattgtcaacctcgccctgccgacgctgcagtacgccctggataccgacctggccggcctgcagtgggtggtcgacgcctatgcgctgtgcctgagcgccttcatgctgtcttccggaccgctgagcgaccgctacggtcgcaagctcacctggctgctcggggtcggcctgttcagcttcggttcgctgctctgcgcgctggccacctcgctggcgctgctgctgttcggacgcgcggtccagggcatcgccggggcgctgttgatacccggcgcgctgtcgatccttacccaggctttccacgatcccggccagcgcgcccaggtgatcggcggctggacctccttcagcgcgctgtcgctgatcctcggcccgctgctcggcggcctgctggtggagcacgccggctggcagagcatcttcctgatcaacctgccgctcggcctgctggcgctcgccctgggcctgtggggcatcgaggaaaccgcgcaccccgagcacgccgccttcgatcctctggggcagctgctcagcgtggtctggctgggggcgttgacctacgccctgatcgccgcgggagagggcggctggttgtctcccacggcctggccggcgctgctcctggccggggtcggcctgcttggcttcctcttcgtcgagcggcggaccgcccgaccgctgctgcccctggggttgttccgccaggccgggttcgccgtctgcaacctggcctcgttcgtcctcggtttttccggctacgccagcctgttcttcctctccctgttcttccagcaggtgcagggtgcctcggcgcagcaggccggcttctacctggcgccgcagttcctcgccatgggcgcactgtccatgctgttcggccggttgcagcggcacgtaccgctgcgacgcctgctggtgctgggctacctggtgatcggcctggccatgctggcgctggccgcttgcggtacgggaaccgcgtatccctgggtcggcctgttgctggtggcgctcggcctgggcatgggcctggccgttcccggcaccggtctggcggtcatggcgagcgtggcccgcgagcgttccgggatggcctcggcgaccatgaataccctgcgccaggccggcatggccgtcggcatcgcgttgctgggagcgctgctgagcgggcgggcgatcgtcgtcctgggcgatcggctggaggggctggggattgccgatgcgcaacggctcgccacccaggcggtcacgtcccatcgcttgcctggttccctggcggggctcgacgccgagctgccggccgcgctggccgagggcttccgtctggctatgctggtggccggagccagcgccctgctggccgccgcgctgctctggcgcctgcgcgttag

SEQ ID NO: 5824 - DNA, 1005 bp, Pseudomonas aeruginosa
ggccggaagatgaccaaagcaaacccgtttgccgcattgaaatggctttccctggcgcccgcgctgctgctcggcggctgcgacatgaccctgttcaacccgaaagggcaggtgggcatggacgagcgcaccctgatcattaccgcgaccctgctgatgctgatcgtggtcatcccggtgatcgtgatgaccctggcgttcgcctggaagtaccgcgcctcgaacacccaggccgagtacaagccggactggcaccattccaaccgcatcgaggcggtggtctggctggtgccctgcgtgatcatcgcgatcctcggctggatcacctgggaaagcacccacaagctcgacccgtaccgtccgctggactccgaggtcaagccggtcaccatccaggccgtttcgctggattggaagtggttgttcatctacccggagcagggtatcgccacggtcaacgagatcgccttcccgaaagacaccccggtgaatttccagatcacctcggattcggtgatgaactcgttcttcatcccgcagctgggcagccagatctactcgatggccgggatgatgaccaagctgcacctgatcgccaacgaagaaggcgtgttcgacggtatctccgcgaactacagcggcggcggtttctccggcatgcgcttcaaggccatcgccacctccgagcagggcttccaggactgggtcgccaaggtcaaggcggcaccggcaagcctgtcgatcggcacctatccggaactggtcaagccgagcgagaacgttccgccgacctacttctcttcggtcagcccggaactgtttggccacatcctcaccaagtacgagcaccacggcgacgccaagggtgccgcgcacggcgagcacgccggggctgagcacgaagccgccatgaccggtcacgacatgcaggacatggacatgcaagccatgcagggcatgaaagacatgaaggacatgcacatgcaaccgagtacccaggagtaa

SEQ ID NO: 5825 - DNA, 1983 bp, Pseudomonas aeruginosa
gcgcagatgttcgggaaactgacactctcggccgtgccttaccacgagcccatcgtcatggtcacactggccgtcgtcgccctgctgggcctcggcgtggtcggtgcgatcacctactaccgcaagtggacctacctgtggaccgagtggctgacctcggtcgaccacaagaagatcggcgtgatgtacatcgtcgtcgccctggtcatgctggtccgcggcttcgccgacgcgatcatgatgcgcggccaactggccctggccgaaggcgccaaccacggctacctgccgccggagcactacgaccagatcttcaccgcgcatggcgtgatcatgatcatcttcatggccatgccgttcatgaccggcctgatgaacctggccgtgccgctgcagatcggcgcgcgcgacgtggcgttccccttcctcaactcgctgagcttctggctgctcgtggtcagcgccatgctggtcaacgtgtcgctgggcctgggcgaattcgcccgtaccggctgggtggcctatccgccgctgtcggagctggcctatagccccggggtaggggtggactactacatctgggcgctacagatatccgggatgggcacgttgctcacggggatcaacttcctggtcaccgtgttcaagatgcgtgccccgggcatgaagctgatgcagatgccgatcttcacctggacctgcaccttcgccaacatcctgatcgtcgcctcgttcccgatcctcactgctgcgctgggcctgctgtcgctcgaccgctacctggacatgcacttcttcaccaacgagctcggcggcaacgccatgatgtacatcaacctcttctgggcctggggccatcccgaggtgtacatcctgatcctgccggccttcggtatcttctccgaggtcaccgcgaccttcgccggcaagcgcatgttcggctacaagtcgatggtctgggccagcgccgcgatcaccttcctcggcttcaccgtgtggctgcaccacttcttcaccatgggttcgggcggtgacgtcaacggcttcttcggcgtggccaccatgctgatctcgatccccaccggggtgaagctgttcaactggctgttcaccatctacaagggccgcctgcgcttcagcacgccgatcctgtggaccctgggcttcatggtgaccttcaccatcggcggcatgaccggcgtcctgctggccatcccgggcgcggacttcctgctgcacaacagcctgttcctgatcgcccacttccacaacaccatcatcggcggcgcggtattcggctacctggccggcttcgccttctggttcccgaaagcgttcggcttcaccctcgacgagaagtggggcaagcgttccttctggtgctggctggtgggcttctacatggccttcatgccgctctacatcctcggcttcatgggcatgacccgtcgcctgaaccactacgacaacccgctgtggaagccctacctggtggtcgcgttcttcggcgccgtgctgatcttctgcggcatcgcctgccaactgatccagctgttcgtctcggtccgcaaccgcaagcaactggccgacgtcaatggcgacccgtgggaatgccgcaccctggaatgggccacttcctcgccgccgccgttctacaacttcgccgagctgccgaaggtacaggacgtggatgccttccacgacatgaagaaggccggcaccgcctaccgcaagctgccggcctaccagccgatccacatgccgaagaacaccgccgcgggcttctccatcgccgtgttcgccttcgtcttcggcttcgccgccatctggcatatctggtggctcatggcggtcggcttcgtcggcatgatcggctccttcatcgtgcgcagctacaaccaggacgtcgactactacgtccagcccgaagagatcgagaagatcgaaagcgcccgtttccagcaactcgccaagcaggtctga

SEQ ID NO: 5826 - DNA, 633 bp, Pseudomonas aeruginosa
accatgtcgacggcagtattgaacaagcatctggccgacgcccacgaagtgggccacgaccacgatcatgcacacgatagcggcggcaacaccgtattcggtttctggctctacctgatgaccgactgcgtgctgttcgccagcgtcttcgccacctacgcggtgctggttcaccacaccgccggcggccccagcggcaaggacatcttcgagctgccctacgtgctggtggaaaccgccatcctgctggtttccagctgcacctacggcctggccatgctctctgcgcacaagggcgccaagggccaggcgatcgcctggctcggggtcaccttcctgctcggcgccgcgttcatcgggatggagatcaacgagttccaccacctgatcgccgaaggtttcggcccgagccgaagcgccttcctgtcgtccttcttcaccctggtcggcatgcacggcctgcacgtcagcgccggtctgctgtggatgctggtgctgatggcgcagatctggacccgcggcctcaccgcgcagaacaacacccggatgatgtgcctgagcctgttctggcacttcctcgacatcgtctggatctgcgtcttcaccgtcgtctacctgatgggggccctgtaa

SEQ ID NO: 5827 - DNA, 915 bp, Pseudomonas aeruginosa
tgccgatgccctgagggccatgacgtgaagctgaaacgctatctcctggtggccaagccgggaatcatcttcggcaacctgatcgcggtggcggggggatacttcctcgccgcccgcggcagcgtcgagccgatgctgttgctggccacggtcatcggcctgtcgctggtggtcgccagtgggtgcgtgctgaacaactgcatcgaccgcgacatcgaccggcacatggagcggacccgcgggcgggtcaccgtgaccgggcagatctcgctgaaggctgccctggcccacggcctggtcctcggggtcgccggcttcggcctgctgtggtggcggaccaacccgctgaccaccgcgctggccggcttcggctacttcgtctacgtcggcctgtacagcctgtggttcaagcgtcgttcgcagtacggcacgctggtcggcagcctctccggggcgatgccgccggtggtcggctactgcgcggtgagcggccagttcgacgccggcgccgcctcgctgctggcgatcttctgcctgtggcagatgccgcactcctatgccatcgccatcttccgcctgaaggactacgaggcggctggcatcccggtgctgccggtggcgcgcggcatcgcggtgaccaagatccacatcgtgctctacatcctcgccttcatggcggcgaccctcgccttgtgcttgggcggctacgccggctacggctacctgctggtggcggtggcggtgagcctgtggtggctggccatcgccctgaccggctactggaccgccgacgaccgggtctgggcgcgcaagctgttcgccttctccatcgtcgccatcaccgcgctgagcgtgatgatgtccatcgacttccaggtggcgcccgccacccatctggtcgcctcgctgttctga

SEQ ID NO: 5828 - DNA, 552 bp, Pseudomonas aeruginosa
ccttcgcgaccctgcttacccgccgcagcattattaccgccattccagctatggcgggttagccagcgtccactccgaacccgccctcgaggcgggttcttcgttctgtctcctgggccaaaaccaccgaaccgggagaacagcatgcagcaccagaccctccagaacctcgttggccgggccgacgccctgatcaatgccgggcagttcgatgccctgatggatttctattgcgacgacgccaccctggtggtcaagccgggcctcaacgcctgcggcaaggcgcagatccgccaggcgttcgacgccatcgcccggcacttcgagcacagcctgcgagtgcgccagcacgacctgcgggtgatcgaggcgggagatacggcgctggtcatggccgaggcggtgatcgagtcgaaggccggacgcctgcaacgtcgggccacctacgtgttccgccaggaggccgatggccagtggcgctgcgcggtggacaactcctacggcaccgacctgctggcctcggtggcggcgagcgcggaggccagccgatga

SEQ ID NO: 5829 - DNA, 1968 bp, Pseudomonas aeruginosa
actcctgccagggatatccgcccagcgagggacatggccatgcgcaagcgcaacccccggcgggccacgccggaagaactgcgggtctgctcggtactgaaggaaaagggcacccgcgaggaactcgcccacctcgccgcccgcggtgagtggagcaacgtgccggcgtacaacgccagccgcgagcagatcgccgaccacctgggcaagagcgtgtcgccggaatccgacgcctcgttcttcgactcgcggcgcttcagcgaggcgatcgtcctgctcaagagccggccggtgctgctggtgaagaacggtatcttcgacgaagcgccgctggccggcctggagcagcgcctgaagaagcatcgcgccgcgctggccacgccgatccgctcggtcggtcggctggaactgatcgaccacgacagcatggactggtgcggtaccggctggcgcatcgaggacgacctgatcgtcaccaaccggcatgtcgccagcctgttcgccgaacgccagggcagcctgttccgcttccgtctcaaccaggccggcaagcaggtgcgcacccgcgtggacttccgcgaggaataccgccagccggaaagcgacgagcatgtgatcgcgcgggtcctgtggatcgccccggacgtctccgaggcgccggacatggcgatcctccaggtagtgaagggcgacttgctgccgccgccgctggtcctcgcgcgccaggatgccgagccgcgccaggcggtggcggtggtcggctatccggcgcgcgacagccgcaacgacgccggggcgatggaagatatcttcggcaacatctacgacgtcaagcgcttcgctcccggcgaagtcgtgggattgccccatgacgcctggtacctgacccacgactgctcgaccctgggcggcaattccggctcggcggtgctttcgatcgacggcggcgaggtggtcggcctgcacttcggcggccagttccgcaagaccaactatgcggtgaaggccagcgtgatccgcagcctgctggcgcgtcgcgcctgggtgccggtggccggggcggagctgaagcgcggcgtgccgcgcttccaggaaaagcagcgcagcgtcgccgacctggccgagcgcaagggtttcgacgaggccttcctcgggccgaaggcggccttgcccaagccgggcaagagccaccaggtgctgccggtgggcaagggcacgcgcctggactatctgcatttctcggtggtgatgagcgccagccggcgcttgccgatcctcaccgcggtgaatatcgacggcgcgctcaagcgttcgctcaagcgcaaggattcctggggcttcgacccgcgcatcgaggcggccgcgcaggtcggacacaaggacttctacggcccggcttcgttcgacaagggccacatggtgcgtcgcgaggatcccggctggggcgacagcgatgccgtcgcccggcaggctgaggacgacaccttcgtctacaccaacgcggtgccccaggtggcgcagctcaaccagcgcagctggctgtcgctggaggactacgtgctgcagaacgccaggagcgagggcttccgcatctcggtgttcaccggcccggtgttccgcgacgacgatccgctctaccagggcgtgcaggtgccgctggagttctggaaggtggtggcgatgatcgacgccgacagcggcgaactgggagtgtccgcctacctgctggggcaggaagggatgatgcccagcgaaggcttccgctacggtgcgttcaagacctaccaggtgccgttggcgaaggtcgaggccagcgccgacctgcgtttctcccgcgccctgcgcaaggccgacgtgctcgccggcacgccgctggaggaggcgctggaaagcggtcgcttcatcgagatcgacggaccggacgacctcctgctgagccggccggggccggccggcaagggccgctga

SEQ ID NO: 5830 - DNA, 888 bp, Pseudomonas aeruginosa
cagttcgatgaaggcgcgcagcttggccggtacgtggcggcggttcaggtaatacagccacatcggcggcagcggcaggcaactgccaggcagcacttccaccaggcgcccggcggcgaggtccgcggcgacccgctcgcggatgaatgcctgggcgatccctgcgccggcgcgggccgcctcgatgatcgcctcggtgtcggtgctgacgaagcgtgccggcaggtccacttccagttcccgcccgtcttcccgcaagcgccacttgtgcaggcggccgctgcgcgggaaacggaagcgcacggcggcatgcccatcgaggtcggcgacgctggccggcgtaccgtactcggcgaggtaggccggagtggccaccagcaggcacgccagcggcgctgtcagttgcaccccgaccatgcccggctgcagggcgtcggccaggcggatgccggcatccagtcgttccctgacgatatccaccaactggtcctcgtagcggatctccagttgtaccttcgggtagcgtcgcacgaactcgttgagcatcggtgcgatcaccaggttcttcgccaggtgcagggcgctgatgcgcagctgcccggagggttccgcgaggctttcgccgagcgcttcgcgggcgcgcaccaggtcgcggtagggctgttcggtctgttcgtggtagcgctgcccggcctcgctcaggctgaccccgcgggtggtgcggtggaacagcttgagacgcagctcggcttccagttggttgatcgcctggctcaccgctgccggcgtcaccccgagcagggcggcggcgcgggtgaagctgccggtgtcggcgacctgcctgaagacgtgcaggccggcgaggggatcgcgtcgattcattgttag

SEQ ID NO: 5831 - DNA, 468 bp, Pseudomonas aeruginosa
agcttcgacctttctagactggcccgcaagcactcgatgaggacgccggccatgtctacccacctgtctctgcaacatgcccaacgctgcatcgcggcggccattgccgaagcgcagcggcagcgcctggcggtctgcgtcgcggtggtcgacgcccatgccaacctgctggcgttcgtacggatggacgacagcgttcccggtgccatcgacctggcccagcgcaaggcgcgcagcgccgcgctgttccgcctgcccagcggcgagctgggccgactcgccgggccgggccagccgttgtggagcatcgagcagagcaacggcgggctggcctgcttcgccggcggcatgccgctgggcgatgccggcggttcctgcctgggtggcgtcggcgtctccggcgccagcgcggcccaggaccaatccatcgccgaggccgccgtggccatggcaacaatccagaggtaa

SEQ ID NO: 5832 - DNA, 213 bp, Pseudomonas aeruginosa
ccggggccggcagcggcttcggtcgggaagtggcgttgcgcctggccgcccgcggccatcggacgatcgccggcgtgcgcggcgccgggcaggccgccgacctgcgcgaagaggccgggcggcgtggcgttccgctgcgggtggaaaccctcgacatcaacgtcgccgccgatcgcgaacgcgcctgggaatgggatatcgacgtgctgctga

SEQ ID NO: 5833 - DNA, 1074 bp, Pseudomonas aeruginosa
aggacgagcaggcgcaggcctggcagcgccgcctgtagcggtctgccgctgcgccggggaggacggcggccggatcggcggccgccgcttcgctcagcccctgcgcagcaggacccgggtcacccggcgttcttccacttccaccacccgcagttcccagtcctgccactgcaggcggtcgccgatcaccggcaggcggtcgagcaggctcatcaccagcccggcgagggtctggtagtcctccgtggcgcgcgcgtcgaaccccacgcgtcgacgcacctggctgaggttcatggcaccgctgaccagatagccgtcgttctcctcgaccacgtccggaccgtcgatctcactggcgtcgggcagctcgccggcgatggattcgagaatgtcggtcagggtcagcaggccgatgaactcgccgaactcgttgaccacgaaggccacgtgggtcgaggcctcgcgcatctgctccagggcgttgaggatcgagcagtcctgcaacaggttgagcggctggcgggccaggctttccagatccggctgggcgccggcgagctgctccttgagcagttccttcttgtgcacgtagcccagcggctcctcgacgcgcccgtcgcgcaccagcggcaggcgcgagtaggacgattcgagcagcgccgcgcggatcgcctcgcggccgctgtcgaggtcgatgcagtcgacctcggcgcgtaccgtcatcaggctgcggatgggcttctcggccaattgcagcacgccgctgatcatcacccgctcgcggcggtcgaagaccacctggtcgtcgccctcctcgaacaggtcggcgacttcctcgccgacctcgtcggcctccaggcgctggccgccgagcaggcgcagcaccgcatgggcggtacgcgcgcgcagcgggcggtggccctgcaggctcttcttgcggcgcttgcgggcgacctggttgaacacctcgatgaggatcgagaagccgatggccgcgtacaggtagcctttcgggatatggaagcccaggccctcggcggtcaggctgaagccgatcatcatcaggaagcctag

SEQ ID NO: 5834 - DNA, 768 bp, Pseudomonas aeruginosa
gcacagcatgatcaccgtcgggtgacgattgacgaagcgggtcagcggcttgctggcgacgatcatcaggccgatggagacgatcaccgcgatcatcatcacttccagatgctcgaccatgcccaccgcggtgatcaccgcgtcgagcgagaacaccgcgtcgagcaccacgatctgcgcgacgatcggccagaacagcgcgtaggtcttgttgccggcgtgctgggcgacatggccttcgaggcgttcgtgcagttccatggtggccttgaacagcaggaacacgccaccgaacagcatgatcaggtcgcggccggagaagctcttgccgaatacctcgaacagcggctcggtgagggtcaccatccacgagatgctcgccagcaggcccaggcgcatcagcagcgccagcgacaggccgaggacccgggcgcggtcgcgcaggtgcggcggcagcttgtcggcgaggatcgcgatgaacaccaggttgtcgatgccgaggacgatctccagcacgatcagggtcgccaggccgagccaggcagtcgggtcagctatccattccatgtgcgcttacctcccggtccggctggccgtcgcgctggcgcgacgctgcacggcgcggctgcggcagccggcggtgacggagggggacgaggcgagggattcggcgtcgaggggcggacgcaggtggcgaaggcgaagcggggagggttgtccggaaggacgactggggggctccgaaagggtggtcatgatggccattga

SEQ ID NO: 5835 - DNA, 936 bp, Pseudomonas aeruginosa
actgggcggaaccccgccactgcgagcagacatgagcaccgaggatttcgacgcgatcaccgccaccaccctggccgactaccagcgcaacgccgaaggcttccgcgagggcacccgaggccacgacgtgagccagaacgtcgaggcgctgctgcgccatatcgacgggccgccgccgtaccggatcctcgatttcggctgcggtcccgggcgcgacctggccaccttccgccgcctcggccaccagccggtgggactcgaaggcacgccgcgcttcgtcgagatggccagggccgacagcggttgcgaggtatggcaacagaatttcctggcgctgcgactgccggccgggcacttcgacggcatcttcgccaacgccagcctgttccatgtgcccggcagcgccttgccgcgggtgctcggcgaactcttcgaagcgctgcggccgggcggcgtgctgttcagctccaacccgcgcggcgacaaccgcgagggctggaatggccaacgctacggtgcctaccacgattacccggcctggaaacgcctgctggaggaagccggtttcgtcgagctggagcactactaccggccgccgggcctgccgcgcgagcagcagccctggctggcgagcgtctggcggcgccccgtctgaaggcgctacagggtctgccggtgcggcgtgccgagcacgctgcggtactggtcgaggcgcttcggcgagaggtcgctgcgctccaggctgtcgagggcgtaggacttgatttcggcgtcgctgtaggggcgttcgacgctgcgcggcgggttggcgcaaccggccaggacgaccaggctggcggccagggagacgatcagggacttgctcatggcggattcctcgaaatgttcctcgatgctatcggtggtcccccctgtccaggaaatcaggcctattaa

SEQ ID NO: 5836 - DNA, 2019 bp, Pseudomonas aeruginosa
cgacgatgccggcgaagtcgcggtcgacccgttgcagcgcctcctcggcgctgccgacgccgatgcaggggatgtcctccagctccagcgcctgctggcagccgagcaagacatgcggatcgtcttcgacgatcaggacggaaagcggctcgttcatcgggcgggactcgcagtcggggaatcgggaaccagggacaggctcagctcgaatgcggttccgccgctttcggggtgctgcacgctgaggctgccgccggcggcggtggccatgctggccgagagggtcaggccgaggcccaggccatgttcgccgggcttggtggtgaaaaagggttcgaacaggtggacgcgcgccgccggcgggataccggggccgttgtcgcgcacgcgcaggacgtagcgctcctcctcgcgccggccttccagccagagctggcggtcggcctgcccgctcatggcgtcgagggcgttggccagcaggttgaccaggatctgttccaggcgggtctggtcgatgcccaggcgcacgtcgtcgaaatgccggtgcagggtcggcgggtcctgctccaggcgcccgtgcaggatcagcagcgccgcgtccaccgccttggccaggctggcctggccggcgtcgtcgctgcgccgggcgaaggcacgcaggctggcggtgatgcggcccatgcggtcgaccagttcgttgatggtggcgaggttggtgctggcggtctccagcttgccgcgctggaggaagcgcacggtgttgccggacagcgtacgcagcgccgccagcggttggttgagttcgtgggcgatgctggtggacatctgcccgatcaccgccagcttgccggcctggaccagtttgtcctgggccttgcgcagggtgtcctcggcctgctggcgctcgtggatctcggcggtcaggcgtgcgttgctggcctgcaggtcggcggtacgttcggcgatcttcacttccagctcgccgttggcccgttgcagcgcctcgcgcgcggcgaggcgggtggcgagtaccttgcgccgctcgttccaggcgatcagcaggaatgccaggagggcgaaaccgatggcggccagcatgccgttgcgcaccgcgtcgcggcgcaggtcttccagcgggctgagcagggtcaggttccacggtgtgtcgttcagcgcgcgggtctgcgccaggtaggtgaccgcttcgccgcgcggatgctgctcatcggcggggaagctgagcttctccacaccggcggccagcggctcgcgctgcagcggttgccactcgttcagcgcccaccagtagtactgcatgctgcgcgccaggcgctccttgtcgtcggcgctcagggagcgcaccgccttcaggcgcagggcggggttgctggagaggatgatgatgccgttctcgtcgctgacgaaggcttccaggcgcgccttctcccagcgttcctcgagggcgtccatcttcaccttgactaccgccacgccgatgatccggccgccgtggaccaggccgtgggccaggtagtagcccggctcgccgcgggtgctgccgatgccgtagaagcggcccggcttgcccttcatcgcgtcctgccagtaggcgcggaacgacaggtcctcgccgaggtagctgtccgggtcgctccagttgctggtggccaggacccggccgttggtgtccagcaggtacaccgcgcggctgccggcgcggcggttgaggccttcgaggtaggcgttgacctggttgcgccggtatggcgtcgggtcggtgagcaggtgactgacgctgcgctccagctccagcaggctgggcaggtaggtgtacttgctgatctcgctctcgaccgtccgtgcatgcagctccagctggcgttcgccattctcggcgagggcacggatgccggcgctctcgctgatccggtagccgccgtagccgaagccgagcatcagcaggagcaggggaatggggagcagcaactggcggacgaggcggggcttcacggtcagtga

SEQ ID NO: 5837 - DNA, 270 bp, Pseudomonas aeruginosa
ctcttgccctcgaccaccatgcccagcgggccccacgggctcttgaacgcttcggtcttgatgttgaccatcttgctcgcgtcgcggccggagaggatctcgtcgttcatggtgatcagcacgcccttgccgcgtgccgacttgtcgccggccaccgccacggcgttgtacaggttgagcatgccgtcggcggacatcgcggtgcccgggcgcatcgagccgaccaccacgataggcttctcggtgtgctcgaccagggtcaggaagtag

SEQ ID NO: 5838 - DNA, 2772 bp, Pseudomonas aeruginosa
gtggcgctgttggcggcgctggcgccggcgccggcgatggtgccgccggtggccaggatgaccacgttggacagtttctgttgcggtgcgacttccttggcctgggcggcctgcggcagcaggagcatcagggccataacaccgggggcgaacgcgtggagcaatggcttcatggcgatatctcgtgtcggtaggttggtagggttatcgtcgttgcacgcaatcaggcgcgggcggcgtcggccgcccgccgtcctgtcagggtttcaccaccaggccgacgccgcggccacggggatcggaggcggtctccagggccttgccgtcgacgcggatggcctggatatcgcccatgttccagccctggtcctccagggtgtagcccatcgccttcagctcctcggcgaccttgccggcgagcggcgcgtaggcgtcgtagtagatcgtgtccttgggcagcaactggtggtgcacgcgctgcgcggccacggccttctccagcggcaggtggaagtcgtagatgttgttcagcacctggaagatcgaggtgaagatccgcgagccgccgggagtgccgaccaccaggctgaccttgccgtcgcgggtgacgatgctcgggctcatcgaggagagcatgcgcttgcccggctcgatggcgttggcgtcgctgccgaccacgccgaaggcgttggccacgcccggtttggcgctgaagtcgtccatctcgtcgttgagcaggaagccagcgcccttgaccaccacgccgctgccgaagtcccagttgagggtgtaggtgttgctcaccgcgttgccgtcggcgtcgacgatggagaagtgcgtggtctggtgcggctccaggccgggacggaccttctcggtcggcgagatcgccgtcggattgacctcggcggcacgctgcttcaggtatgccggatcggtcaggcgcgcctccgggaccttggagaagtccgggtcgccgaggtagtcggcgcggtcggcgaacacgcgtttctcgatctccgccagcaggtggatgtagcgcgcggagttcagctcgacgcccttgaagtcggcggcacggttttccttgatgcccagcaactgggccagggcgatcccgccggagcttggcagcggcgcggtatagagcgtgttgccctgccagtcgacgcgcatcggttcgcgccacctgaccttgtagtcggcgaggtcctggtgggtgatcagtcccttgtcctgctgcatctgtgccaccagcaggtcggcggtatggcctttgtagaactcgtccgggcccttgtcggcgatacgctccagggtcttcgccaggtccggctggaggaacgcctcgccggccttcatgtggccgaagtagtcgccgaagttggtcttgccgttgaacagggcgacggcgtcctggcggtactggaactgcttgtcggcgaccttgaagcccttttgcgcgtagccgatggccggggtcagcagctcgctccagggcagcttgccgaaccgcttgtgggcttcccagaggcccatcacggtgcccggcacgccggcggccttggcgccgaccaggctgaggttctcgatcacctcgcccttgtcgtccaggtacatggtcttgctcgcggccttcggcgccacctcgcggtagtcgaggaagtacggcttgccgtccatgtacagggtcatgaagccgccgccgccgatgttgccggcctcggggtaggtgaccgccagggtgaaggcggtggccaccgcggcgtccaccgcgttgccgccggccttgaggatctgcgcggcgaccttggcgccgtactcgtcgggcgcggcgacggcgccgccgtcgagcgtggcggcgaaggccgaggaggatgcggcggcaatggcgacgccgagggacagggttctgaagagcacaggttgcatgggctttccctatttattgttatcgcaggcgagggtggagcaggcccccgccgggcgggccggcgagggcgggtacatcagtgcgggaggatcttggcgaggaactgctgggcacgttcggagcgggcgctgacgtcgccgaagaactcctccttctcgcagtcttccacgatctgcccgcggtccatgaagatcacccggttggcgaccttgcgcgcgaagcccatctcgtgggtcacgcacatcatggtcatgccttcgtgggccaactggaccatcacgtcgagcacttcgttgaccatttccgggtcgagcgccgaggtcggctcgtcgaacagcatcaccaccgggtccatcgccagcgcgcgggcgatcgccacgcgctgctgctggccgccggagagctggccggggtgcttgtgcgcgtgctccttgagaccgacgcgctcgagcagggccaggcccttcttggtggcttcttccttgctgcggccgagtaccttgatctgcgcgatggtcaggttctcggtgatgctcaggtggggaaacagctcgaaatgctggaacaccatgccgacccgcgagcgcagcttgggcaggttggtcttcggatcggcgatggaggtgccgtcgacgacgatgtcgcccttctggaagggttccagtgcgttgacgcacttgatcagggtcgacttgcccgagcccgacggcccgcagaccaccaccacttcgcctttcgcaacctcggtggagcagtcggtcaggacctggaagtcgccataccacttgctgacattcttgatggaaatcatacggttaaccttttctgcagacgtttga

SEQ ID NO: 5839 - DNA, 1077 bp, Pseudomonas aeruginosa
agtccatcatttacctcctacggagatcaggcccggtacggcgacctttctctccaccaggcgcatgatcagcatcaggctcatgttcagcgtgaagtagatcagcgtggccagggtgaaggcctcgaacaggttggcggagaactcggcggtctgcttggtctgcgccagcagctccatcaggccgatcagcgacgccaccgaggagttcttgaagatgttgaggaactccgaggtcagcggcgggatgatgatccggaaggcctgcggcagcagcacgtggcggtatatctgcggcaggcggaagcccatcgcgcgggccgccgaggtctgcccgtagggcagcgcctggatgccggtgcgcacctgctcgcagacccgcgcggcggtgaacaggccgaggcagacgaccacgctgaggtaggccgaggtagtcgggttgaggtcctgcttgaaccaggtctgcaggccctcgggcagcaggtcgggtaccaggaagtaccagatgaacagctgcaccagcagcggcacgttgcggaagatttccacgtaggcggtggcgatccccgataccaggcggttcggcacggtgcgcatgacgccgagcagcgagcccagcgccagggcgatgatccagccgaccagggcgatggcgatggtccagcccagaccggcgatgtaccagtcgaggtaggtttcgctgccgatcccggtggacttgaagaacacgccccagtcccagttgtaattcatgttggggtttcccctcggttcaatcggttgcagacactggcggggaaggcaggcgccggcgcggccgtgcgggccggcggcgctgctcttccgggggagacggctggggaggggcaggcccctccccgcgtccccgaggccccgctgcgaggcgggggcgacgcgcgaagcgctggcgctccgggaggaacgccaggcgctcgttacatctgctcggcggccttgtcggtcgggctggcgatcagcttcttcagctcttcgctcatggggaagttgaggttcaggcccttcggcgggatcggctgggtgaaccacttgtcgtag

SEQ ID NO: 5840 - DNA, 942 bp, Pseudomonas aeruginosa
atcttgttgacctcgccggagggcgtaggtatcggtgatggccttgtcgaccactttcttgaacgccgcgtcgcccttgcgcaccatgcagccgtagatctcgaaggactgcggggtgccgccgacgacccagtcgtccggcttcttggccttggccatttcgccgtagagcagcgcgtcgtccatcatgaaggccaccgcgcggccggattcgagcatcatgaaggactcgccgtggtccttggcggagatgatgttcatgcccatcttcttgtccgcgttcatggccttgagcaggcgctcggaggtggtgccggcggtggtcaccacgttcttgcccttgaggtcgtcgaagtccttgatgttggcggtcttcttcgacagcaggcgggtgccgacctcgaagatgccgacggagaagtcgacctgcttctggcgctcttcgttgttggtggtggagccgcactcgatgtccacggtgccgttctgcaccagcgggatgcgggtctgcgaggtgaccaggttatagcggaccttcagctcggggaggttgagttccttcttcaccgcctcgaccactttcagttgcaggtcgtgggagtagccgatcggcttgcccggctcggtgccgaggtaggagaagggaatcgaagcgtcacggtgaccgagggtgatggtgccggtgtccttgatcttcttcagcgtgccggtgagctcgtcagcgacgaccggagcggacaacagagcggccacgatggcggtgctcagcagactgggagcgatacgcatgaatttcttcctcgacttgttttgatttttattgagccgcgagcgcctggcctctccgggacagggtgtttcgcggttttccccggcgggggaagccacgagagtatcgtgcttgccgaacagtgtagtggcaggatgcatgccagcttatga

SEQ ID NO: 5841 - DNA, 855 bp, Pseudomonas aeruginosa
gctgtcgtctgttccccgagccgcgttcctgagcggttcgtcactcgacaggagactcccatgcagatcgatctgagcgacaaactggcaatcgtcagcggttccaccgccggcatcggcttcgccatcgccagcggcctcgccgccgccggcgccaccgtggtggtcaacggacgcagccaggcggcggtggaccgtgcgatcgcggcgatccggaacggccagccggatgccaggatacgcggcgtcgccggcgacctgggcacggcggaaggctgcgcggccttcgtcgcggccgagccgaaggcggacatcctggtcaacaacctgggcatcttcgagctgaaggacttcttcgacatcgaggacgccgagtggagccgcttcttcgaggtcaacgtgatgtccggggtacgcctggcccgcgcctacgtcccgggaatggtcgagcggggttgggggcgagtggtgttcctgtcttcggaatcggcgttgaacatcccggcggacatgatccactacggcttcagcaagaccgccaacctctcggtgtcgcgcggcctggccaagcgcctggccggcaccggggtgacggtgaatgcggtgctgcccggaccgaccctcaccgaaggcgtcgccgagatgctccgcgaggatgcgcagaaggccgggcagagcatagaagaggccggcaccgcctttgtccggcagcaccgttccagttcgatcatccagcgcctggcgacgcccgaggaagtcgccaacctggtggtctacacctgctcgacccaggcctcggcgaccaccggcgcggccctgcgggtcgacggcggggtgctcgacagcctggcctga

SEQ ID NO: 5842 - DNA, 330 bp, Pseudomonas aeruginosa
cgaggcgcgacaggaggcgccggcaggtctagaacggcaggtaccgtcattcagaggataccgccactcatgtcagctgcctcgttagccaccctcgacgggtcgctccgcatgacccccgtcgagcaaccccgaccgccggctctcgccgacctcggcagccgcctgatgatcgtcgtcgagcgacgcgaggactgggcctcctacctgcccagcgaggaagtactcaccgcccaggaatacctcgagcaatcggcgcacgaccacggcggccgccgcgtgcagatgatcaacctgtgccgcggctacaagtacctcggcctcggctaa

SEQ ID NO: 5843 - DNA, 1314 bp, Pseudomonas aeruginosa
tactgttcgctgctggccgaggcccgtggccaccgggtgatcccgtcgctgcgctgcatcagcgaactggctcgcaagtcggtgtacgggctggccctgggtggcctcgacaaggccctggacaaggcgctgtgccgtacgccctatggcgccaccgacggcttcaccctgaccctgtatttcggccataccgagttcgagccgctggccgacctcgcgcgccagttgttcgaagcctttccctgtccgatcctgctggtggagttccgtcgccagcagggctggcatatcgagggcgtgcgccctggcgtgctgaaccgcttgcgcagcgaccaggaggatgtcttcgccgatgccctcgacggtttcagccggcgcgcctggcgcatgccgcgttcgcggcgggtggcacgctacgacatggcgatcctccacgatcccgacgaagcgctgccgccgtccaacccgcaggcgctggccaacttcgtacgggtcggcgccagcctcggcatcgacgtcgaactgatcggacgcaaggactacgcgcgcctggccgagttcgacgccctgctgatccgcgagaccacccgggtcgaccaccatacctatcgcttcgccgagaaggccgagcgcgaaggcctggtggtgatggacgacccggcatcgatcctgcgctgcaccaacaaggtctacctggccgacctgcttggttgccggcaactgggcatgccgctcaccgagatcctctacaaggaacgcccgcaggactggcagcgggtggcccggcgcctgggcttcccgctggtgctgaagattcccgatggctgcttctcccgtggcgtggtcaaggtcaacgacgacagcgaactgctggcggcggcgagcgagctgttcgagcgctcggtcctgttgctggcccaggagttcttctacaccgagtacgactggcgcatcggcgtgctcgaccgccaaccgctgtacgcctgccagtacttcatgtcgcgcggccactggcagatctacaaccacaaggccgacgggcaggacgtcaacggcgagtgccgcgccgtgccgctggagcaggtgccgccggcggtgctggagctggccctggaggccgccgggctgatcggcgacggcctctacggggtggaacctgaagcaggccggcgacaaggtgctggtcatcgaggtcaacgacaacccgaatatcgatgccggcgtcgaggacgggccagctcggcgacgaactctaccggcgcatcctccaggccttcgtccagcgcctggaactcaagcaccgtggccagttga

SEQ ID NO: 5844 - DNA, 1251 bp, Pseudomonas aeruginosa
gcaaggcgctacgctgaacggcgcgcctcagtccggccggcgcgtggccaggcgcaggccggagccgcgggcgagggcggccggcctgacgcaacggacccggtagcggccgcgctcatcgatctcgatgccctgcaactcgggagcgaaaccgggaaagtgctcgccgaaggcctgcaaggccagcaggtagtcgatcagcgccggcgattcatcggccacccgttcgccgggcaacagcagcggcgcggccgccggatggacgccgaccaggctggcgaccacacggccgccgagcctgtcgatcgccaccgcttcggtttcgtccctgaccaggtgcccatagaccgtggccggcgccagcgcggcgtggccggcagccctggcggcggcgtcggcgagggcggtcaggtgcagccgcaggctggcttcgtggatcatcgcgcagagttcgcgcaggccgatgtagcggtacagcggcgagctgtcgagcaactccggcaacacctgcttcagcggcgcattgtcgtcgtgccggcgtttgaattcgcacagcctgtccaccagcggctgcgcgtgttccgccctggcgccctggggaaacagcagcaggaagcgatagtcgccggtgcgcaacggggcgatgccgtgccggcgcaggtagcggcagaccaccgcggcgggtactccgaagctggccgggcgaccgcgcgaatcgaggccgggggcgctcagggcgacgcgcagcgggtccagcagaggactgctgtcgagtgtctcggcgagcccgtgccagcgcttcgccggcgtctcccggccggcctcgatgccaggccccgggttgccccgcagtatctcgaagaaccacgtatcgccatcctccctggcgagccgcgcggcggcttcccagagcgcccggcgaaaggcctcggcgatgtcgccggcgtgcgccgccggggctcctgcggacgtcttgcggtaggccgtggagaggtcgttcagcggcgtcgccaggtgctccgcggtgctctccgagccgatccgccactgcttggccggcgccagatcgaggcgtgcgcggccgttgtagcgggcgctcaccggcgtgcgcgggaccggcggggcatagtcgcgcagccgcctggggcccgccggggcgcgccattcacgcaggtcgctgtcgatgcgctcggcgatgaagcgtgcggggccggcggccaggttgaagcatccctggacctcgtccagtag

SEQ ID NO: 5845 - DNA, 498 bp, Pseudomonas aeruginosa
gcttgtgctgcggtcggcagcgttccacggcgagcgccgaccgttcgtccgcgccgcgggcttttttccccgccgctgtcgaaaggcgccctcgccgggcgactaccgaacgaacggatcgtcgatccgcaccaggagcccaccgccatgaaatacctctgcctgatctatttcgacgaagcgaagctggccgccgtgccggccgaggagcttgccgccatcgtcgacgagtgcatgacctactccgaccagttgggcaaggccggccactacatcgcctcgcacgccctgcagtcggtgcagaccgccaccaccctgcgccaccagggcgggcggctggcgatgaccgacgggccgttcgccgagaccaaggagcaactcggtggcttctacctgatcgaggcgcgcgacctcaaccaggccctgcagatcgccgcgaagattccgccgggacggctcggctgcgtcgaggtgcgaccggtcaaggaatgggagtga

SEQ ID NO: 5846 - DNA, 924 bp, Pseudomonas aeruginosa
gggcgcccggcgccggaggtgaagtatgtgccccctgtgcatcgcatccctgtccctggtgtgcgccggcggcgcttcgctggccggcttcgccctggcgaccgggcgccggcgccgctggcggaacgaccccgggcaggctggaaaaccgagaatttccgtggagaatcggcaatgaatccttctttgcaggaccacccggtgagcagccgggaacaatggctggacgcccgtcgccgtctgctggcgcgggaaaagcaactcacccgcctgcgcgaccaggtcgccgccgaacgacgcgaactgccctgggtcagggtggacaaggactaccgcttccagggcgagcgcggtgagcgttcgctggccgagttgttcggcggcaatagccagctaatcgtctaccacttcatgttcgcgccgggctggagcgaaggctgcgtcggctgttcgttcctcgccgaccacatcgacggcgccaaccggcacctggcgcaccacgacgtcagcctggtggcggtatcgcgcgcgcccctggaagagttccaggcgttccgccggcgcatgggctggcgtttcgactggtactcctcgtacggcagcgatttcaacagtgacttcggggtgtccttcgacaaggcgcaactggccgccggcagcgtcgactacaactaccagccgacccccgacgccggcgaggaaatgccgggtgccagcgtgttcctgcgcaatccggcgggcgaggtgttccacacctattcggcctatgcgcgcggcctcgacatcctgctcaccacctacaccttcctcgacctgacgcccaaggggcgcaacgaggacgcgatcatggactggctgcgtcaccacgaccgctacgacgaggcgccgaaaagcgcctgctgccatgcgcaggccagccattga

SEQ ID NO: 5847 - DNA, 1857 bp, Pseudomonas aeruginosa
tcgtcgaggggctcggcctggtcgagcgggccctggccagccgccgcgtcgggccctacaccctgcaggcggcgatcgttgcggtgcatgcccaggcgccgcgcgccgaggacaccgactgggcacggatcgtcgccctctacgacgcgctgctgtacctggcgccgtcgccggtggtcgaactcaaccgcgccgtggccttggccatgcgcgatggcgtcgaggtcgggctggccgtggtcgatgcgttgctggcgcgaggtgaactggccgattaccacctggcgcactcggcgcgtgccgacttctgccgccgtctcggtcgccgccgcgaggcccgcgaggcctaccgcgcggcgctggccctggcgcgccaggagccggagcggcgcttcatcgagcagcgcctgcgcgaactcgattgaagccggctcaggcgccgttggcgcaggccgtacgcgcttcgccgccaacgccacgggtgaaccaccagaacgccagggccgccaggctgatcgccgcgccgagcaggctcaccgcgtcccagccggcccaggcgtacatggcggtgccggcgctggcgccgaggccgctgccggcggcgtagaacagcatgtagcaacccaccaggcggctgtgggcgcgcgggtcgatggcgaagaccaggctctggttgagcacatggatcgcctggccggcgagatcgagcagcagcacgccgagaatcagcgccgccagcgaatgcgcgccgagggcgagcggcagccaggacagcagcaacagcagcagggcgccgccgctgagcgcctgggcgtggccgcgatcggccaggctgccggcccgcgccgcgcccagcgcgccgagcgcgccgaccaggccgaaggcgccgatggcgctgtgcgacagcgaatgcggcggcgcgccgagcagcaataccaggctgctccagaacaccccgaaggcggcgaacatcaacagcccgagcaggccgcgcacctgcagcacgcgctggctcgccagcaggtcgaacatcgagccgagcagttgccggtaggtcagccccagttcgttgctcggcgccgccggcagtacccgccagagcagcaggccgagcccgcccatgctcgctgccgagaccaggtagacgctgcgccagccgccgaggtcggcgagcagcccggccaggctgcgcgccagcagcaggcctatcaccacgccgccctgcgccgcgccgaccacccgcccgcgctcgccaggcgccgccagcgccgcggcgtaggccagcagtccctgggtcatggcggtgccgagcaggcccagtccgagcagccccagcgccaggccgagggtatcgccggcgaagcccaccagcagcagcgacagcaccagcagcaggagctggacgaacatcagccggcgccgctccagcaggtcgcccagcggcaccaccagcagcagcgccagggcgcaaccggcctgggtcgcgccgaacagcaggccgaccccggcctggccgatggcgaactcggcaccgaggacgtccagcagcggctgggcgtaatagacgttggccacgctgagaccgcaggcgacggcgaacagcagcaccagcgcggaggggagggaggatggcgaggatggcatgcgaagcgctccgtaaggtttcaatatgaaactaaagcggaggctaggaattttggttttaaaatgcaacctaaattatcgcagcagtgcgtctatcgatcgcgactcgcgcacagtggaacgcgggcccgctcttctaattctctgattggaccgggcggtgtctccggatctactcgccgtgggtttccgttagctccccatcctggctga

SEQ ID NO: 5848 - DNA, 444 bp, Pseudomonas aeruginosa
ggtcgacaattgtacctgcaacgccgggtgcagccgggcgaatgcctgcagggccggcaccagttggcgcaggccgtattcctgggtggtggtgacgcgcaggctgccacgcagttcgccatgctcggcgcgggcgtcgtcgatggccaggcgcgcctcgtcgagcaccttcacgcagcgctggtagaagcgttcgccagcatcggtcagggccatccgccgggtgctgcggctgagcagagaaacgcccagctcggcctccagccgcttgaggttgaagctgactaccgcacgcgtctggccgagggtgtcggcggcggcgctgagggaaccgcagtcgaccacggcgcgaaaggtttcgaagcggtcgaggctgaccatggaaggcgaccctattgtcaaattcgatttgacagtctatgcgcgattagcctctccagatag

SEQ ID NO: 5849 - DNA, 444 bp, Pseudomonas aeruginosa
ggcgtatcgattccgccggggttcgcgccctggtccagacctgaaaggagctacaccatgacttgtgcctaccgccgggaaatccaccatgcccacgtggcgatccgcgactggctggccggcgactcacgggctgacgcgctggatgcgttgatggcgcgtttcgccgaggacttctcgatggtcacgccgcatggcgtggtcctggacaagactgctctgggcgagctgttccgcagcaagggcggcacccgtcctgggctgcgcatcgagatcgacggcgagagtctgctggcttcaggcgtggatggcgcgaccctggcctatcgggaaatccagtccgacgcggcgggtcgcagcgagcgcctgtccaccgtagtcctgcaccgtgacgacgaagggcggctgtactggcgccacctgcaggaaaccttctgcggctga

SEQ ID NO: 5850 - DNA, 1599 bp, Pseudomonas aeruginosa
ctgaccgtcggtcaatggattattcctgggccagcgccctctcataggagtactcccatgtacccttcgcgtcgtgtcgccctggtcgccgccatttacctgggaaccttcatcgcctcgctcgacatcagcattgtcaacctcgccctgccgacgctgcagtacgccctggataccgacctggccggcctgcagtgggtggtcgacgcctatgcgctgtgcctgagcgccttcatgctgtcttccggaccgctgagcgaccgctacggtcgcaagctcacctggctgctcggggtcggcctgttcagcttcggttcgctgctctgcgcgctggccacctcgctggcgctgctgctgttcggacgcgcggtccagggcatcgccggggcgctgttgatacccggcgcgctgtcgatccttacccaggctttccacgatcccggccagcgcgcccaggtgatcggcggctggacctccttcagcgcgctgtcgctgatcctcggcccgctgctcggcggcctgctggtggagcacgccggctggcagagcatcttcctgatcaacctgccgctcggcctgctggcgctcgccctgggcctgtggggcatcgaggaaaccgcgcaccccgagcacgccgccttcgatcctctggggcagctgctcagcgtggtctggctgggggcgttgacctacgccctgatcgccgcgggagagggcggctggttgtctcccacggcctggccggcgctgctcctggccggggtcggcctgcttggcttcctcttcgtcgagcggcggaccgcccgaccgctgctgcccctggggttgttccgccaggccgggttcgccgtctgcaacctggcctcgttcgtcctcggtttttccggctacgccagcctgttcttcctctccctgttcttccagcaggtgcagggtgcctcggcgcagcaggccggcttctacctggcgccgcagttcctcgccatgggcgcactgtccatgctgttcggccggttgcagcggcacgtaccgctgcgacgcctgctggtgctgggctacctggtgatcggcctggccatgctggcgctggccgcttgcggtacgggaaccgcgtatccctgggtcggcctgttgctggtggcgctcggcctgggcatgggcctggccgttcccggcaccggtctggcggtcatggcgagcgtggcccgcgagcgttccgggatggcctcggcgaccatgaataccctgcgccaggccggcatggccgtcggcatcgcgttgctgggagcgctgctgagcgggcgggcgatcgtcgtcctgggcgatcggctggaggggctggggattgccgatgcgcaacggctcgccacccaggcggtcacgtcccatcgcttgcctggttccctggcggggctcgacgccgagctgccggccgcgctggccgagggcttccgtctggctatgctggtggccggagccagcgccctgctggccgccgcgctgctctggcgcctgcgcgttagcgccggcccggcggcggatacagttggcgcatctggacgaacggcaggggtacagttgcaggccgatagacactga

SEQ ID NO: 5851 - DNA, 1920 bp, Pseudomonas aeruginosa
aaaaaaccctccatcaatcaaatgccaatgattctcaataaccaagatggagtacttcatggatcgtcgcaacgagccgtcccccttgcccaccaaacgcccgctggcgccgctgatgctgttgatggccgcctgctcctcgccggccctggccgaggacgcggcgcgcaaggacgatcccctggaactgggagccgacacggtcaccggcgagcaggcctcgtccagggtcgaacgctcggcctcggccaagtacgccgtgccgctgctggataccccgcagaccgtcacggtggtgccgcaaaaggtgatccaggagcagaacgccctgagcctgcgccaggtgctgtccaacgtctccggcatcaccttcaacgccggcgagggcggcggcggttccggcgacagcatcaacatccgcggcttcagcgccaacgccaacatgcaggtggacgggctgcgcgacagcgcccagaccagccgcagcgacctgttcaacctggaggcggtggaagtgatcaagggaccgaactcggtgttcggcggcgccggcaccagcggcggcagcatcaacatggtcagcaagcagcccaaggccgaagccttcacccacctgggcgccgggctgggcacggaccgctaccggcgcctgaccctggacaccaaccagccgctggaagggcttggcgaatcgaccgccttccgcctcaacctcatggcccaccacaacgacgtcgccgggcgcgaacagatcgacaagcagcgctggggcatcgcgccatccctgaccttcggcctggacaccccgacccgcctgaccctgagctacttccaccagcgcgacgacaaccttcccgactatggcgtgccggcgctgaacgggcgcaagctggacggcgtcagccgccacgattatttcggctggcgcaacctggacgaggaacggatcgacaacgacgtcgccaccctcaagctcgaacacgatttcagcgacgacttccagttgcagaacctcatccgctattcccacctgcatcgggacacggtgatctccgcctcccacgtcaaccagaagggcctgccgccgggtcgctacctgccggcgggaccgcaagcctacgggcgcgattcgaagacgcggatgtggatcaaccagaccaacctcaccggccgcttcgataccttcggcctggcgcatacgctgatcggcggcttcgagctgtcccgcgagacctacgaccgcaccacctactcctacaacctgggcaagttctacccggccaacggcttcgacctgcacaacccgccgggctactggaacggccccaccgacaagcgcgacagcgcgcgcaaccggaccgaactggaggtcaaggcgctgtacgccttcgacaccatcgccctggacgagcgctgggacctcagcctgggcctgcgctacgactggatcgacggcacctcgcggagcacgccctcaggcaagccgacggtgcgcgccgacagttccgacggcaagctgagcacacgggcggggctggtattcaagccgctggagaacgggcgggtgtacttctcctacggcacctccttcaacccctcggcggaacacctggtcactaccggctcgggcgtgaccgaggcgaccggaggcctggcgccggagaagaacagtacctacgagctgggcaccaagtgggagttcctcggacggcgcctggagctggacgcggcgctgttccaggtgaagaaggaggacgctcgcgaacgcctggccgacggcagctacgtgcttgccggcgaacagcgcgtgcgtggcctggagctgagcgccagcggcaagctgaacgagcactgggacctcttcgccacctacacctacctcgacagcgaaaccctgaaatccagcaacccgcagcgtga

SEQ ID NO: 5852 - DNA, 393 bp, Pseudomonas aeruginosa
actttttcactgcggcgcctatcaactcctttgcaagtcatttttcagggagcctcttcgatggcacgcaagaacgcagtgaaagacaacctcgagcagattcagcaccagagctacagcgagctgcaggaactgctctccgaagccaacagcatgctcgccgacagcgccgctttcgccggcgacaaggccgacagcgcccgtgcgcggatcggcgcgctgctggagaaggccaacgatgccctcggcaagggcggtagcgccgtggccgaacgcagccgccacgcggtggatgcgacggaaagctatatcggcgccaatccctggcagaccgtggccatcaccaccgcggtgggcctgctcgccggcttcctgctcgggcgtcgctcctga

SEQ ID NO: 5853 - DNA, 1842 bp, Pseudomonas aeruginosa
tcgagtcgaaggccggacgcctgcaacgtcgggccacctacgtgttccgccaggaggccgatggccagtggcgctgcgcggtggacaactcctacggcaccgacctgctggcctcggtggcggcgagcgcggaggccagccgatgagcgcctcgaccctcagcgcaagcaaacccctgctggccggctacgtggaaagcatcctggccgcgccggtgtacgacgtcgccgtggaaacccccttgcaggtcgcgccgcagttgtcccagcgcctgggcaaccgggtgctgctcaagcgcgaggacctgcagccggtgttctccttcaagatccgcggcgcctacacccgtgtcgcgcgcctgagcgacgagcagaaggcccgcggggtgatcaccgcctccgccggcaaccatgcccagggcctggccctggcggcgcagcgcctgggcgtgcgggcggtgatcgtgatgccgcgcaccactcccgagctcaaggtcaagggcgtgctggcgcgcggcggcgaggcgttgctgcacggcgacgccttccccgatgcgctggcccatgccctgcaactggccgagcgcgaaggcatgaccttcgtcccaccctacgacgatccggacgtgatcgccggacagggcacggtggcgatggagatcctccgccagcacagcggccgcctcgacgcgatcttcgtgccggtcggcggcggcagcctgatcgccgggatcgccgcctacgtcaagcacctgcgtccggatattcgcgtgatcggcgtcgagccggaggattccaactgcctgcaggcggcgctggccgccggcgaacgggtggtgctgggccaggtcgggctgttcgccgacggggtggcggtggcgcagatcggcgcttgcaacttcgaggtctgcaaggaccatgtcgacgaggtgatcaccgtcggcagcgacgaaatctgcgcggcgatcaaggacatctacgacgacacccgttcgatcaccgagccggccggcgccctggccgtagcggggatcaagaagtacgtggcccgcgaacgcaccgaggggcagaccctggtggccatcgactccggtgccaacatcaacttcgaccgcctgcgccacgttgccgagcgcgccgaactgggcgaacagcgcgaagcgatcatcgccgtcaccgtggccgagcggccgggcagcttcaaggccttctgcgcggcgctgggccggcgccagatcaccgagttcaactaccgctaccacagcgaccgccaggcccacctgttcgtcggcgtgcagacccatccgctcaccgacagccgcgccgacctgctcgccggcctgcgcgagcagggcttcccggtactcgacctgaccgacaacgagatggccaagctgcacatccgccacatggtcggcggccacggtaccgaggtgcgccgcgagcggctgttccgcttcgagtttcccgaacgccccggggccttgctgaacttcctcgacaagctcggctcgcgctggaacatcagcctgttccactaccgcaaccacggcgccgccgacggtcgggtgctggccggattacaggtgccggacgaggagcgcggcgagctggaggcggcgttgcaagccatcggctatccgtactgggaggaaacccacaacccggcctaccggctgttcgccggttgagcggcgcggcggtgcgccaacgggacatggccctgtcatgtccctcggctagactcctgccagggatatccgcccagcgagggacatggccatgcgcaagcgcaacccccggcgggccacgccggaagaactgcgggtctgctcggtactga

SEQ ID NO: 5854 - DNA, 1125 bp, Pseudomonas aeruginosa
ggacgccggccatgtctacccacctgtctctgcaacatgcccaacgctgcatcgcggcggccattgccgaagcgcagcggcagcgcctggcggtctgcgtcgcggtggtcgacgcccatgccaacctgctggcgttcgtacggatggacgacagcgttcccggtgccatcgacctggcccagcgcaaggcgcgcagcgccgcgctgttccgcctgcccagcggcgagctgggccgactcgccgggccgggccagccgttgtggagcatcgagcagagcaacggcgggctggcctgcttcgccggcggcatgccgctgggcgatgccggcggttcctgcctgggtggcgtcggcgtctccggcgccagcgcggcccaggaccaatccatcgccgaggccgccgtggccatggcaacaatccagaggtaatcgagatgaaacagaagcgaatcctggtgaccggggccggcagcggcttcggtcgggaagtggcgttgcgcctggccgcccgcggccatcggacgatcgccggcgtgcgcggcgccgggcaggccgccgacctgcgcgaagaggccgggcggcgtggcgttccgctgcgggtggaaaccctcgacatcaacgtcgccgccgatcgcgaacgcgcctgggaatgggatatcgacgtgctgctgaacaacgccggcagcgccgaagccggggccagcgcggagatcccgctggaactggtgcgcgcgctgttcgagaccaacgtgttcgccaacctggaactgacccagggtttcgtccggcgcatggtcgagcagaagcgtggcggcaaggtgctcttcgtgtcgtccatcgccggcttgatcaccggaccctataccggcccctactgcgcctccaagcatgccctggaggccttcgccgaggccctgcatgccgaactgaagccgttcggcatccaggttggcaccatcaatcccggcccgtaccagaccggcttcaacgatcgcatgatggaaacctggaaacgctggtacgacccgcagcgccacttcaccgaccacagcggcgtgcgctttcccttcgagcagtacgatccggaggaaatgatcgcgcggatggtcgagctggccgaggctga

SEQ ID NO: 5855 - DNA, 1311 bp, Pseudomonas aeruginosa
gtcttgttgccggcgtgctgggcgacatggccttcgaggcgttcgtgcagttccatggtggccttgaacagcaggaacacgccaccgaacagcatgatcaggtcgcggccggagaagctcttgccgaatacctcgaacagcggctcggtgagggtcaccatccacgagatgctcgccagcaggcccaggcgcatcagcagcgccagcgacaggccgaggacccgggcgcggtcgcgcaggtgcggcggcagcttgtcggcgaggatcgcgatgaacaccaggttgtcgatgccgaggacgatctccagcacgatcagggtcgccaggccgagccaggcagtcgggtcagctatccattccatgtgcgcttacctcccggtccggctggccgtcgcgctggcgcgacgctgcacggcgcggctgcggcagccggcggtgacggagggggacgaggcgagggattcggcgtcgaggggcggacgcaggtggcgaaggcgaagcggggagggttgtccggaaggacgactggggggctccgaaagggtggtcatgatggccattgagagtcaaagggaagtcgatcctactgtgtcgcgggccctcgccacagcgggaaactattacaaaaccttaggcgaaacccgtgccggcgctagactgggcggaaccccgccactgcgagcagacatgagcaccgaggatttcgacgcgatcaccgccaccaccctggccgactaccagcgcaacgccgaaggcttccgcgagggcacccgaggccacgacgtgagccagaacgtcgaggcgctgctgcgccatatcgacgggccgccgccgtaccggatcctcgatttcggctgcggtcccgggcgcgacctggccaccttccgccgcctcggccaccagccggtgggactcgaaggcacgccgcgcttcgtcgagatggccagggccgacagcggttgcgaggtatggcaacagaatttcctggcgctgcgactgccggccgggcacttcgacggcatcttcgccaacgccagcctgttccatgtgcccggcagcgccttgccgcgggtgctcggcgaactcttcgaagcgctgcggccgggcggcgtgctgttcagctccaacccgcgcggcgacaaccgcgagggctggaatggccaacgctacggtgcctaccacgattacccggcctggaaacgcctgctggaggaagccggtttcgtcgagctggagcactactaccggccgccgggcctgccgcgcgagcagcagccctggctggcgagcgtctggcggcgccccgtctga

SEQ ID NO: 5856 - DNA, 1617 bp, Pseudomonas aeruginosa
agcatcgcgccctgcgccaggcgggcagggcgaagagggcgctccggcctattgcaggccgtacttcttcaccttgtcgaacagcgtggtcttggccatgcccaggtcctggctggcctgggtcaggttgccgtggtggcgggccagggcgtcgccgagcagggccttctcgaatgcctccaccgcttcggcgaagcgcgggccgccggtctgtacggcctggccgcccttgttgaacaccggcaggccgagggcgaagcgttcggcgacgttgcgcagttcgcgtacgttgcccggccagtcgtgggccatcaggctggccacggtggcacggtcgagttccggcgcggggcggtcgaagcgcagcgaggactgctggaggaagtgttcgaagagcagcaggatgtcctcgcggcggtcgcgcagcgccggcagttccaggctcactattttgagccggtagtaaaggtcgctgcggaactggccgctcttgcccatggcggcgaggtctgccttggtcgccgcgatcacccggcagtccaccgggatcgactggttcgagccgaggcgttccagggtgtgttcctgcaacacccgcagcagcttgatctgcaggttgaccggcatgctctcgatctcgtcgaggaacagcgtgccgccgttggcatgctcgatcttgccgatccgccgcttgttggcaccggtgaaggcgtgcgcctcgtggccgaatatctcgctgtcgaacaggttctccggcaggccgccgcagttcagcgcgacgaaggcatgctggtggcgccggctatagtcgtggaggcaacgcgccaccagctccttgcccgtgccggtctcgccgaggatcagcacgttggccgaggtgtcgccgacgttggcgatcagctcgcgcaacgcctggatcgccggcgagcggccgatgatccgttgcgccaggtcctggcggccggccaactggcgacgcagcgcgctgacctcgcgggccagcccgcgctgctccagggcgcggcgggcgacctcgaccaggcgttccggagagaagggcttctccatgaagtcgtaggcgccggcgtgcatcgcctgtaccgccatggagatgtcgccgtgaccggtgatcagcaccaccggcaggctcgggtcgagggccttgagacgctccagcagggtcaggccatcgatgccgggcaggcggatgtcgctgacgacgatgccggcgaagtcgcggtcgacccgttgcagcgcctcctcggcgctgccgacgccgatgcaggggatgtcctccagctccagcgcctgctggcagccgagcaagacatgcggatcgtcttcgacgatcaggacggaaagcggctcgttcatcgggcgggactcgcagtcggggaatcgggaaccagggacaggctcagctcgaatgcggttccgccgctttcggggtgctgcacgctgaggctgccgccggcggcggtggccatgctggccgagagggtcaggccgaggcccaggccatgttcgccgggcttggtggtgaaaaagggttcgaacaggtggacgcgcgccgccggcgggataccggggccgttgtcgcgcacgcgcaggacgtag

SEQ ID NO: 5857 - DNA, 471 bp, Pseudomonas aeruginosa
ccttttctgcagacgtttgacggcgaacgaggcggtgaagcttacgacgaagtagaccaggccggcgaaaatcaggaactcgttggcctggccgatgatgtcgccgcgcgaacgggccgaattgaggaagtccatcaggccgacggtatagaccagcgaggtgtcctggaacaggatgatgctctgttgcagcagcagcggggtcatcttgcggaacgcctgcggcaggatcaccaggcgcatggtctgcccgtaggtcatgcccagtgcctgggcggcgcccatctggcctttcgggatggcctggatgccggcgcggacgatctcgcagtagtaggccgcctcgaacatcatgaaggccaccaggcaggaggtgaacgcccccaccggggtgtcctcgccggtgatccagcgcaggatgaagggcaccgcgaagtagaaccaggtgatcaccagcagcagcgggattga

SEQ ID NO: 5858 - DNA, 588 bp, Pseudomonas aeruginosa
cggttcgttcagaaattgttcaggcttcgttcaggcccgattcaggccgggttcagcagaattcacgctgcgaggcgcaagccgtcacgtcttgccttccttacctggcgacggccgcctggagtccccatgcgctatctcatcctgagcctgctggccgtgctcgccgcacctgcctgggctgccgacgacggcgacttctggtacctgcagaccagcgtctacacccggcatttcaacccggatccggaacacaacaatcaccaggacctgctcggcctcgaatacaaccgcgccgatggcgtgctggccggcggcgcgaccttccgcaactcgttcagccagcgctccaactacgcctacctgggcaagcgcttcgacagtgacagctacccggtctacctgaagctcaccggcggcctgttgcagggctatcgcggcgaataccgcgacaagatcccgctgaaccgcttcggcgtcgcgccggcgatcatcccctcggtgggcgttcgcttcggcccgctgggcagcgagctggtgctgctcggcaattcggcggcgatgatcaacctcggcctgcgtctctga

SEQ ID NO: 5859 - DNA, 195 bp, Pseudomonas aeruginosa
aagaggccggcaccgcctttgtccggcagcaccgttccagttcgatcatccagcgcctggcgacgcccgaggaagtcgccaacctggtggtctacacctgctcgacccaggcctcggcgaccaccggcgcggccctgcgggtcgacggcggggtgctcgacagcctggcctgacgagcgcgcaacgccagcgtaa

SEQ ID NO: 5860 - DNA, 735 bp, Pseudomonas aeruginosa
atggaagaaagatggcgaggcgagtgcgtgccgggatgttcgttgggtcctgcggaagtttctctggcaagtgctatcttcttttcggtggcgttcgactcctgcgtctgcgaagtgttaccggagcaactacgccggggcgcaattcgatttcaggttatatccgcgacctcatgctcaggctgtacttttgatcgagtttttttgcgctgttctaatagggggcgggcgcgttgttcgaaaagtcgattgacagctgacggaggtggccagggtcctatcgaacaattccaggaattccctttttccaatgcgcgatgccgctggtccgtacttcgctcgccggggccgttgcgcggctatggtggaagtcccgaggcctatcgaggctttgtcatgtcgcgtgtgcttttcctgctcctggccatggtgctcgccggcctgggccaaccgaccctcgccgcgcccctgccggacgagctgccggcagccttgcccgccgcgccgccggtcgcgccgtcgcccatgggcagcgcgccacagccgcaaccggaggccgccgagccggacctgccgggcagcgacgcggccagcgccgacggggaggcgacgaccaaggacggcttgaagatcggcaacggcagtctccgcctgcgccaggacgatcccgggccgacccgggaaagcccgctgcgcgatccccgcctgaatccctacgcaccgcgccagccctga

SEQ ID NO: 5861 - DNA, 420 bp, Pseudomonas aeruginosa
tcgtctaccacttcatgttcgcgccgggctggagcgaaggctgcgtcggctgttcgttcctcgccgaccacatcgacggcgccaaccggcacctggcgcaccacgacgtcagcctggtggcggtatcgcgcgcgcccctggaagagttccaggcgttccgccggcgcatgggctggcgtttcgactggtactcctcgtacggcagcgatttcaacagtgacttcggggtgtccttcgacaaggcgcaactggccgccggcagcgtcgactacaactaccagccgacccccgacgccggcgaggaaatgccgggtgccagcgtgttcctgcgcaatccggcgggcgaggtgttccacacctattcggcctatgcgcgcggcctcgacatcctgctcaccacctacaccttcctcgacctga

SEQ ID NO: 5862 - DNA, 1188 bp, Pseudomonas aeruginosa
cgcccaaggggcgcaacgaggacgcgatcatggactggctgcgtcaccacgaccgctacgacgaggcgccgaaaagcgcctgctgccatgcgcaggccagccattgagggagcacggcgagccgttgcgcagccgcatcgaggcgctgtaccgcgaggagtcgcggcgcgtgctggcgacccttgtccgcctgctcggcgatttcgagctggccgaggaggccttgcacgacgccttcatcgccgccgtcgagcagtggccgcgcgacggtatcccgcgcaacccgcgcgcctggctggtttccgctgggcgcttcaaggccatcgacaacctgcgccggcgagcgcgcttcgacgcctcgcagcgactgctcgccgagcaactggaagagcaggccgaggcgccggcggaggagggcgatgcggtggaagacgaccggctacgcctgatcttcacctgctgccacccggcgctgacccccgaggcacaggtggcgctgaccctgcgcgaggtctgcgacctgcgcaccgaggagatcgcccgcgccttcctcgccgcgcccagcgccatcgcccaacgcatcgtgcgggccaagaacaagatccgcgaggcccggattccctaccaggtaccgaccctggaggaactccccgagcggctgggcaacgtcctgcaagtgatctacctggtgttcaacgagggctactcggcctccaccggcgccagcctgacccgcgccgatctcagcggcgaggcgatccgcgtcggccgcctgctggtcgagctgctgcccgaccccgaggccctcggcctgctcgccctgatgttgctgcacgactcgcggcgccaggcgcggatctcggccagcggcgaactggtgcggctcgacgagcaggaccgcgctctgtgggatcgtggactgatcgtcgaggggctcggcctggtcgagcgggccctggccagccgccgcgtcgggccctacaccctgcaggcggcgatcgttgcggtgcatgcccaggcgccgcgcgccgaggacaccgactgggcacggatcgtcgccctctacgacgcgctgctgtacctggcgccgtcgccggtggtcgaactcaaccgcgccgtggccttggccatgcgcgatggcgtcgaggtcgggctggccgtggtcgatgcgttgctggcgcgaggtga

SEQ ID NO: 5863 - DNA, 435 bp, Pseudomonas aeruginosa
caacccaccaggcggctgtgggcgcgcgggtcgatggcgaagaccaggctctggttgagcacatggatcgcctggccggcgagatcgagcagcagcacgccgagaatcagcgccgccagcgaatgcgcgccgagggcgagcggcagccaggacagcagcaacagcagcagggcgccgccgctgagcgcctgggcgtggccgcgatcggccaggctgccggcccgcgccgcgcccagcgcgccgagcgcgccgaccaggccgaaggcgccgatggcgctgtgcgacagcgaatgcggcggcgcgccgagcagcaataccaggctgctccagaacaccccgaaggcggcgaacatcaacagcccgagcaggccgcgcacctgcagcacgcgctggctcgccagcaggtcgaacatcgagccgagcagttgccggtag

SEQ ID NO: 5864 - DNA, 1017 bp, Pseudomonas aeruginosa
aagcgttcgccagcatcggtcagggccatccgccgggtgctgcggctgagcagagaaacgcccagctcggcctccagccgcttgaggttgaagctgactaccgcacgcgtctggccgagggtgtcggcggcggcgctgagggaaccgcagtcgaccacggcgcgaaaggtttcgaagcggtcgaggctgaccatggaaggcgaccctattgtcaaattcgatttgacagtctatgcgcgattagcctctccagatagcgcgagcgcctcgctatgctccccggcaaacctccggagcgcccatgaatcaaccgtcccgcctggccactttgtacctgctggggttcgccctggacctggtgaacatcttcatcgccagcgtcgcctatccggacatcgggcgttcccttggcgcttcggtggcgaccctggcgtggatcggcaacacctacctgctcggcttgaccctggtgattccgttgagcgtctggctcgcttcgcgcctgggagaacggcgactgatgctgctggcactggccggtttcgccagcgcttcgctgggttgcggcctggctggatcggcggcgacgttgatcgtctggcgcctgtgccaggggttggccggcgggttgctgatccccctcggccaggccatggcctatcggaatgtcccggcgtcggcacgggccggcctgaccgcacgggtgatgctggtggcgctgatcgttcccgccgtggcgcctgccctcggcggctggctggtggacagcctgtcctggcgtgggatcttcttcgccagcgtggcgccggcgctgctggtgctggccctggcgatgcgctggctgcccaggcacaagcatgcggcgcagcgcctggacctgcgcggcctgctgctcggctcggcggcgctggccacgctgctggtggcgctcgcctggctgggatcgcccggcggcggcgggcgtggcctgctcctggcgctgctggcctgcgtgctgggctgctgctactggcgtga

SEQ ID NO: 5865 - DNA, 366 bp, Pseudomonas aeruginosa
tcgccgcgggagagggcggctggttgtctcccacggcctggccggcgctgctcctggccggggtcggcctgcttggcttcctcttcgtcgagcggcggaccgcccgaccgctgctgcccctggggttgttccgccaggccgggttcgccgtctgcaacctggcctcgttcgtcctcggtttttccggctacgccagcctgttcttcctctccctgttcttccagcaggtgcagggtgcctcggcgcagcaggccggcttctacctggcgccgcagttcctcgccatgggcgcactgtccatgctgttcggccggttgcagcggcacgtaccgctgcgacgcctgctggtgctgggctacctggtga

SEQ ID NO: 5866 - DNA, 660 bp, Pseudomonas aeruginosa
gcacgaagccgccatgaccggtcacgacatgcaggacatggacatgcaagccatgcagggcatgaaagacatgaaggacatgcacatgcaaccgagtacccaggagtaagcgcagatgttcgggaaactgacactctcggccgtgccttaccacgagcccatcgtcatggtcacactggccgtcgtcgccctgctgggcctcggcgtggtcggtgcgatcacctactaccgcaagtggacctacctgtggaccgagtggctgacctcggtcgaccacaagaagatcggcgtgatgtacatcgtcgtcgccctggtcatgctggtccgcggcttcgccgacgcgatcatgatgcgcggccaactggccctggccgaaggcgccaaccacggctacctgccgccggagcactacgaccagatcttcaccgcgcatggcgtgatcatgatcatcttcatggccatgccgttcatgaccggcctgatgaacctggccgtgccgctgcagatcggcgcgcgcgacgtggcgttccccttcctcaactcgctgagcttctggctgctcgtggtcagcgccatgctggtcaacgtgtcgctgggcctgggcgaattcgcccgtaccggctgggtggcctatccgccgctgtcggagctggcctatag

SEQ ID NO: 5867 - DNA, 1029 bp, Pseudomonas aeruginosa
cgtcaacggcttcttcggcgtggccaccatgctgatctcgatccccaccggggtgaagctgttcaactggctgttcaccatctacaagggccgcctgcgcttcagcacgccgatcctgtggaccctgggcttcatggtgaccttcaccatcggcggcatgaccggcgtcctgctggccatcccgggcgcggacttcctgctgcacaacagcctgttcctgatcgcccacttccacaacaccatcatcggcggcgcggtattcggctacctggccggcttcgccttctggttcccgaaagcgttcggcttcaccctcgacgagaagtggggcaagcgttccttctggtgctggctggtgggcttctacatggccttcatgccgctctacatcctcggcttcatgggcatgacccgtcgcctgaaccactacgacaacccgctgtggaagccctacctggtggtcgcgttcttcggcgccgtgctgatcttctgcggcatcgcctgccaactgatccagctgttcgtctcggtccgcaaccgcaagcaactggccgacgtcaatggcgacccgtgggaatgccgcaccctggaatgggccacttcctcgccgccgccgttctacaacttcgccgagctgccgaaggtacaggacgtggatgccttccacgacatgaagaaggccggcaccgcctaccgcaagctgccggcctaccagccgatccacatgccgaagaacaccgccgcgggcttctccatcgccgtgttcgccttcgtcttcggcttcgccgccatctggcatatctggtggctcatggcggtcggcttcgtcggcatgatcggctccttcatcgtgcgcagctacaaccaggacgtcgactactacgtccagcccgaagagatcgagaagatcgaaagcgcccgtttccagcaactcgccaagcaggtctgaaccatgtcgacggcagtattgaacaagcatctggccgacgcccacgaagtgggccacgaccacgatcatgcacacgatag

SEQ ID NO: 5868 - DNA, 888 bp, Pseudomonas aeruginosa
cggcggcaacaccgtattcggtttctggctctacctgatgaccgactgcgtgctgttcgccagcgtcttcgccacctacgcggtgctggttcaccacaccgccggcggccccagcggcaaggacatcttcgagctgccctacgtgctggtggaaaccgccatcctgctggtttccagctgcacctacggcctggccatgctctctgcgcacaagggcgccaagggccaggcgatcgcctggctcggggtcaccttcctgctcggcgccgcgttcatcgggatggagatcaacgagttccaccacctgatcgccgaaggtttcggcccgagccgaagcgccttcctgtcgtccttcttcaccctggtcggcatgcacggcctgcacgtcagcgccggtctgctgtggatgctggtgctgatggcgcagatctggacccgcggcctcaccgcgcagaacaacacccggatgatgtgcctgagcctgttctggcacttcctcgacatcgtctggatctgcgtcttcaccgtcgtctacctgatgggggccctgtaatgagcagcgctgcacacgacaaccacggcgccggccacggcagcctgggttcctacgcgatcggcttcgtgctctcggtgatcctcaccgcgatcccgttctacatggtcatggacggcggcttctcgcgccacgtgaccatcctcaccatggtcgtcctcggcctggtgcaggtggtggtgcacctgatctgcttcctgcacatgaacatgtcgtcggaagggcgctggaacgtgatggcgttcatcttcacggtgatcgtcatcctgctggtggtcggtctctcgctgtggatcatcttcagcgccgacatgctgatgatgccgatgccctga

SEQ ID NO: 5869 - DNA, 2226 bp, Pseudomonas aeruginosa
ttctcaataaccaagatggagtacttcatggatcgtcgcaacgagccgtcccccttgcccaccaaacgcccgctggcgccgctgatgctgttgatggccgcctgctcctcgccggccctggccgaggacgcggcgcgcaaggacgatcccctggaactgggagccgacacggtcaccggcgagcaggcctcgtccagggtcgaacgctcggcctcggccaagtacgccgtgccgctgctggataccccgcagaccgtcacggtggtgccgcaaaaggtgatccaggagcagaacgccctgagcctgcgccaggtgctgtccaacgtctccggcatcaccttcaacgccggcgagggcggcggcggttccggcgacagcatcaacatccgcggcttcagcgccaacgccaacatgcaggtggacgggctgcgcgacagcgcccagaccagccgcagcgacctgttcaacctggaggcggtggaagtgatcaagggaccgaactcggtgttcggcggcgccggcaccagcggcggcagcatcaacatggtcagcaagcagcccaaggccgaagccttcacccacctgggcgccgggctgggcacggaccgctaccggcgcctgaccctggacaccaaccagccgctggaagggcttggcgaatcgaccgccttccgcctcaacctcatggcccaccacaacgacgtcgccgggcgcgaacagatcgacaagcagcgctggggcatcgcgccatccctgaccttcggcctggacaccccgacccgcctgaccctgagctacttccaccagcgcgacgacaaccttcccgactatggcgtgccggcgctgaacgggcgcaagctggacggcgtcagccgccacgattatttcggctggcgcaacctggacgaggaacggatcgacaacgacgtcgccaccctcaagctcgaacacgatttcagcgacgacttccagttgcagaacctcatccgctattcccacctgcatcgggacacggtgatctccgcctcccacgtcaaccagaagggcctgccgccgggtcgctacctgccggcgggaccgcaagcctacgggcgcgattcgaagacgcggatgtggatcaaccagaccaacctcaccggccgcttcgataccttcggcctggcgcatacgctgatcggcggcttcgagctgtcccgcgagacctacgaccgcaccacctactcctacaacctgggcaagttctacccggccaacggcttcgacctgcacaacccgccgggctactggaacggccccaccgacaagcgcgacagcgcgcgcaaccggaccgaactggaggtcaaggcgctgtacgccttcgacaccatcgccctggacgagcgctgggacctcagcctgggcctgcgctacgactggatcgacggcacctcgcggagcacgccctcaggcaagccgacggtgcgcgccgacagttccgacggcaagctgagcacacgggcggggctggtattcaagccgctggagaacgggcgggtgtacttctcctacggcacctccttcaacccctcggcggaacacctggtcactaccggctcgggcgtgaccgaggcgaccggaggcctggcgccggagaagaacagtacctacgagctgggcaccaagtgggagttcctcggacggcgcctggagctggacgcggcgctgttccaggtgaagaaggaggacgctcgcgaacgcctggccgacggcagctacgtgcttgccggcgaacagcgcgtgcgtggcctggagctgagcgccagcggcaagctgaacgagcactgggacctcttcgccacctacacctacctcgacagcgaaaccctgaaatccagcaacccgcagcgtgagggacaggccctgggcaataccccgccgcgctcgttgagcctctggagcacctacgaactgcccgagggcgtgaccctgggctatggcgcacgctacgtcagccagcgcaacgtcacctcggtggacaacggcaagctggatgcctactgggtgcacaacatgatgctcggctaccaggcgacgcgcgacctgaaactgcaactcaacctcgacaacctgttcgacaaggcctacgtcgagcgggtgcgccaggtgtacggcaaccagtcgcgctcctcggccatcgagtatggcgacggtcgcacggcgattctttcggcgatctacgcgttctga

SEQ ID NO: 5870 - DNA, 882 bp, Pseudomonas aeruginosa
aagacaacctcgagcagattcagcaccagagctacagcgagctgcaggaactgctctccgaagccaacagcatgctcgccgacagcgccgctttcgccggcgacaaggccgacagcgcccgtgcgcggatcggcgcgctgctggagaaggccaacgatgccctcggcaagggcggtagcgccgtggccgaacgcagccgccacgcggtggatgcgacggaaagctatatcggcgccaatccctggcagaccgtggccatcaccaccgcggtgggcctgctcgccggcttcctgctcgggcgtcgctcctgagcacgcggtcggtgccgcacaacggactcgttaccttcgcttgaaaaaggaattgcccatgctttcgatcaagaagaacctcggcctcctggccatgaccgcggccctggcggcctgcgcctccaatcccaacgacctgccggatttcccggagcatgaatacgcggcgacccagcaggtgggcgagggcgtgatcaacggcgacctgtacctgaccagtgcgtcgggtgcgatccagaaggggaccaacaccaaggtcaccctggagcctgcgaccagctacatgaaggcctactacgcgaagttcggcaacctcgatgccgccaagcgcgatcccgacgtgcaaccgccggtgctcgacccgcgacgcgccacctacgtgcgcgaggcgaccaccgaccagaacggtcgcttcgacttcgaccacatccccaacggcacctactacatttccagcgagctgacctggagcgcccagagcgatggcaagaccatcaccgagggcggcaccgtcaccaagctggtcaccgtgagcggctcgcagccgcagaaggtgctgctgacccgctga

SEQ ID NO: 5871 - DNA, 2034 bp, Pseudomonas aeruginosa
ccagcgtccactccgaacccgccctcgaggcgggttcttcgttctgtctcctgggccaaaaccaccgaaccgggagaacagcatgcagcaccagaccctccagaacctcgttggccgggccgacgccctgatcaatgccgggcagttcgatgccctgatggatttctattgcgacgacgccaccctggtggtcaagccgggcctcaacgcctgcggcaaggcgcagatccgccaggcgttcgacgccatcgcccggcacttcgagcacagcctgcgagtgcgccagcacgacctgcgggtgatcgaggcgggagatacggcgctggtcatggccgaggcggtgatcgagtcgaaggccggacgcctgcaacgtcgggccacctacgtgttccgccaggaggccgatggccagtggcgctgcgcggtggacaactcctacggcaccgacctgctggcctcggtggcggcgagcgcggaggccagccgatgagcgcctcgaccctcagcgcaagcaaacccctgctggccggctacgtggaaagcatcctggccgcgccggtgtacgacgtcgccgtggaaacccccttgcaggtcgcgccgcagttgtcccagcgcctgggcaaccgggtgctgctcaagcgcgaggacctgcagccggtgttctccttcaagatccgcggcgcctacacccgtgtcgcgcgcctgagcgacgagcagaaggcccgcggggtgatcaccgcctccgccggcaaccatgcccagggcctggccctggcggcgcagcgcctgggcgtgcgggcggtgatcgtgatgccgcgcaccactcccgagctcaaggtcaagggcgtgctggcgcgcggcggcgaggcgttgctgcacggcgacgccttccccgatgcgctggcccatgccctgcaactggccgagcgcgaaggcatgaccttcgtcccaccctacgacgatccggacgtgatcgccggacagggcacggtggcgatggagatcctccgccagcacagcggccgcctcgacgcgatcttcgtgccggtcggcggcggcagcctgatcgccgggatcgccgcctacgtcaagcacctgcgtccggatattcgcgtgatcggcgtcgagccggaggattccaactgcctgcaggcggcgctggccgccggcgaacgggtggtgctgggccaggtcgggctgttcgccgacggggtggcggtggcgcagatcggcgcttgcaacttcgaggtctgcaaggaccatgtcgacgaggtgatcaccgtcggcagcgacgaaatctgcgcggcgatcaaggacatctacgacgacacccgttcgatcaccgagccggccggcgccctggccgtagcggggatcaagaagtacgtggcccgcgaacgcaccgaggggcagaccctggtggccatcgactccggtgccaacatcaacttcgaccgcctgcgccacgttgccgagcgcgccgaactgggcgaacagcgcgaagcgatcatcgccgtcaccgtggccgagcggccgggcagcttcaaggccttctgcgcggcgctgggccggcgccagatcaccgagttcaactaccgctaccacagcgaccgccaggcccacctgttcgtcggcgtgcagacccatccgctcaccgacagccgcgccgacctgctcgccggcctgcgcgagcagggcttcccggtactcgacctgaccgacaacgagatggccaagctgcacatccgccacatggtcggcggccacggtaccgaggtgcgccgcgagcggctgttccgcttcgagtttcccgaacgccccggggccttgctgaacttcctcgacaagctcggctcgcgctggaacatcagcctgttccactaccgcaaccacggcgccgccgacggtcgggtgctggccggattacaggtgccggacgaggagcgcggcgagctggaggcggcgttgcaagccatcggctatccgtactgggaggaaacccacaacccggcctaccggctgttcgccggttga

SEQ ID NO: 5872 - DNA, 723 bp, Pseudomonas aeruginosa
gtggagcaacgtgccggcgtacaacgccagccgcgagcagatcgccgaccacctgggcaagagcgtgtcgccggaatccgacgcctcgttcttcgactcgcggcgcttcagcgaggcgatcgtcctgctcaagagccggccggtgctgctggtgaagaacggtatcttcgacgaagcgccgctggccggcctggagcagcgcctgaagaagcatcgcgccgcgctggccacgccgatccgctcggtcggtcggctggaactgatcgaccacgacagcatggactggtgcggtaccggctggcgcatcgaggacgacctgatcgtcaccaaccggcatgtcgccagcctgttcgccgaacgccagggcagcctgttccgcttccgtctcaaccaggccggcaagcaggtgcgcacccgcgtggacttccgcgaggaataccgccagccggaaagcgacgagcatgtgatcgcgcgggtcctgtggatcgccccggacgtctccgaggcgccggacatggcgatcctccaggtagtgaagggcgacttgctgccgccgccgctggtcctcgcgcgccaggatgccgagccgcgccaggcggtggcggtggtcggctatccggcgcgcgacagccgcaacgacgccggggcgatggaagatatcttcggcaacatctacgacgtcaagcgcttcgctcccggcgaagtcgtgggattgccccatga

SEQ ID NO: 5873 - DNA, 534 bp, Pseudomonas aeruginosa
ggacgacaccttcgtctacaccaacgcggtgccccaggtggcgcagctcaaccagcgcagctggctgtcgctggaggactacgtgctgcagaacgccaggagcgagggcttccgcatctcggtgttcaccggcccggtgttccgcgacgacgatccgctctaccagggcgtgcaggtgccgctggagttctggaaggtggtggcgatgatcgacgccgacagcggcgaactgggagtgtccgcctacctgctggggcaggaagggatgatgcccagcgaaggcttccgctacggtgcgttcaagacctaccaggtgccgttggcgaaggtcgaggccagcgccgacctgcgtttctcccgcgccctgcgcaaggccgacgtgctcgccggcacgccgctggaggaggcgctggaaagcggtcgcttcatcgagatcgacggaccggacgacctcctgctgagccggccggggccggccggcaagggccgctgaggttcaggccggctgccgccactcgcgtagcagttcgatga

SEQ ID NO: 5874 - DNA, 1236 bp, Pseudomonas aeruginosa
actggcccgcaagcactcgatgaggacgccggccatgtctacccacctgtctctgcaacatgcccaacgctgcatcgcggcggccattgccgaagcgcagcggcagcgcctggcggtctgcgtcgcggtggtcgacgcccatgccaacctgctggcgttcgtacggatggacgacagcgttcccggtgccatcgacctggcccagcgcaaggcgcgcagcgccgcgctgttccgcctgcccagcggcgagctgggccgactcgccgggccgggccagccgttgtggagcatcgagcagagcaacggcgggctggcctgcttcgccggcggcatgccgctgggcgatgccggcggttcctgcctgggtggcgtcggcgtctccggcgccagcgcggcccaggaccaatccatcgccgaggccgccgtggccatggcaacaatccagaggtaatcgagatgaaacagaagcgaatcctggtgaccggggccggcagcggcttcggtcgggaagtggcgttgcgcctggccgcccgcggccatcggacgatcgccggcgtgcgcggcgccgggcaggccgccgacctgcgcgaagaggccgggcggcgtggcgttccgctgcgggtggaaaccctcgacatcaacgtcgccgccgatcgcgaacgcgcctgggaatgggatatcgacgtgctgctgaacaacgccggcagcgccgaagccggggccagcgcggagatcccgctggaactggtgcgcgcgctgttcgagaccaacgtgttcgccaacctggaactgacccagggtttcgtccggcgcatggtcgagcagaagcgtggcggcaaggtgctcttcgtgtcgtccatcgccggcttgatcaccggaccctataccggcccctactgcgcctccaagcatgccctggaggccttcgccgaggccctgcatgccgaactgaagccgttcggcatccaggttggcaccatcaatcccggcccgtaccagaccggcttcaacgatcgcatgatggaaacctggaaacgctggtacgacccgcagcgccacttcaccgaccacagcggcgtgcgctttcccttcgagcagtacgatccggaggaaatgatcgcgcggatggtcgagctggccgaggctgacgaaggcccgttccgcaccctgttgccggaagctttcgtcgaggtggtgaaggacgagcaggcgcaggcctggcagcgccgcctgtag

SEQ ID NO: 5875 - DNA, 633 bp, Pseudomonas aeruginosa
gccagaacgtcgaggcgctgctgcgccatatcgacgggccgccgccgtaccggatcctcgatttcggctgcggtcccgggcgcgacctggccaccttccgccgcctcggccaccagccggtgggactcgaaggcacgccgcgcttcgtcgagatggccagggccgacagcggttgcgaggtatggcaacagaatttcctggcgctgcgactgccggccgggcacttcgacggcatcttcgccaacgccagcctgttccatgtgcccggcagcgccttgccgcgggtgctcggcgaactcttcgaagcgctgcggccgggcggcgtgctgttcagctccaacccgcgcggcgacaaccgcgagggctggaatggccaacgctacggtgcctaccacgattacccggcctggaaacgcctgctggaggaagccggtttcgtcgagctggagcactactaccggccgccgggcctgccgcgcgagcagcagccctggctggcgagcgtctggcggcgccccgtctgaaggcgctacagggtctgccggtgcggcgtgccgagcacgctgcggtactggtcgaggcgcttcggcgagaggtcgctgcgctccaggctgtcgagggcgtaggacttga

SEQ ID NO: 5876 - DNA, 891 bp, Pseudomonas aeruginosa
ccgcgccgcggccaggtaggtggcttgcggggtgtcgtcgaccgcgccctgcagggtggtcagcggcgccaggcgcacgccgatgcgctccctgccgaccaccgcggtgaccgcctcggcgacttcgcggaggaagcgcaggcggttctccagcgagccgccgtattggtcgttgcgcgcattggcctgggagtcgatgaactggttgatcaggtagccgttggcgccgtgcagttcgaccccgtcgaagccggcgtcgagggcgttgcgtgcggcctgggcatagtcggcgacgatctcccggatttcctccacggccagtgcgcgcggcgccgagtgctggaccatctcgccgccgccggcctgcgctccgcggccctggggatcgacgaagaccttcacgccttcggccaccagcgccgaggaggacaccggggcggcgttgcccggttgcagcgaggtgtgcgagaccctgccgacgtgccagagctgggcgaagatgcgcccgccggcggcgtgcaccgcgtcggtgacctggcgccagccggcgacctgctcggcgctgtggatgcccggcgtccaggcgtagccctggccctgccggctgatctgggtgccttcggaaacgatcaggccggcgccggcgcgctggctgtagtactcggccatcagcgcggtggcgacttcgccactggcggcgcgggaacgggtcatcggcggcatgacgatgcgattggggagggtcaggtggccaagggcataggggctgaacagcatgatggcgatctcgctcgtgaggccggccgcggcgcggcgtactggaagaaggtgggcgcattattggcggaacgattcgtgcgaaaaacagctgccggggaaaatgacacttga

SEQ ID NO: 5877 - DNA, 1335 bp, Pseudomonas aeruginosa
tccggtagccgccgtagccgaagccgagcatcagcaggagcaggggaatggggagcagcaactggcggacgaggcggggcttcacggtcagtgacggaggtacgctgcagggcgggtcgggggattccatcacagtcgtcgcggataggccagcccgccgccacgatgggcggcggagcgggcggttttccggcacggccggcaggcggcgccggaagggttcactcagtattcccagaagatccgttgcagctccttgctgtcctgggtcttggtcatcgcgaccgcggccaggatgcgcgccttctgcgggttcaggtcgtgggcgacgatccagtcgttcttgtcgtccggctgctcggcgttgcgcaggacgaagccgccggcattgacgtgcgaggagcggatgatctgcacgccctgcttgcgcagttcctgcagggtcggcaccacgcgcgcgggcaccgagccgttgccggtgccggcatggatgatcgccttggcgccggcctgggccagggccttgtaggcggtgtcgctgacgttgccgtagctgtaggcgatttccaccggagccagcgcggagatctgcttgatgtcgaactcggagttcaccgtgtgccgcttcaccggtgcgcggaaccagtagctcttgccctcgaccaccatgcccagcgggccccacgggctcttgaacgcttcggtcttgatgttgaccatcttgctcgcgtcgcggccggagaggatctcgtcgttcatggtgatcagcacgcccttgccgcgtgccgacttgtcgccggccaccgccacggcgttgtacaggttgagcatgccgtcggcggacatcgcggtgcccgggcgcatcgagccgaccaccacgataggcttctcggtgtgctcgaccagggtcaggaagtaggcggtctcttccagggtgtcggtaccgtgggtgatcacgatgccgtcgacgtcgtcgctatcggccagcttggcgacggtcttgcccagttccagcaggttctcgttggtgaagctttccgaggcgatctggaacacctgttcgccgcggacgttggcgatgtccttgagctgcggcacgctggccagcaactggtcgaccggcaccttggcggcggtgtaggtggcgctgttggcggcgctggcgccggcgccggcgatggtgccgccggtggccaggatgaccacgttggacagtttctgttgcggtgcgacttccttggcctgggcggcctgcggcagcaggagcatcagggccataacaccgggggcgaacgcgtggagcaatggcttcatggcgatatctcgtgtcggtag

SEQ ID NO: 5878 - DNA, 891 bp, Pseudomonas aeruginosa
agagcacaggttgcatgggctttccctatttattgttatcgcaggcgagggtggagcaggcccccgccgggcgggccggcgagggcgggtacatcagtgcgggaggatcttggcgaggaactgctgggcacgttcggagcgggcgctgacgtcgccgaagaactcctccttctcgcagtcttccacgatctgcccgcggtccatgaagatcacccggttggcgaccttgcgcgcgaagcccatctcgtgggtcacgcacatcatggtcatgccttcgtgggccaactggaccatcacgtcgagcacttcgttgaccatttccgggtcgagcgccgaggtcggctcgtcgaacagcatcaccaccgggtccatcgccagcgcgcgggcgatcgccacgcgctgctgctggccgccggagagctggccggggtgcttgtgcgcgtgctccttgagaccgacgcgctcgagcagggccaggcccttcttggtggcttcttccttgctgcggccgagtaccttgatctgcgcgatggtcaggttctcggtgatgctcaggtggggaaacagctcgaaatgctggaacaccatgccgacccgcgagcgcagcttgggcaggttggtcttcggatcggcgatggaggtgccgtcgacgacgatgtcgcccttctggaagggttccagtgcgttgacgcacttgatcagggtcgacttgcccgagcccgacggcccgcagaccaccaccacttcgcctttcgcaacctcggtggagcagtcggtcaggacctggaagtcgccataccacttgctgacattcttgatggaaatcatacggttaaccttttctgcagacgtttgacggcgaacgaggcggtgaagcttacgacgaagtag

SEQ ID NO: 5879 - DNA, 1458 bp, Pseudomonas aeruginosa
aacggcaggtaccgtcattcagaggataccgccactcatgtcagctgcctcgttagccaccctcgacgggtcgctccgcatgacccccgtcgagcaaccccgaccgccggctctcgccgacctcggcagccgcctgatgatcgtcgtcgagcgacgcgaggactgggcctcctacctgcccagcgaggaagtactcaccgcccaggaatacctcgagcaatcggcgcacgaccacggcggccgccgcgtgcagatgatcaacctgtgccgcggctacaagtacctcggcctcggctaatactgttcgctgctggccgaggcccgtggccaccgggtgatcccgtcgctgcgctgcatcagcgaactggctcgcaagtcggtgtacgggctggccctgggtggcctcgacaaggccctggacaaggcgctgtgccgtacgccctatggcgccaccgacggcttcaccctgaccctgtatttcggccataccgagttcgagccgctggccgacctcgcgcgccagttgttcgaagcctttccctgtccgatcctgctggtggagttccgtcgccagcagggctggcatatcgagggcgtgcgccctggcgtgctgaaccgcttgcgcagcgaccaggaggatgtcttcgccgatgccctcgacggtttcagccggcgcgcctggcgcatgccgcgttcgcggcgggtggcacgctacgacatggcgatcctccacgatcccgacgaagcgctgccgccgtccaacccgcaggcgctggccaacttcgtacgggtcggcgccagcctcggcatcgacgtcgaactgatcggacgcaaggactacgcgcgcctggccgagttcgacgccctgctgatccgcgagaccacccgggtcgaccaccatacctatcgcttcgccgagaaggccgagcgcgaaggcctggtggtgatggacgacccggcatcgatcctgcgctgcaccaacaaggtctacctggccgacctgcttggttgccggcaactgggcatgccgctcaccgagatcctctacaaggaacgcccgcaggactggcagcgggtggcccggcgcctgggcttcccgctggtgctgaagattcccgatggctgcttctcccgtggcgtggtcaaggtcaacgacgacagcgaactgctggcggcggcgagcgagctgttcgagcgctcggtcctgttgctggcccaggagttcttctacaccgagtacgactggcgcatcggcgtgctcgaccgccaaccgctgtacgcctgccagtacttcatgtcgcgcggccactggcagatctacaaccacaaggccgacgggcaggacgtcaacggcgagtgccgcgccgtgccgctggagcaggtgccgccggcggtgctggagctggccctggaggccgccgggctgatcggcgacggcctctacggggtggaacctga

SEQ ID NO: 5880 - DNA, 1548 bp, Pseudomonas aeruginosa
cttcggggtgtccttcgacaaggcgcaactggccgccggcagcgtcgactacaactaccagccgacccccgacgccggcgaggaaatgccgggtgccagcgtgttcctgcgcaatccggcgggcgaggtgttccacacctattcggcctatgcgcgcggcctcgacatcctgctcaccacctacaccttcctcgacctgacgcccaaggggcgcaacgaggacgcgatcatggactggctgcgtcaccacgaccgctacgacgaggcgccgaaaagcgcctgctgccatgcgcaggccagccattgagggagcacggcgagccgttgcgcagccgcatcgaggcgctgtaccgcgaggagtcgcggcgcgtgctggcgacccttgtccgcctgctcggcgatttcgagctggccgaggaggccttgcacgacgccttcatcgccgccgtcgagcagtggccgcgcgacggtatcccgcgcaacccgcgcgcctggctggtttccgctgggcgcttcaaggccatcgacaacctgcgccggcgagcgcgcttcgacgcctcgcagcgactgctcgccgagcaactggaagagcaggccgaggcgccggcggaggagggcgatgcggtggaagacgaccggctacgcctgatcttcacctgctgccacccggcgctgacccccgaggcacaggtggcgctgaccctgcgcgaggtctgcgacctgcgcaccgaggagatcgcccgcgccttcctcgccgcgcccagcgccatcgcccaacgcatcgtgcgggccaagaacaagatccgcgaggcccggattccctaccaggtaccgaccctggaggaactccccgagcggctgggcaacgtcctgcaagtgatctacctggtgttcaacgagggctactcggcctccaccggcgccagcctgacccgcgccgatctcagcggcgaggcgatccgcgtcggccgcctgctggtcgagctgctgcccgaccccgaggccctcggcctgctcgccctgatgttgctgcacgactcgcggcgccaggcgcggatctcggccagcggcgaactggtgcggctcgacgagcaggaccgcgctctgtgggatcgtggactgatcgtcgaggggctcggcctggtcgagcgggccctggccagccgccgcgtcgggccctacaccctgcaggcggcgatcgttgcggtgcatgcccaggcgccgcgcgccgaggacaccgactgggcacggatcgtcgccctctacgacgcgctgctgtacctggcgccgtcgccggtggtcgaactcaaccgcgccgtggccttggccatgcgcgatggcgtcgaggtcgggctggccgtggtcgatgcgttgctggcgcgaggtgaactggccgattaccacctggcgcactcggcgcgtgccgacttctgccgccgtctcggtcgccgccgcgaggcccgcgaggcctaccgcgcggcgctggccctggcgcgccaggagccggagcggcgcttcatcgagcagcgcctgcgcgaactcgattga

SEQ ID NO: 5881 - DNA, 777 bp, Pseudomonas aeruginosa
gcgcctgggcgtggccgcgatcggccaggctgccggcccgcgccgcgcccagcgcgccgagcgcgccgaccaggccgaaggcgccgatggcgctgtgcgacagcgaatgcggcggcgcgccgagcagcaataccaggctgctccagaacaccccgaaggcggcgaacatcaacagcccgagcaggccgcgcacctgcagcacgcgctggctcgccagcaggtcgaacatcgagccgagcagttgccggtaggtcagccccagttcgttgctcggcgccgccggcagtacccgccagagcagcaggccgagcccgcccatgctcgctgccgagaccaggtagacgctgcgccagccgccgaggtcggcgagcagcccggccaggctgcgcgccagcagcaggcctatcaccacgccgccctgcgccgcgccgaccacccgcccgcgctcgccaggcgccgccagcgccgcggcgtaggccagcagtccctgggtcatggcggtgccgagcaggcccagtccgagcagccccagcgccaggccgagggtatcgccggcgaagcccaccagcagcagcgacagcaccagcagcaggagctggacgaacatcagccggcgccgctccagcaggtcgcccagcggcaccaccagcagcagcgccagggcgcaaccggcctgggtcgcgccgaacagcaggccgaccccggcctggccgatggcgaactcggcaccgaggacgtccagcagcggctgggcgtaatagacgttggccacgctga

SEQ ID NO: 5882 - DNA, 1026 bp, Pseudomonas aeruginosa
ggcgccttccggggtgtgccaattcatctttccattcaacgcaacagctacccccattcgggcccgccaaggggcgccggtttcgttacccgggacgttttcgaccaaggccttcttccccgctcgcccacgtcgcgtcgcgatcaccccgaactcgcccagcaagccacgcacctcattgcacaacgccgtgcgggcccgcaccagacgactgcgcacccgatgcacggactgcacggcctgctgctctgcgctcttcaccgggacatagcgcatgttcggacgactggcggcttcgcagatcgcctcggcgtcgtgtgcatcgtgcttgtcccccttgacgtagggtttgacgaactgcggtgcgatcaggcgtaccgtgtggcccagctcccgcaactcgcgcgcccagtagtgcgcactgccgcaggcctccatcgccaccaggcacggcggcagttggcgaaagaaatcccgcacctgtgcccgcttgagttggcgacgacataccacatgctcgtgacgatcaacgccgtgcacctggaatacttgttttgccagatccagaccaatgcgactaaggttcatgctgactccccctccgggacttgtggctgcaccattagtctggcgcttgacgccgtaggagggaggagtccatttcattgccctacgtggtgctgcgcggggtacggtagggcgaataacgccaggggcgttatccgccgatgctcggctggccggcggataaccgcgttgcggttatgcgccctacgtcgcggtgttgcgcggggtacggtggggcgttatccgccgatgcgtcgctggggcggggcgcggggctcagatcaccttgccgtcgcgcagcctttccagcgcggccgcgtccaggccgaggagcgtctcgaggacctcgtcggtgtgctggccgagggtgggcggcgggttgcggtattccaccggcgtctcggacaggcggatcgggctggctacctgcggcaccgtcccggccagcgggtgcggtag

SEQ ID NO: 5883 - DNA, 951 bp, Pseudomonas aeruginosa
cctgggcgtcatagatgcgaaaccggcactccggagtcctccatgcgacgcaagatcccttccaccgccgcgctggtcagcttcgaatccgccgcgcgccacgagagcttcaccaaggcggcggaggagttgtccctgacccagagcgcgatctgccggcagatcgccacgctcgaggagttcctcggtgtcgagctgttccgtcgctcgcggcgcggggtcaagctcaccgaggccgggctgtcctatagccggcgggtggcggtacgcctcgacgcggtggagcgcgacaccctggcggtgatggggcaccagggcggcggcgcgatcgaactggcggtggtgccgaccttcggcacccaatggctgttgccgcggctcaagcgcttccagcggctgcacccggaggtcacgatcaacctgaccaaccgcacccgcccgttcctcttcgccgacaccgagttcgacgccgcgctgtacttcggcgacgccgactggtcgggtaccgtctcgcatttcctgatgcgcgagaatccggtgccggtgtgcagcccggagctgctgggcgggcgtcgaacgctgagcgccgagcaggtcgccgggctgccgctgatgcagcagagcacccggccctacgcttggcgccagtggtttcactcccagggactgaacgtcgcccacgacatgagcgggccgcgctacgagctgttctccatgcttgcccaggcggccatgcacggcatgggcgtggccctcataccgcccttcctgatccaggacgagctggccgacggaaggcttatcgtgcccatgcaacatgcctatttgagcgagaatgcgtattacctgatcattcccgagcgcagggtcgaatcggcgatgctcaatgccttccgcgactggctggtggaagaggccaggcagtaccgcgaggccaacgggctgggctga

SEQ ID NO: 5884 - DNA, 744 bp, Pseudomonas aeruginosa
tcgacctgcaggcccgcgacatgcccgacctgctgcgccaggttggacggccgcagcctgcgcgtcggcgagcgcgcgctgaccctggctaccgccggcgccacggtcgagcggccaggcaccggactggcgcgcgcggttgctggcggtgctcaccgatcccagcgtggcgctgatcctgatgatgatcggcatctacgggctgatcttcgaactggccaatcccggcatggcgctgcccggcgtgctcggcggcatctgcctgctgctcggcctgtacgccctgcagatgctgccggtcaactacgccgggctggcgctgatcgcgctgggcctggcgttcatggtgggcgaggcgttcgtcgccagcttcggcgtgctcggcatcggtggaatcgtctcgttcgtggtcggcgcgctgatcctgatcgataccgaggtgcccggctacggcattccgcccggcctggtggtggccctggcgttgctcagcgccgcgctgatcgtcggtctgctgggcatggccctgcgtactcgccggcaagcggtggtaagtggcaccgccggattggtcggcagcctggcgacggtggcggcggtggattccgaacaaccctgcgcaggctgggtgcagctccagggcgagcgctggcgggtgctcgccgcgcggccgctggcggtgggccagccggtctgggtgctggcgcgcaagggcctgctcctggaagtcgcgctggccgatga

SEQ ID NO: 5885 - DNA, 558 bp, Pseudomonas aeruginosa
aggaggtggatgatgggtatttcctatggtttggcgatgttgctggtgttcctcgcgctgctgctgttcagcgcgctgcgcatcctccgcgagtacgagcgcggcgtggtgttccagctcgggcggttctggaaggtcaaggggccggggctggtgctggtgatcccggcgatccagcagatggtgcgcatcgacctgcgcaccatcgtcctcgacgtgccgccgcaggatgtgatttcccgcgacaacgtttcggtgaaggtcaacgcggtggtgtacttccgcgtgctcgatccgcaggaaggcgatcatccaggtggagaactacctggccgccaccagccagttggcccagaccaccctgcgcgcggtgctgggcaagcacgagctggacgagatgctcgccgagcgcgagcgcctgaacctggatatccagcaagtgctcgatgcgcagaccgacgcctggggcatcaaggtggcgaatgtggaaatcaagcacgtcgatctcaacgaatcgatggttcgcgccatcgcccggcaggccgaggcggagcgtga

SEQ ID NO: 5886 - DNA, 822 bp, Pseudomonas aeruginosa
tggaaatatcatcgagccgcgacacggggacatgcgtgcccggggtcgggatggctatgctgtggcgatccactcccgggacgctccttcatgctgcgatgcgcactcctgctgctgacattgctcctcccttgcgcgctgcctgccgccaacctgcgcctggtcggcgactcctggccgcctttcgtcgattcgcgcctgcctggcaacggcctggcggtggaactggtgaccaccgcgctcaagcgcgccggcttcgactcgagtttccagcaggtaccctggtcgcgtgccctgtacggcgtgcgcagcggcgactacgacatcgccctgagcgcctggtacgagcccgcccgcagcctctacgggcagttttcccgcgcctacctgagcaaccgcatccgcctgctgcaacgcaaggggcggggtatcgagttttcccgcctgagcgacctgcgtccctaccgcatcgcggtcgtgcgcgactatgcctacgcgcccgaattcgaccgtgacagccgtctgcagaaggtcaacgtgaccagcttcgccaacgccgcgcggatgctcgaggcggggcgggtcgacctggcggtggaggacgagctggcgctgggggtcgccttcaagggcgaactggccgatttgcgcgacaagctggaggtactgcccatcccgcttggcgagaacggcctgcacctgctggtgagcctgaggaatccccggcatgacgagatcgtcgacggcttcgacctggccatccgcggcatgcgcgacgacggcagctaccagcgcctgctggaacgctacggcgcgcgctag

SEQ ID NO: 5887 - DNA, 324 bp, Pseudomonas aeruginosa
gcgaacttgtcgagggcccagaggcggcggagcgtgtgtgtcaacgaagagggcggcatgggggcggagtgctatccgatggtccgtggttcagcctatgtggcctgtccggctaattcaatcggccgatttcgcgcgactggaagtccgctgcccgccgcagtcgcaggaagcgctgccgtgggcaactcggtcgagccgggcatctggcggatgcaggcttcgtgcctgcgaacgctaagacgtcgtcgccgcgccgaacgttacccggcggcgatatcgcgcgccggagcgggcccggcgagcgaagcggcggcgcgctaa

SEQ ID NO: 5888 - DNA, 813 bp, Pseudomonas aeruginosa
agcaggcggaccttgaacgagcgacccttgatcttgccttcgctcaggcgcttgagggcctggtgggcgaggccgcgctcgatggcgacgaaggcctggaagtcgaagatggcgatcttgcccaccgcgctgccgggcagcccggcgtcgccggtgagggcaccgagcaggtcgccggggcgcaccttgtccttgcgtccgccggcgatgcacagggtgctcatcggcggcagcaatggttccgggctggccttcaactggccgagggcgtaccaggccagcggctgcttctgcaggtcctcgatggcctgcgcgcggctggcctcggccggcgccaccagcgacagggccaggcctttctcgccggcgcgaccgctgcgtccgatgcgatggatgtggacctccgggtcacgcgccagctcgacgttgatcaccgtttccagggcggcgatgtccagcccgcgggcggccacgtcggtggccaccagtacgttgcaactgcggttggcgaacaccgtcaggacctggtcgcgctcgcgctgctccaggtcgccgtgcagggccagggcggaaatccgctgcgccttcagtgcgtcggccagctcctggcactgctggcgggtctggcagaaggccacgctggactgtggccggaaatgctggagcaggcgtaccacggcgtccatgcgctgtttcggatcgatctcgaagaaacgttgctcgatctggctgtcggcgtgcagcgactcgaccctcacctgtcgcggatcgcgcatgaaggtcttcgccagcttctcgatgccgtccgggtag

SEQ ID NO: 5889 - DNA, 1254 bp, Pseudomonas aeruginosa
cggcttcaagaccctggccgaaggccagaaggtcagcttcgaagtcgtacaaggccagaaaggcatgcaggccgagcgcgttcaggtgatcaactaagatccctgggccccagcccgaagaacccggatggaagcatccgggttttttattgcccggagaaaaccgtcacactgtcttcgcctgccgttcaccctgtcttgacgagttcccgcccagagtggcccggtcccgttcggagtcgtttcgatgaagcctgtgcaatcccgtcgtctggccttcgccgcgctgttgtcgctgtcgttctcttccgcgtcctgccatgccgccaccgagcactggggctggatcgagcagtcctggctgatgcccgagcgcatgcaggccaaggccaagctggataccggcgcgctgacctcgtcgctggacgcgaggaatatccatcgctacaggaaggacggcgagcgctgggtgcgcttcgatgtcgtgctgcccaccgccgacagcaaggcgccggtcagcgtgaccttcgagcgcaaggtgctgcggctgatcaaggtacgcggcgccggcggcagcgacagccgtccggtggtggcgatggacatctgcctgggcgccaagctgctgcgcgagcagttctccctgcgcgaccgcggcaacatgaactatccggtgctgctcggtcgccgcacgctcgaacacctcggcgcggtcgacgtgtcccgaacctttacccgcaaacctacctgcagcgcgctcgccgctcagtagaagaaccagcgcagcagtccagcgcccagcgccacccagaacagcacgatcagcgcagccatccacaggttgcgcgggtgcgtctcgacctcgcgagcccgcgcgcggcactcggcgagcagcgtgggtggggtgaggcggatcgccagccagatccccagcggcaccagcaacaggtcgtcgaggtagccgagcagcggtatgaagtccgggatcaggtcgatcggactcagcgcataggccaccaccagcagagccaccagtcgggccagccagggcatgtgcggatggcggctgcacagccagagggcgatgacctcggtcttcagctcgcgagcccagcgcttgagcgtagcgatccaggccatcctagaggtccgggtccttttccggatcgacccggcgcgggctggtgcgaccgtcctcgctgccgagctggaagaagatcgccgcggccagcatcgacatcaggccgacgctga

SEQ ID NO: 5890 - DNA, 1707 bp, Pseudomonas aeruginosa
acgaacgcggcgaagcgatccagacccatcgcggcctgggctacagctacagcccggaccacgcctgatgccgctcggcgttcggatcttcctggtctacttcctgttcgtcggtctcaccggctacttcgtgctgagcacggtgatggacgaagtgcggcccggcgtgcgccagtccaccgaggaaaccctggtggacaccgccaacctgctcgccgagatcctccgccaggacgtgaagaacggcaccctggcacagagcgacctgccggagatgctcgaggactacggcaagcgcgtgccgcaggcggatatctggggcttgcgcaaggaggctgtgaaccaccgcatctacgtcaccgacgccagcggcaaggtgctgctggactccgccggggtggctgtcggccaggactattcgcgctggaacgacgtctacctgactctccggggccagtacggcgcgcgctccagccgcgaagacccggacgacccggattcctcggtgatgtacgtggcggcgccgatcaaggatggtgggaagatcatcggggtggtttcggtggccaagccgaacagcagcctgcaaccctacatcgaccgctcgcagcggcgcctggcctggctcggtgccgggctgatcgccctcgggctgctggtcggcggcctgctctcctggtggctcagcggcgcgctgcggcgcctcacccagtacgcacaggcggtcagcgaggggcgccgcgccgagctgccgcgctatcgcggcggcgagatggcgcaactggcggacgcggtggaacgcatgcgcacgcaactggaaggcaaggactacgtcgagcgctacgtgcataccctgacccacgaactgaagagcccattggcggcgatccgtggcgccgccgagttgctcgacggcgagatgccggccgagcagcgggcgcgcttcgtcggcaacatcgccggcgagagcgagcgcctgcaacaactgatcgagcgcctgctgagcctggcccaggtggagcagcggcaaggcctggaggaggtcggcaaggtcgacctgcgggagatcgccgcgtccctgctggaaggccaggcggcgcgtatccagcgccagcgattgcgggtggagaaccgcctggaaggtccctgcgaggttcgcggcgagcagttcctgctgcgccaggcgctggccaacctgctcgacaacgccctcgacttcaccccgcccggcggcatccttcgcctgctcgccgaggtcgacggcgagggtatcgccttgcgcctgttcaaccaggggccggcgattcccgactacgccctggcgcgcctcaccgaacgcttctactcgctgccgcgcccggccagcgggcgcaagagcaccgggctgggactgaacttcgtcgccgaggtggcgcaactgcatggcggccggttgcaggtcggcaaccgcgacgacggcgtcgaggcgctgctctggctgccgcgcggctgaggcgcctccacggaaactccatcgactctccacacggcgacccgaagcccgccatcgcggcgccgcagactttccgccatcaccccgacggagagtccccccatgaaccgcacgctggcctacaagctcggtgccatcgccctactcatcctgctattgctgattcccctgttgatgatcgacggcctgatccgcgatcgccaggaggttcgtga

SEQ ID NO: 5891 - DNA, 1545 bp, Pseudomonas aeruginosa
tgccggacggattctgggaaggcctcagcggcatcgagggcgccgccggcaatccgcacgtgcgctccttcctggagctttgcatggggctcggacagagcgcgctgttgctgggcctgctgctgttccgcctggtgtgctggaaatgaacgggtatgtcggcctgcgcgacgaccgtcgcgacggcgagcgcctggcggcgcggatcggcctgctgttccccggcccctcggcggcctggctgcaacgcgccgagcgcctgcggcggcagcaggcgtcggcgggccctcggggtcaggcgcgggtggcctgcatcgacgggcgctggctgacttcggcgaaccaggcggcgagtcgcgggtagcggccgcgccagtcccactccggctggcgcaggtcgagatagcccagggcgcaggcgacgccgatggcggcgatgtcgaagcgcgcctgcagttcggcgatgcagtcgccctccagccacgccagggaccgcgcgatcttttcccgctgtgcttcgagccaggtgtcccagcgcttctcctcggggcggacgaaggtttcgtagcgggacagcaccgcggcgtcgaggacggcgtccgccagcgaggcgatggtcaggcgtcgccagcggacgctgccttcgcgggggatcagcggttcgccgacgtgctgctggtcgaagtagtcgcagatcacccggctgtcgtgcagcacctggccgtccggcaggcgcagggcgggaatcttgccggccgggttgctggcgttgagctgccggatgggcgcgaccggcgtcggcgtgacttcctcgagcgccacgcgctcgcgttggccggtttcgtggagcaggaccaggaccttgcgcacgaagggcgaggcggcggcgtagaacagcgtatgggtagcgctcatgcgggctccttggaaggatcagtcgcggacgacgcgcagacgatcggcggcaggctcggcgctccaggtttctccggggcgaccgccgagcagggcgttgccgggcgccggccggtcgctgggcaggacgcggaatgtcgcctgcgcactgtcgaaacgcaagagcgccccgctggcggcgtcgtgcagccagacacggtccatggcgtcgacccgcaggctgtccgggcgggcctggctgtccggcagcggccagctctgccacgaggcatcgctgggatcgtagcggtacagccgggcgccaccgctgtcgctggcccagagcctgccgatggagtcggcgccgatcccgcgcaaggccttcgtgccttcaggcgcgggcaactgctcggcgctgccgtcgagcggatcgacatgcaccagcgcgtcgtcctgcgcgtaccagacctcgccgtccggggtgacgcagatgccgttcgccgccttgccctggggcgagggccagacctccaccaggcgcctggctgggtcgaggcgaccgtggaagccgcggctgccggtgaaccagaggcgcccgtcgtcgtcgaataccgcggagtcgagcccggccggcgcggccttggccggtag

SEQ ID NO: 5892 - DNA, 1209 bp, Pseudomonas aeruginosa
cgggaaacgttcgctgcccaggcgctcgccgccgatgcgaaggatggcgttgaggccgctgtcgagcacccaggcgttgccgctctcgtcgctgacgatggctcgcggccgcgcgccttcgccgagcggcacctgcacgctctcgccgctggtcgggtcgagacgccccagcgaatgcccgccgtccgcgccgtaccagaccgcaccctgtgcactgggcgcgaccgcgtagggcgcggagcccttgtccagcgggtagtactgttcgccggccagggcggcgccggtcgacgacagggccaggaacaggcccagcagcgggtagggcaggtgacgcatacggttctcccggaacgacgagcggaacgtggaaaggctctgtcttgctattctggcagcgcattgagcataggaggaactgcgaatggccacagtggaaatactcggggcggaatgccgcgcggggggcgcggtgaacgacgatgcgctgggctgcacggcgcaggccgcctgggtgatcgacggtgccaccagcatcggtcgcagcgtgctgggcgtggaaagcgacgcgcgctggctggcccaggcggtggaccggcacctgcggttgctgctggaagtcgagcccgagcaatccagcgagaccctgctgcggcgcctgctcaacgatatccagggcgacttccgcgcccagagcggccgcgactggcacgacctcgaagacatgccggcggcctgcctgagcctgctgcggattcgcggcggagaaatcgaactgctcaacatcggcgacagccggatcctcgtcgaaggcgccgacggccaggtacgcagcttcggcgattcggccctacacgaactggatcggcaatccctggcgcatttctgccggatgcgcgaggaacatccgcagtgggatcacgccgaactgttcaaggccagccgcccgcgcgtgcggcagaaccgcctgctgatgaacaagcccgagggctactgggcgctggacatcagcgaccgctggctcggccaggtgcagcgcgagaccttgccgctcgccgcgttgcgttccttcgtgctgatgaccgacggcttcgaccggctggtcgagcctttccgccgctataccgacgaacagttgctgcggcgcctcgaggacgtcggagtgagcgccatgctcgacgagttgcgcgagatcgaacagggcgatga

SEQ ID NO: 5893 - DNA, 1674 bp, Pseudomonas aeruginosa
agcgtgcgttgccggacagcagggcgttgcgcgccggcccgttggcggctctcgccaggtgccggtcgaggccgccgagctgttcccaggcgcgttcgtgttcgggatgcgccgcgtaccagcggtggaaggcgcggtgatcgtcgggatgggcttcgccggagtcgagcagcaattgccaggcgatggcttcgtcgagcacccgcgcgcgtaccggcgaatgacgatcatcggcgctcaccggggctctccgtagagggcgatgtagcactggcgcagaccctgggccaggtattggcgcacgcgcggcaccgagactccgagacgctcggcgatctccgcgtggggcatgccgtccaggcggctatagagaaacgcgctacgcgccttcagcgacagcgtgccaagcaggcgatcgatctcgcggaggtcctcgagaatcaggtactgctcttcggccgaaggctgctccgcttccggaaccagcgccagttcggcgagataggcctgctcaagggcggcgcggcggaagtggtcgatcatcagaccgcgcgccaccttcgccaggaacgcgcgcggttcgcgcaggccgggcagctccgggcggccgaggaggcgaacgaaggtgtcctggctgaggtcttcggcgcgctggcggcagccgaggttgcggttcagccaggcaagcagccagccgcggtggtcccggtacaggctacccacgaattcgctgttgctgacgtcacccgccgacacgaccgctccccatcccgaaacgggattgaatggaaaaacgagaattattcgcaaatgatcgcaaagtgcgactatccctgcaattggcgtccgtcgggaagccacttgagtcgtcccgctggtttgccggaggatcggtgttcccataacaagaacaggagtctcgccgtggccgaacctttgctgatcatcggttcctatctgtccccctatgtgcgcaaggtgctggtgctgctggaactgaaaggcattgcctaccgcatcgaccccatcgtgccgttcttcggcgacgaggccttcgagcgcctcagtccgttgcgccagattccggtgctggtggacggtgacttcgtcctcaacgattccagcgtgatctgccagtacctggaggagcgctacccgcagccgagcctgtatcccgtcgacatcggccagcgcgcccaggcccgctggctggaggagtacgccgattcgcggctgggccaggtgatcatctggcagttgttccaccagttggtgatcaaccgtggcatctggcagcgcgaacccgaccaggcgatcctgcaacgcacctacgacgaagacctgccatcgatctgcaactacctggaagggcgggtcccgccaagcggctggctgtgcggcgagctgtccatcgccgatgtcgccgtcgcctgcctgttccgcaatgcccagttggcgcgctaccaggtcgacggcgagcgctggccgcgcctggcgcgcctgttggctgacgctttcgccctgccggccttccagcatttggcgcgtttcgagaaggccaccgcgcagaccccggtcgccgaacagcgccaggcgctgcgcgaggccggcgcgccgctcagcgagaccagccacgcccgcgagcggccggtgcgcggtccgatgagccgctga

SEQ ID NO: 5894 - DNA, 1674 bp, Pseudomonas aeruginosa
aaccgcttgggaaaaagctgtcgcttcgatcaggtaagaatttcgaaccgattcataggcttatgcggacggacgagggagaggggaaaaagcgggacgccaggaggccgcattgggaaaattgtgcacaataattgtgcccagtgttaccgccgcgcccgtcgacggtgcgcggcgcgaagctcagcccgtccgggaaatatccaggcccttcaactgcccgatcatccacgcatgggcgtcacgcccgacatgctggacgtggctgtagagccgcagcacgtagggcggaatgtcgaacggcgcgggatacagggcgaggccggcggcttccgccagggcccgtgcggcatgtcgcggagcggtgagcaggaaatcggtggagcctgccaggaacagcgccgccagcaccgtcggcagttgcaccgccacttcgcgacgcaggccggagcgggccagcagccggtcgatcaccccgctgtcctcgttccacggcgtcaccaccgcatgccgttcggccaggtagccctccagcgtcggcgccccggcgaggcgtgggtggtcgcgccgcgctaccaccacgtagcggtcggcgaaccagtcatgggcctggatgccttcgggcaggcgctcgtgttcctcgtcgtagccgagggcgaaatcgatccgcccgctggccagggcctccaccgacagcttgcgttccgcattgaccaggcgcaggcgcactccgggcgcgctgtgctgcaggcggttcatcagcggcggaagcagggcgaaggcggtgtagtcggtggcggcgaagacgaaggtgcgctggctctgtcccggtacgaacggccgccactcttccagcccctcgccgagggcgcgcagggcggcggccaccgcagcggccaggtgctcggcacgctgggtcggctgcatgcggttgccctggcgcaggaacagctcgtcgtccagcccctggcgcaggcgccccagcgcatggctgaaggccgaggcgctgatcgccagttcgctggctgcggtgccgacgttgcggtggcgatacagggcgtcgaagacaagcaggaggttgagatcgaggcggcgcagcaggggatgcatgttattcagttgccgatgagaagaatgcacttcatgcatcttagcagtcgcactaggatggccggatcccccaccggaaggttgcccatgactctcgaaatccgtcccgccgtaccggccgacgccgaacagatccttgccttcatcatcgaactggccgactacgagcgcgcccgccacgaggtggtcaccgatgtcgaaggcatccgccgcagcctgttcgccgaaggctcgccgacccgcgcgctgatgtgcctgagcgagggccggccgatcggctatgcggtgtatttctacagctactcgacctggctggggcgcaacggcatctacctcgaagacctctacgtcaccccggaataccgtggcgtcggcgccggtcgccggctgctccgcgagttggcccgcgaggccgtggccaacgactgcggacgcctggagtggagcgtgctggactggaaccagccggccatcgacttctaccgctccatcggcgcgctgccgcaggacgagtgggtgcgctatcgcctggatggcgaggcgttgcgcaagatggcggaatag

SEQ ID NO: 5895 - DNA, 864 bp, Pseudomonas aeruginosa
tttttcccagggaccgtcgcaactagcctggcgtgcatggcaatcaccctgaccccggaggctcccatgggcaacctgtcttttctcgctaccagcgacggcgccagcctcgcctatcgcctggatggtgcggcagagaaaccgctgctggcgctctccaactccatcggcaccaccctgcacatgtgggatgcgcaactcccggcactgacccggcacttccgcgtcctgcgctacgacgcccgcggccatggcgcctccagcgtgccgccggggccctacaccctggcccggctgggcgaggacgtactggagctgctcgacgcgctggaggtacggcgcgcgcatttcctcggcctgtccctgggcgggatcgtcggccagtggctggcgctgcatgcgccgcagcggatcgagcggctggtgctggccaacacctcggcctggctcggcccggcggcgcagtgggacgagcgcatcgccgcggtgctgcaggccgaggacatgagcgagaccgccgcgggtttcctcggcaactggtttccgccggcgctgctggagcgcgccgagcccgtcgtcgagcgcttccgggcgatgctcatggccaccaaccggcacggcctggccggctccttcgcggcggtgcgcgataccgacctgcgcgcgcaactggcgcggatcgagcggccgaccctggtgatcgcaggggcgtacgacacggtcaccgccgccagccacggcgagctgatcgccgcgtcgattgccggggccaggctggttacgctgccggcggtgcacctgtcgaacgtcgagttcccgcaggcgttcgaaggcgcggtgctgagctttctcggcgcagactga

SEQ ID NO: 5896 - DNA, 486 bp, Pseudomonas aeruginosa
ttacgctatcgtcgcgccttttccctcggcgcaggagccgacatgaacgagccgggcagtttcatctggacgtggtacgggcaggatgagcatcgatgggtcctgctcagcgcagaggcgttcctggcgctcgatttcctggcccttgacggtgccatgcagagagagaccatcggcagttgcccgggctgctctacctggtcggagaaggtcgtgccgttgcacgagtggctcgaaggctgtccgggtcaccaggccgggagttttcgcgatgccttgaggcgtgtctgggcgctgtgcaacgagctgcccgaggaagcgctgggctgcttcgacttcgacatctatgcccaccccggatggcaggcggtacgtcgagaggcccgggaggcgctgcggcagaacggttgggacagcatccgtagccacgccgaggagctgcgcgacgactgttgggagcgtgtgcatggctacccgaagaaatga

SEQ ID NO: 5897 - DNA, 582 bp, Pseudomonas aeruginosa
accaggcccggggtttcgccgaaagcatgggcgcctgcggcctgcaactggagacggcgaagaccaaccacgccgggcagtcgctctacgagcgcctcggctatgtccgtgacgaacagttctacacttactggctgcagctctgaactcccattcgtcccagcaggaggcaagctcatggatcacctggtcctgaccgtgatcgccaccgaccatcccggcctggtcgagcgcatcgcccaatgcatcgcctcccacggcggcaactggctggaaagccgcatgtcgcggatggccgggcagttcgccgggatactgcgggtggccgtgccggcggaaggctacgacgaactggtggaagggctacagggcctgtccagccacggtatccgcgtgctcctggcggaaagcgggatcgagccggtatgcaactggaagcctatccacctcgacctggtgggcaacgaccgccccggtatcgtgcgtgacatcacccggctgctggccgagcacggggtgaacctggagagcctgtccaccgaagtgcgcccggcgccgatgagcagcgaaccgctgttccat

SEQ ID NO: 5898 - DNA, 657 bp, Pseudomonas aeruginosa
tcattcccgagcgcagggtcgaatcggcgatgctcaatgccttccgcgactggctggtggaagaggccaggcagtaccgcgaggccaacgggctgggctgaacgcgcaggaacatcgggtggcgcaggcaggacgcgccgccccgggaccgggccgatccgccgggtcccgcggagccgcggcggcgataccgccgggcatcctccacgacggccaggatggcggccgtggggcaccacaccaggagttcacatgaatttccacacccgcaagtgggtcaagccagaagatctcaaccccaacggcaccctgttcggcggcagcctgctgcgctggatcgacgaagaagcggcgatctacgcgatcatccagctgggcaaccagcgcgtggtcaccaagtacatttccgagatcaacttcgtcagctcggcgcgccagggcgacatcatcgagctgggcatcaccgccaccgacttcggtcgtacctcgctgaccatgacctgccacgtgcgcaacaagatcacccgcaagagcatcctcaccatcgacaagatggtcttcgtcaacctcggcccggacggcctgccggcgccccacggcaagaccgagatcacctacatcaaggaccagttcaaggaagacgaagtcctgccctga

SEQ ID NO: 5899 - DNA, 243 bp, Pseudomonas aeruginosa
tcccgaaccgttcgccgccatggtcccggccaccccggaagacagcacatgggtggtggataccggcaagccatacaggtccgccgcgccaatggtcagcatcgccacggtttccgccgaggcgccctgggcgtaggtcaggtgggtcttgccgatcttctcgccgaccgtcaccacgatgcgtttccagccgaccatggtgcccaggccgagggcgatggccacggcgatcttcacccatag

SEQ ID NO: 5900 - DNA, 1296 bp, Pseudomonas aeruginosa
cgggatgaacttggtggcgtcgtcgatcttccgcttgaacgcctgcaacttgccgcgggtgtcggcgtcgaagcggccgacgtcgtccttgtccatcaggcggatcgcctcggaggtcaggtacatgtcgttgcgcacgttgcccatggcttgcgccggtacccgcgagaacgcgccatagcctttcacttcctggccgatcgagccggtcagggcggccagcgccgggatcagctcaggcgatgcctgcttgctgcgcacgtagtcggagagtacctggcgcggatcggccggcgccggttgcggcgcgctcttcaccagcgcttgctgggtgacctcggcgacggcggcgaactgcactgcctggtccgccggcatggtgcggttcagggcgtaggccatcggcagggtgccgaccaggatcagcatgatcaggcccatgcctttctgtccgtcgttggagccgtgggcgaaggacaccccggtacaggtcaggatcagcaggccgcggatccaccagggcggcggcgccttgcccttcggcgccttgtacagcgcgcggttcttcaccagcaggcgcagcgccaggagcaacagggcggcgcaggcgaagccgatcagcggcgagagcagcagggaatagccgaccttggttgcctggccccagtccaccccgctggtgccgtcgcgcccgtgcatcagcgcgttggccacgccgacgccgatgatcgagccgatcagggtgtgcgaggacgacgccggcaggcccagccaccaggtcccgaggttccacgggatggcggcgatcagcagggcgaagaccatggcgaagccggccgaggaaccgacctgcaggatcagttccaccggcagcagggcgatgatgccgaaggccaccgcgccgctggagagcaatacgccgagaaagttgaagcaacccgaccagaccaccgcgaagtgcggcggcagcgagtgggtgtagatcaccgtggccaccgcgttggcggtgtcgtggaagccgttgacgaactcgaagccgagggcgatcagcagggccacgccgagcagcaggaagggcgtccaggtggtgatcgcggaaccgacgtcatcgacgtcctgcatcaggccgtaggcgctgaacagcagtccggtggcgagcacggcgaagaatacgaaggcggtgaggcggccgggacgctgctcgagatggggcttgtgcgcgttgccggcggcactggcgacggcgtcggcgggaaggacatcggaggtcatggtgcgggtccgcgctggggatga

SEQ ID NO: 5901 - DNA, 759 bp, Pseudomonas aeruginosa
actgagaagtgcgcggcggggccggtcgcttgccggcccggtgcgcgggacgagcgccttcgtcccggggtggcccggccgggcggtcggggaggtcgatatgcggatgccgtgccggctcgcgctggcgctgttgctgtgcttcgccggcccggcctgtctcgcggcctccggaccggtacgggtgctctcggtggatggtgcgatcggcccggccagcgccgattacctggtgcgcggcatcgagcgtgccgccgaggacggcgcgcaactggtggtgctggaactggacacgcccggcggcctggacgcatcgatgcggcgcatcgtcaaggcgatcctcgccagccaggtgccggtcgccggtttcgtcgcgcccagcggggcgcgggcggcgagcgccggcacctacatcctgtatgcctgccatatcgcggcgatggcgccgggcaccaacctcggcgccgccaccccggtgcgcctggggacgccggacaagcccgcagagaagcccccggcgcgggacgccgaacccatggtgcgcaagcaggtcaacgacgccgccgcctatatccgtggcctcgcgcagttgcgcgggcgcaacgtcgaatgggccgagcgcgcggtgcgcgaggcggtcagcctggcggcgcacgaggcggcggcgcagaaggtgatcgacctgcaggcccgcgacatgcccgacctgctgcgccaggttggacggccgcagcctgcgcgtcggcgagcgcgcgctga

SEQ ID NO: 5902 - DNA, 675 bp, Pseudomonas aeruginosa
ccctggctaccgccggcgccacggtcgagcggccaggcaccggactggcgcgcgcggttgctggcggtgctcaccgatcccagcgtggcgctgatcctgatgatgatcggcatctacgggctgatcttcgaactggccaatcccggcatggcgctgcccggcgtgctcggcggcatctgcctgctgctcggcctgtacgccctgcagatgctgccggtcaactacgccgggctggcgctgatcgcgctgggcctggcgttcatggtgggcgaggcgttcgtcgccagcttcggcgtgctcggcatcggtggaatcgtctcgttcgtggtcggcgcgctgatcctgatcgataccgaggtgcccggctacggcattccgcccggcctggtggtggccctggcgttgctcagcgccgcgctgatcgtcggtctgctgggcatggccctgcgtactcgccggcaagcggtggtaagtggcaccgccggattggtcggcagcctggcgacggtggcggcggtggattccgaacaaccctgcgcaggctgggtgcagctccagggcgagcgctggcgggtgctcgccgcgcggccgctggcggtgggccagccggtctgggtgctggcgcgcaagggcctgctcctggaagtcgcgctggccgatgaaggaggtggatga

SEQ ID NO: 5903 - DNA, 546 bp, Pseudomonas aeruginosa
aggtcaacgcggtggtgtacttccgcgtgctcgatccgcaggaaggcgatcatccaggtggagaactacctggccgccaccagccagttggcccagaccaccctgcgcgcggtgctgggcaagcacgagctggacgagatgctcgccgagcgcgagcgcctgaacctggatatccagcaagtgctcgatgcgcagaccgacgcctggggcatcaaggtggcgaatgtggaaatcaagcacgtcgatctcaacgaatcgatggttcgcgccatcgcccggcaggccgaggcggagcgtgagcgcagggccaaggtgatccatgccgagggcgagctgcaagcctcggagaaactcatgcaggcggcgcagatgctcggccggcagagtggcgccatgcagttgcgctacatgcagaccctcggcgcgatcgccggcgacaagagttcgaccatcgtcttcccgatgccgatcgaactcttcggcggcaagtacgcaggtgccgcgccgcggaacgaaaaggccgccggagaggaagaggagaggtga

SEQ ID NO: 5904 - DNA, 228 bp, Pseudomonas aeruginosa
ttccaaggagaacttgcaatgtcccgtcagaacggcaccgttaagtggttcaacgaaaccaaaggctacggcttcattaccccggaaagcggcccggacgttttcgttcacttccgtgccatcgaaggtaacggcttcaagaccctggccgaaggccagaaggtcagcttcgaagtcgtacaaggccagaaaggcatgcaggccgagcgcgttcaggtgatcaactaa

SEQ ID NO: 5905 - DNA, 570 bp, Pseudomonas aeruginosa
cgagttcccgcccagagtggcccggtcccgttcggagtcgtttcgatgaagcctgtgcaatcccgtcgtctggccttcgccgcgctgttgtcgctgtcgttctcttccgcgtcctgccatgccgccaccgagcactggggctggatcgagcagtcctggctgatgcccgagcgcatgcaggccaaggccaagctggataccggcgcgctgacctcgtcgctggacgcgaggaatatccatcgctacaggaaggacggcgagcgctgggtgcgcttcgatgtcgtgctgcccaccgccgacagcaaggcgccggtcagcgtgaccttcgagcgcaaggtgctgcggctgatcaaggtacgcggcgccggcggcagcgacagccgtccggtggtggcgatggacatctgcctgggcgccaagctgctgcgcgagcagttctccctgcgcgaccgcggcaacatgaactatccggtgctgctcggtcgccgcacgctcgaacacctcggcgcggtcgacgtgtcccgaacctttacccgcaaacctacctgcagcgcgctcgccgctcagtag

SEQ ID NO: 5906 - DNA, 813 bp, Pseudomonas aeruginosa
gccaccaccagcagagccaccagtcgggccagccagggcatgtgcggatggcggctgcacagccagagggcgatgacctcggtcttcagctcgcgagcccagcgcttgagcgtagcgatccaggccatcctagaggtccgggtccttttccggatcgacccggcgcgggctggtgcgaccgtcctcgctgccgagctggaagaagatcgccgcggccagcatcgacatcaggccgacgctgacataggtggcgtggaaggcgccgagtacggtgtcctgccccgtatccaggtcggtctggaaaccgcccagcaacgccgccgcgcaagccacgccgaggctgatcgacaactgcacgaccaccgacatcaggctgttgccgctgctggcgttgctgtcctgcaggtcgatcagggtgagggtgttcatcgccgtgaattgcagggagttcaccgcgccgagcaggctcaggtgcagcagcagccagacgtagggggtgtcctggtcgaccaggccgaagccggcgatcaggcagccgaggatcagggtgttgccgaccagcagcttgcgatagccgaagaagtccagcagtggcttggccatcggcttggcgaccatcgcgaacagcgccagcgggatcatggtcatgcccgcggtggagggcgggtagcccagtcccacctgcagcaacagcggggtgaggaagggcagggcgccgctgcccaggcgggcgaacaggttgccgaggatgccgacggcgaaggtccgcgccttgaacaggctcggtgggaacagcggcttgtcgatgcgtag

SEQ ID NO: 5907 - DNA, 2133 bp, Pseudomonas aeruginosa
cgcgcgcagccagtaggcggtgagcaggaccagtccgccgatcagcagcaggaccacgcgcaggtgcgacaggtgcagctcgccgagtccttccagggcgatggagatcagcaccatggagccgccgaagagcaggaagccgatgctgtcgaaacggctcggcaccgggctgcgcaggtccggcatcagcttcatcgccaccaggcagccgagcaggccgaccggcaggttgatcaggaagatccagtgccaggaggcgtactccaccagccagccgcccagcgtcggtcccgccagcgggccgagcaggccgggaatggtgacgaagctgagcacccgcaccaggtcctggcgcgggtagacgcgcaggatcaccagccgtcccaccggcatcatcagcgcgccgccgacgccctgtacgatgcgcgccccgaccagcagttcgaggctcggcgacagcgcgcaaagcaacgagccgaggctgaacagcagtaccgcgccgaggaacacccggcgcgtgccgaaacggtcggcgatccaccccgaggccggtatcagcagggccaccgtgagcaggtaggcgatcaccaccgcctgcatgcgcagcgggttttcgttcagcgaactggccatgctcggcagcgcggtgttgaggatggtgccgtcgagggcttgcatgaagaaggcgacggcaaccagccagggcagttggcgggcgatgcggggggtgagctggaacggctcgctcatggacgggctccctcgggcggacagggcccaagcatagagaagttctcgccgcgatgggacggccggcgaccggatcggggcgaacagcgggcattgcggcggaagtcgcggccagagaggtcgcctttcattgtcctgggtcaagccgaagcgctggcgctcgccggctgctgtgctagtactcaagagtcaccccgtcagtggctgcggatgcgacgtcggcgcttcgtcatcgcacggacatgtcccgcgttgcatgctcgacggcgcgtgcttcaccgccttgtcgcgatgttctccacgcagcgctcggcgaccccggtcgccgctgccgtcgccgaagcccaccttccgtggaaacaggagtcctcccatggcccaggaactttgcgctatctgccacgaacgtcccgccgtcgcccgcgtcagcctggtacagaacggccagcgccgcgaactcgccctctgcgaactgcattaccgccagttgatgcgccagcagcgtatgcgctcgccgctggagtcgctgttcggcggcggcagcccgttcgacgagatcttctccggcttcggcgagcagagcccggtcaccccggtgcgcgcccgcgagccggaggcggtggacatcgccgagtacttcagcaagcagaccaccgagtacctgcaacgcgccgcgcaggtcgccgccgaattcggcaagcgcgaagtggacaccgagcacctgctctacgccctggccgacgccgacgtggtgcaggcggtgctcaagcagttcggcctgtcgccggccgagctcaagcagtacatcgaggccaacgccgtgcgcggcgccagcaagggcgaggcgagcgaggacatgaccatctcgccgcgggtgaagagcgccttgcagcatgccttcgccctgtcccgcgaactcggccacagctatgtcggccccgagcacctgttgctcggcctggcggcggtgccggacagcttcgccgggacgctcctgaagaagtacggcctgaccgagcaggcgctacggcagaaagcggtcaaggtggtcggcaagggcgccgaggacggccgcgtggacggcccgagcaacactccgcaactggacaagttcagccgcgacctgacccggctggcccgcgaaggcaagctcgatccggtgatcggccgctcgaaggaagtcgagaccaccatcgaggttctcgcccggcgcaagaagaacaacccggtgctgatcggcgagcccggcgtcggcaagaccgccatcgtcgaaggcctggcccagcgcatggtccagggcgaggtgccggaggtgctgcgcgacaagcgcctggtcgaactgaacatcaacgccatggtcgccggcgccaagtaccgcggtga

SEQ ID NO: 5908 - DNA, 2469 bp, Pseudomonas aeruginosa
gttcgaggaacgcctcaagcaggtgatggacgaactgcaggcggcgcagagcgagatcatcctgttcatcgacgaggtgcacaccatcgtcggtgccggccagggcggcggcgaaggcgggctggacgtggccaacgtgctgaagccggcgatggcgcgcggcgagatgaacctgatcggcgccaccaccctcaacgagtaccagaagtacatcgagaaggacgccgcgctggagcggcgcttccagccggtgttcgtccccgagccgacggtggagcagaccatctccatcctccgtggcctgcgcgacaagctcgaaggccaccacaaggtgaccatccgcgacgaggccttcgtcgccgccgccgagctgtccgatcgctacatcggcaaccgcttcctgccggacaaggccatcgacctgatcgaccaggccgccgcccgcgtgcgcatcgccagcacctcgcggccggccgagatccaggaactggaggccgagctggcgcagctcaagcgcgagcaggactacgccgccagccgcaagtggtacgacgaggcgaaggtcttcgagaaacgcatccaggaacgcaaggaacacctcgagcagatcaccgagcgctggcagcagacccaggggtcgaagaccgaggaggtgcgggtcgaggacatcgccgagatcatctccaggctcaccggcatcccggtcaccgaactgaccgccgaggagcgcgagaagctcctgcagatggaagagcgcctgcaccagcgggtgatcggccagcaggaagcgatcaccgcggtcagcgacgccgtgcgcctggcccgcgccgggctgcgccagggcagccggccgatcgccaccttcctgttcctcggcccgaccggggtgggcaagaccgagctggccaaggccctggccgaggtggtgttcggcgacgaagacgcgatgatccgcatcgacatgagcgaatacatggagcgccacgcggtgtcccggctgatcggtgcgccgccgggctacgtcggctacgacgagggcggccagctcaccgagcgggtgcgccggcggccttacagcgtgatcctgctcgacgagatcgagaaggcccacgccgacgtcaacaacatcctcctgcaggtgttcgacgacggccgcctgaccgacggcaaggggcgcgtggtggacttcaccaataccatcatcatcgccaccagcaacctaggctccgagctgatcatgaagaacgcccaggccggcgagttcgcccagccgccggagaagctcaagcgcgaactgatgactaccctgcgcggacatttccgcccggaattcctcaaccgcctcgacgaggtgatcgtcttcgagtcgctgagcaaggcgcagatcgaggacatcgtgcgcctgcaactggagcgggtgaagcgcgccgcgcacgctcaggacatctacctgcacatcgacgacagcctggtcggccacctcgccgaagaggcctaccagccggagttcggcgcccgcgagctgaagcggcagatccgccagcaactggagacgcgcctggccacggcgatgctcaagggcgaggtgaaagagggcgagacggtcaccttcttctacgacgccaaggacggcgtcggctaccgcaagggcgccgcgccgaagccggcggcacgcaagaaatccggcgccggcgagacgcccaagggccgcgcgacggcggcgaggaagccggcggcgaagaaaggcgccgccgccaagggcaaggccgacaagccgaaggccaagtgacccgaccaaggttggggaacaaggcaccggccggtcggtcgaaatctcaccccggcctgcgaatgcggccggggcgttcgatatctcatgaggaattgccgatgcgcgtcaccacccacgctaccctggccgcggccctgctgctcagcgccgcctccgcgttcgccttcaatctcggggatgccgccaaggcggtcgccggggcatcccagggcgactccgcccaggtagccaccaccccgcagaccaacggtctgctcggcgcactcaccggccagctcggggtcagccaggagcaggcggtcggcggtaccggcgccctgctcggcctggccaagaaccagttggccggcaacgattattcgcaactggttaagaccatccccggcctcgacaagctggccggcaacaacgccctggccggtctcggcgggctcggcaacgtgctcggcaagagcggcggcgacagcaagggcctcggttcgctgctcggcaatgcggacagcatgggcgacgtgaacaaagccttcggcaccctgggcatggatagcgggatgaccgagaagttcgcccaggtgctggtcgactacttcggcaagcagggcgccaacagcgagctgctgggcagcctgagcaatctctggggagtgagcaaggcgggcggctcgtcgctgctctga

SEQ ID NO: 5909 - DNA, 1515 bp, Pseudomonas aeruginosa
ccgcgttgcggttattcgccctacgaggtgggtgcgacccccgggtattcgttgcccgcaccggtagggcgaataacgcccccggcgttatccgccgctgcgccgtggaaacggcggataaccgcgttgcggttattcgccctacgagatgggtgtgcttcggccggtacttcagcgcagttgccgcaagcgggcgatgcgttcgtccttttcttcccacatgcgcgagacccattcctgcacgtactggcggaacaccgggtcgttctcgtagtcgccctgccacagggcgggatcgatcgggcgggtctggatgtcgacgatcaccttcggcacccgtccgcagagcaggtcccagaatcccggcaccttgtcgctcgggtagaccacggtgacgtcgagcagggcgtccagttgctcgcccagcgcggcgaggacgaaggccaccccgccggccttgggcttgagcaggtggcgatagggcgactgttgccgggccttcttctgctcgctgaaacgcgtgccttccaggtagttcaccacggtcaccgggatgcgcttgaacttctcgcaggcggccttggtgatctccaggtccttgcccttgagttccgggtgcttctccaggaaggccttggaatagcgcttcatgaacggatactccagcgcccaccaggccaggccgaggaagggcacccagatcagctccttcttgaggaagaacttgaagtacggggtgcgccggttgaacacctggatcaacgcggggatgtcgacccaggactggtggttgctcaccaccaggtacgaggtgtcctggcgcaggtcgccggcgccgcgcacgtcccagaccgtcggcgtgcaggtggcgaagatccacttgtcgatctccgcccaggtctcggcgatccacatcacgcccctggagcagaggtctttcaggcgctggccggggagcaccagcttgagcagtgcgatcagcatcatcgggccgatcaggatcagcgtgttgagaagcagcagaaggctgctggtcaggccggtcaacagttcccgcatggttggtttccctgtcctgggtgtgggtcgacgcggcccatcatacgcatccgcgccgcgccgcccaagccgccggcgtggcgaacgaaaccgcgccgtgctagtcctatgtggacctcgtatcacttcaggagatgcccgcgtgaagcgtgcccttgccttgctctcgctgttcgccctgccggtcctcgccgccgaacccaacctctacggccgctacgaatgggtctccctgccggagctggaccgcaccctgcaggcgaagatggacaccggcgcctacacctcctcgctgtcggccaaggacatcgagttgttccagcgcgacggcgaggagtgggtgcgcttccggctggccaccaaggaggccgacggctcggtgttcgagcacaagctggcgcgcatcggcaagatcaagaaccgcgccgacaaccgcaacggcgaggacgaggatga

SEQ ID NO: 5910 - DNA, 2085 bp, Pseudomonas aeruginosa
agccgcgattgccgacaccctgctctacgccctgcaggccgaaggcttcgccaccacctgggtgaccctcgccggcgaggcgctggcgttacaggagcgccagccggcggatctgctgatcctcgacgtcggtctgccggacatcagcggtttcgaggcctgcaagcgcctgcgccggttctccgaggtgccggtgatcttcctcaccgcgcgcgatgccgagatcgaccgtgtggtcggcctggagatcggcgccgacgactacgtggtcaagccgttcagcccgcgcgaggtggcggctcgggtcaaggccatcctcaagcgcatggcgccgcgcccggcggcgctggaagaggccgcgccgagcgggccgttccaggtcgacgaggagcgcgtgcggatccactaccgcgacaccccgctcaacctcacccgccacgagttccgcctgctgcagacgctgctcgggcagcccgagcgggtattcagccgcgagcagttgctcgacgccctcggcgtcgccagcgaggccggctacgagcgcaacatcgacagccacatcaagagcctgcgcgccaagctgcgccaggtgaacgaacgcggcgaagcgatccagacccatcgcggcctgggctacagctacagcccggaccacgcctgatgccgctcggcgttcggatcttcctggtctacttcctgttcgtcggtctcaccggctacttcgtgctgagcacggtgatggacgaagtgcggcccggcgtgcgccagtccaccgaggaaaccctggtggacaccgccaacctgctcgccgagatcctccgccaggacgtgaagaacggcaccctggcacagagcgacctgccggagatgctcgaggactacggcaagcgcgtgccgcaggcggatatctggggcttgcgcaaggaggctgtgaaccaccgcatctacgtcaccgacgccagcggcaaggtgctgctggactccgccggggtggctgtcggccaggactattcgcgctggaacgacgtctacctgactctccggggccagtacggcgcgcgctccagccgcgaagacccggacgacccggattcctcggtgatgtacgtggcggcgccgatcaaggatggtgggaagatcatcggggtggtttcggtggccaagccgaacagcagcctgcaaccctacatcgaccgctcgcagcggcgcctggcctggctcggtgccgggctgatcgccctcgggctgctggtcggcggcctgctctcctggtggctcagcggcgcgctgcggcgcctcacccagtacgcacaggcggtcagcgaggggcgccgcgccgagctgccgcgctatcgcggcggcgagatggcgcaactggcggacgcggtggaacgcatgcgcacgcaactggaaggcaaggactacgtcgagcgctacgtgcataccctgacccacgaactgaagagcccattggcggcgatccgtggcgccgccgagttgctcgacggcgagatgccggccgagcagcgggcgcgcttcgtcggcaacatcgccggcgagagcgagcgcctgcaacaactgatcgagcgcctgctgagcctggcccaggtggagcagcggcaaggcctggaggaggtcggcaaggtcgacctgcgggagatcgccgcgtccctgctggaaggccaggcggcgcgtatccagcgccagcgattgcgggtggagaaccgcctggaaggtccctgcgaggttcgcggcgagcagttcctgctgcgccaggcgctggccaacctgctcgacaacgccctcgacttcaccccgcccggcggcatccttcgcctgctcgccgaggtcgacggcgagggtatcgccttgcgcctgttcaaccaggggccggcgattcccgactacgccctggcgcgcctcaccgaacgcttctactcgctgccgcgcccggccagcgggcgcaagagcaccgggctgggactgaacttcgtcgccgaggtggcgcaactgcatggcggccggttgcaggtcggcaaccgcgacgacggcgtcgaggcgctgctctggctgccgcgcggctga

SEQ ID NO: 5911 - DNA, 1461 bp, Pseudomonas aeruginosa
ggcgcctccacggaaactccatcgactctccacacggcgacccgaagcccgccatcgcggcgccgcagactttccgccatcaccccgacggagagtccccccatgaaccgcacgctggcctacaagctcggtgccatcgccctactcatcctgctattgctgattcccctgttgatgatcgacggcctgatccgcgatcgccaggaggttcgtgacggcgtgctgcaggatatcgcccgcagctccagctacagccagcgcctcaccggcccgctgctggtggtgccgtaccgcaggacggtgcgcgagtgggtcaccgaggagaagaccgagaagcgcgtgttgcaggagcgcgagcagcgcggcgagctgtacttcctgcccgaccgctttgccctcgacgggcagatgcgcaccgagctgcgctaccgtggcatctaccaggcgcgcctgtaccacgtcgacaacaaggttgccggctacttccaggtgcctgcgcactatggcatcgaagaagacctggaggactaccagttcgaaacgccgttcctggcgatgggcatcagcgacatccgcggcatcgagaatgccctgcgcctgtccctcaacggtgccagcgtcgacttcgagccgggtagccgggtcggcctgctcggcagcggtgtgcacgcaccgctgcaaggcgtcgacgggcgccaggcgcagcgcctggagtacgccttcgacctgtcgttgctcggcagcgagcggctggacatcgtgccggtgggccgcgacagccaggtcatcctgaaggccgactggccgcacccgagcttcggcggcgagttcctgcccagcgagcgggagatcaccgcccagggcttcaccgcgcgctggcagaccagcttcttcgccaccaacatggaagaggcgctgcgcagttgcgtggaggagcagcgttgcgacggcttccaggcgcgcgccttcggcgtcggcctggtcgatccggtggaccagtacctgaaggccgaccgcgcgatcaagtacgcgctgctgttcatcaccctgaccttcgccggtttcttcctcttcgaggtgctcaagcgcctggcggtacacccggtccagtacgcgctggtcggcctggcgctggcgttcttctacctgctgctgctgtcgctggccgagcacgtcggcttcgagctggcctacctggtctccgccggagcctgcgtcggcctgatcggcttctacctgtgcttcgtcctgcgcagcgtggcccgagggctgggcttcagcgccggcctggcagggctgtacggcctgctctacggcttgctgagcgcggaggactacgccttgctgatgggctcgctgctgctgttcgcggtgcttgccgcggtgatggtgctgacccgccgcctggactggtacggggtcggccgcaaggacttcccggcggtacccgccagggcctga

SEQ ID NO: 5912 - DNA, 870 bp, Pseudomonas aeruginosa
gaggaactgcgaatggccacagtggaaatactcggggcggaatgccgcgcggggggcgcggtgaacgacgatgcgctgggctgcacggcgcaggccgcctgggtgatcgacggtgccaccagcatcggtcgcagcgtgctgggcgtggaaagcgacgcgcgctggctggcccaggcggtggaccggcacctgcggttgctgctggaagtcgagcccgagcaatccagcgagaccctgctgcggcgcctgctcaacgatatccagggcgacttccgcgcccagagcggccgcgactggcacgacctcgaagacatgccggcggcctgcctgagcctgctgcggattcgcggcggagaaatcgaactgctcaacatcggcgacagccggatcctcgtcgaaggcgccgacggccaggtacgcagcttcggcgattcggccctacacgaactggatcggcaatccctggcgcatttctgccggatgcgcgaggaacatccgcagtgggatcacgccgaactgttcaaggccagccgcccgcgcgtgcggcagaaccgcctgctgatgaacaagcccgagggctactgggcgctggacatcagcgaccgctggctcggccaggtgcagcgcgagaccttgccgctcgccgcgttgcgttccttcgtgctgatgaccgacggcttcgaccggctggtcgagcctttccgccgctataccgacgaacagttgctgcggcgcctcgaggacgtcggagtgagcgccatgctcgacgagttgcgcgagatcgaacagggcgatgaccaggccctggctttcccgcgtttcaagatccacgacgacgccagcgcgctgtggggtcggatcgcggggtga

SEQ ID NO: 5913 - DNA, 420 bp, Pseudomonas aeruginosa
aacggaggccgcaccgtgatgaacgtccccgaagggttccagccgctgttccgcagcagtccgttgctcgacctgctcggtcctttcttctgccggcaggacgcccagcgccagttggtggtggcgctgcgcatcgacgaaaagcactgcaaccacggtggcaccgcccacggcggcctgctctcgaccctggccgacgttggcctcggctacgccatggcgttctcccgcgaaccgccgcagccgatggtcaccgtcggcctgcgcctggacttctgcggggtcgcgcgggtcggcgactggctggaggtgcatacccgggtcgacaagctcggccagcgcatggccttcgcctcggcccggctgcacagcggcgagcgcctggtggccagcgccagcggcgtgtttcatctgccctga

SEQ ID NO: 5914 - DNA, 822 bp, Pseudomonas aeruginosa
ggctcgggcatgcttgcccggtcgtctgccgtgagttggggagtcaggtttgccgaagaagtccaatgccgccgaacggatcgtccatgccaccgcctcgctgctggccagccgcgggtatttcggcaccgggctgagcgacatcatcgctcgcgccgaggcgccgaaaggctcgctctatcactatttccccgagggcaagccgcagatcgccagcgccgcgatcggcttcgtcgccgacgaggtggcgtccttcctcgaccgcgccgggacccaggccccccatgcgcgcaacgtcctccgccagttcaccgcgaccctgcgtggctggctggagcattcgcgtttcgaagaggcctgcccggtgctttccaccagcctgagcatcgacgccgagctggccccggtgcatgccgaatgccgccgggcgctccgcgcctggcacgccagcatcgagcgtgcgttgcgcgccgacggactggcggaaaagctcgccgcctcgcgcgcctggctgatcctcgcggcgctggagggggcggtcgcggtggcccgcgtcgagcggtcgttccaggcgctggatgcgatcgaggaagaattgcaggcgctactgccggcctaggcgggtgtcgcgcccaggccggccaggtatccgtcagtgctgcacgctgtccaccgcgatcgcttcgccggaaacttcgcggtaggccgtgcggcgcttggccagggcgtagtggatcaggccggccaggccggcgccgaagaaccaggagaacggcgatagctcggcgaatgccggcaacaatgccagcagggtggagatga

SEQ ID NO: 5915 - DNA, 1035 bp, Pseudomonas aeruginosa
gcaggatcaccggtccggcgaaggattcgtagcgacgcaccatctccatgccgtaggcgaagatcagcaattgcacgcaccagatggcgacgaaggtcgcccagcccaggctcgacaggccgaggatggcgtcctggtcgtaggctgcgagccccggccagatcgccgtcagcagcacgcgcaggacgatggaggcgagataggtctggatgccgaaccaggcgatggcgatcactgcgcggatcagcgcggggagttgcgcgccgtggatgccgaaggcgatgcggcacatcaccgggtagggcagcccggtcttctggcccatgtagccggacaggttcatcagcccgtagaccatcagcgcgcccagggccagcgcggcgaggatctgcgcgccgctcatgccgagggcgaagaggccgatggcgaaggagtagttggcgatattgtgcacgtcgttggtccacagcgcgaacaggctgtagcgtccccagcggcgcccttcggccttggtcggggcgagatcggcgctgtacaggcgcgggctcagcggcggcagttcggggccggcgtgatggctggcgcggggcaggcaatcgagactggcgggagtgcccaggtccaggcgcgccgccgagaactccgctgcgcgcagcccggcgcgtggcaggcagtcgagactggccggagtgcccaggtcgagcagtgaggcggagaactcggcgctccgctgaccggcgcgcggcaggctgtcgaggctttccagggtgccgaggtcgagcagcgagggagaaaactcgcggggcgaggcgggcggcttcggggtgctggacatggcggtctcctccggcagtcggaagaactcggcgcgaggtcgggttcgtctgttgtttttgtatacaagaatttcgaagatttaagccagttatgtgccaaccgatcctcgaccgaattttccgcgctctgcggaaaccggcctttcggcggcaagcccctgaaaccgcttgggaaaaagctgtcgcttcgatcaggtaa

SEQ ID NO: 5916 - DNA, 1323 bp, Pseudomonas aeruginosa
cggttctcgctgctgggggctggaaacggaaatggccgggaagacgggttccttgcccgtctccccggcggccggcgcgctaccgtgaaaaagcgcgccggggtgttgctcggtggctcagaagaatgcctggatgccggtctgcgcgcggccgaggatcagcgcgtggacatcgtgggtgccctcgtaggtgttcaccacttccaggttgaccaggtggcgggcgatgccgaattcgtcggagatgccgttgccgcccagcatgtcgcgggccaggcgggcgatgtcgagggccttgccgcagctgttgcgcttcatgatcgaggtgatttccaccgccgcggtgccttcgtccttcatccgccccaggcgcaggcagccttgcagggccagggtgatctcggtctgcatgtcggccagcttcttctggatcagttggttggcggccagcgggcggccgaactgctggcggtcgagcacgtactggcgggcggtgtgccagcagaattcggcggcgcccagggcgccccaggagatcccgtagcgcgccgagttcaggcaggtgaacggaccgcgcaggccgcgcacttcggggaaggcgttctcttccggaacgaacacgttgtccatcacgatctcgccggtgatcgaggcacgcaggccgaccttgccatggatcgccggggcgctcagaccttcccagcccttctcgaggacgaagccgcggatctgcccttcgtcatccttggcccagaccacgaagacgtcggcgatcgggctgttggtgatccacatcttgctgccgctcaggcgatagccgccgtcgaccttcttcgcccgggtgaccatcgagcccgggtcggaaccgtggttcggctcggtcaggccgaagcagccgatgtattcgccgctggccagcttgggcaggtacttctgccgggtggcttcgttgccgaattcatggatcggcaccatcaccagcgaggactgcacgctcatcatcgagcgatagccggagtcgacgcgctcgacttcgcgagcgatcaggccatagcagacgtagttgaggccgctgccgccgtaggcttcgggaatggtcgcgccgagcaggccggtctcgcccatctcgcggaagatcttcgggtcggtctgttcgtggcggaaggcttcgagcacgcgcggggccagcttgtcctgggcgaactgctgggcgctgtcgcgaaccatgcgctcttcttcggtgagctgctggtccagcagcaggggatcttcccagttgaagctagctttggtggccatgcgtacatcctcgtcaagcggtag

SEQ ID NO: 5917 - DNA, 855 bp, Pseudomonas aeruginosa
ccggcgggtggcggtacgcctcgacgcggtggagcgcgacaccctggcggtgatggggcaccagggcggcggcgcgatcgaactggcggtggtgccgaccttcggcacccaatggctgttgccgcggctcaagcgcttccagcggctgcacccggaggtcacgatcaacctgaccaaccgcacccgcccgttcctcttcgccgacaccgagttcgacgccgcgctgtacttcggcgacgccgactggtcgggtaccgtctcgcatttcctgatgcgcgagaatccggtgccggtgtgcagcccggagctgctgggcgggcgtcgaacgctgagcgccgagcaggtcgccgggctgccgctgatgcagcagagcacccggccctacgcttggcgccagtggtttcactcccagggactgaacgtcgcccacgacatgagcgggccgcgctacgagctgttctccatgcttgcccaggcggccatgcacggcatgggcgtggccctcataccgcccttcctgatccaggacgagctggccgacggaaggcttatcgtgcccatgcaacatgcctatttgagcgagaatgcgtattacctgatcattcccgagcgcagggtcgaatcggcgatgctcaatgccttccgcgactggctggtggaagaggccaggcagtaccgcgaggccaacgggctgggctgaacgcgcaggaacatcgggtggcgcaggcaggacgcgccgccccgggaccgggccgatccgccgggtcccgcggagccgcggcggcgataccgccgggcatcctccacgacggccaggatggcggccgtggggcaccacaccaggagttcacatga

SEQ ID NO: 5918 - DNA, 954 bp, Pseudomonas aeruginosa
attcctgtggcgagtgccatcatttcgtcgctaaaaagttggcatgttgagggatttgccgatccggacacgcgcggggaaggcgagagccactggactagactgagaagtgcgcggcggggccggtcgcttgccggcccggtgcgcgggacgagcgccttcgtcccggggtggcccggccgggcggtcggggaggtcgatatgcggatgccgtgccggctcgcgctggcgctgttgctgtgcttcgccggcccggcctgtctcgcggcctccggaccggtacgggtgctctcggtggatggtgcgatcggcccggccagcgccgattacctggtgcgcggcatcgagcgtgccgccgaggacggcgcgcaactggtggtgctggaactggacacgcccggcggcctggacgcatcgatgcggcgcatcgtcaaggcgatcctcgccagccaggtgccggtcgccggtttcgtcgcgcccagcggggcgcgggcggcgagcgccggcacctacatcctgtatgcctgccatatcgcggcgatggcgccgggcaccaacctcggcgccgccaccccggtgcgcctggggacgccggacaagcccgcagagaagcccccggcgcgggacgccgaacccatggtgcgcaagcaggtcaacgacgccgccgcctatatccgtggcctcgcgcagttgcgcgggcgcaacgtcgaatgggccgagcgcgcggtgcgcgaggcggtcagcctggcggcgcacgaggcggcggcgcagaaggtgatcgacctgcaggcccgcgacatgcccgacctgctgcgccaggttggacggccgcagcctgcgcgtcggcgagcgcgcgctgaccctggctaccgccggcgccacggtcgagcggccaggcaccggactggcgcgcgcggttgctggcggtgctcaccgatcccagcgtggcgctga

SEQ ID NO: 5919 - DNA, 1932 bp, Pseudomonas aeruginosa
atagctgagcagggtgtgcgagaggaccaggaagcggaagccgatctcggcgtccttcctgaaatggccgggttccaggagcatgttcgacagggtggtcgagagcgccgcgtcggcgttgtgcgcgttgcgccgggcggtgcggtagtcgaggtcgtcgcgcttgccggtggcgtactgctgcatgatctgccgcaggtaacggctgttgcaggcgagggtgttggcgagcatgcggttgagccggcggccctgccagtcgggcagcaccaggaacaccgcgaggccggcgatcaggctgcccagcaaggtatcgaacaggcggggcaggatcagcccgtagccatcgccgacctggttgaagcagaacagcaccagcagggtgatcgccgccgtcgccagggtatagcgactgctgcgggtggcgaagaaggcgaccccggcggcgaccgcgaacagcgactgcaccagcgggctggggaacaggtcgatcagcgcccagccgaccaccaggccgaccaccgtaccgaggatccgctgcaccaggcgcaggcgggtcgcgccatagttgggctggcagacgaacaccgtggtgagcagtatccagtagccctgggtcggatggatccagtgcagcacgccgtagccggcggtcagcgccagggccatgcgcaggccgtggcggaacagcagcgaggtcggggtgagctgctggcgcaggcgctcgaaggcgtccttcaggctgcgcggcgagcggtcgagcagggcgctgtcctgttcgtcggcgatggcgtccgggttgctcgccccggccagcttgcggtccagcgtggtgaggttggcggccagggcgccgagcgagcgcagcaggcccttccaggccgggttgctctgctggcgcaggtgttcgagcgaggcctggaggtcttccagggccagctcgcggtcggcgtaatcaaacggctggcgcaggcggatagcccgcgccagggcctggcaggccttgccctgctggttgagcaggcgctggcagcggaacagcacgtcgctgtggaagaacgcctcggccagccggttgtacgggtagtgcgaggaactggcgcgctcgtggacgtcctgggcgatgaaatagagcttcaggtagcggctcaccttggggcccggccgaccatggccgaggcggttgagaatggtctccttggcctggttcagcgccaccaccaccttgccgttctgccgtgccagggcgaggcgctggccctccacgtcgagctggcgcaacggttcgaacaggctcgacttgatcctcaggtattcgcccagctcgaaatacaggcgggaaagactctgctgcaccggctggttggagaacagcgcgttccacagcaccgagagcagcccgtaccaggccgccccggccaccagcagcagcggttcgtgccagacatcggcgacctcgccgccgcgctggtccacgccgatcatggtgtagatcgagaggatcagggtcgccgaggcgattgccgcatagcgctcgccgagggcgccgaggaggatcatgccgaacgccgacagcgccatcccggaaacgaacagccagggataggggaacagcaactcgacggcgaaggcggcgacgctgaagcacagcagggtcaccagcagcgcttgcaggcggccgagccagttgtcgtcggtctccgccagggcgctggcgatgatcccgaggaacagcgggatcagcagctcgatgcggtcctgccaccagcacagcagcagggcgccggccagggcgatgaacacccgcaggctgtaggcgaacttgtcgagggcccagaggcggcggagcgtgtgtgtcaacgaagagggcggcatgggggcggagtgctatccgatggtccgtggttcagcctatgtggcctgtccggctaa

SEQ ID NO: 5920 - DNA, 1620 bp, Pseudomonas aeruginosa
ttcaatcggccgatttcgcgcgactggaagtccgctgcccgccgcagtcgcaggaagcgctgccgtgggcaactcggtcgagccgggcatctggcggatgcaggcttcgtgcctgcgaacgctaagacgtcgtcgccgcgccgaacgttacccggcggcgatatcgcgcgccggagcgggcccggcgagcgaagcggcggcgcgctaaagcaggcggaccttgaacgagcgacccttgatcttgccttcgctcaggcgcttgagggcctggtgggcgaggccgcgctcgatggcgacgaaggcctggaagtcgaagatggcgatcttgcccaccgcgctgccgggcagcccggcgtcgccggtgagggcaccgagcaggtcgccggggcgcaccttgtccttgcgtccgccggcgatgcacagggtgctcatcggcggcagcaatggttccgggctggccttcaactggccgagggcgtaccaggccagcggctgcttctgcaggtcctcgatggcctgcgcgcggctggcctcggccggcgccaccagcgacagggccaggcctttctcgccggcgcgaccgctgcgtccgatgcgatggatgtggacctccgggtcacgcgccagctcgacgttgatcaccgtttccagggcggcgatgtccagcccgcgggcggccacgtcggtggccaccagtacgttgcaactgcggttggcgaacaccgtcaggacctggtcgcgctcgcgctgctccaggtcgccgtgcagggccagggcggaaatccgctgcgccttcagtgcgtcggccagctcctggcactgctggcgggtctggcagaaggccacgctggactgtggccggaaatgctggagcaggcgtaccacggcgtccatgcgctgtttcggatcgatctcgaagaaacgttgctcgatctggctgtcggcgtgcagcgactcgaccctcacctgtcgcggatcgcgcatgaaggtcttcgccagcttctcgatgccgtccgggtaggtggcggagaacagcagggtctgccggcgctcggggagctggccgatgatctcggcgatgctgtcgtagaagcccatgtcgagcatccggtcggcttcgtcgaggaccagggtattgagcccgtcgaggaccagggtgcccttgcgcaggtgctcttggatgcgccccggggtgccgaccaccacgtgcgcgccgtgctccagcgaagccacctgcgggccgtaggggacgccgccgcagagggtcaggaccttgatgttgtcggcggcgcgggccagccggcggatctccttggcgacctggtcggccagttcgcgggtcgggcacagcaccagcgcctggcagccgaagtagcgcgggttcagcgggctgagcagggcgaggccgaaggccgcggtcttgccgctgccggtcttggcctgggcgatcaggtcgtgtccctggaggatcagcggcaggctctgcgcctggatcggcgtcatctcccggtaaccgagggagtcgagattggccaggaggtccgcggaaagcggcagcgaggagaaagcggtggaggtcacggggcagggctcggcaggcgatacgagcggctagtctag

SEQ ID NO: 5921 - DNA, 219 bp, Pseudomonas aeruginosa
acgcgcaggatcaccagccgtcccaccggcatcatcagcgcgccgccgacgccctgtacgatgcgcgccccgaccagcagttcgaggctcggcgacagcgcgcaaagcaacgagccgaggctgaacagcagtaccgcgccgaggaacacccggcgcgtgccgaaacggtcggcgatccaccccgaggccggtatcagcagggccaccgtgagcaggtag

SEQ ID NO: 5922 - DNA, 3135 bp, Pseudomonas aeruginosa
agaagttctcgccgcgatgggacggccggcgaccggatcggggcgaacagcgggcattgcggcggaagtcgcggccagagaggtcgcctttcattgtcctgggtcaagccgaagcgctggcgctcgccggctgctgtgctagtactcaagagtcaccccgtcagtggctgcggatgcgacgtcggcgcttcgtcatcgcacggacatgtcccgcgttgcatgctcgacggcgcgtgcttcaccgccttgtcgcgatgttctccacgcagcgctcggcgaccccggtcgccgctgccgtcgccgaagcccaccttccgtggaaacaggagtcctcccatggcccaggaactttgcgctatctgccacgaacgtcccgccgtcgcccgcgtcagcctggtacagaacggccagcgccgcgaactcgccctctgcgaactgcattaccgccagttgatgcgccagcagcgtatgcgctcgccgctggagtcgctgttcggcggcggcagcccgttcgacgagatcttctccggcttcggcgagcagagcccggtcaccccggtgcgcgcccgcgagccggaggcggtggacatcgccgagtacttcagcaagcagaccaccgagtacctgcaacgcgccgcgcaggtcgccgccgaattcggcaagcgcgaagtggacaccgagcacctgctctacgccctggccgacgccgacgtggtgcaggcggtgctcaagcagttcggcctgtcgccggccgagctcaagcagtacatcgaggccaacgccgtgcgcggcgccagcaagggcgaggcgagcgaggacatgaccatctcgccgcgggtgaagagcgccttgcagcatgccttcgccctgtcccgcgaactcggccacagctatgtcggccccgagcacctgttgctcggcctggcggcggtgccggacagcttcgccgggacgctcctgaagaagtacggcctgaccgagcaggcgctacggcagaaagcggtcaaggtggtcggcaagggcgccgaggacggccgcgtggacggcccgagcaacactccgcaactggacaagttcagccgcgacctgacccggctggcccgcgaaggcaagctcgatccggtgatcggccgctcgaaggaagtcgagaccaccatcgaggttctcgcccggcgcaagaagaacaacccggtgctgatcggcgagcccggcgtcggcaagaccgccatcgtcgaaggcctggcccagcgcatggtccagggcgaggtgccggaggtgctgcgcgacaagcgcctggtcgaactgaacatcaacgccatggtcgccggcgccaagtaccgcggtgagttcgaggaacgcctcaagcaggtgatggacgaactgcaggcggcgcagagcgagatcatcctgttcatcgacgaggtgcacaccatcgtcggtgccggccagggcggcggcgaaggcgggctggacgtggccaacgtgctgaagccggcgatggcgcgcggcgagatgaacctgatcggcgccaccaccctcaacgagtaccagaagtacatcgagaaggacgccgcgctggagcggcgcttccagccggtgttcgtccccgagccgacggtggagcagaccatctccatcctccgtggcctgcgcgacaagctcgaaggccaccacaaggtgaccatccgcgacgaggccttcgtcgccgccgccgagctgtccgatcgctacatcggcaaccgcttcctgccggacaaggccatcgacctgatcgaccaggccgccgcccgcgtgcgcatcgccagcacctcgcggccggccgagatccaggaactggaggccgagctggcgcagctcaagcgcgagcaggactacgccgccagccgcaagtggtacgacgaggcgaaggtcttcgagaaacgcatccaggaacgcaaggaacacctcgagcagatcaccgagcgctggcagcagacccaggggtcgaagaccgaggaggtgcgggtcgaggacatcgccgagatcatctccaggctcaccggcatcccggtcaccgaactgaccgccgaggagcgcgagaagctcctgcagatggaagagcgcctgcaccagcgggtgatcggccagcaggaagcgatcaccgcggtcagcgacgccgtgcgcctggcccgcgccgggctgcgccagggcagccggccgatcgccaccttcctgttcctcggcccgaccggggtgggcaagaccgagctggccaaggccctggccgaggtggtgttcggcgacgaagacgcgatgatccgcatcgacatgagcgaatacatggagcgccacgcggtgtcccggctgatcggtgcgccgccgggctacgtcggctacgacgagggcggccagctcaccgagcgggtgcgccggcggccttacagcgtgatcctgctcgacgagatcgagaaggcccacgccgacgtcaacaacatcctcctgcaggtgttcgacgacggccgcctgaccgacggcaaggggcgcgtggtggacttcaccaataccatcatcatcgccaccagcaacctaggctccgagctgatcatgaagaacgcccaggccggcgagttcgcccagccgccggagaagctcaagcgcgaactgatgactaccctgcgcggacatttccgcccggaattcctcaaccgcctcgacgaggtgatcgtcttcgagtcgctgagcaaggcgcagatcgaggacatcgtgcgcctgcaactggagcgggtgaagcgcgccgcgcacgctcaggacatctacctgcacatcgacgacagcctggtcggccacctcgccgaagaggcctaccagccggagttcggcgcccgcgagctgaagcggcagatccgccagcaactggagacgcgcctggccacggcgatgctcaagggcgaggtgaaagagggcgagacggtcaccttcttctacgacgccaaggacggcgtcggctaccgcaagggcgccgcgccgaagccggcggcacgcaagaaatccggcgccggcgagacgcccaagggccgcgcgacggcggcgaggaagccggcggcgaagaaaggcgccgccgccaagggcaaggccgacaagccgaaggccaagtga

SEQ ID NO: 5923 - DNA, 1068 bp, Pseudomonas aeruginosa
cgcttcatgaacggatactccagcgcccaccaggccaggccgaggaagggcacccagatcagctccttcttgaggaagaacttgaagtacggggtgcgccggttgaacacctggatcaacgcggggatgtcgacccaggactggtggttgctcaccaccaggtacgaggtgtcctggcgcaggtcgccggcgccgcgcacgtcccagaccgtcggcgtgcaggtggcgaagatccacttgtcgatctccgcccaggtctcggcgatccacatcacgcccctggagcagaggtctttcaggcgctggccggggagcaccagcttgagcagtgcgatcagcatcatcgggccgatcaggatcagcgtgttgagaagcagcagaaggctgctggtcaggccggtcaacagttcccgcatggttggtttccctgtcctgggtgtgggtcgacgcggcccatcatacgcatccgcgccgcgccgcccaagccgccggcgtggcgaacgaaaccgcgccgtgctagtcctatgtggacctcgtatcacttcaggagatgcccgcgtgaagcgtgcccttgccttgctctcgctgttcgccctgccggtcctcgccgccgaacccaacctctacggccgctacgaatgggtctccctgccggagctggaccgcaccctgcaggcgaagatggacaccggcgcctacacctcctcgctgtcggccaaggacatcgagttgttccagcgcgacggcgaggagtgggtgcgcttccggctggccaccaaggaggccgacggctcggtgttcgagcacaagctggcgcgcatcggcaagatcaagaaccgcgccgacaaccgcaacggcgaggacgaggatgaggaccgcctgagcgaacgcccggtgatcgacctgcaggtctgcctgggcggagcgatgaagaccatcgaggtcaacctcaccgaccgcagcgccttcaactatccgttcctgatgggcaccaagggcttgcgcaaattccacgtcgcggtcgatccctccgagcgcttcgtcgccgacaagcccacctgcaagtaa

SEQ ID NO: 5924 - DNA, 774 bp, Pseudomonas aeruginosa
gcgtcctacgccaccggcggcgcgattgacgcgcgcgccggcttgcggcaccgttccggcattcccgtcagccgccgtcacgccatgccgcatatcctgatcgtcgaagatgaagccgcgattgccgacaccctgctctacgccctgcaggccgaaggcttcgccaccacctgggtgaccctcgccggcgaggcgctggcgttacaggagcgccagccggcggatctgctgatcctcgacgtcggtctgccggacatcagcggtttcgaggcctgcaagcgcctgcgccggttctccgaggtgccggtgatcttcctcaccgcgcgcgatgccgagatcgaccgtgtggtcggcctggagatcggcgccgacgactacgtggtcaagccgttcagcccgcgcgaggtggcggctcgggtcaaggccatcctcaagcgcatggcgccgcgcccggcggcgctggaagaggccgcgccgagcgggccgttccaggtcgacgaggagcgcgtgcggatccactaccgcgacaccccgctcaacctcacccgccacgagttccgcctgctgcagacgctgctcgggcagcccgagcgggtattcagccgcgagcagttgctcgacgccctcggcgtcgccagcgaggccggctacgagcgcaacatcgacagccacatcaagagcctgcgcgccaagctgcgccaggtgaacgaacgcggcgaagcgatccagacccatcgcggcctgggctacagctacagcccggaccacgcctga

SEQ ID NO: 5925 - DNA, 390 bp, Pseudomonas aeruginosa
gcctggcccaggtggagcagcggcaaggcctggaggaggtcggcaaggtcgacctgcgggagatcgccgcgtccctgctggaaggccaggcggcgcgtatccagcgccagcgattgcgggtggagaaccgcctggaaggtccctgcgaggttcgcggcgagcagttcctgctgcgccaggcgctggccaacctgctcgacaacgccctcgacttcaccccgcccggcggcatccttcgcctgctcgccgaggtcgacggcgagggtatcgccttgcgcctgttcaaccaggggccggcgattcccgactacgccctggcgcgcctcaccgaacgcttctactcgctgccgcgcccggccagcgggcgcaagagcaccgggctgggactga

SEQ ID NO: 5926 - DNA, 603 bp, Pseudomonas aeruginosa
tccgcgatcgccaggaggttcgtgacggcgtgctgcaggatatcgcccgcagctccagctacagccagcgcctcaccggcccgctgctggtggtgccgtaccgcaggacggtgcgcgagtgggtcaccgaggagaagaccgagaagcgcgtgttgcaggagcgcgagcagcgcggcgagctgtacttcctgcccgaccgctttgccctcgacgggcagatgcgcaccgagctgcgctaccgtggcatctaccaggcgcgcctgtaccacgtcgacaacaaggttgccggctacttccaggtgcctgcgcactatggcatcgaagaagacctggaggactaccagttcgaaacgccgttcctggcgatgggcatcagcgacatccgcggcatcgagaatgccctgcgcctgtccctcaacggtgccagcgtcgacttcgagccgggtagccgggtcggcctgctcggcagcggtgtgcacgcaccgctgcaaggcgtcgacgggcgccaggcgcagcgcctggagtacgccttcgacctgtcgttgctcggcagcgagcggctggacatcgtgccggtgggccgcgacagccaggtcatcctga

SEQ ID NO: 5927 - DNA, 417 bp, Pseudomonas aeruginosa
cccgccgcctggactggtacggggtcggccgcaaggacttcccggcggtacccgccagggcctgacgacgaaggcggcggcgccggccgccgccgatttccaaggaggaaaagcatgcgcctgttcttcgagttcaccctctgtgccgccctcggcctgctggtcagcggcgtgatcctgatctttctgctgttcttcggcaagttcggcctgatcgagtactggatcgccagcggcaagcccctggcccacgccatgctggtgctgatgccggacggattctgggaaggcctcagcggcatcgagggcgccgccggcaatccgcacgtgcgctccttcctggagctttgcatggggctcggacagagcgcgctgttgctgggcctgctgctgttccgcctggtgtgctggaaatga

SEQ ID NO: 5928 - DNA, 801 bp, Pseudomonas aeruginosa
  unsure (580): Identity of nucleotide at the above locations are unknown.
cgaggcctggttgcgcggcgcctgttgcaggcggttgcctgcgtactggccttttttcacttcggtgtcggtgtagctataggcgccgatcatcttcaggttgtcggtgacgttgctggtggcttccagctctatcccggagaccttcacttcgcccgtctgcgaagtgaccggcgtgccgcctatgttctgcgacacgctgacgttctcctggcgcaggtcatagaccgcggcggtgaacagcgagtcggagcccaccggctggtacttcacaccgatttcccattgcttgccttcggtcggcttcagcgaactggtgctgttcatatcggcgccagtggtgggttggaacgactccgcataggagatgtagggcgccacgccattgtcgaagatgtagctgagcgccgcgttgccgctgaacttcttgtcgcggctggtattggtggcgtcgcccttgttgtagaaggtggccccggtgtgcacccagtcctcgcgaccgccgagggtcaggcgccagttgtcgagggcgatctggtcctcgacctagaggccggtctggtaggtctgctgcttgtantcgtaatacgcgtcggaacgcggcggcttgggaatcggctggccgtaaatcgggttgttgatgttggtcggcggtacattgaagccgaagatcgaggtgtattcgttggtggtccggttgtggtccaggcccagcagcagggtgtggcgcagcgcgccggtgtcgaagtcggcctggaagttgttgtccaccacgaactggctgacgtcctcgtccactga

SEQ ID NO: 5929 - DNA, 942 bp, Pseudomonas aeruginosa
tgtgctggtgcgctgcagggtaccgtcgtcgctggcggcagcgtaatagctggctggggtcagcgcctggaacgacaggtcgttgcgcaggtagcgcaggttctggcggaactgccagacatcgttgatccgccgctcgaaggcgtagcccagccagtagtaggtgcggtcgtagtattcccagtccggatcgccgaggttcttgtgatgggaaaccttgccgaacggcgcgtcgtacttggttccgcgcagcggcaggaactggctggtgatgccggtatcgtcgcggttgaactggccgaggaaggtcagcctggtgtcgtcgtcgatgttccaggtcaggctcggggcgatgttgtagcgcttgtcgtcgatatggtcgacctgggtgttgctgtcgcgcaccacgccggagacgcggtagagaaagcgtccctcgtcgtcgagcgggccggtgctgtcgaagctgacctgcttgtggttgtagttgccgacctcggccttcacctcgtgactggcgacgttctgcggacgcaggctgaccatgtcgagcatgccgcccggcggggtctggccgtagaccgaggaggccgggccgcgcaacagggcgacacgctccaggttccaggtttccagcttcgggttgttgtagacgccgaccgccatcggcaggccgtcgaggaactgggtcggcttgaagccgcgcaccttcaaccagtcggagcgggtgtcgctgccgaagctgctggcgacgacgccgggcatgtagcgcaccgcgtcgtcgaggttgtgcacggcgcggtcggtcatctgctggcgggtcgccaccgagatcgagcgcggggtctcgaggatcggcgtatcggtcttggtgccggtcatgctgcgcttggcccacgtagccgctggtcggccccagtgggtcttcctcggcgccgctga

SEQ ID NO: 5930 - DNA, 414 bp, Pseudomonas aeruginosa
cgatcatcggcgctcaccggggctctccgtagagggcgatgtagcactggcgcagaccctgggccaggtattggcgcacgcgcggcaccgagactccgagacgctcggcgatctccgcgtggggcatgccgtccaggcggctatagagaaacgcgctacgcgccttcagcgacagcgtgccaagcaggcgatcgatctcgcggaggtcctcgagaatcaggtactgctcttcggccgaaggctgctccgcttccggaaccagcgccagttcggcgagataggcctgctcaagggcggcgcggcggaagtggtcgatcatcagaccgcgcgccaccttcgccaggaacgcgcgcggttcgcgcaggccgggcagctccgggcggccgaggaggcgaacgaaggtgtcctggctga

SEQ ID NO: 5931 - DNA, 432 bp, Pseudomonas aeruginosa
acgtccccgaagggttccagccgctgttccgcagcagtccgttgctcgacctgctcggtcctttcttctgccggcaggacgcccagcgccagttggtggtggcgctgcgcatcgacgaaaagcactgcaaccacggtggcaccgcccacggcggcctgctctcgaccctggccgacgttggcctcggctacgccatggcgttctcccgcgaaccgccgcagccgatggtcaccgtcggcctgcgcctggacttctgcggggtcgcgcgggtcggcgactggctggaggtgcatacccgggtcgacaagctcggccagcgcatggccttcgcctcggcccggctgcacagcggcgagcgcctggtggccagcgccagcggcgtgtttcatctgccctgaggctcgggcatgcttgcccggtcgtctgccgtga

SEQ ID NO: 5932 - DNA, 585 bp, Pseudomonas aeruginosa
gttggggagtcaggtttgccgaagaagtccaatgccgccgaacggatcgtccatgccaccgcctcgctgctggccagccgcgggtatttcggcaccgggctgagcgacatcatcgctcgcgccgaggcgccgaaaggctcgctctatcactatttccccgagggcaagccgcagatcgccagcgccgcgatcggcttcgtcgccgacgaggtggcgtccttcctcgaccgcgccgggacccaggccccccatgcgcgcaacgtcctccgccagttcaccgcgaccctgcgtggctggctggagcattcgcgtttcgaagaggcctgcccggtgctttccaccagcctgagcatcgacgccgagctggccccggtgcatgccgaatgccgccgggcgctccgcgcctggcacgccagcatcgagcgtgcgttgcgcgccgacggactggcggaaaagctcgccgcctcgcgcgcctggctgatcctcgcggcgctggagggggcggtcgcggtggcccgcgtcgagcggtcgttccaggcgctggatgcgatcgaggaagaattgcaggcgctactgccggcctag

SEQ ID NO: 5933 - DNA, 1473 bp, Pseudomonas aeruginosa
ctcggcgaatgccggcaacaatgccagcagggtggagatgatcgccgccgggacgaacgcggcgatggcccgcgggttcacccctcgcgcgtagtgataggcgccggcgcggctttcggtgtacagctccggcaggttcacccggcctttccgcaccaggtagtagtcgaccatgatgatcccgtacagcgggccgagcagcgcgccgaggccgccgaggaagtagaggatcaccccggggctgttgtacaggtgccagggcaggatcagcaccgcgatggtcgcgctgatcagcccggcgcggcggaagttcagcaggttcggcgccaggttggtgagtacgtaggccggggcgacgaagttggccatgatgttcaccgccacggtgacgatcagcagcgccaggctggccagcaccaggaagagggtgtcggggatcgcggcgacgatgtcggtggggctctggatgagctggccgtcgatcctgaactgggcgccggcgaggaccaccgcgaacaggccgaacagcaggatgttcaccggcagcccccagaagttgccgacgctgatggtgcggcggtccgggcagccgcgggcgaagtcgcagaagttcaggatcatggtgccgtacagggtcacccagaacgccgcgccgccgaagatcttcaaccacatctgcgaaccgctcatgggttcgccgctggaccaggcgatggaggcgccggcgcgcaggtacatccaggcggcgagggcggcgacggtgagcaggatcaccggtccggcgaaggattcgtagcgacgcaccatctccatgccgtaggcgaagatcagcaattgcacgcaccagatggcgacgaaggtcgcccagcccaggctcgacaggccgaggatggcgtcctggtcgtaggctgcgagccccggccagatcgccgtcagcagcacgcgcaggacgatggaggcgagataggtctggatgccgaaccaggcgatggcgatcactgcgcggatcagcgcggggagttgcgcgccgtggatgccgaaggcgatgcggcacatcaccgggtagggcagcccggtcttctggcccatgtagccggacaggttcatcagcccgtagaccatcagcgcgcccagggccagcgcggcgaggatctgcgcgccgctcatgccgagggcgaagaggccgatggcgaaggagtagttggcgatattgtgcacgtcgttggtccacagcgcgaacaggctgtagcgtccccagcggcgcccttcggccttggtcggggcgagatcggcgctgtacaggcgcgggctcagcggcggcagttcggggccggcgtgatggctggcgcggggcaggcaatcgagactggcgggagtgcccaggtccaggcgcgccgccgagaactccgctgcgcgcagcccggcgcgtggcaggcagtcgagactggccggagtgcccaggtcgagcagtga

SEQ ID NO: 5934 - DNA, 3036 bp, Pseudomonas aeruginosa
ccacgccgaggagctgcgcgacgactgttgggagcgtgtgcatggctacccgaagaaatgaaaaagccgcccctcggggcggcttttcgttgcgctgcggcgaacggcctacagcccgttcttcgccttgaactcacggcggcggcgatgcaggaccggctcggtatagccgttcggctgccgggtgccttccaccaccagctccagggcggcctggaacgcgacgttgtcgtcgaagttcggcgccatcggccggtaggacgggtcgctggcgttctgccggtcgaccaccacggccatgcgcttgaggctctcgaccacctgctcctggctgatcacgccgtgacgcagccagttggccagcagttggctggagatgcgcagggtggcgcggtcttccatcagaccgacgtcgttgatgtccggcaccttggagcagccgacgccctggtcgatccagcggacgacatagccgaggatgccctgggcgttgttgtccacctcgttcttgatctcttccgcggtccagttggtgttcggcgccagcggaatggtcaggatgtcgtccaccgaggccggggtgcgcttggccagctcggcctggcgggcgaacacgtcgaccttgtggtaatgcagggcgtgcagggtcgcggcggtcggcgacgggacccaggcggtgttggcgccggccagcggatggccgatcttctgctcgagcatggcggccatcaggtcgggcatggcccacatgcccttgccgatctgcgccttgccttgcaggccggtggccaggccgacgtcgacgttgttgttctcgtaggcgccgatccacttctccgacttcatggcgcccttgcgcaccacggcgccggcttccatggaggtgtggatctcgtcgccggtgcggtcgaggaagccggtgttgatgaacaccacgcgatccttggccgccttgatgcaggccttcaggttcacggtggtgcggcgctcctcgtccatgatgccgaccttcagggtgttgcgcggcaggccgaggacgtcctcgacgcggccgaacagctcgttggtgaaggcggcttcttccggaccgtgcatcttcggcttgacgatatacacgctgccggtgcggctgttcttgcggctggtgttgccgttcaggtcatgaatggcgatcaggctggtgaacagaccgtcctggatgccttccggcacttcgttgccgtccttgtcgaggatcgcatcgttggtcatcaggtggccgacgttgcgcacgaacagcagcgagcggccgtgcagggtcagttcggaaccgtcggccctggtgtagacgcggtccgggttcatggtgcgggtgaaggtgctgccgcccttgctgacttcctcggccaggtcgcctttcatcaggcccagccagttgcggtagatcactaccttgtcgtcggcgtcgaccgcggcgaccgagtcctcgcagtccatgatggtggtgagggcggcttccatcagcacgtccttcacgcctgcggcatcggtctggccgaccgggctgctcgggtcgatctggatttcgaagtgcaggccgttgtgcttgagcagtaccgcttgcggcttggcggcgtcgccctggaaggcaaggaactggccagcattcttcaggccggtttcgctgccgttcttcagcgcgacgaccagcgcgccgttcttcacgctgtaggaagtggcgtcgacatgggagccggactccagcggcgcggcctcgtcgaggaaggcgcgagcgaaggcgatgaccttgtcgccgcgaaccttgttgtagcccttgcctttctcggcgccgccttcttcgctgatcacgtcggtgccgtagagtgcgtcgtacagcgagccccagcgggcgttggaggcgttgagggcgaagcgcgcattcatcaccggcaccaccagctgcgggccggccatgcgggcgatctcgtcgtcgacgttctgggtgccggcctggaagtcttccgcctcgggcagcaggtagccgatttcctcgaggaaggccttgtaggcagcggcgtcgtgggcctggccggcgcgagcctggtgccagccgtcgatcttggcctggagttcgtcgcgcttggcgagcagggctttattcttcggcgccaggtcgttgatcacggcctccgcaccggtccagaacgtgtcggcagagacgccggttccggggatggcttcgttgttcacgaagtcgaacaggactttggcgacctgcaggccaccgacttgaacgcgttcagtcattgtttgcctcactctgctctagaccagctctggacccgggccgcacggccttgtagtccgagccgcggcatactacatgatgccgcgggaaaaatcagtggttacgcgtcgcgttacgactggatgacgcttcacggtcacgttggccaggctcaatgttcgcaaaaaaactgtactttgttccagataaatctaaaaacagtacacgatttatcgcgagcccaactgcggcgcggcgtcgcaggatgtttcactgcgctgcgagcgccttgcctatactcccggaatcgccccaggagcctcgccatgcccgtccatgccgcatccctcgccgatctcgccgacctggttccgctgttttccgcctacctcgacttttacgaagtgccggcgccggaagagcaggttcgcgcattcctcgccgagcgcctgcgccagggcgattcgaccctgttcctggccagggatgccgaggcgcgggcgctgggcttcgtccaactctatccgctgttcgcctccctggcgctacgaccttcgtggctgctcagcgatctctacgtccgcccggaggcgcgtcgccggggtgtcggcgaggccctgatgaaccaggcccggggtttcgccgaaagcatgggcgcctgcggcctgcaactggagacggcgaagaccaaccacgccgggcagtcgctctacgagcgcctcggctatgtccgtgacgaacagttctacacttactggctgcagctctga

SEQ ID NO: 5935 - DNA, 975 bp, Pseudomonas aeruginosa
agccctgctcgccaagcgcgacgaactccaggccaagatcgacggctggcaccaggctcgcgccggccaggcccacgacgccgctgcctacaaggccttcctcgaggaaatcggctacctgctgcccgaggcggaagacttccaggccggcacccagaacgtcgacgacgagatcgcccgcatggccggcccgcagctggtggtgccggtgatgaatgcgcgcttcgccctcaacgcctccaacgcccgctggggctcgctgtacgacgcactctacggcaccgacgtgatcagcgaagaaggcggcgccgagaaaggcaagggctacaacaaggttcgcggcgacaaggtcatcgccttcgctcgcgccttcctcgacgaggccgcgccgctggagtccggctcccatgtcgacgccacttcctacagcgtgaagaacggcgcgctggtcgtcgcgctgaagaacggcagcgaaaccggcctgaagaatgctggccagttccttgccttccagggcgacgccgccaagccgcaagcggtactgctcaagcacaacggcctgcacttcgaaatccagatcgacccgagcagcccggtcggccagaccgatgccgcaggcgtgaaggacgtgctgatggaagccgccctcaccaccatcatggactgcgaggactcggtcgccgcggtcgacgccgacgacaaggtagtgatctaccgcaactggctgggcctgatgaaaggcgacctggccgaggaagtcagcaagggcggcagcaccttcacccgcaccatgaacccggaccgcgtctacaccagggccgacggttccgaactgaccctgcacggccgctcgctgctgttcgtgcgcaacgtcggccacctgatgaccaacgatgcgatcctcgacaaggacggcaacgaagtgccggaaggcatccaggacggtctgttcaccagcctgatcgccattcatga

SEQ ID NO: 5936 - DNA, 1026 bp, Pseudomonas aeruginosa
cctgaacggcaacaccagccgcaagaacagccgcaccggcagcgtgtatatcgtcaagccgaagatgcacggtccggaagaagccgccttcaccaacgagctgttcggccgcgtcgaggacgtcctcggcctgccgcgcaacaccctgaaggtcggcatcatggacgaggagcgccgcaccaccgtgaacctgaaggcctgcatcaaggcggccaaggatcgcgtggtgttcatcaacaccggcttcctcgaccgcaccggcgacgagatccacacctccatggaagccggcgccgtggtgcgcaagggcgccatgaagtcggagaagtggatcggcgcctacgagaacaacaacgtcgacgtcggcctggccaccggcctgcaaggcaaggcgcagatcggcaagggcatgtgggccatgcccgacctgatggccgccatgctcgagcagaagatcggccatccgctggccggcgccaacaccgcctgggtcccgtcgccgaccgccgcgaccctgcacgccctgcattaccacaaggtcgacgtgttcgcccgccaggccgagctggccaagcgcaccccggcctcggtggacgacatcctgaccattccgctggcgccgaacaccaactggaccgcggaagagatcaagaacgaggtggacaacaacgcccagggcatcctcggctatgtcgtccgctggatcgaccagggcgtcggctgctccaaggtgccggacatcaacgacgtcggtctgatggaagaccgcgccaccctgcgcatctccagccaactgctggccaactggctgcgtcacggcgtgatcagccaggagcaggtggtcgagagcctcaagcgcatggccgtggtggtcgaccggcagaacgccagcgacccgtcctaccggccgatggcgccgaacttcgacgacaacgtcgcgttccaggccgccctggagctggtggtggaaggcacccggcagccgaacggctataccgagccggtcctgcatcgccgccgccgtga

SEQ ID NO: 5937 - DNA, 924 bp, Pseudomonas aeruginosa
catgcacgacttcaccctccacgacctccaatgcttcgacgcggtggtcgacgccggcggcttccaggccgccgcacagcgcctgcaccgctcccatccggcggtgttcgccgccgttgcccggctggagcgccagctcggcctggtgctgctggaacggggcggctaccgggtcggcctgaccgccgccggtcgctccttccaccagcgtgcccaggccctgctctacgaactggaagggttgcgtggccacgccgcgcacctggcccagggcgaggaaagcgagctgcgcgtggtactgggcgacttttgcccgccgcgcccggccctggcgctgctcgcagggtttttcggcagccagccgcagacccgcctgcaattgctgttcgaaaccgtcagcggcccgctggagcgcctgctggacggcgaggccgacctgatcctgcatcgcgtggacaagtccgacccacgcctggaatggctcgacctgtgcagggtcgggctggtcccggtcatcgcgccgggcctgctcggcgatcctccgccgcgaccggtgcgcccggaacaactgcgccccttcgcccagtgcgtgatgcgcgacagcgcccgccattctccgccgacggactatttcatgctcgccggcgcgcgacagtgcagcgtgccggaccagcgaacgaagaaagaggtgatcctccagggcctcggctgggggcacctgccggacttcctggtcgacgaggaactggccgacggccgcctgctcgctctggccgggccgcatctgccaggacgcagcgaagaggtggtggcggcgcgccggcgcgatcgcgcgcagggcccggtagcggaacgcctgtgggcgttcctgcgggacaacgctacagcgatacgggagagcggcatggataccggtggcgatga

SEQ ID NO: 5938 - DNA, 1596 bp, Pseudomonas aeruginosa
ctcggcaggcgccaggcgtcctcggtgagaaactggcggatatcgccaggcgctattcgccctaccccccacactcccccggcatcaacgtcggcttgccgccagctattccgccatcttgcgcaacgcctcgccatccaggcgatagcgcacccactcgtcctgcggcagcgcgccgatggagcggtagaagtcgatggccggctggttccagtccagcacgctccactccaggcgtccgcagtcgttggccacggcctcgcgggccaactcgcggagcagccggcgaccggcgccgacgccacggtattccggggtgacgtagaggtcttcgaggtagatgccgttgcgccccagccaggtcgagtagctgtagaaatacaccgcatagccgatcggccggccctcgctcaggcacatcagcgcgcgggtcggcgagccttcggcgaacaggctgcggcggatgccttcgacatcggtgaccacctcgtggcgggcgcgctcgtagtcggccagttcgatgatgaaggcaaggatctgttcggcgtcggccggtacggcgggacggatttcgagagtcatgggcaaccttccggtgggggatccggccatcctagtgcgactgctaagatgcatgaagtgcattcttctcatcggcaactgaataacatgcatcccctgctgcgccgcctcgatctcaacctcctgcttgtcttcgacgccctgtatcgccaccgcaacgtcggcaccgcagccagcgaactggcgatcagcgcctcggccttcagccatgcgctggggcgcctgcgccaggggctggacgacgagctgttcctgcgccagggcaaccgcatgcagccgacccagcgtgccgagcacctggccgctgcggtggccgccgccctgcgcgccctcggcgaggggctggaagagtggcggccgttcgtaccgggacagagccagcgcaccttcgtcttcgccgccaccgactacaccgccttcgccctgcttccgccgctgatgaaccgcctgcagcacagcgcgcccggagtgcgcctgcgcctggtcaatgcggaacgcaagctgtcggtggaggccctggccagcgggcggatcgatttcgccctcggctacgacgaggaacacgagcgcctgcccgaaggcatccaggcccatgactggttcgccgaccgctacgtggtggtagcgcggcgcgaccacccacgcctcgccggggcgccgacgctggagggctacctggccgaacggcatgcggtggtgacgccgtggaacgaggacagcggggtgatcgaccggctgctggcccgctccggcctgcgtcgcgaagtggcggtgcaactgccgacggtgctggcggcgctgttcctggcaggctccaccgatttcctgctcaccgctccgcgacatgccgcacgggccctggcggaagccgccggcctcgccctgtatcccgcgccgttcgacattccgccctacgtgctgcggctctacagccacgtccagcatgtcgggcgtgacgcccatgcgtggatgatcgggcagttgaagggcctggatatttcccggacgggctga

SEQ ID NO: 5939 - DNA, 2295 bp, Pseudomonas aeruginosa
gcctatgaatcggttcgaaattcttacctgatcgaagcgacagctttttcccaagcggtttcaggggcttgccgccgaaaggccggtttccgcagagcgcggaaaattcggtcgaggatcggttggcacataactggcttaaatcttcgaaattcttgtatacaaaaacaacagacgaacccgacctcgcgccgagttcttccgactgccggaggagaccgccatgtccagcaccccgaagccgcccgcctcgccccgcgagttttctccctcgctgctcgacctcggcaccctggaaagcctcgacagcctgccgcgcgccggtcagcggagcgccgagttctccgcctcactgctcgacctgggcactccggccagtctcgactgcctgccacgcgccgggctgcgcgcagcggagttctcggcggcgcgcctggacctgggcactcccgccagtctcgattgcctgccccgcgccagccatcacgccggccccgaactgccgccgctgagcccgcgcctgtacagcgccgatctcgccccgaccaaggccgaagggcgccgctggggacgctacagcctgttcgcgctgtggaccaacgacgtgcacaatatcgccaactactccttcgccatcggcctcttcgccctcggcatgagcggcgcgcagatcctcgccgcgctggccctgggcgcgctgatggtctacgggctgatgaacctgtccggctacatgggccagaagaccgggctgccctacccggtgatgtgccgcatcgccttcggcatccacggcgcgcaactccccgcgctgatccgcgcagtgatcgccatcgcctggttcggcatccagacctatctcgcctccatcgtcctgcgcgtgctgctgacggcgatctggccggggctcgcagcctacgaccaggacgccatcctcggcctgtcgagcctgggctgggcgaccttcgtcgccatctggtgcgtgcaattgctgatcttcgcctacggcatggagatggtgcgtcgctacgaatccttcgccggaccggtgatcctgctcaccgtcgccgccctcgccgcctggatgtacctgcgcgccggcgcctccatcgcctggtccagcggcgaacccatgagcggttcgcagatgtggttgaagatcttcggcggcgcggcgttctgggtgaccctgtacggcaccatgatcctgaacttctgcgacttcgcccgcggctgcccggaccgccgcaccatcagcgtcggcaacttctgggggctgccggtgaacatcctgctgttcggcctgttcgcggtggtcctcgccggcgcccagttcaggatcgacggccagctcatccagagccccaccgacatcgtcgccgcgatccccgacaccctcttcctggtgctggccagcctggcgctgctgatcgtcaccgtggcggtgaacatcatggccaacttcgtcgccccggcctacgtactcaccaacctggcgccgaacctgctgaacttccgccgcgccgggctgatcagcgcgaccatcgcggtgctgatcctgccctggcacctgtacaacagccccggggtgatcctctacttcctcggcggcctcggcgcgctgctcggcccgctgtacgggatcatcatggtcgactactacctggtgcggaaaggccgggtgaacctgccggagctgtacaccgaaagccgcgccggcgcctatcactacgcgcgaggggtgaacccgcgggccatcgccgcgttcgtcccggcggcgatcatctccaccctgctggcattgttgccggcattcgccgagctatcgccgttctcctggttcttcggcgccggcctggccggcctgatccactacgccctggccaagcgccgcacggcctaccgcgaagtttccggcgaagcgatcgcggtggacagcgtgcagcactgacggatacctggccggcctgggcgcgacacccgcctaggccggcagtagcgcctgcaattcttcctcgatcgcatccagcgcctggaacgaccgctcgacgcgggccaccgcgaccgccccctccagcgccgcgaggatcagccaggcgcgcgaggcggcgagcttttccgccagtccgtcggcgcgcaacgcacgctcgatgctggcgtgccaggcgcggagcgcccggcggcattcggcatgcaccggggccagctcggcgtcgatgctcaggctggtggaaagcaccgggcaggcctcttcgaaacgcgaatgctccagccagccacgcagggtcgcggtga

SEQ ID NO: 5940 - DNA, 1539 bp, Pseudomonas aeruginosa
aatatgcccggacgctggatccaccagcgccgcgaaggtcttatcgaggcgctgaatggcgcttcatcaggacggcgccctgggcgccgcccgcactccctctcagcggctcatcggaccgcgcaccggccgctcgcgggcgtggctggtctcgctgagcggcgcgccggcctcgcgcagcgcctggcgctgttcggcgaccggggtctgcgcggtggccttctcgaaacgcgccaaatgctggaaggccggcagggcgaaagcgtcagccaacaggcgcgccaggcgcggccagcgctcgccgtcgacctggtagcgcgccaactgggcattgcggaacaggcaggcgacggcgacatcggcgatggacagctcgccgcacagccagccgcttggcgggacccgcccttccaggtagttgcagatcgatggcaggtcttcgtcgtaggtgcgttgcaggatcgcctggtcgggttcgcgctgccagatgccacggttgatcaccaactggtggaacaactgccagatgatcacctggcccagccgcgaatcggcgtactcctccagccagcgggcctgggcgcgctggccgatgtcgacgggatacaggctcggctgcgggtagcgctcctccaggtactggcagatcacgctggaatcgttgaggacgaagtcaccgtccaccagcaccggaatctggcgcaacggactgaggcgctcgaaggcctcgtcgccgaagaacggcacgatggggtcgatgcggtaggcaatgcctttcagttccagcagcaccagcaccttgcgcacatagggggacagataggaaccgatgatcagcaaaggttcggccacggcgagactcctgttcttgttatgggaacaccgatcctccggcaaaccagcgggacgactcaagtggcttcccgacggacgccaattgcagggatagtcgcactttgcgatcatttgcgaataattctcgtttttccattcaatcccgtttcgggatggggagcggtcgtgtcggcgggtgacgtcagcaacagcgaattcgtgggtagcctgtaccgggaccaccgcggctggctgcttgcctggctgaaccgcaacctcggctgccgccagcgcgccgaagacctcagccaggacaccttcgttcgcctcctcggccgcccggagctgcccggcctgcgcgaaccgcgcgcgttcctggcgaaggtggcgcgcggtctgatgatcgaccacttccgccgcgccgcccttgagcaggcctatctcgccgaactggcgctggttccggaagcggagcagccttcggccgaagagcagtacctgattctcgaggacctccgcgagatcgatcgcctgcttggcacgctgtcgctgaaggcgcgtagcgcgtttctctatagccgcctggacggcatgccccacgcggagatcgccgagcgtctcggagtctcggtgccgcgcgtgcgccaatacctggcccagggtctgcgccagtgctacatcgccctctacggagagccccggtga

SEQ ID NO: 5941 - DNA, 2022 bp, Pseudomonas aeruginosa
  unsure (1663): Identity of nucleotide at the above locations are unknown.
ggcacaacgcctggtggttcgaagtggtgccacgctgaaccgaacgggccggcgaaaaatttttcccgccggccctatcactttttccgattcgtccggcaaggaggcattgagactcgtttccatccaggagccccgcacatgccccgcccgacgttccgtcccggcctgctcgccctagccatcgccctcgccgttcccgcaccgttcctccacgccgccccggccgaacaggccagcgtgcgcgactaccgcatcgccgccgggccgctggcaggcaccctgaaccgcatcgcggcccaggccggcctggtcctcaccctggacccggcgctcgccgaaggacgcagcgcccacgccgtgcaaggtcgcttcgacgcgcccggcgcattgcgcgaagcgctcaagggcagcggcctggaactggtggaaaatgccggcggcacctacagcctgcgcaaggtgccggaagacaccctgtcgctgcaggcgatgacggtcagcggcgccgaggaagacccactggggccgaccagcggctacgtgggccaagcgcagcatgaccggcaccaagaccgatacgccgatcctcgagaccccgcgctcgatctcggtggcgacccgccagcagatgaccgaccgcgccgtgcacaacctcgacgacgcggtgcgctacatgcccggcgtcgtcgccagcagcttcggcagcgacacccgctccgactggttgaaggtgcgcggcttcaagccgacccagttcctcgacggcctgccgatggcggtcggcgtctacaacaacccgaagctggaaacctggaacctggagcgtgtcgccctgttgcgcggcccggcctcctcggtctacggccagaccccgccgggcggcatgctcgacatggtcagcctgcgtccgcagaacgtcgccagtcacgaggtgaaggccgaggtcggcaactacaaccacaagcaggtcagcttcgacagcaccggcccgctcgacgacgagggacgctttctctaccgcgtctccggcgtggtgcgcgacagcaacacccaggtcgaccatatcgacgacaagcgctacaacatcgccccgagcctgacctggaacatcgacgacgacaccaggctgaccttcctcggccagttcaaccgcgacgataccggcatcaccagccagttcctgccgctgcgcggaaccaagtacgacgcgccgttcggcaaggtttcccatcacaagaacctcggcgatccggactgggaatactacgaccgcacctactactggctgggctacgccttcgagcggcggatcaacgatgtctggcagttccgccagaacctgcgctacctgcgcaacgacctgtcgttccaggcgctgaccccagccagctattacgctgccgccagcgacgacggtaccctgcagcgcaccagcacatcagtggacgaggacgtcagccagttcgtggtggacaacaacttccaggccgacttcgacaccggcgcgctgcgccacaccctgctgctgggcctggaccacaaccggaccaccaacgaatacacctcgatcttcggcttcaatgtaccgccgaccaacatcaacaacccgatttacggccagccgattcccaagccgccgcgttccgacgcgtattacgantacaagcagcagacctaccagaccggcctctaggtcgaggaccagatcgccctcgacaactggcgcctgaccctcggcggtcgcgaggactgggtgcacaccggggccaccttctacaacaagggcgacgccaccaataccagccgcgacaagaagttcagcggcaacgcggcgctcagctacatcttcgacaatggcgtggcgccctacatctcctatgcggagtcgttccaacccaccactggcgccgatatgaacagcaccagttcgctgaagccgaccgaaggcaagcaatgggaaatcggtgtgaagtaccagccggtgggctccgactcgctgttcaccgccgcggtctatga

SEQ ID NO: 5942 - DNA, 1530 bp, Pseudomonas aeruginosa
tcccactgcggatgttcctcgcgcatccggcagaaatgcgccagggattgccgatccagttcgtgtagggccgaatcgccgaagctgcgtacctggccgtcggcgccttcgacgaggatccggctgtcgccgatgttgagcagttcgatttctccgccgcgaatccgcagcaggctcaggcaggccgccggcatgtcttcgaggtcgtgccagtcgcggccgctctgggcgcggaagtcgccctggatatcgttgagcaggcgccgcagcagggtctcgctggattgctcgggctcgacttccagcagcaaccgcaggtgccggtccaccgcctgggccagccagcgcgcgtcgctttccacgcccagcacgctgcgaccgatgctggtggcaccgtcgatcacccaggcggcctgcgccgtgcagcccagcgcatcgtcgttcaccgcgccccccgcgcggcattccgccccgagtatttccactgtggccattcgcagttcctcctatgctcaatgcgctgccagaatagcaagacagagcctttccacgttccgctcgtcgttccgggagaaccgtatgcgtcacctgccctacccgctgctgggcctgttcctggccctgtcgtcgaccggcgccgccctggccggcgaacagtactacccgctggacaagggctccgcgccctacgcggtcgcgcccagtgcacagggtgcggtctggtacggcgcggacggcgggcattcgctggggcgtctcgacccgaccagcggcgagagcgtgcaggtgccgctcggcgaaggcgcgcggccgcgagccatcgtcagcgacgagagcggcaacgcctgggtgctcgacagcggcctcaacgccatccttcgcatcggcggcgagcgcctgggcagcgaacgtttcccgctaccggccaaggccgcgccggccgggctcgactccgcggtattcgacgacgacgggcgcctctggttcaccggcagccgcggcttccacggtcgcctcgacccagccaggcgcctggtggaggtctggccctcgccccagggcaaggcggcgaacggcatctgcgtcaccccggacggcgaggtctggtacgcgcaggacgacgcgctggtgcatgtcgatccgctcgacggcagcgccgagcagttgcccgcgcctgaaggcacgaaggccttgcgcgggatcggcgccgactccatcggcaggctctgggccagcgacagcggtggcgcccggctgtaccgctacgatcccagcgatgcctcgtggcagagctggccgctgccggacagccaggcccgcccggacagcctgcgggtcgacgccatggaccgtgtctggctgcacgacgccgccagcggggcgctcttgcgtttcgacagtgcgcaggcgacattccgcgtcctgcccagcgaccggccggcgcccggcaacgccctgctcggcggtcgccccggagaaacctggagcgccgagcctgccgccgatcgtctgcgcgtcgtccgcgactga

SEQ ID NO: 5943 - DNA, 639 bp, Pseudomonas aeruginosa
tccttccaaggagcccgcatgagcgctacccatacgctgttctacgccgccgcctcgcccttcgtgcgcaaggtcctggtcctgctccacgaaaccggccaacgcgagcgcgtggcgctcgaggaagtcacgccgacgccggtcgcgcccatccggcagctcaacgccagcaacccggccggcaagattcccgccctgcgcctgccggacggccaggtgctgcacgacagccgggtgatctgcgactacttcgaccagcagcacgtcggcgaaccgctgatcccccgcgaaggcagcgtccgctggcgacgcctgaccatcgcctcgctggcggacgccgtcctcgacgccgcggtgctgtcccgctacgaaaccttcgtccgccccgaggagaagcgctgggacacctggctcgaagcacagcgggaaaagatcgcgcggtccctggcgtggctggagggcgactgcatcgccgaactgcaggcgcgcttcgacatcgccgccatcggcgtcgcctgcgccctgggctatctcgacctgcgccagccggagtgggactggcgcggccgctacccgcgactcgccgcctggttcgccgaagtcagccagcgcccgtcgatgcaggccacccgcgcctga

SEQ ID NO: 5944 - DNA, 471 bp, Pseudomonas aeruginosa
tcgggaatcgccggcccctggttgaacaggcgcaaggcgataccctcgccgtcgacctcggcgagcaggcgaaggatgccgccgggcggggtgaagtcgagggcgttgtcgagcaggttggccagcgcctggcgcagcaggaactgctcgccgcgaacctcgcagggaccttccaggcggttctccacccgcaatcgctggcgctggatacgcgccgcctggccttccagcagggacgcggcgatctcccgcaggtcgaccttgccgacctcctccaggccttgccgctgctccacctgggccaggctcagcaggcgctcgatcagttgttgcaggcgctcgctctcgccggcgatgttgccgacgaagcgcgcccgctgctcggccggcatctcgccgtcgagcaactcggcggcgccacggatcgccgccaatgggctcttcagttcgtgggtcagggtatgcacgtag

SEQ ID NO: 5945 - DNA, 474 bp, Pseudomonas aeruginosa
tgtcgatgctggccgcggcgatcttcttccagctcggcagcgaggacggtcgcaccagcccgcgccgggtcgatccggaaaaggacccggacctctaggatggcctggatcgctacgctcaagcgctgggctcgcgagctgaagaccgaggtcatcgccctctggctgtgcagccgccatccgcacatgccctggctggcccgactggtggctctgctggtggtggcctatgcgctgagtccgatcgacctgatcccggacttcataccgctgctcggctacctcgacgacctgttgctggtgccgctggggatctggctggcgatccgcctcaccccacccacgctgctcgccgagtgccgcgcgcgggctcgcgaggtcgagacgcacccgcgcaacctgtggatggctgcgctgatcgtgctgttctgggtggcgctgggcgctggactgctgcgctggttcttctactga

SEQ ID NO: 5946 - DNA, 1116 bp, Pseudomonas aeruginosa
aaatacagaaacgcgcttttttcgtttttcggacgaacggtactggccaaagatacattgcctgtcgctgctgctccggcggcgatcgcacgcggcaagccgccgcaggctgctagactagccgctcgtatcgcctgccgagccctgccccgtgacctccaccgctttctcctcgctgccgctttccgcggacctcctggccaatctcgactccctcggttaccgggagatgacgccgatccaggcgcagagcctgccgctgatcctccagggacacgacctgatcgcccaggccaagaccggcagcggcaagaccgcggccttcggcctcgccctgctcagcccgctgaacccgcgctacttcggctgccaggcgctggtgctgtgcccgacccgcgaactggccgaccaggtcgccaaggagatccgccggctggcccgcgccgccgacaacatcaaggtcctgaccctctgcggcggcgtcccctacggcccgcaggtggcttcgctggagcacggcgcgcacgtggtggtcggcaccccggggcgcatccaagagcacctgcgcaagggcaccctggtcctcgacgggctcaataccctggtcctcgacgaagccgaccggatgctcgacatgggcttctacgacagcatcgccgagatcatcggccagctccccgagcgccggcagaccctgctgttctccgccacctacccggacggcatcgagaagctggcgaagaccttcatgcgcgatccgcgacaggtgagggtcgagtcgctgcacgccgacagccagatcgagcaacgtttcttcgagatcgatccgaaacagcgcatggacgccgtggtacgcctgctccagcatttccggccacagtccagcgtggccttctgccagacccgccagcagtgccaggagctggccgacgcactgaaggcgcagcggatttccgccctggccctgcacggcgacctggagcagcgcgagcgcgaccaggtcctgacggtgttcgccaaccgcagttgcaacgtactggtggccaccgacgtggccgcccgcgggctggacatcgccgccctggaaacggtgatcaacgtcgagctggcgcgtga

SEQ ID NO: 5947 - DNA, 951 bp, Pseudomonas aeruginosa
accacggaccatcggatagcactccgcccccatgccgccctcttcgttgacacacacgctccgccgcctctgggccctcgacaagttcgcctacagcctgcgggtgttcatcgccctggccggcgccctgctgctgtgctggtggcaggaccgcatcgagctgctgatcccgctgttcctcgggatcatcgccagcgccctggcggagaccgacgacaactggctcggccgcctgcaagcgctgctggtgaccctgctgtgcttcagcgtcgccgccttcgccgtcgagttgctgttcccctatccctggctgttcgtttccgggatggcgctgtcggcgttcggcatgatcctcctcggcgccctcggcgagcgctatgcggcaatcgcctcggcgaccctgatcctctcgatctacaccatgatcggcgtggaccagcgcggcggcgaggtcgccgatgtctggcacgaaccgctgctgctggtggccggggcggcctggtacgggctgctctcggtgctgtggaacgcgctgttctccaaccagccggtgcagcagagtctttcccgcctgtatttcgagctgggcgaatacctgaggatcaagtcgagcctgttcgaaccgttgcgccagctcgacgtggagggccagcgcctcgccctggcacggcagaacggcaaggtggtggtggcgctgaaccaggccaaggagaccattctcaaccgcctcggccatggtcggccgggccccaaggtgagccgctacctgaagctctatttcatcgcccaggacgtccacgagcgcgccagttcctcgcactacccgtacaaccggctggccgaggcgttcttccacagcgacgtgctgttccgctgccagcgcctgctcaaccagcagggcaaggcctgccaggccctggcgcgggctatccgcctgcgccagccgtttga

SEQ ID NO: 5948 - DNA, 2046 bp, Pseudomonas aeruginosa
ttacgccgaccgcgagctggccctggaagacctccaggcctcgctcgaacacctgcgccagcagagcaacccggcctggaagggcctgctgcgctcgctcggcgccctggccgccaacctcaccacgctggaccgcaagctggccggggcgagcaacccggacgccatcgccgacgaacaggacagcgccctgctcgaccgctcgccgcgcagcctgaaggacgccttcgagcgcctgcgccagcagctcaccccgacctcgctgctgttccgccacggcctgcgcatggccctggcgctgaccgccggctacggcgtgctgcactggatccatccgacccagggctactggatactgctcaccacggtgttcgtctgccagcccaactatggcgcgacccgcctgcgcctggtgcagcggatcctcggtacggtggtcggcctggtggtcggctgggcgctgatcgacctgttccccagcccgctggtgcagtcgctgttcgcggtcgccgccggggtcgccttcttcgccacccgcagcagtcgctataccctggcgacggcggcgatcaccctgctggtgctgttctgcttcaaccaggtcggcgatggctacgggctgatcctgccccgcctgttcgataccttgctgggcagcctgatcgccggcctcgcggtgttcctggtgctgcccgactggcagggccgccggctcaaccgcatgctcgccaacaccctcgcctgcaacagccgttacctgcggcagatcatgcagcagtacgccaccggcaagcgcgacgacctcgactaccgcaccgcccggcgcaacgcgcacaacgccgacgcggcgctctcgaccaccctgtcgaacatgctcctggaacccggccatttcaggaaggacgccgagatcggcttccgcttcctggtcctctcgcacaccctgctcagctatctatccggtctcggcgcgcaccgcgaaagcctgcccgaggacgccagcgacggcctcctggagcgcgccgccgagcggctctccgccagcctcgaggaaatcgccgcgagcctggaacagaaacgcccggtcgccatctacagcgaagaggaggaagcgctggccaaggaactggagcagatgcccgaggacatggacgacagccatcgcctggtacagacccaactggcacacatctgccgccagctcgccccgctgcgcaccctggccgcgcacttgctgaagaaggaactggccggcgcgcagccactgccaggccagccctagcgcgcgccgtagcgttccagcaggcgctggtagctgccgtcgtcgcgcatgccgcggatggccaggtcgaagccgtcgacgatctcgtcatgccggggattcctcaggctcaccagcaggtgcaggccgttctcgccaagcgggatgggcagtacctccagcttgtcgcgcaaatcggccagttcgcccttgaaggcgacccccagcgccagctcgtcctccaccgccaggtcgacccgccccgcctcgagcatccgcgcggcgttggcgaagctggtcacgttgaccttctgcagacggctgtcacggtcgaattcgggcgcgtaggcatagtcgcgcacgaccgcgatgcggtagggacgcaggtcgctcaggcgggaaaactcgataccccgccccttgcgttgcagcaggcggatgcggttgctcaggtaggcgcgggaaaactgcccgtagaggctgcgggcgggctcgtaccaggcgctcagggcgatgtcgtagtcgccgctgcgcacgccgtacagggcacgcgaccagggtacctgctggaaactcgagtcgaagccggcgcgcttgagcgcggtggtcaccagttccaccgccaggccgttgccaggcaggcgcgaatcgacgaaaggcggccaggagtcgccgaccaggcgcaggttggcggcaggcagcgcgcaagggaggagcaatgtcagcagcaggagtgcgcatcgcagcatgaaggagcgtcccgggagtggatcgccacagcatag

SEQ ID NO: 5949 - DNA, 1263 bp, Pseudomonas aeruginosa
actcctggtgtggtgccccacggccgccatcctggccgtcgtggaggatgcccggcggtatcgccgccgcggctccgcgggacccggcggatcggcccggtcccggggcggcgcgtcctgcctgcgccacccgatgttcctgcgcgttcagcccagcccgttggcctcgcggtactgcctggcctcttccaccagccagtcgcggaaggcattgagcatcgccgattcgaccctgcgctcgggaatgatcaggtaatacgcattctcgctcaaataggcatgttgcatgggcacgataagccttccgtcggccagctcgtcctggatcaggaagggcggtatgagggccacgcccatgccgtgcatggccgcctgggcaagcatggagaacagctcgtagcgcggcccgctcatgtcgtgggcgacgttcagtccctgggagtgaaaccactggcgccaagcgtagggccgggtgctctgctgcatcagcggcagcccggcgacctgctcggcgctcagcgttcgacgcccgcccagcagctccgggctgcacaccggcaccggattctcgcgcatcaggaaatgcgagacggtacccgaccagtcggcgtcgccgaagtacagcgcggcgtcgaactcggtgtcggcgaagaggaacgggcgggtgcggttggtcaggttgatcgtgacctccgggtgcagccgctggaagcgcttgagccgcggcaacagccattgggtgccgaaggtcggcaccaccgccagttcgatcgcgccgccgccctggtgccccatcaccgccagggtgtcgcgctccaccgcgtcgaggcgtaccgccacccgccggctataggacagcccggcctcggtgagcttgaccccgcgccgcgagcgacggaacagctcgacaccgaggaactcctcgagcgtggcgatctgccggcagatcgcgctctgggtcagggacaactcctccgccgccttggtgaagctctcgtggcgcgcggcggattcgaagctgaccagcgcggcggtggaagggatcttgcgtcgcatggaggactccggagtgccggtttcgcatctatgacgcccaggtcacgattcctcgcacctcttcaagggcatgaaatacgagactcattttctcggagtgagaaaatagcacaagtgcttgcgaattcctcgtttgccgccccattcgctaggctcttaggatgcttccattccggctggcccacgccagcctccgctaccgcttga

SEQ ID NO: 5950 - DNA, 660 bp, Pseudomonas aeruginosa
cgaagggcagatccgcggcttcgtcctcgagaagggctgggaaggtctgagcgccccggcgatccatggcaaggtcggcctgcgtgcctcgatcaccggcgagatcgtgatggacaacgtgttcgttccggaagagaacgccttccccgaagtgcgcggcctgcgcggtccgttcacctgcctgaactcggcgcgctacgggatctcctggggcgccctgggcgccgccgaattctgctggcacaccgcccgccagtacgtgctcgaccgccagcagttcggccgcccgctggccgccaaccaactgatccagaagaagctggccgacatgcagaccgagatcaccctggccctgcaaggctgcctgcgcctggggcggatgaaggacgaaggcaccgcggcggtggaaatcacctcgatcatgaagcgcaacagctgcggcaaggccctcgacatcgcccgcctggcccgcgacatgctgggcggcaacggcatctccgacgaattcggcatcgcccgccacctggtcaacctggaagtggtgaacacctacgagggcacccacgatgtccacgcgctgatcctcggccgcgcgcagaccggcatccaggcattcttctgagccaccgagcaacaccccggcgcgctttttcacggtag

SEQ ID NO: 5951 - DNA, 1305 bp, Pseudomonas aeruginosa
cgcgccggccgccggggagacgggcaaggaacccgtcttcccggccatttccgtttccagcccccagcagcgagaaccgtcatgcccggcgccctttcccatatccgcgtactcgacctgtcccgtgtcctggccggcccctgggccgggcagatcctcgccgacctcggcgccgaggtgatcaagatcgagcgccccggcagcggcgacgacacccgcgcctggggcccgccgttcctcaaggatgccgaaggcaacgacaccagcgaggcggcctactacctgtcggccaaccgcaacaagaagtcggtgacggtggacttcacccagccggaaggccagcgcatcgttcgcgaactggcggccaaggccgacatcctgctggagaacttcaaggtcggcgggctcaaggcctatggcctcgactatgaatcgctgaagcaggtcaacccgaagctgatctactgttcgatcaccggcttcggccagtccggaccctatgccaagcgcgccggctatgacttcatgatccagggcctgggcggcctgatgagcctcaccgggcgcgccgacaacgaggaaggcgccggtccggtgaaggtcggcgtggcgctgaccgatatcctcaccgggctgtactcctccaccgcggtgctcgccgccctcgcccaccgcgacgtcagcggcatcggccagcacatcgacatggccctgctcgacgtgcaggtcgcctgcctggccaaccagaccctcaactacctgaccaccggcgtgccgccgcggcgcctgggcaacgcacacccgaacatcgtgccgtaccaggacttccccaccgccgacggcgacatgatcctcacggtcggcaacgacagccagttccgcaagttcgccgagctggcagaccacccggaatgggccgacgacccgcgcttcgccaccaacaaggcgcgggtggccaaccgcgaggtgctgatcccgctgatccgccaggccacggtgctgcacaccaccgccgagtggattctttccctggagcgcgccggcgtgccctgcgggccgatcaacgacctggcgcaggtgttcgccgacccgcaggtgcaggcccgcggcctgcgcgtggagctaccgcacccgctggccgggacggtgccgcaggtagccagcccgatccgcctgtccgagacgccggtggaataccgcaacccgccgcccaccctcggccagcacaccgacgaggtcctcgagacgctcctcggcctggacgcggccgcgctggaaaggctgcgcgacggcaaggtgatctga

SEQ ID NO: 5952 - DNA, 762 bp, Pseudomonas aeruginosa
ccgcaacgcggttatccgccggccagccgagcatcggcggataacgcccctggcgttattcgccctaccgtaccccgcgcagcaccacgtagggcaatgaaatggactcctccctcctacggcgtcaagcgccagactaatggtgcagccacaagtcccggagggggagtcagcatgaaccttagtcgcattggtctggatctggcaaaacaagtattccaggtgcacggcgttgatcgtcacgagcatgtggtatgtcgtcgccaactcaagcgggcacaggtgcgggatttctttcgccaactgccgccgtgcctggtggcgatggaggcctgcggcagtgcgcactactgggcgcgcgagttgcgggagctgggccacacggtacgcctgatcgcaccgcagttcgtcaaaccctacgtcaagggggacaagcacgatgcacacgacgccgaggcgatctgcgaagccgccagtcgtccgaacatgcgctatgtcccggtgaagagcgcagagcagcaggccgtgcagtccgtgcatcgggtgcgcagtcgtctggtgcgggcccgcacggcgttgtgcaatgaggtgcgtggcttgctgggcgagttcggggtgatcgcgacgcgacgtgggcgagcggggaagaaggccttggtcgaaaacgtcccgggtaacgaaaccggcgccccttggcgggcccgaatgggggtagctgttgcgttgaatggaaagatgaattggcacaccccggaaggcgcc

SEQ ID NO: 5953 - DNA, 2196 bp, Pseudomonas aeruginosa
agcagagtgaggcaaacaatgactgaacgcgttcaagtcggtggcctgcaggtcgccaaagtcctgttcgacttcgtgaacaacgaagccatccccggaaccggcgtctctgccgacacgttctggaccggtgcggaggccgtgatcaacgacctggcgccgaagaataaagccctgctcgccaagcgcgacgaactccaggccaagatcgacggctggcaccaggctcgcgccggccaggcccacgacgccgctgcctacaaggccttcctcgaggaaatcggctacctgctgcccgaggcggaagacttccaggccggcacccagaacgtcgacgacgagatcgcccgcatggccggcccgcagctggtggtgccggtgatgaatgcgcgcttcgccctcaacgcctccaacgcccgctggggctcgctgtacgacgcactctacggcaccgacgtgatcagcgaagaaggcggcgccgagaaaggcaagggctacaacaaggttcgcggcgacaaggtcatcgccttcgctcgcgccttcctcgacgaggccgcgccgctggagtccggctcccatgtcgacgccacttcctacagcgtgaagaacggcgcgctggtcgtcgcgctgaagaacggcagcgaaaccggcctgaagaatgctggccagttccttgccttccagggcgacgccgccaagccgcaagcggtactgctcaagcacaacggcctgcacttcgaaatccagatcgacccgagcagcccggtcggccagaccgatgccgcaggcgtgaaggacgtgctgatggaagccgccctcaccaccatcatggactgcgaggactcggtcgccgcggtcgacgccgacgacaaggtagtgatctaccgcaactggctgggcctgatgaaaggcgacctggccgaggaagtcagcaagggcggcagcaccttcacccgcaccatgaacccggaccgcgtctacaccagggccgacggttccgaactgaccctgcacggccgctcgctgctgttcgtgcgcaacgtcggccacctgatgaccaacgatgcgatcctcgacaaggacggcaacgaagtgccggaaggcatccaggacggtctgttcaccagcctgatcgccattcatgacctgaacggcaacaccagccgcaagaacagccgcaccggcagcgtgtatatcgtcaagccgaagatgcacggtccggaagaagccgccttcaccaacgagctgttcggccgcgtcgaggacgtcctcggcctgccgcgcaacaccctgaaggtcggcatcatggacgaggagcgccgcaccaccgtgaacctgaaggcctgcatcaaggcggccaaggatcgcgtggtgttcatcaacaccggcttcctcgaccgcaccggcgacgagatccacacctccatggaagccggcgccgtggtgcgcaagggcgccatgaagtcggagaagtggatcggcgcctacgagaacaacaacgtcgacgtcggcctggccaccggcctgcaaggcaaggcgcagatcggcaagggcatgtgggccatgcccgacctgatggccgccatgctcgagcagaagatcggccatccgctggccggcgccaacaccgcctgggtcccgtcgccgaccgccgcgaccctgcacgccctgcattaccacaaggtcgacgtgttcgcccgccaggccgagctggccaagcgcaccccggcctcggtggacgacatcctgaccattccgctggcgccgaacaccaactggaccgcggaagagatcaagaacgaggtggacaacaacgcccagggcatcctcggctatgtcgtccgctggatcgaccagggcgtcggctgctccaaggtgccggacatcaacgacgtcggtctgatggaagaccgcgccaccctgcgcatctccagccaactgctggccaactggctgcgtcacggcgtgatcagccaggagcaggtggtcgagagcctcaagcgcatggccgtggtggtcgaccggcagaacgccagcgacccgtcctaccggccgatggcgccgaacttcgacgacaacgtcgcgttccaggccgccctggagctggtggtggaaggcacccggcagccgaacggctataccgagccggtcctgcatcgccgccgccgtgagttcaaggcgaagaacgggctgtag

SEQ ID NO: 5954 - DNA, 591 bp, Pseudomonas aeruginosa
cgtaatcagtctgcgccgagaaagctcagcaccgcgccttcgaacgcctgcgggaactcgacgttcgacaggtgcaccgccggcagcgtaaccagcctggccccggcaatcgacgcggcgatcagctcgccgtggctggcggcggtgaccgtgtcgtacgcccctgcgatcaccagggtcggccgctcgatccgcgccagttgcgcgcgcaggtcggtatcgcgcaccgccgcgaaggagccggccaggccgtgccggttggtggccatgagcatcgcccggaagcgctcgacgacgggctcggcgcgctccagcagcgccggcggaaaccagttgccgaggaaacccgcggcggtctcgctcatgtcctcggcctgcagcaccgcggcgatgcgctcgtcccactgcgccgccgggccgagccaggccgaggtgttggccagcaccagccgctcgatccgctgcggcgcatgcagcgccagccactggccgacgatcccgcccagggacaggccgaggaaatgcgcgcgccgtacctccagcgcgtcgagcagctccagtacgtcctcgcccagccgggccagggtgtag

SEQ ID NO: 5955 - DNA, 1101 bp, Pseudomonas aeruginosa
gcgaggctggcgccgtcgctggtagcgagaaaagacaggttgcccatgggagcctccggggtcagggtgattgccatgcacgccaggctagttgcgacggtccctgggaaaaactacaaagaatggaacgactctgtcagggaagctgacatgcacgacttcaccctccacgacctccaatgcttcgacgcggtggtcgacgccggcggcttccaggccgccgcacagcgcctgcaccgctcccatccggcggtgttcgccgccgttgcccggctggagcgccagctcggcctggtgctgctggaacggggcggctaccgggtcggcctgaccgccgccggtcgctccttccaccagcgtgcccaggccctgctctacgaactggaagggttgcgtggccacgccgcgcacctggcccagggcgaggaaagcgagctgcgcgtggtactgggcgacttttgcccgccgcgcccggccctggcgctgctcgcagggtttttcggcagccagccgcagacccgcctgcaattgctgttcgaaaccgtcagcggcccgctggagcgcctgctggacggcgaggccgacctgatcctgcatcgcgtggacaagtccgacccacgcctggaatggctcgacctgtgcagggtcgggctggtcccggtcatcgcgccgggcctgctcggcgatcctccgccgcgaccggtgcgcccggaacaactgcgccccttcgcccagtgcgtgatgcgcgacagcgcccgccattctccgccgacggactatttcatgctcgccggcgcgcgacagtgcagcgtgccggaccagcgaacgaagaaagaggtgatcctccagggcctcggctgggggcacctgccggacttcctggtcgacgaggaactggccgacggccgcctgctcgctctggccgggccgcatctgccaggacgcagcgaagaggtggtggcggcgcgccggcgcgatcgcgcgcagggcccggtagcggaacgcctgtgggcgttcctgcgggacaacgctacagcgatacgggagagcggcatggataccggtggcgatgactcggcaggcgccaggcgtcctcggtga

SEQ ID NO: 5956 - DNA, 1809 bp, Pseudomonas aeruginosa
atcttcgaaattcttgtatacaaaaacaacagacgaacccgacctcgcgccgagttcttccgactgccggaggagaccgccatgtccagcaccccgaagccgcccgcctcgccccgcgagttttctccctcgctgctcgacctcggcaccctggaaagcctcgacagcctgccgcgcgccggtcagcggagcgccgagttctccgcctcactgctcgacctgggcactccggccagtctcgactgcctgccacgcgccgggctgcgcgcagcggagttctcggcggcgcgcctggacctgggcactcccgccagtctcgattgcctgccccgcgccagccatcacgccggccccgaactgccgccgctgagcccgcgcctgtacagcgccgatctcgccccgaccaaggccgaagggcgccgctggggacgctacagcctgttcgcgctgtggaccaacgacgtgcacaatatcgccaactactccttcgccatcggcctcttcgccctcggcatgagcggcgcgcagatcctcgccgcgctggccctgggcgcgctgatggtctacgggctgatgaacctgtccggctacatgggccagaagaccgggctgccctacccggtgatgtgccgcatcgccttcggcatccacggcgcgcaactccccgcgctgatccgcgcagtgatcgccatcgcctggttcggcatccagacctatctcgcctccatcgtcctgcgcgtgctgctgacggcgatctggccggggctcgcagcctacgaccaggacgccatcctcggcctgtcgagcctgggctgggcgaccttcgtcgccatctggtgcgtgcaattgctgatcttcgcctacggcatggagatggtgcgtcgctacgaatccttcgccggaccggtgatcctgctcaccgtcgccgccctcgccgcctggatgtacctgcgcgccggcgcctccatcgcctggtccagcggcgaacccatgagcggttcgcagatgtggttgaagatcttcggcggcgcggcgttctgggtgaccctgtacggcaccatgatcctgaacttctgcgacttcgcccgcggctgcccggaccgccgcaccatcagcgtcggcaacttctgggggctgccggtgaacatcctgctgttcggcctgttcgcggtggtcctcgccggcgcccagttcaggatcgacggccagctcatccagagccccaccgacatcgtcgccgcgatccccgacaccctcttcctggtgctggccagcctggcgctgctgatcgtcaccgtggcggtgaacatcatggccaacttcgtcgccccggcctacgtactcaccaacctggcgccgaacctgctgaacttccgccgcgccgggctgatcagcgcgaccatcgcggtgctgatcctgccctggcacctgtacaacagccccggggtgatcctctacttcctcggcggcctcggcgcgctgctcggcccgctgtacgggatcatcatggtcgactactacctggtgcggaaaggccgggtgaacctgccggagctgtacaccgaaagccgcgccggcgcctatcactacgcgcgaggggtgaacccgcgggccatcgccgcgttcgtcccggcggcgatcatctccaccctgctggcattgttgccggcattcgccgagctatcgccgttctcctggttcttcggcgccggcctggccggcctgatccactacgccctggccaagcgccgcacggcctaccgcgaagtttccggcgaagcgatcgcggtggacagcgtgcagcactga

SEQ ID NO: 5957 - DNA, 1101 bp, Pseudomonas aeruginosa
tcgtcattcgccggtacgcgcgcgggtgctcgacgaagccatcgcctggcaattgctgctcgactccggcgaagcccatcccgacgatcaccgcgccttccaccgctggtacgcggcgcatcccgaacacgaacgcgcctgggaacagctcggcggcctcgaccggcacctggcgagagccgccaacgggccggcgcgcaacgccctgctgtccggcaacgcacgcttcaagcgccgcctgcgccggctcggcggcagcgccctggggctagtgctggcgctaggcgtcgggctcggcgtggccaaccgctacgtcccggtccgctacctgctggccgatgcctacagcgccaccggcgagcagcgcgagctgaccctcccggatgccactcatgtgcgcctgaacagccgcagcgccatcgacgtccgcttcgacggcgaacgccgccaggtcgtgctactggccggcgagatcctggtggaaaccgcccatggcgacccgcgccccttcgtggtcagcagcgccgatggcgacatgcgcgccctcggcacgcgcttcctggtgcgccgcgaggaacccggcacgcgcctcaccgtgttgcagtcggcggtggccgcgcgcgcggaaacgctcagcgaagagcgtgtgatcaaggaaggccagcaggtgctgatcctgccgcaaggcctgcaggccagcgaagcggccccggccctggccggcgcctgggcacaaggcatgctggtggtagagaacgcccggctggccgacctggtggcggaactggggcgctattcgccggcgctgctgcgggtcgacccgagcatcgccgacctgcgcgtcaccggcagtttcccgctgaaggacacccgcctcgcccttcaggctttggagccgagcctgccggtgcgcagcgtaaggcacaacgcctggtggttcgaagtggtgccacgctgaaccgaacgggccggcgaaaaatttttcccgccggccctatcactttttccgattcgtccggcaaggaggcattgagactcgtttccatccaggagccccgcacatgccccgcccgacgttccgtcccggcctgctcgccctag

SEQ ID NO: 5958 - DNA, 1200 bp, Pseudomonas aeruginosa
  unsure (1167): Identity of nucleotide at the above locations are unknown.
cggtcagcggcgccgaggaagacccactggggccgaccagcggctacgtgggccaagcgcagcatgaccggcaccaagaccgatacgccgatcctcgagaccccgcgctcgatctcggtggcgacccgccagcagatgaccgaccgcgccgtgcacaacctcgacgacgcggtgcgctacatgcccggcgtcgtcgccagcagcttcggcagcgacacccgctccgactggttgaaggtgcgcggcttcaagccgacccagttcctcgacggcctgccgatggcggtcggcgtctacaacaacccgaagctggaaacctggaacctggagcgtgtcgccctgttgcgcggcccggcctcctcggtctacggccagaccccgccgggcggcatgctcgacatggtcagcctgcgtccgcagaacgtcgccagtcacgaggtgaaggccgaggtcggcaactacaaccacaagcaggtcagcttcgacagcaccggcccgctcgacgacgagggacgctttctctaccgcgtctccggcgtggtgcgcgacagcaacacccaggtcgaccatatcgacgacaagcgctacaacatcgccccgagcctgacctggaacatcgacgacgacaccaggctgaccttcctcggccagttcaaccgcgacgataccggcatcaccagccagttcctgccgctgcgcggaaccaagtacgacgcgccgttcggcaaggtttcccatcacaagaacctcggcgatccggactgggaatactacgaccgcacctactactggctgggctacgccttcgagcggcggatcaacgatgtctggcagttccgccagaacctgcgctacctgcgcaacgacctgtcgttccaggcgctgaccccagccagctattacgctgccgccagcgacgacggtaccctgcagcgcaccagcacatcagtggacgaggacgtcagccagttcgtggtggacaacaacttccaggccgacttcgacaccggcgcgctgcgccacaccctgctgctgggcctggaccacaaccggaccaccaacgaatacacctcgatcttcggcttcaatgtaccgccgaccaacatcaacaacccgatttacggccagccgattcccaagccgccgcgttccgacgcgtattacgantacaagcagcagacctaccagaccggcctctag

SEQ ID NO: 5959 - DNA, 855 bp, Pseudomonas aeruginosa
gtcgaggaccagatcgccctcgacaactggcgcctgaccctcggcggtcgcgaggactgggtgcacaccggggccaccttctacaacaagggcgacgccaccaataccagccgcgacaagaagttcagcggcaacgcggcgctcagctacatcttcgacaatggcgtggcgccctacatctcctatgcggagtcgttccaacccaccactggcgccgatatgaacagcaccagttcgctgaagccgaccgaaggcaagcaatgggaaatcggtgtgaagtaccagccggtgggctccgactcgctgttcaccgccgcggtctatgacctgcgccaggagaacgtcagcgtgtcgcagaacataggcggcacgccggtcacttcgcagacgggcgaagtgaaggtctccgggatagagctggaagccaccagcaacgtcaccgacaacctgaagatgatcggcgcctatagctacaccgacaccgaagtgaaaaaaggccagtacgcaggcaaccgcctgcaacaggcgccgcgcaaccaggcctcgctatgggccgactacacctggtacgagggtacgctgaacggtttcagcgtgggtgccggcgcccgctacgtaggctcgacctacggcgaccaggccaacacctacgacggctacgccggctcgtacaccctgtacgacgccgccgtgcgctacgacctgggccaattgaacggcagcctgaaaggcgtcagcgtggcggtcaatgccaacaatctgttcaacaaggactacctggcgtcctgcgacggctactactgctactacggcgaccagcgcagcgtggtgggcagcgtcagctacaagtggtga

SEQ ID NO: 5960 - DNA, 1020 bp, Pseudomonas aeruginosa
caagacagagcctttccacgttccgctcgtcgttccgggagaaccgtatgcgtcacctgccctacccgctgctgggcctgttcctggccctgtcgtcgaccggcgccgccctggccggcgaacagtactacccgctggacaagggctccgcgccctacgcggtcgcgcccagtgcacagggtgcggtctggtacggcgcggacggcgggcattcgctggggcgtctcgacccgaccagcggcgagagcgtgcaggtgccgctcggcgaaggcgcgcggccgcgagccatcgtcagcgacgagagcggcaacgcctgggtgctcgacagcggcctcaacgccatccttcgcatcggcggcgagcgcctgggcagcgaacgtttcccgctaccggccaaggccgcgccggccgggctcgactccgcggtattcgacgacgacgggcgcctctggttcaccggcagccgcggcttccacggtcgcctcgacccagccaggcgcctggtggaggtctggccctcgccccagggcaaggcggcgaacggcatctgcgtcaccccggacggcgaggtctggtacgcgcaggacgacgcgctggtgcatgtcgatccgctcgacggcagcgccgagcagttgcccgcgcctgaaggcacgaaggccttgcgcgggatcggcgccgactccatcggcaggctctgggccagcgacagcggtggcgcccggctgtaccgctacgatcccagcgatgcctcgtggcagagctggccgctgccggacagccaggcccgcccggacagcctgcgggtcgacgccatggaccgtgtctggctgcacgacgccgccagcggggcgctcttgcgtttcgacagtgcgcaggcgacattccgcgtcctgcccagcgaccggccggcgcccggcaacgccctgctcggcggtcgccccggagaaacctggagcgccgagcctgccgccgatcgtctgcgcgtcgtccgcgactgatccttccaaggagcccgcatga

SEQ ID NO: 5961 - DNA, 1005 bp, Pseudomonas aeruginosa
ccatcgcctcgctggcggacgccgtcctcgacgccgcggtgctgtcccgctacgaaaccttcgtccgccccgaggagaagcgctgggacacctggctcgaagcacagcgggaaaagatcgcgcggtccctggcgtggctggagggcgactgcatcgccgaactgcaggcgcgcttcgacatcgccgccatcggcgtcgcctgcgccctgggctatctcgacctgcgccagccggagtgggactggcgcggccgctacccgcgactcgccgcctggttcgccgaagtcagccagcgcccgtcgatgcaggccacccgcgcctgaccccgagggcccgccgacgcctgctgccgccgcaggcgctcggcgcgttgcagccaggccgccgaggggccggggaacagcaggccgatccgcgccgccaggcgctcgccgtcgcgacggtcgtcgcgcaggccgacatacccgttcatttccagcacaccaggcggaacagcagcaggcccagcaacagcgcgctctgtccgagccccatgcaaagctccaggaaggagcgcacgtgcggattgccggcggcgccctcgatgccgctgaggccttcccagaatccgtccggcatcagcaccagcatggcgtgggccaggggcttgccgctggcgatccagtactcgatcaggccgaacttgccgaagaacagcagaaagatcaggatcacgccgctgaccagcaggccgagggcggcacagagggtgaactcgaagaacaggcgcatgcttttcctccttggaaatcggcggcggccggcgccgccgccttcgtcgtcaggccctggcgggtaccgccgggaagtccttgcggccgaccccgtaccagtccaggcggcgggtcagcaccatcaccgcggcaagcaccgcgaacagcagcagcgagcccatcagcaaggcgtagtcctccgcgctcagcaagccgtagagcaggccgtacagccctgccaggccggcgctga

SEQ ID NO: 5962 - DNA, 492 bp, Pseudomonas aeruginosa
agtcgagggcgttgtcgagcaggttggccagcgcctggcgcagcaggaactgctcgccgcgaacctcgcagggaccttccaggcggttctccacccgcaatcgctggcgctggatacgcgccgcctggccttccagcagggacgcggcgatctcccgcaggtcgaccttgccgacctcctccaggccttgccgctgctccacctgggccaggctcagcaggcgctcgatcagttgttgcaggcgctcgctctcgccggcgatgttgccgacgaagcgcgcccgctgctcggccggcatctcgccgtcgagcaactcggcggcgccacggatcgccgccaatgggctcttcagttcgtgggtcagggtatgcacgtagcgctcgacgtagtccttgccttccagttgcgtgcgcatgcgttccaccgcgtccgccagttgcgccatctcgccgccgcgatagcgcggcagctcggcgcggcgcccctcgctga

SEQ ID NO: 5963 - DNA, 621 bp, Pseudomonas aeruginosa
gaccgacgaacaggaagtagaccaggaagatccgaacgccgagcggcatcaggcgtggtccgggctgtagctgtagcccaggccgcgatgggtctggatcgcttcgccgcgttcgttcacctggcgcagcttggcgcgcaggctcttgatgtggctgtcgatgttgcgctcgtagccggcctcgctggcgacgccgagggcgtcgagcaactgctcgcggctgaatacccgctcgggctgcccgagcagcgtctgcagcaggcggaactcgtggcgggtgaggttgagcggggtgtcgcggtagtggatccgcacgcgctcctcgtcgacctggaacggcccgctcggcgcggcctcttccagcgccgccgggcgcggcgccatgcgcttgaggatggccttgacccgagccgccacctcgcgcgggctgaacggcttgaccacgtagtcgtcggcgccgatctccaggccgaccacacggtcgatctcggcatcgcgcgcggtgaggaagatcaccggcacctcggagaaccggcgcaggcgcttgcaggcctcgaaaccgctgatgtccggcagaccgacgtcgaggatcagcagatccgccggctggcgctcctgtaa

SEQ ID NO: 5964 - DNA, 1200 bp, Pseudomonas aeruginosa
tgggccgcgtcgacccacacccaggacagggaaaccaaccatgcgggaactgttgaccggcctgaccagcagccttctgctgcttctcaacacgctgatcctgatcggcccgatgatgctgatcgcactgctcaagctggtgctccccggccagcgcctgaaagacctctgctccaggggcgtgatgtggatcgccgagacctgggcggagatcgacaagtggatcttcgccacctgcacgccgacggtctgggacgtgcgcggcgccggcgacctgcgccaggacacctcgtacctggtggtgagcaaccaccagtcctgggtcgacatccccgcgttgatccaggtgttcaaccggcgcaccccgtacttcaagttcttcctcaagaaggagctgatctgggtgcccttcctcggcctggcctggtgggcgctggagtatccgttcatgaagcgctattccaaggccttcctggagaagcacccggaactcaagggcaaggacctggagatcaccaaggccgcctgcgagaagttcaagcgcatcccggtgaccgtggtgaactacctggaaggcacgcgtttcagcgagcagaagaaggcccggcaacagtcgccctatcgccacctgctcaagcccaaggccggcggggtggccttcgtcctcgccgcgctgggcgagcaactggacgccctgctcgacgtcaccgtggtctacccgagcgacaaggtgccgggattctgggacctgctctgcggacgggtgccgaaggtgatcgtcgacatccagacccgcccgatcgatcccgccctgtggcagggcgactacgagaacgacccggtgttccgccagtacgtgcaggaatgggtctcgcgcatgtgggaagaaaaggacgaacgcatcgcccgcttgcggcaactgcgctgaagtaccggccgaagcacacccatctcgtagggcgaataaccgcaacgcggttatccgccgtttccacggcgcagcggcggataacgccgggggcgttattcgccctaccggtgcgggcaacgaatacccgggggtcgcacccacctcgtagggcgaataaccgcaacgcggttatccgccgtttccacggcgcagcggcggataacgccgggggcgttattcgccctaccggtgcgggcaacgaatatccgggcgccgcacccacttcgtag

SEQ ID NO: 5965 - DNA, 1578 bp, Pseudomonas aeruginosa
gttgctggtggcgatgatgatggtattggtgaagtccaccacgcgccccttgccgtcggtcaggcggccgtcgtcgaacacctgcaggaggatgttgttgacgtcggcgtgggccttctcgatctcgtcgagcaggatcacgctgtaaggccgccggcgcacccgctcggtgagctggccgccctcgtcgtagccgacgtagcccggcggcgcaccgatcagccgggacaccgcgtggcgctccatgtattcgctcatgtcgatgcggatcatcgcgtcttcgtcgccgaacaccacctcggccagggccttggccagctcggtcttgcccaccccggtcgggccgaggaacaggaaggtggcgatcggccggctgccctggcgcagcccggcgcgggccaggcgcacggcgtcgctgaccgcggtgatcgcttcctgctggccgatcacccgctggtgcaggcgctcttccatctgcaggagcttctcgcgctcctcggcggtcagttcggtgaccgggatgccggtgagcctggagatgatctcggcgatgtcctcgacccgcacctcctcggtcttcgacccctgggtctgctgccagcgctcggtgatctgctcgaggtgttccttgcgttcctggatgcgtttctcgaagaccttcgcctcgtcgtaccacttgcggctggcggcgtagtcctgctcgcgcttgagctgcgccagctcggcctccagttcctggatctcggccggccgcgaggtgctggcgatgcgcacgcgggcggcggcctggtcgatcaggtcgatggccttgtccggcaggaagcggttgccgatgtagcgatcggacagctcggcggcggcgacgaaggcctcgtcgcggatggtcaccttgtggtggccttcgagcttgtcgcgcaggccacggaggatggagatggtctgctccaccgtcggctcggggacgaacaccggctggaagcgccgctccagcgcggcgtccttctcgatgtacttctggtactcgttgagggtggtggcgccgatcaggttcatctcgccgcgcgccatcgccggcttcagcacgttggccacgtccagcccgccttcgccgccgccctggccggcaccgacgatggtgtgcacctcgtcgatgaacaggatgatctcgctctgcgccgcctgcagttcgtccatcacctgcttgaggcgttcctcgaactcaccgcggtacttggcgccggcgaccatggcgttgatgttcagttcgaccaggcgcttgtcgcgcagcacctccggcacctcgccctggaccatgcgctgggccaggccttcgacgatggcggtcttgccgacgccgggctcgccgatcagcaccgggttgttcttcttgcgccgggcgagaacctcgatggtggtctcgacttccttcgagcggccgatcaccggatcgagcttgccttcgcgggccagccgggtcaggtcgcggctgaacttgtccagttgcggagtgttgctcgggccgtccacgcggccgtcctcggcgcccttgccgaccaccttgaccgctttctgccgtag

SEQ ID NO: 5966 - DNA, 1605 bp, Pseudomonas aeruginosa
aaggcgacctctctggccgcgacttccgccgcaatgcccgctgttcgccccgatccggtcgccggccgtcccatcgcggcgagaacttctctatgcttgggccctgtccgcccgagggagcccgtccatgagcgagccgttccagctcaccccccgcatcgcccgccaactgccctggctggttgccgtcgccttcttcatgcaagccctcgacggcaccatcctcaacaccgcgctgccgagcatggccagttcgctgaacgaaaacccgctgcgcatgcaggcggtggtgatcgcctacctgctcacggtggccctgctgataccggcctcggggtggatcgccgaccgtttcggcacgcgccgggtgttcctcggcgcggtactgctgttcagcctcggctcgttgctttgcgcgctgtcgccgagcctcgaactgctggtcggggcgcgcatcgtacagggcgtcggcggcgcgctgatgatgccggtgggacggctggtgatcctgcgcgtctacccgcgccaggacctggtgcgggtgctcagcttcgtcaccattcccggcctgctcggcccgctggcgggaccgacgctgggcggctggctggtggagtacgcctcctggcactggatcttcctgatcaacctgccggtcggcctgctcggctgcctggtggcgatgaagctgatgccggacctgcgcagcccggtgccgagccgtttcgacagcatcggcttcctgctcttcggcggctccatggtgctgatctccatcgccctggaaggactcggcgagctgcacctgtcgcacctgcgcgtggtcctgctgctgatcggcggactggtcctgctcaccgcctactggctgcgcgcgctacgcatcgacaagccgctgttcccaccgagcctgttcaaggcgcggaccttcgccgtcggcatcctcggcaacctgttcgcccgcctgggcagcggcgccctgcccttcctcaccccgctgttgctgcaggtgggactgggctacccgccctccaccgcgggcatgaccatgatcccgctggcgctgttcgcgatggtcgccaagccgatggccaagccactgctggacttcttcggctatcgcaagctgctggtcggcaacaccctgatcctcggctgcctgatcgccggcttcggcctggtcgaccaggacaccccctacgtctggctgctgctgcacctgagcctgctcggcgcggtgaactccctgcaattcacggcgatgaacaccctcaccctgatcgacctgcaggacagcaacgccagcagcggcaacagcctgatgtcggtggtcgtgcagttgtcgatcagcctcggcgtggcttgcgcggcggcgttgctgggcggtttccagaccgacctggatacggggcaggacaccgtactcggcgccttccacgccacctatgtcagcgtcggcctgatgtcgatgctggccgcggcgatcttcttccagctcggcagcgaggacggtcgcaccagcccgcgccgggtcgatccggaaaaggacccggacctctaggatggcctggatcgctacgctcaagcgctgggctcgcgagctga

SEQ ID NO: 5967 - DNA, 1407 bp, Pseudomonas aeruginosa
ccgctcgtatcgcctgccgagccctgccccgtgacctccaccgctttctcctcgctgccgctttccgcggacctcctggccaatctcgactccctcggttaccgggagatgacgccgatccaggcgcagagcctgccgctgatcctccagggacacgacctgatcgcccaggccaagaccggcagcggcaagaccgcggccttcggcctcgccctgctcagcccgctgaacccgcgctacttcggctgccaggcgctggtgctgtgcccgacccgcgaactggccgaccaggtcgccaaggagatccgccggctggcccgcgccgccgacaacatcaaggtcctgaccctctgcggcggcgtcccctacggcccgcaggtggcttcgctggagcacggcgcgcacgtggtggtcggcaccccggggcgcatccaagagcacctgcgcaagggcaccctggtcctcgacgggctcaataccctggtcctcgacgaagccgaccggatgctcgacatgggcttctacgacagcatcgccgagatcatcggccagctccccgagcgccggcagaccctgctgttctccgccacctacccggacggcatcgagaagctggcgaagaccttcatgcgcgatccgcgacaggtgagggtcgagtcgctgcacgccgacagccagatcgagcaacgtttcttcgagatcgatccgaaacagcgcatggacgccgtggtacgcctgctccagcatttccggccacagtccagcgtggccttctgccagacccgccagcagtgccaggagctggccgacgcactgaaggcgcagcggatttccgccctggccctgcacggcgacctggagcagcgcgagcgcgaccaggtcctgacggtgttcgccaaccgcagttgcaacgtactggtggccaccgacgtggccgcccgcgggctggacatcgccgccctggaaacggtgatcaacgtcgagctggcgcgtgacccggaggtccacatccatcgcatcggacgcagcggtcgcgccggcgagaaaggcctggccctgtcgctggtggcgccggccgaggccagccgcgcgcaggccatcgaggacctgcagaagcagccgctggcctggtacgccctcggccagttgaaggccagcccggaaccattgctgccgccgatgagcaccctgtgcatcgccggcggacgcaaggacaaggtgcgccccggcgacctgctcggtgccctcaccggcgacgccgggctgcccggcagcgcggtgggcaagatcgccatcttcgacttccaggccttcgtcgccatcgagcgcggcctcgcccaccaggccctcaagcgcctgagcgaaggcaagatcaagggtcgctcgttcaaggtccgcctgctttag

SEQ ID NO: 5968 - DNA, 2214 bp, Pseudomonas aeruginosa
cactccgcccccatgccgccctcttcgttgacacacacgctccgccgcctctgggccctcgacaagttcgcctacagcctgcgggtgttcatcgccctggccggcgccctgctgctgtgctggtggcaggaccgcatcgagctgctgatcccgctgttcctcgggatcatcgccagcgccctggcggagaccgacgacaactggctcggccgcctgcaagcgctgctggtgaccctgctgtgcttcagcgtcgccgccttcgccgtcgagttgctgttcccctatccctggctgttcgtttccgggatggcgctgtcggcgttcggcatgatcctcctcggcgccctcggcgagcgctatgcggcaatcgcctcggcgaccctgatcctctcgatctacaccatgatcggcgtggaccagcgcggcggcgaggtcgccgatgtctggcacgaaccgctgctgctggtggccggggcggcctggtacgggctgctctcggtgctgtggaacgcgctgttctccaaccagccggtgcagcagagtctttcccgcctgtatttcgagctgggcgaatacctgaggatcaagtcgagcctgttcgaaccgttgcgccagctcgacgtggagggccagcgcctcgccctggcacggcagaacggcaaggtggtggtggcgctgaaccaggccaaggagaccattctcaaccgcctcggccatggtcggccgggccccaaggtgagccgctacctgaagctctatttcatcgcccaggacgtccacgagcgcgccagttcctcgcactacccgtacaaccggctggccgaggcgttcttccacagcgacgtgctgttccgctgccagcgcctgctcaaccagcagggcaaggcctgccaggccctggcgcgggctatccgcctgcgccagccgtttgattacgccgaccgcgagctggccctggaagacctccaggcctcgctcgaacacctgcgccagcagagcaacccggcctggaagggcctgctgcgctcgctcggcgccctggccgccaacctcaccacgctggaccgcaagctggccggggcgagcaacccggacgccatcgccgacgaacaggacagcgccctgctcgaccgctcgccgcgcagcctgaaggacgccttcgagcgcctgcgccagcagctcaccccgacctcgctgctgttccgccacggcctgcgcatggccctggcgctgaccgccggctacggcgtgctgcactggatccatccgacccagggctactggatactgctcaccacggtgttcgtctgccagcccaactatggcgcgacccgcctgcgcctggtgcagcggatcctcggtacggtggtcggcctggtggtcggctgggcgctgatcgacctgttccccagcccgctggtgcagtcgctgttcgcggtcgccgccggggtcgccttcttcgccacccgcagcagtcgctataccctggcgacggcggcgatcaccctgctggtgctgttctgcttcaaccaggtcggcgatggctacgggctgatcctgccccgcctgttcgataccttgctgggcagcctgatcgccggcctcgcggtgttcctggtgctgcccgactggcagggccgccggctcaaccgcatgctcgccaacaccctcgcctgcaacagccgttacctgcggcagatcatgcagcagtacgccaccggcaagcgcgacgacctcgactaccgcaccgcccggcgcaacgcgcacaacgccgacgcggcgctctcgaccaccctgtcgaacatgctcctggaacccggccatttcaggaaggacgccgagatcggcttccgcttcctggtcctctcgcacaccctgctcagctatctatccggtctcggcgcgcaccgcgaaagcctgcccgaggacgccagcgacggcctcctggagcgcgccgccgagcggctctccgccagcctcgaggaaatcgccgcgagcctggaacagaaacgcccggtcgccatctacagcgaagaggaggaagcgctggccaaggaactggagcagatgcccgaggacatggacgacagccatcgcctggtacagacccaactggcacacatctgccgccagctcgccccgctgcgcaccctggccgcgcacttgctgaagaaggaactggccggcgcgcagccactgccaggccagccctag

SEQ ID NO: 5969 - DNA, 900 bp, Pseudomonas aeruginosa
gcaccgccagcaaccgcgcgcgccagtccggtgcctggccgctcgaccgtggcgccggcggtagccagggtcagcgcgcgctcgccgacgcgcaggctgcggccgtccaacctggcgcagcaggtcgggcatgtcgcgggcctgcaggtcgatcaccttctgcgccgccgcctcgtgcgccgccaggctgaccgcctcgcgcaccgcgcgctcggcccattcgacgttgcgcccgcgcaactgcgcgaggccacggatataggcggcggcgtcgttgacctgcttgcgcaccatgggttcggcgtcccgcgccgggggcttctctgcgggcttgtccggcgtccccaggcgcaccggggtggcggcgccgaggttggtgcccggcgccatcgccgcgatatggcaggcatacaggatgtaggtgccggcgctcgccgcccgcgccccgctgggcgcgacgaaaccggcgaccggcacctggctggcgaggatcgccttgacgatgcgccgcatcgatgcgtccaggccgccgggcgtgtccagttccagcaccaccagttgcgcgccgtcctcggcggcacgctcgatgccgcgcaccaggtaatcggcgctggccgggccgatcgcaccatccaccgagagcacccgtaccggtccggaggccgcgagacaggccgggccggcgaagcacagcaacagcgccagcgcgagccggcacggcatccgcatatcgacctccccgaccgcccggccgggccaccccgggacgaaggcgctcgtcccgcgcaccgggccggcaagcgaccggccccgccgcgcacttctcagtctagtccagtggctctcgccttccccgcgcgtgtccggatcggcaaatccctcaacatgccaactttttag

SEQ ID NO: 5970 - DNA, 237 bp, Pseudomonas aeruginosa
gacagcccggcctcggtgagcttgaccccgcgccgcgagcgacggaacagctcgacaccgaggaactcctcgagcgtggcgatctgccggcagatcgcgctctgggtcagggacaactcctccgccgccttggtgaagctctcgtggcgcgcggcggattcgaagctgaccagcgcggcggtggaagggatcttgcgtcgcatggaggactccggagtgccggtttcgcatctatga

SEQ ID NO: 5971 - DNA, 1242 bp, Pseudomonas aeruginosa
gatgcttccattccggctggcccacgccagcctccgctaccgcttgacgaggatgtacgcatggccaccaaagctagcttcaactgggaagatcccctgctgctggaccagcagctcaccgaagaagagcgcatggttcgcgacagcgcccagcagttcgcccaggacaagctggccccgcgcgtgctcgaagccttccgccacgaacagaccgacccgaagatcttccgcgagatgggcgagaccggcctgctcggcgcgaccattcccgaagcctacggcggcagcggcctcaactacgtctgctatggcctgatcgctcgcgaagtcgagcgcgtcgactccggctatcgctcgatgatgagcgtgcagtcctcgctggtgatggtgccgatccatgaattcggcaacgaagccacccggcagaagtacctgcccaagctggccagcggcgaatacatcggctgcttcggcctgaccgagccgaaccacggttccgacccgggctcgatggtcacccgggcgaagaaggtcgacggcggctatcgcctgagcggcagcaagatgtggatcaccaacagcccgatcgccgacgtcttcgtggtctgggccaaggatgacgaagggcagatccgcggcttcgtcctcgagaagggctgggaaggtctgagcgccccggcgatccatggcaaggtcggcctgcgtgcctcgatcaccggcgagatcgtgatggacaacgtgttcgttccggaagagaacgccttccccgaagtgcgcggcctgcgcggtccgttcacctgcctgaactcggcgcgctacgggatctcctggggcgccctgggcgccgccgaattctgctggcacaccgcccgccagtacgtgctcgaccgccagcagttcggccgcccgctggccgccaaccaactgatccagaagaagctggccgacatgcagaccgagatcaccctggccctgcaaggctgcctgcgcctggggcggatgaaggacgaaggcaccgcggcggtggaaatcacctcgatcatgaagcgcaacagctgcggcaaggccctcgacatcgcccgcctggcccgcgacatgctgggcggcaacggcatctccgacgaattcggcatcgcccgccacctggtcaacctggaagtggtgaacacctacgagggcacccacgatgtccacgcgctgatcctcggccgcgcgcagaccggcatccaggcattcttctga

SEQ ID NO: 5972 - DNA, 510 bp, Pseudomonas aeruginosa
gcatcgcccggaagcgctcgacgacgggctcggcgcgctccagcagcgccggcggaaaccagttgccgaggaaacccgcggcggtctcgctcatgtcctcggcctgcagcaccgcggcgatgcgctcgtcccactgcgccgccgggccgagccaggccgaggtgttggccagcaccagccgctcgatccgctgcggcgcatgcagcgccagccactggccgacgatcccgcccagggacaggccgaggaaatgcgcgcgccgtacctccagcgcgtcgagcagctccagtacgtcctcgcccagccgggccagggtgtagggccccggcggcacgctggaggcgccatggccgcgggcgtcgtagcgcaggacgcggaagtgccgggtcagtgccgggagttgcgcatcccacatgtgcagggtggtgccgatggagttggagagcgccagcagcggtttctctgccgcaccatccaggcgataggcgaggctggcgccgtcgctggtag

SEQ ID NO: 5973 - DNA, 510 bp, Pseudomonas aeruginosa
catgcatcccctgctgcgccgcctcgatctcaacctcctgcttgtcttcgacgccctgtatcgccaccgcaacgtcggcaccgcagccagcgaactggcgatcagcgcctcggccttcagccatgcgctggggcgcctgcgccaggggctggacgacgagctgttcctgcgccagggcaaccgcatgcagccgacccagcgtgccgagcacctggccgctgcggtggccgccgccctgcgcgccctcggcgaggggctggaagagtggcggccgttcgtaccgggacagagccagcgcaccttcgtcttcgccgccaccgactacaccgccttcgccctgcttccgccgctgatgaaccgcctgcagcacagcgcgcccggagtgcgcctgcgcctggtcaatgcggaacgcaagctgtcggtggaggccctggccagcgggcggatcgatttcgccctcggctacgacgaggaacacgagcgcctgcccgaaggcatccaggcccatga

SEQ ID NO: 5974 - DNA, 360 bp, Pseudomonas aeruginosa
ctggttcgccgaccgctacgtggtggtagcgcggcgcgaccacccacgcctcgccggggcgccgacgctggagggctacctggccgaacggcatgcggtggtgacgccgtggaacgaggacagcggggtgatcgaccggctgctggcccgctccggcctgcgtcgcgaagtggcggtgcaactgccgacggtgctggcggcgctgttcctggcaggctccaccgatttcctgctcaccgctccgcgacatgccgcacgggccctggcggaagccgccggcctcgccctgtatcccgcgccgttcgacattccgccctacgtgctgcggctctacagccacgtccagcatgtcgggcgtga

SEQ ID NO: 5975 - DNA, 432 bp, Pseudomonas aeruginosa
gccggcagtagcgcctgcaattcttcctcgatcgcatccagcgcctggaacgaccgctcgacgcgggccaccgcgaccgccccctccagcgccgcgaggatcagccaggcgcgcgaggcggcgagcttttccgccagtccgtcggcgcgcaacgcacgctcgatgctggcgtgccaggcgcggagcgcccggcggcattcggcatgcaccggggccagctcggcgtcgatgctcaggctggtggaaagcaccgggcaggcctcttcgaaacgcgaatgctccagccagccacgcagggtcgcggtgaactggcggaggacgttgcgcgcatggggggcctgggtcccggcgcggtcgaggaaggacgccacctcgtcggcgacgaagccgatcgcggcgctggcgatctgcggcttgccctcggggaaatag

SEQ ID NO: 5976 - DNA, 1095 bp, Pseudomonas aeruginosa
ccgcctggacggcatgccccacgcggagatcgccgagcgtctcggagtctcggtgccgcgcgtgcgccaatacctggcccagggtctgcgccagtgctacatcgccctctacggagagccccggtgagcgccgatgatcgtcattcgccggtacgcgcgcgggtgctcgacgaagccatcgcctggcaattgctgctcgactccggcgaagcccatcccgacgatcaccgcgccttccaccgctggtacgcggcgcatcccgaacacgaacgcgcctgggaacagctcggcggcctcgaccggcacctggcgagagccgccaacgggccggcgcgcaacgccctgctgtccggcaacgcacgcttcaagcgccgcctgcgccggctcggcggcagcgccctggggctagtgctggcgctaggcgtcgggctcggcgtggccaaccgctacgtcccggtccgctacctgctggccgatgcctacagcgccaccggcgagcagcgcgagctgaccctcccggatgccactcatgtgcgcctgaacagccgcagcgccatcgacgtccgcttcgacggcgaacgccgccaggtcgtgctactggccggcgagatcctggtggaaaccgcccatggcgacccgcgccccttcgtggtcagcagcgccgatggcgacatgcgcgccctcggcacgcgcttcctggtgcgccgcgaggaacccggcacgcgcctcaccgtgttgcagtcggcggtggccgcgcgcgcggaaacgctcagcgaagagcgtgtgatcaaggaaggccagcaggtgctgatcctgccgcaaggcctgcaggccagcgaagcggccccggccctggccggcgcctgggcacaaggcatgctggtggtagagaacgcccggctggccgacctggtggcggaactggggcgctattcgccggcgctgctgcgggtcgacccgagcatcgccgacctgcgcgtcaccggcagtttcccgctgaaggacacccgcctcgcccttcaggctttggagccgagcctgccggtgcgcagcgtaaggcacaacgcctggtggttcgaagtggtgccacgctga

SEQ ID NO: 5977 - DNA, 450 bp, Pseudomonas aeruginosa
gactcgtttccatccaggagccccgcacatgccccgcccgacgttccgtcccggcctgctcgccctagccatcgccctcgccgttcccgcaccgttcctccacgccgccccggccgaacaggccagcgtgcgcgactaccgcatcgccgccgggccgctggcaggcaccctgaaccgcatcgcggcccaggccggcctggtcctcaccctggacccggcgctcgccgaaggacgcagcgcccacgccgtgcaaggtcgcttcgacgcgcccggcgcattgcgcgaagcgctcaagggcagcggcctggaactggtggaaaatgccggcggcacctacagcctgcgcaaggtgccggaagacaccctgtcgctgcaggcgatgacggtcagcggcgccgaggaagacccactggggccgaccagcggctacgtgggccaagcgcagcatga

SEQ ID NO: 5978 - DNA, 1110 bp, Pseudomonas aeruginosa
ggccgaatcgccgaagctgcgtacctggccgtcggcgccttcgacgaggatccggctgtcgccgatgttgagcagttcgatttctccgccgcgaatccgcagcaggctcaggcaggccgccggcatgtcttcgaggtcgtgccagtcgcggccgctctgggcgcggaagtcgccctggatatcgttgagcaggcgccgcagcagggtctcgctggattgctcgggctcgacttccagcagcaaccgcaggtgccggtccaccgcctgggccagccagcgcgcgtcgctttccacgcccagcacgctgcgaccgatgctggtggcaccgtcgatcacccaggcggcctgcgccgtgcagcccagcgcatcgtcgttcaccgcgccccccgcgcggcattccgccccgagtatttccactgtggccattcgcagttcctcctatgctcaatgcgctgccagaatagcaagacagagcctttccacgttccgctcgtcgttccgggagaaccgtatgcgtcacctgccctacccgctgctgggcctgttcctggccctgtcgtcgaccggcgccgccctggccggcgaacagtactacccgctggacaagggctccgcgccctacgcggtcgcgcccagtgcacagggtgcggtctggtacggcgcggacggcgggcattcgctggggcgtctcgacccgaccagcggcgagagcgtgcaggtgccgctcggcgaaggcgcgcggccgcgagccatcgtcagcgacgagagcggcaacgcctgggtgctcgacagcggcctcaacgccatccttcgcatcggcggcgagcgcctgggcagcgaacgtttcccgctaccggccaaggccgcgccggccgggctcgactccgcggtattcgacgacgacgggcgcctctggttcaccggcagccgcggcttccacggtcgcctcgacccagccaggcgcctggtggaggtctggccctcgccccagggcaaggcggcgaacggcatctgcgtcaccccggacggcgaggtctggtacgcgcaggacgacgcgctggtgcatgtcgatccgctcgacggcagcgccgagcagttgcccgcgcctga

SEQ ID NO: 5979 - DNA, 2796 bp, Pseudomonas aeruginosa
aggcacgaaggccttgcgcgggatcggcgccgactccatcggcaggctctgggccagcgacagcggtggcgcccggctgtaccgctacgatcccagcgatgcctcgtggcagagctggccgctgccggacagccaggcccgcccggacagcctgcgggtcgacgccatggaccgtgtctggctgcacgacgccgccagcggggcgctcttgcgtttcgacagtgcgcaggcgacattccgcgtcctgcccagcgaccggccggcgcccggcaacgccctgctcggcggtcgccccggagaaacctggagcgccgagcctgccgccgatcgtctgcgcgtcgtccgcgactgatccttccaaggagcccgcatgagcgctacccatacgctgttctacgccgccgcctcgcccttcgtgcgcaaggtcctggtcctgctccacgaaaccggccaacgcgagcgcgtggcgctcgaggaagtcacgccgacgccggtcgcgcccatccggcagctcaacgccagcaacccggccggcaagattcccgccctgcgcctgccggacggccaggtgctgcacgacagccgggtgatctgcgactacttcgaccagcagcacgtcggcgaaccgctgatcccccgcgaaggcagcgtccgctggcgacgcctgaccatcgcctcgctggcggacgccgtcctcgacgccgcggtgctgtcccgctacgaaaccttcgtccgccccgaggagaagcgctgggacacctggctcgaagcacagcgggaaaagatcgcgcggtccctggcgtggctggagggcgactgcatcgccgaactgcaggcgcgcttcgacatcgccgccatcggcgtcgcctgcgccctgggctatctcgacctgcgccagccggagtgggactggcgcggccgctacccgcgactcgccgcctggttcgccgaagtcagccagcgcccgtcgatgcaggccacccgcgcctgaccccgagggcccgccgacgcctgctgccgccgcaggcgctcggcgcgttgcagccaggccgccgaggggccggggaacagcaggccgatccgcgccgccaggcgctcgccgtcgcgacggtcgtcgcgcaggccgacatacccgttcatttccagcacaccaggcggaacagcagcaggcccagcaacagcgcgctctgtccgagccccatgcaaagctccaggaaggagcgcacgtgcggattgccggcggcgccctcgatgccgctgaggccttcccagaatccgtccggcatcagcaccagcatggcgtgggccaggggcttgccgctggcgatccagtactcgatcaggccgaacttgccgaagaacagcagaaagatcaggatcacgccgctgaccagcaggccgagggcggcacagagggtgaactcgaagaacaggcgcatgcttttcctccttggaaatcggcggcggccggcgccgccgccttcgtcgtcaggccctggcgggtaccgccgggaagtccttgcggccgaccccgtaccagtccaggcggcgggtcagcaccatcaccgcggcaagcaccgcgaacagcagcagcgagcccatcagcaaggcgtagtcctccgcgctcagcaagccgtagagcaggccgtacagccctgccaggccggcgctgaagcccagccctcgggccacgctgcgcaggacgaagcacaggtagaagccgatcaggccgacgcaggctccggcggagaccaggtaggccagctcgaagccgacgtgctcggccagcgacagcagcagcaggtagaagaacgccagcgccaggccgaccagcgcgtactggaccgggtgtaccgccaggcgcttgagcacctcgaagaggaagaaaccggcgaaggtcagggtgatgaacagcagcgcgtacttgatcgcgcggtcggccttcaggtactggtccaccggatcgaccaggccgacgccgaaggcgcgcgcctggaagccgtcgcaacgctgctcctccacgcaactgcgcagcgcctcttccatgttggtggcgaagaagctggtctgccagcgcgcggtgaagccctgggcggtgatctcccgctcgctgggcaggaactcgccgccgaagctcgggtgcggccagtcggccttcaggatgacctggctgtcgcggcccaccggcacgatgtccagccgctcgctgccgagcaacgacaggtcgaaggcgtactccaggcgctgcgcctggcgcccgtcgacgccttgcagcggtgcgtgcacaccgctgccgagcaggccgacccggctacccggctcgaagtcgacgctggcaccgttgagggacaggcgcagggcattctcgatgccgcggatgtcgctgatgcccatcgccaggaacggcgtttcgaactggtagtcctccaggtcttcttcgatgccatagtgcgcaggcacctggaagtagccggcaaccttgttgtcgacgtggtacaggcgcgcctggtagatgccacggtagcgcagctcggtgcgcatctgcccgtcgagggcaaagcggtcgggcaggaagtacagctcgccgcgctgctcgcgctcctgcaacacgcgcttctcggtcttctcctcggtgacccactcgcgcaccgtcctgcggtacggcaccaccagcagcgggccggtgaggcgctggctgtagctggagctgcgggcgatatcctgcagcacgccgtcacgaacctcctggcgatcgcggatcaggccgtcgatcatcaacaggggaatcagcaatag

SEQ ID NO: 5980 - DNA, 1587 bp, Pseudomonas aeruginosa
ggcgatggcaccgagcttgtaggccagcgtgcggttcatggggggactctccgtcggggtgatggcggaaagtctgcggcgccgcgatggcgggcttcgggtcgccgtgtggagagtcgatggagtttccgtggaggcgcctcagccgcgcggcagccagagcagcgcctcgacgccgtcgtcgcggttgccgacctgcaaccggccgccatgcagttgcgccacctcggcgacgaagttcagtcccagcccggtgctcttgcgcccgctggccgggcgcggcagcgagtagaagcgttcggtgaggcgcgccagggcgtagtcgggaatcgccggcccctggttgaacaggcgcaaggcgataccctcgccgtcgacctcggcgagcaggcgaaggatgccgccgggcggggtgaagtcgagggcgttgtcgagcaggttggccagcgcctggcgcagcaggaactgctcgccgcgaacctcgcagggaccttccaggcggttctccacccgcaatcgctggcgctggatacgcgccgcctggccttccagcagggacgcggcgatctcccgcaggtcgaccttgccgacctcctccaggccttgccgctgctccacctgggccaggctcagcaggcgctcgatcagttgttgcaggcgctcgctctcgccggcgatgttgccgacgaagcgcgcccgctgctcggccggcatctcgccgtcgagcaactcggcggcgccacggatcgccgccaatgggctcttcagttcgtgggtcagggtatgcacgtagcgctcgacgtagtccttgccttccagttgcgtgcgcatgcgttccaccgcgtccgccagttgcgccatctcgccgccgcgatagcgcggcagctcggcgcggcgcccctcgctgaccgcctgtgcgtactgggtgaggcgccgcagcgcgccgctgagccaccaggagagcaggccgccgaccagcagcccgagggcgatcagcccggcaccgagccaggccaggcgccgctgcgagcggtcgatgtagggttgcaggctgctgttcggcttggccaccgaaaccaccccgatgatcttcccaccatccttgatcggcgccgccacgtacatcaccgaggaatccgggtcgtccgggtcttcgcggctggagcgcgcgccgtactggccccggagagtcaggtagacgtcgttccagcgcgaatagtcctggccgacagccaccccggcggagtccagcagcaccttgccgctggcgtcggtgacgtagatgcggtggttcacagcctccttgcgcaagccccagatatccgcctgcggcacgcgcttgccgtagtcctcgagcatctccggcaggtcgctctgtgccagggtgccgttcttcacgtcctggcggaggatctcggcgagcaggttggcggtgtccaccagggtttcctcggtggactggcgcacgccgggccgcacttcgtccatcaccgtgctcagcacgaagtagccggtgagaccgacgaacaggaagtagaccaggaagatccgaacgccgagcggcatcaggcgtggtccgggctgtag

SEQ ID NO: 5981 - DNA, 1095 bp, Pseudomonas aeruginosa
aggttgggttcggcggcgaggaccggcagggcgaacagcgagagcaaggcaagggcacgcttcacgcgggcatctcctgaagtgatacgaggtccacataggactagcacggcgcggtttcgttcgccacgccggcggcttgggcggcgcggcgcggatgcgtatgatgggccgcgtcgacccacacccaggacagggaaaccaaccatgcgggaactgttgaccggcctgaccagcagccttctgctgcttctcaacacgctgatcctgatcggcccgatgatgctgatcgcactgctcaagctggtgctccccggccagcgcctgaaagacctctgctccaggggcgtgatgtggatcgccgagacctgggcggagatcgacaagtggatcttcgccacctgcacgccgacggtctgggacgtgcgcggcgccggcgacctgcgccaggacacctcgtacctggtggtgagcaaccaccagtcctgggtcgacatccccgcgttgatccaggtgttcaaccggcgcaccccgtacttcaagttcttcctcaagaaggagctgatctgggtgcccttcctcggcctggcctggtgggcgctggagtatccgttcatgaagcgctattccaaggccttcctggagaagcacccggaactcaagggcaaggacctggagatcaccaaggccgcctgcgagaagttcaagcgcatcccggtgaccgtggtgaactacctggaaggcacgcgtttcagcgagcagaagaaggcccggcaacagtcgccctatcgccacctgctcaagcccaaggccggcggggtggccttcgtcctcgccgcgctgggcgagcaactggacgccctgctcgacgtcaccgtggtctacccgagcgacaaggtgccgggattctgggacctgctctgcggacgggtgccgaaggtgatcgtcgacatccagacccgcccgatcgatcccgccctgtggcagggcgactacgagaacgacccggtgttccgccagtacgtgcaggaatgggtctcgcgcatgtgggaagaaaaggacgaacgcatcgcccgcttgcggcaactgcgctga

SEQ ID NO: 5982 - DNA, 492 bp, Pseudomonas aeruginosa
cccggcggcgcaccgatcagccgggacaccgcgtggcgctccatgtattcgctcatgtcgatgcggatcatcgcgtcttcgtcgccgaacaccacctcggccagggccttggccagctcggtcttgcccaccccggtcgggccgaggaacaggaaggtggcgatcggccggctgccctggcgcagcccggcgcgggccaggcgcacggcgtcgctgaccgcggtgatcgcttcctgctggccgatcacccgctggtgcaggcgctcttccatctgcaggagcttctcgcgctcctcggcggtcagttcggtgaccgggatgccggtgagcctggagatgatctcggcgatgtcctcgacccgcacctcctcggtcttcgacccctgggtctgctgccagcgctcggtgatctgctcgaggtgttccttgcgttcctggatgcgtttctcgaagaccttcgcctcgtcgtaccacttgcggctggcggcgtag

SEQ ID NO: 5983 - DNA, 837 bp, Pseudomonas aeruginosa
cgatcggacagctcggcggcggcgacgaaggcctcgtcgcggatggtcaccttgtggtggccttcgagcttgtcgcgcaggccacggaggatggagatggtctgctccaccgtcggctcggggacgaacaccggctggaagcgccgctccagcgcggcgtccttctcgatgtacttctggtactcgttgagggtggtggcgccgatcaggttcatctcgccgcgcgccatcgccggcttcagcacgttggccacgtccagcccgccttcgccgccgccctggccggcaccgacgatggtgtgcacctcgtcgatgaacaggatgatctcgctctgcgccgcctgcagttcgtccatcacctgcttgaggcgttcctcgaactcaccgcggtacttggcgccggcgaccatggcgttgatgttcagttcgaccaggcgcttgtcgcgcagcacctccggcacctcgccctggaccatgcgctgggccaggccttcgacgatggcggtcttgccgacgccgggctcgccgatcagcaccgggttgttcttcttgcgccgggcgagaacctcgatggtggtctcgacttccttcgagcggccgatcaccggatcgagcttgccttcgcgggccagccgggtcaggtcgcggctgaacttgtccagttgcggagtgttgctcgggccgtccacgcggccgtcctcggcgcccttgccgaccaccttgaccgctttctgccgtagcgcctgctcggtcaggccgtacttcttcaggagcgtcccggcgaagctgtccggcaccgccgccaggccgagcaacaggtgctcggggccgacatag

SEQ ID NO: 5984 - DNA, 1623 bp, Pseudomonas aeruginosa
ctcttgagtactagcacagcagccggcgagcgccagcgcttcggcttgacccaggacaatgaaaggcgacctctctggccgcgacttccgccgcaatgcccgctgttcgccccgatccggtcgccggccgtcccatcgcggcgagaacttctctatgcttgggccctgtccgcccgagggagcccgtccatgagcgagccgttccagctcaccccccgcatcgcccgccaactgccctggctggttgccgtcgccttcttcatgcaagccctcgacggcaccatcctcaacaccgcgctgccgagcatggccagttcgctgaacgaaaacccgctgcgcatgcaggcggtggtgatcgcctacctgctcacggtggccctgctgataccggcctcggggtggatcgccgaccgtttcggcacgcgccgggtgttcctcggcgcggtactgctgttcagcctcggctcgttgctttgcgcgctgtcgccgagcctcgaactgctggtcggggcgcgcatcgtacagggcgtcggcggcgcgctgatgatgccggtgggacggctggtgatcctgcgcgtctacccgcgccaggacctggtgcgggtgctcagcttcgtcaccattcccggcctgctcggcccgctggcgggaccgacgctgggcggctggctggtggagtacgcctcctggcactggatcttcctgatcaacctgccggtcggcctgctcggctgcctggtggcgatgaagctgatgccggacctgcgcagcccggtgccgagccgtttcgacagcatcggcttcctgctcttcggcggctccatggtgctgatctccatcgccctggaaggactcggcgagctgcacctgtcgcacctgcgcgtggtcctgctgctgatcggcggactggtcctgctcaccgcctactggctgcgcgcgctacgcatcgacaagccgctgttcccaccgagcctgttcaaggcgcggaccttcgccgtcggcatcctcggcaacctgttcgcccgcctgggcagcggcgccctgcccttcctcaccccgctgttgctgcaggtgggactgggctacccgccctccaccgcgggcatgaccatgatcccgctggcgctgttcgcgatggtcgccaagccgatggccaagccactgctggacttcttcggctatcgcaagctgctggtcggcaacaccctgatcctcggctgcctgatcgccggcttcggcctggtcgaccaggacaccccctacgtctggctgctgctgcacctgagcctgctcggcgcggtgaactccctgcaattcacggcgatgaacaccctcaccctgatcgacctgcaggacagcaacgccagcagcggcaacagcctgatgtcggtggtcgtgcagttgtcgatcagcctcggcgtggcttgcgcggcggcgttgctgggcggtttccagaccgacctggatacggggcaggacaccgtactcggcgccttccacgccacctatgtcagcgtcggcctgatgtcgatgctggccgcggcgatcttcttccagctcggcagcgaggacggtcgcaccagcccgcgccgggtcgatccggaaaaggacccggacctctag

SEQ ID NO: 5985 - DNA, 399 bp, Pseudomonas aeruginosa
agctctatttcatcgcccaggacgtccacgagcgcgccagttcctcgcactacccgtacaaccggctggccgaggcgttcttccacagcgacgtgctgttccgctgccagcgcctgctcaaccagcagggcaaggcctgccaggccctggcgcgggctatccgcctgcgccagccgtttgattacgccgaccgcgagctggccctggaagacctccaggcctcgctcgaacacctgcgccagcagagcaacccggcctggaagggcctgctgcgctcgctcggcgccctggccgccaacctcaccacgctggaccgcaagctggccggggcgagcaacccggacgccatcgccgacgaacaggacagcgccctgctcgaccgctcgccgcgcagcctga

SEQ ID NO: 5986 - DNA, 576 bp, Pseudomonas aeruginosa
tcgccggcctcgcggtgttcctggtgctgcccgactggcagggccgccggctcaaccgcatgctcgccaacaccctcgcctgcaacagccgttacctgcggcagatcatgcagcagtacgccaccggcaagcgcgacgacctcgactaccgcaccgcccggcgcaacgcgcacaacgccgacgcggcgctctcgaccaccctgtcgaacatgctcctggaacccggccatttcaggaaggacgccgagatcggcttccgcttcctggtcctctcgcacaccctgctcagctatctatccggtctcggcgcgcaccgcgaaagcctgcccgaggacgccagcgacggcctcctggagcgcgccgccgagcggctctccgccagcctcgaggaaatcgccgcgagcctggaacagaaacgcccggtcgccatctacagcgaagaggaggaagcgctggccaaggaactggagcagatgcccgaggacatggacgacagccatcgcctggtacagacccaactggcacacatctgccgccagctcgccccgctgcgcaccctggccgcgcacttgctga

SEQ ID NO: 5987 - DNA, 648 bp, Pseudomonas aeruginosa
aggagcgtcccgggagtggatcgccacagcatagccatcccgaccccgggcacgcatgtccccgtgtcgcggctcgatgatatttccatcacaaaccgcacgcgttcacctctcctcttcctctccggcggccttttcgttccgcggcgcggcacctgcgtacttgccgccgaagagttcgatcggcatcgggaagacgatggtcgaactcttgtcgccggcgatcgcgccgagggtctgcatgtagcgcaactgcatggcgccactctgccggccgagcatctgcgccgcctgcatgagtttctccgaggcttgcagctcgccctcggcatggatcaccttggccctgcgctcacgctccgcctcggcctgccgggcgatggcgcgaaccatcgattcgttgagatcgacgtgcttgatttccacattcgccaccttgatgccccaggcgtcggtctgcgcatcgagcacttgctggatatccaggttcaggcgctcgcgctcggcgagcatctcgtccagctcgtgcttgcccagcaccgcgcgcagggtggtctgggccaactggctggtggcggccaggtagttctccacctggatgatcgccttcctgcggatcgagcacgcggaagtacaccaccgcgttga

SEQ ID NO: 5988 - DNA, 723 bp, Pseudomonas aeruginosa
acagcagcagcgcgaggaacaccagcaacatcgccaaaccataggaaatacccatcatccacctccttcatcggccagcgcgacttccaggagcaggcccttgcgcgccagcacccagaccggctggcccaccgccagcggccgcgcggcgagcacccgccagcgctcgccctggagctgcacccagcctgcgcagggttgttcggaatccaccgccgccaccgtcgccaggctgccgaccaatccggcggtgccacttaccaccgcttgccggcgagtacgcagggccatgcccagcagaccgacgatcagcgcggcgctgagcaacgccagggccaccaccaggccgggcggaatgccgtagccgggcacctcggtatcgatcaggatcagcgcgccgaccacgaacgagacgattccaccgatgccgagcacgccgaagctggcgacgaacgcctcgcccaccatgaacgccaggcccagcgcgatcagcgccagcccggcgtagttgaccggcagcatctgcagggcgtacaggccgagcagcaggcagatgccgccgagcacgccgggcagcgccatgccgggattggccagttcgaagatcagcccgtagatgccgatcatcatcaggatcagcgccacgctgggatcggtgagcaccgccagcaaccgcgcgcgccagtccggtgcctggccgctcgaccgtggcgccggcggtag

SEQ ID NO: 5989 - DNA, 1794 bp, Pseudomonas aeruginosa
tcttcgcggccgcagcgggcaggccgcctggcgcccgaccccatccggcttccggcggcctcccgcggcccttgtcctttcttcgccagacgaagccggtatgcgaaagacataacttgtcacaatcgcctgcccatcatgtgccggtcatccccagcgcggacccgcaccatgacctccgatgtccttcccgccgacgccgtcgccagtgccgccggcaacgcgcacaagccccatctcgagcagcgtcccggccgcctcaccgccttcgtattcttcgccgtgctcgccaccggactgctgttcagcgcctacggcctgatgcaggacgtcgatgacgtcggttccgcgatcaccacctggacgcccttcctgctgctcggcgtggccctgctgatcgccctcggcttcgagttcgtcaacggcttccacgacaccgccaacgcggtggccacggtgatctacacccactcgctgccgccgcacttcgcggtggtctggtcgggttgcttcaactttctcggcgtattgctctccagcggcgcggtggccttcggcatcatcgccctgctgccggtggaactgatcctgcaggtcggttcctcggccggcttcgccatggtcttcgccctgctgatcgccgccatcccgtggaacctcgggacctggtggctgggcctgccggcgtcgtcctcgcacaccctgatcggctcgatcatcggcgtcggcgtggccaacgcgctgatgcacgggcgcgacggcaccagcggggtggactggggccaggcaaccaaggtcggctattccctgctgctctcgccgctgatcggcttcgcctgcgccgccctgttgctcctggcgctgcgcctgctggtgaagaaccgcgcgctgtacaaggcgccgaagggcaaggcgccgccgccctggtggatccgcggcctgctgatcctgacctgtaccggggtgtccttcgcccacggctccaacgacggacagaaaggcatgggcctgatcatgctgatcctggtcggcaccctgccgatggcctacgccctgaaccgcaccatgccggcggaccaggcagtgcagttcgccgccgtcgccgaggtcacccagcaagcgctggtgaagagcgcgccgcaaccggcgccggccgatccgcgccaggtactctccgactacgtgcgcagcaagcaggcatcgcctgagctgatcccggcgctggccgccctgaccggctcgatcggccaggaagtgaaaggctatggcgcgttctcgcgggtaccggcgcaagccatgggcaacgtgcgcaacgacatgtacctgacctccgaggcgatccgcctgatggacaaggacgacgtcggccgcttcgacgccgacacccgcggcaagttgcaggcgttcaagcggaagatcgacgacgccaccaagttcatcccgctatgggtgaagatcgccgtggccatcgccctcggcctgggcaccatggtcggctggaaacgcatcgtggtgacggtcggcgagaagatcggcaagacccacctgacctacgcccagggcgcctcggcggaaaccgtggcgatgctgaccattggcgcggcggacctgtatggcttgccggtatccaccacccatgtgctgtcttccggggtggccgggaccatggcggcgaacggttcgggactacagtggaagaccatccgcaacctgctgatggcctgggtgctgacgctgccggcggcgatcctgctctcggcctcgctctactggctgctcacccggctgttctga

SEQ ID NO: 5990 - DNA, 324 bp, Pseudomonas aeruginosa
gctcttaggatgcttccattccggctggcccacgccagcctccgctaccgcttgacgaggatgtacgcatggccaccaaagctagcttcaactgggaagatcccctgctgctggaccagcagctcaccgaagaagagcgcatggttcgcgacagcgcccagcagttcgcccaggacaagctggccccgcgcgtgctcgaagccttccgccacgaacagaccgacccgaagatcttccgcgagatgggcgagaccggcctgctcggcgcgaccattcccgaagcctacggcggcagcggcctcaactacgtctgctatggcctga

SEQ ID NO: 5991 - DNA, 510 bp, Pseudomonas aeruginosa
tcctcggccgcgcgcagaccggcatccaggcattcttctgagccaccgagcaacaccccggcgcgctttttcacggtagcgcgccggccgccggggagacgggcaaggaacccgtcttcccggccatttccgtttccagcccccagcagcgagaaccgtcatgcccggcgccctttcccatatccgcgtactcgacctgtcccgtgtcctggccggcccctgggccgggcagatcctcgccgacctcggcgccgaggtgatcaagatcgagcgccccggcagcggcgacgacacccgcgcctggggcccgccgttcctcaaggatgccgaaggcaacgacaccagcgaggcggcctactacctgtcggccaaccgcaacaagaagtcggtgacggtggacttcacccagccggaaggccagcgcatcgttcgcgaactggcggccaaggccgacatcctgctggagaacttcaaggtcggcgggctcaaggcctatggcctcgactatga

SEQ ID NO: 5992 - DNA, 909 bp, Pseudomonas aeruginosa
cttcatgatccagggcctgggcggcctgatgagcctcaccgggcgcgccgacaacgaggaaggcgccggtccggtgaaggtcggcgtggcgctgaccgatatcctcaccgggctgtactcctccaccgcggtgctcgccgccctcgcccaccgcgacgtcagcggcatcggccagcacatcgacatggccctgctcgacgtgcaggtcgcctgcctggccaaccagaccctcaactacctgaccaccggcgtgccgccgcggcgcctgggcaacgcacacccgaacatcgtgccgtaccaggacttccccaccgccgacggcgacatgatcctcacggtcggcaacgacagccagttccgcaagttcgccgagctggcagaccacccggaatgggccgacgacccgcgcttcgccaccaacaaggcgcgggtggccaaccgcgaggtgctgatcccgctgatccgccaggccacggtgctgcacaccaccgccgagtggattctttccctggagcgcgccggcgtgccctgcgggccgatcaacgacctggcgcaggtgttcgccgacccgcaggtgcaggcccgcggcctgcgcgtggagctaccgcacccgctggccgggacggtgccgcaggtagccagcccgatccgcctgtccgagacgccggtggaataccgcaacccgccgcccaccctcggccagcacaccgacgaggtcctcgagacgctcctcggcctggacgcggccgcgctggaaaggctgcgcgacggcaaggtgatctgagccccgcgccccgccccagcgacgcatcggcggataacgccccaccgtaccccgcgcaacaccgcgacgtagggcgcataaccgcaacgcggttatccgccggccagccgagcatcggcggataa

SEQ ID NO: 5993 - DNA, 1290 bp, Pseudomonas aeruginosa
acatgggaaacgaaatggtcctgggcgttgttgaacgcttccacgcgggcccacagcgcatcgaacttgtcggccgggaacggacggttgatgttgccccaggcgatcgcgtccttggtgctcggctcttcgacgatgaaacggtcgaccggcgaacggccggtgcgatggccggtgcgtacgaccagcgagccgttggcggccagttcgccctcaccgcggcgaatggcttcttctaccagttgggcggcgctgatatcggtgtacacggcgttgttggcttgcgtcatgtggttccccgtcggccagaggccgagtcctccaaacttcgtagcgcttcaaaaaactcactacaggaaaaaagtggcgggattatgccagaaaagcccgctggatgaaaaatcgtcagtggcgggtctcggaaggcccctggctgccagcgccagcgaacaactgggcgacgtcggaggcgtcgaacaggtagcgctggttgcagaactggcagtcgatgctgatcgagccttcttcctcctcgagcagccgctcgcagtcggcctgcccgagactgaccagggcgttggccgaacgttcccgcgagcaactgcaatggaagaccagcggttgcggctcgaacaggcgcacggtttcctcgtggtagaggcggtgcaggacggtctcgttgtccagcgccagcagctcttcggcggtcagcgtgtcggccagggtggtcaggtgctgccaactggcctcgcgggcctcggggtccttcaggcggtcggcgggaagctgctgcagcagcaggccgcgggcacggcggccgttggcgttgagccagaaacgggtcggcagctgttccgagctggcgaagtagttggacaggcattccgccaggttcaccccctccagggcgacgatcccctggtagcgctggcccttgaccgggtccacggtgagggtcagcacgccttcgggcatcagttcctgcatgccggcgtcggcgccgatggactccgccgaatagcgggccaggccacgcacctggcggtcgctggaacactccaccatcaacagcggaaccgcgccgctggagcgcgcctgcaataccagcaggccgtcgaacttgagcgtgccgcagagcagcgaggccgccgcgagcatctccccgagcagctgcgcgaccggttccggatagggatgtttggccagcacttcgctgtagctgcgctcgagatcgaccatctcgccgcgcacgtcggtatcgtcgaaaaggaaacgctggctctgatctga

SEQ ID NO: 5994 - DNA, 906 bp, Pseudomonas aeruginosa
atgaaaatcgccgtgctgtcgcgcaatccccggctctactcgacccgtcgcctggtggaggccgggcgggagcgcggccatgaaatggtggtcatcgatacgctgcgcgcctacatgaacatcgccagccacaagccgcagatccactaccggggacaaccgctggagggcttcgacgcggtgatcccgcgcatcggcgcctcggtgaccttctacggctgcgcggtattgcgccagttcgagatgatgggcgtgttcccgctcaacgagtcggtcgccatcgctcgctcgcgggataagctgcgctcgctgcaactgctctcgcgcaagggcatcggcctgccggtgaccggcttcgcccactccccggacgatgtcccggacctgatcgagatggtcggtggcgcaccgctggtgatcaagctgctggagggcacccagggcatcggcgtggtcctctgcgaaaccgagaaggccgccgaatcggtgctcgaggctttcatggggctcaagcacaacatcatggtccaggagtacataaaggaagccggcggcgccgacatccgctgcttcgtggtcggcgacaaggtgatcgcctcgatgaagcgccaggcagcgcccggcgagttccgctccaacctgcaccgcggcggcagcgccagcctgatcaagatcaccccggaagaacgcatgaccgccatccgcgccgctcgcgtgatgggcctgaacgtcgccggggtggatatcctgcgctccaaccatggtccgctggtaatggaggtgaactcctcgccgggcctggaaggtatcgaatccaccaccggcaaggacatcgccgggatcatcatccagtacctggaaaagaacggcggcccccacctggccaggacgaagggaaaggggtga

SEQ ID NO: 5995 - DNA, 948 bp, Pseudomonas aeruginosa
ctggccacctccaccgaaccgccgccgtggttcagggcattgtcgatcaggttgcccagcagacgcttcatcgacacacgccgcaacggcatcgccggtaccggttgcaaggccatgcgcacctgctcgcgagtctggttgaacggcgccacgacctcgcgcaccaggtcggtcaggtcgccctcctccaccggctcgtcgcggccgtcgcggatgaaggcgaggaactggtcgaggatcgcgtccatgtcctcgatgtcgcggatcatgtcctcgaccatctcccgttcgctctccggcagcaactccagcgacaggcgcaggcgcgtcagcggggtgcgcaggtcgtgggagacaccggccaacatcaattcgcgttcgcgcccgccctgctcgatgtcctcggccatctggttgaaggcgcgatacacctcggccatttcactcggcgtctccggtcccagcggtaggcgcacgctgcgcccctggccgaactggcgggcggcgaccaccaggcgcttgagcggctggctgagctggcggacgaagatccaggcggcggcggtggagagcaggccgatgccgaggaaccagccgagcacgctccagatccgttggccacgcaagggatgcggatacagcggcaccgccagccagccttcgccgaggctcggtgcgcgcacccagagctgcgacggctggtggatacgcaggcgggtctcggtgtccggccccagctccatctgcatctgccgctggaagatttccgtgtacggccagtgctgctcgccgggctggtcggcgctgctcggcacccagcgcaggccggaagccttggcgatggccgcgcgcgactcctcgtcggcagcccagaacgcgcggatggtcagcgccgcgccgtggctgtactggcggtcgacgatcacgtcctcgttcatcagcaggtag

SEQ ID NO: 5996 - DNA, 639 bp, Pseudomonas aeruginosa
gacgacgcggccggtgcatcgctgcaccggccgcgcggagactcaggccttgcgcgcgttgccgtccggcacgaacacgtagccgacgccccagaccgtctggatatagcgcggcttggacggatccggctcgatcagccggcgcaggcgcgagatctgcacgtcgatggaacgctccagggcatcccactcgcggccacgggcgaggttcatcagcttgtcccgggtcagcggttcgcgggcgtgctgcaccagggccttgagcacggcgaactcgccggtggtcagcatgtgtacctcgtcgcccttcttcagttcgcgggtggcgaggaacagctggtagtcgccgaaggtcaccacctcgtcggcaccggcaggcgcgccgggcaccagcggcgcctggcggcgcagcacggccttgatccgcgccagcagttcgcgcgggttgaacggcttggccaggtagtcgtcggcgcccagttccaggccctggatgcggctgccctcgtcgcccttggcggtgagcatgatgatcggcacctgattgttctgttcgcgcaggcggcggcaggcagtgaggccgtcctcgccgggaagcatcaggtcgagcacaaccaactggaacagttcgcgggatag

SEQ ID NO: 5997 - DNA, 303 bp, Pseudomonas aeruginosa
cccccgaactggcccgcgacatcaagctcgccgacaccaagacccgtctcgaagacctctacctgccttataagcagaagcgccgcaccaagggccagatcgccctggaagccggcctcggcgagctggccgacgcactgttcgacgacccgaccctggtcccggaaagcgaggccgcgcgtttcgtcgacgccgagaaaggcttcgccgacgtcaaggcggtgctggaaggcgccaagtacatcctcatggagcgcttcgccgaagacgccacgctgctcgacaagctgcgcgtgttcatga

SEQ ID NO: 5998 - DNA, 339 bp, Pseudomonas aeruginosa
tcgccgagcgcttcggcctgtccaaccagggccgcgccgccgacaagtggctggccgaggtggtgcgctggacctggaaggtcaagctctatacccacctggaaaccgacctgttcggcgagctccgcgacggcgccgaggacgaggcgatcagcgtgttcgcgcgcaacctgcacgacctgctgctggccgccccggccggcccgcgcgccaccctcggcctcgacccgggcctgcgcaccggggtcaaggtcgcggtggtcgacgccaccggcaagctgctggacaccgccaccgtctacccacatgcgccgaagaaccagtgggaccagaccctag

SEQ ID NO: 5999 - DNA, 1374 bp, Pseudomonas aeruginosa
accgctcggtccaccctcatattggggcgaccgatctgggacgcgatcacaaggaatcccgacttgagcgatcttctctcccgccgcctggctctgctcggcgccgcagccaacctgcccctgctgaccgagtgcctgcatggcatcgagcgcgaatgcctgcgagtcgatagcgacggcaagctggcgctcaccccccacccccgggccctgggttcgaccctgacccatccgcagatcactaccgactactccgaggccttgctggagttcatcacgcccacggaaaccgacgtcgccgacactctgggcgatctcgagcgcatccaccgcttcgccagttcgaaactggacggcgaatacctgtggagcccatcgatgccctgcgagctgccggacgaggagagcatcccgatcgcccgctacggcagctcgatgatcggccgcctgaagtacgtctaccgcaagggcctggcgctgcgctacggcaagaccatgcagtgcatcgccggcatccactacaacttctccctgccggagaggctctggccgctgctgcgccaggccgaaggcagcgagctgtcggaacgcgactaccagtccgccgcctacatcgccctgattcgcaatttccgccgctacagctggctgctgatgtacctgttcggcgcctcgccggccctcgacgccggcttcctgcgtggccgcccgagccagttggagcgcctcgacgaacacacgctctacctgccctacgccaccagcctgcggatgagcgacctgggctaccagaacaacgcccaggccggcctgacgccctgctacaacgacctgcagagctacatcgacagcctgcgccaggcggtcagcacgccctacccgccctacgagaaggtcggcaccaagcaggatggcgagtgggtgcagctgaacaccaacatcctgcagatcgaaaacgagtactactcgagcatccggccaaagcgcgtcacctacaccggcgagcgtccggtgcaggccctggccgctcgcggcgtgcagtacgtggaagtgcgctgcctggacatcaacccgttcctgccgctgggcatcgacctggacgaggcgcgcttcctcgacgccttcctgctgttctgcgcgttcagcgacagcccgctgctgaatggcgagtgcagcgacgccaccgacaacttcctcgccgtggtcaaggaaggcaggcggccgggcctgcaattgcaacgtcgcggccagccggtggaattgaaggtctgggcgaacgagctgctcgaacgaatcgccgacaccgcggcgctgctcgaccgcgcacgcggcggcgaagcccacgcggcggcgctggcagcgccagcgggctaa

SEQ ID NO: 6000 - DNA, 447 bp, Pseudomonas aeruginosa
ggtcgccgatgccgaactgacgccttcggcgcaggtgctgaaggtcatgcgcgagcgcggcgagagcttcgaagcgttctccctgcgccagagccgcgaacacgcggagtatttccgccagcatccgctggccgccgaagagcaggcacgcttcgagaagatggccagcgactccctggccgaacagacggagctggaacgcgaccaggatggcgacttcgataccttcgtcgccgcctaccaggcgagcatcctcggcctgatcagcaactgagcgaagccggcgcgcccctgcgcccagggacgcgccggcggatcacaggctcttctcgaatacctgcgaattgcgctggaagttgtacagcgaggcccgcgccgccggtagccgctctacgctgctgggctggaagccgcgctcgcggaaccagtgcgcggtccgcgtggtga

SEQ ID NO: 6001 - DNA, 1233 bp, Pseudomonas aeruginosa
accctcggcggccccgcagcggcgggattcgaccatggtacggggcttggggccggaccgaaccgttttaccactatttctgaaaaaaactatccgaaaaccccggttaactcgcgcagcgctttttcgctaggctgcctcgttcgccgtgccgtccggcgcgcacccacgcgaacgaggaaaatccatgagcgaatacttccatcacgtcctggtcggcctgctcgccgtgctcccggtagccaacccgctgaccagcgtctcgctgctgctcggcctcggcggcagcctgccgccggcggagcgcaaccggcagatattcaaggccagcctctacgtggcgctgatcatgctggtcagcttctacggcggcagcctggtgatgcaggtgttcggcatctccattcccggcctgcgcatcgccggcgggctgatcgtcgcctatatcggcttcaccatgctgttccccgccaccacgccggacgagaccgaagtccagcacgacctgctgtcggacgaggaaaagatcaccccgcacttccgcgacctgtccttcgttccgctggccctgccgggtaccgcggggccggggaccatcgccctggtggtcagctcggcgtcgacgctgcaatccacctacggaagcattccgctgttcatccacctcgcggcgatcaccgtcaccctgctcaccgcgctgatcttctggatcgccctgcaaagctccgggcgcatcatgaagttcctcggcgaatccgggatcgacgccatctcgcgagtggtcggcttcctgctggtggcgatgggcgtgcagttcgtcatcaacggcggcttcgagctggtcgccggccacgccgcgcttcagtcggcggcgggcgtcaggcagtaatgctggatcagccggcgcagcacgccgaccatcggttcgatacgcgccagttcgaggtgctcgtcgggctggtgggcacaggcgatgtcgccggcaccgaggaccagggtctcgctgcccaggcgctggaagtacggcgcctcggtaccgaacgccacggcctcggcgcgatgcccggtcaggcgttcggcgacgcgtaccagttcgctgtcctgcgcctgttcgaacggcggcacggcagggaacagcggctggtagtcgatgctcacctggtgccgttcggccagcggccgcaggcgctggcggatcgcctcgcgcaactgctcaggctgcatgccgggtag

SEQ ID NO: 6002 - DNA, 654 bp, Pseudomonas aeruginosa
cgggcgcaggtcgaattccagcgaacactggccgcagatgcggttgggattgtcgccgccgtggatgcaaccgaagttcagggtcggctggggcacgctgaactgcgggttgttccaggcccgctgccattccccgcgcagcgccatcagctcgccgatggtcgcgtgcatggcctccagggcgctacggccgaggttcggatcggacgaatggccgctctgcccgagaatctcgatgcgctccatcatcacccccttgtgcaggcggatcggccgcaggttggtcggctcgccgatcaccgtggcgcgacccagcggtcgcccgctttcggcgagggcacgggcgccggccatcgagctttcctcgtcgcaggtggcgaggatcatcagcggctggcggaacggctggtcgagcagcggcagcaaggcctcgatggccagcgggaagaagcccttcatgtcgcaactgccgaggccgtaccagcggccgtcgcgctcgtccaggcgcagcggatcgctgctccacagcgcttcgtcgtagggcacggtatcggtgtggccggccagcaccagcccgccggaaccgctgccgtagctggccagcaggttgaacttgcccggcgagacttcccggatctcgcagcggaagcctag

SEQ ID NO: 6003 - DNA, 783 bp, Pseudomonas aeruginosa
gcgggtcaccagttccaggtcgccgccggcctggaccaccgcgacgaccgccgccaccgggccgatggcgttggccacgtcgttggcgccatgggcgaaagccatggagcaggcggtgaagatcatcagcaccgcgaagacccgctcgacgctggcgaagccgccacgcggatcggctccgccagtgggtcggatgcgcaacagcaggacgatgcccaggcccatcaccaggccaccggcgagcaacgccagacccagcgtctggaggccggaaagctccaggccgacatgcttcaggcccttgccgacggtcatcagcgcgaccatgaagcccgccaggaacatgtacagcggcacgtagcggcgcgcgctgcggaacgggtcctcggcatgcagtaccaaccactgcacgctcctgaacagggcgaaggcgagcagcccggacagcaccggcgtcaccacccaactggcgacgatcgggccgatcgcgccccagtgcaccgcgtgcaccgagacaccgaccgaggcgaagccgatgatcgcgccgacgatggagtgggtggtcgacaccggccagcccttgatcgtcgccagcaacagccagaccccggcggccagcaaggccgagagcatgccgaagaccagcaggtcgggggtcatgtactgcggatcgacgatgccgctcctgatcgtttcggtgacctcgccgccggcgaagtaggcaccgcagaactcgaagaccatcgccaccaggatcgcctggcggatggtcagcgcccgtga

SEQ ID NO: 6004 - DNA, 1494 bp, Pseudomonas aeruginosa
acggattggtcggcatggaacgcctccctggtggaaatgccgaaaagtataggccacccaccccgcgcgcctttgatctggaacaccttcacccgcggacgcctggcgtcccgagccggacatcgccccatgcagaaagaaaccgaaatcaaactccgcgtcagccgcgccaccctggaagccttgcaggagcacccgttgctgaagaagcgcaacaaatcgggctgggagcgccgcgaactgtacaaccagtactacgacacccccggccgcgagctggcccgggccaaggtcgcgctgcgcatgcgccgcgacggcgagcagtacatccagacgctgaagagccgcgggcagagcgtggccgggttgtccgaacgcaacgagtgggactggtacctggaaaagaacaagctcgacctaaagaaactcgacgacaagtgctggccggcggccctcaaggacctcgacaagaagcagctcaagccgatcttcagcaccgacttcgtccgccagcgcgccgagatcgcctggggccgcggcaaggccagggtagtcgtggaggcggcgctcgacctgggcaaggtggtcgccggcgacaaccaggaggaaatctgcgaactggagctggaactgcgccagggcgatgccgccgcgctgctcgagctggccgcggaactggccgccgacctgccgctgatgccctgcgacatcagcaaggccgagcgcggctaccgcctgttcgacccgaacagctacgaggtcgatcccccggcccagaaactgctggcggaaaccccgctggacggtgccttcgccgccatcgcctggtacctgctcggcagcagccagcgactggccgaacagtatcgtttcaacggccactggcgcctgctggaggactggctgcaacacctgcaggacctgcgtaccctgctcggcagcctcggccaggcggtgccacgcgccagcagtcgcgagctgcgcgaagcgctggacgctctcctcgccgactgggcgccgcgcatcgagcgcggccgtgacgacgagacgctacgccagcaggcgccgcaactgttccgcggcgaactcgacgagacccgctggggtctgttctccctgaatgcctcgcgctggctgctggccaaggcctggaccgagtcgcgcaacgagcgcggcaaccgccagggcgccgccgcgctgggcaaatggctgctgcgcagccttgccgaagaagcccaggccacgccgctggcgcgcgcccaccagcatcccgagctgctccccgaccaagcgccgcgcctgcagcgcatgcttacctggttgcgcctggcgcgcggcgtgctcgacctgccggaagccgaccgcctctacggcgaactggccaagttgctggagctgctgcggcaacctgtcgatgtcgagcgcctggctgcccgcgccacgcaggcccatactgtgctgacgctcaaaccctggaaggcgctgatgaaataa

SEQ ID NO: 6005 - DNA, 1146 bp, Pseudomonas aeruginosa
gcttcgccgctaccgccatcatccgaagggagtctgcatgtccgtgttcgccaccgccgcccaggaccgcctgctggacctcggcgacctgctccgcgagctggtcgcccagggccgggtcgggcaggagcaggccgaacagtgcctggcgatccgccgcagcgcggtgcgcaaccagcagcatccgctggagttcctcgccgcgcagcaggtcgaggatctcaagcgccccggacgcaagctcgacctggagaccctcacccagtggctggccgagtacgccggccagccctacctgcgcatcgacccgctgaagatcgacgtcgccgcggtgactccgctgatgtcctacgccttcgcccagcgccatggcatcctcgccgtcgcgctgagtccggaggaagtcaccatcgccagcgcccagcccttcgtacagggctgggaaagcaacctggtgcatgtgctcaagcgaccgatcaagcgggtggtggcgaacccggcggacatccagcgctacaccgtcgagttcttccgcctggcccgctcggtcagcggcgccacctcgccggaccagaagatcagcggcgtcggcaacttcgaacagttgctcaacctcggcgccgccgaccaggagccggacgccaacgacgcgcacatcgtcaccatcgtcgactggctgttccagtacgccttccagcagcgcgccagcgacatccacatcgagccgcgccgcgagcagggcaccgtgcgcttccgtatcgacggcgtgctgcacaacgtctaccagttcccgccgcaggtgaccatggcggtggtcagccgcctgaagtcactgggacggatgaacgtggcggagaaacgcaagccgcaggacggccgggtcaagaccaagaccccggacggcgccgaggtggagctgcgcctgtcgaccctgcccaccgccttcggcgagaagatggtgatgcgcatcttcgaccccgaggtgctgctcaagagcttcgaccagctcggattctccgccgacgacctgcgccgctggcagagcatgaccagccagcccaacggcatcatcctggtcaccggccccaccggctcgggcaagaccaccacgctttacaccacgctcaagcaactggccaccgatga

SEQ ID NO: 6006 - DNA, 489 bp, Pseudomonas aeruginosa
ggtgaacgtctgcaccatcgaggacccgatcgagatgatcgagccctcgttcaaccagatgcaggtccagcacaacatcgacctgaccttcgccagcggcgtacgcgccctgctgcggcaggacccggacatcatcatggtcggcgagatccgcgacctggagaccgccgagatggcgatccaggcggcgctcaccgggcacctggtgctctccaccctgcacaccaacgactcccccacggcgatcacccgcctgctcgaactgggcgtaccctactacctgatccgcgccacggtgctaggggtcatggcccagcgcctggtgcgcacgctctgcccgcactgcaaggcgccgatgcaactggcggacagcgactggcacgaactgacccgcccctggagcgccccgccgcccagcggcgcgcaccaggccgtgggttgcctggagtgccgcgacaccggctatcgcgggcgcgccggcgtctatga

SEQ ID NO: 6007 - DNA, 585 bp, Pseudomonas aeruginosa
cgagcgttccccccgccgtccccgcgccgacgctccccagccgcggcgcaccgcacctgcggcgagccgcgagcggcgtccctggctcgatgtggctcggccggccgccgagccggcgctgagggccggccgatggaaatcctgctgctacgcctggacttctgggactggctggccttcggtaccgtcctcctgctcctggaaatcttcggtgccggcggctatctgctgcgggtcggcctcaccgccgcttgtgtcggtgcgctcggcgcgctcctgccgggactggcctggccttggcaggtagggctgttcgtcctgctctccgggctggtcgccgccttgcatcgacgccgtcgccgcaaggccggtagcgtcgaggaaacgccagggttgcagcgacgcggcgacgacctgttcggccgcacctttcccttgcaccgggcgatcgtcggcgggctcggcgagctgcgcgtcgaggacgcgtcgtggctggtcagcggtcccgacctgccgcgcggcgccctggtccgggtcaccggccaggacggcgccctgctgcacgtcgagcctgctgcgccttga

SEQ ID NO: 6008 - DNA, 3294 bp, Pseudomonas aeruginosa
tcgtcgccgcgcaggacgacgccggcagctacatcgccagcgacggcgcgatccgcgggccgtacctggaagccgccctgcaaaagctgcgcaacgacaacccggacctgcaggccagcgacatggaactggccagcgcgatcctcgccggcggcgagcagtccgccgtccagcagtaggccacggcgacctcgcctccgcccggaggcgaggtcactcgcggtagtcgtccagcggcacgcaggcgcagaacaggttgcggtcgccgtagacgttgtccacccggttaaccgccggccagtacttgaacgcccgcgcatgttcgctcggggtcaccgcctcggcgatctcgtagggtctctgccagatcccggtgacgtcggccagggtatgcggcgcccgtttcagcgggttgtcctccgccggccaggcgccgctctccaccttgccgatctcggccctgatgctcagcatcgcctcgacgaagcgatccagctccgccttcgactcgctctcggtcggctccaccatcagcgtgcccggcaccgggaaggacatggtcggggcgtggaagccgtagtccatcaggcgcttggccacgtcttcctcggttatcccggtctgcgccttgagcggtcgcaggtcgaggatgcattcgtgggcgacgcgctcgttgcgcccgcggtagagcaccgggaacgccccgtccaggcggttcgccaggtagttggcggagaggatcgccacctcgctggcgtcggccagctgcgggcccatcatggcgatgtacatccaactgatcggcaggatgctggcgctgccccagggcgccgcgctgaccgcgtcgttcagcgggttcggcccttcgacgcggatcaccggatggttggcgacgaacggcgccaggtgccgcttgaccccgatcggccccatgcccggcccgccaccaccatgggggatgcagaaggtcttgtgcaggttcatgtgcgagacgtccgcgccgatgtccgccggtcgcgccaggccgacctgggcgttgaggttggcgccgtccatgtagacctggccgccgtggcggtggaccacttcgcagatctcgcctatcccctcctcgtagacgccgtgggtcgagggataggtgatcatcaggcaggacagccggtcgcccgcctcggccgccttgaggcgcaggtcgtcgaggtcgacgttgccgcagggatcgcactcgacgatcaccacccgcatgctggccatgatcgccgaggccgggttggtgccatgcgccgatgcggggatcaggcagatgtcgcgctggctatcgccgcggctctggtggtagcggcggatcgccagcaacccggcatattcgccctgtgctcccgagttcggctgcatgcagatggcgtcgaagccggtgatcgcccgcagccaggcttccagttcgtcgatcatccggcgatagccctcggcctgctcgcgcggcacgaacggatgcagttcggcgaattccggccaggtgatggggatcatttcgctgctggcgttgagcttcatggtgcaggagccgagcgggatcatcgcctggttcagcgccaggtccttgccttccagctggcgcaggtagcgaagcatctcggtctcgctgtggtgggcgttgaacaccggatgctgcaggtaggccgaagtgcgttgcaggaccgccgggatgccgtcggccaccgccccgccatccaggtgcgcgacatccagcccgtggccggcgccgaggaagatctcgaacagggtcgccagggtcgccgcgtcacaggtttcgtcgaggctcagggccagccgccggtcgtcgaccacgcgcaggttgacccgtgccgcccgcgcccgttcgaggatcgccgcctgacgctcgccgacctcgtaggtcagggtgtcgaagaagtgccggttgagccgccgcagtcccttgctttccaggcccgccgccagcagcgcggtcaggcgctggacgcgttgggcgatgcgtttcagctcctgtggcccatggtagacggcatacagcgaagcaatgttggccagcagcacctgggcggtgcagatgttcgagttggccttttcccgacggatgtgctgctcgcgggtttgcagggccatgcgcaacgccgggttgccgcgggcgtcgcgggaaacgccgatgatccgccccggcattgcccgcttgtacccttcgcgggtggcgaagaacgccgcgtgcggcccgccgtagcccatcggtacgccaaagcgctgggcgctgccgagcaccacgtcggcaccgagttcccccggcggggtcagcaacaacagggcgagcaggtcgctggcgacgcaagccagcgcctgttggccgtgcaacgcctcgataagcgggcgcaggtcgcggatctcgccgcgactgtccgggtattgcagcaaggcgccgaacaccgcgtgggcggcaagattgtccggctcgtcgacgaccagctcgaaaccgaacgcctcggcgcgggtacgcaacaccgaaacggtctgcggatggcaatgcgcatcgacgaagaaccggttgctcctggccttcgccacccgcctggccagggccatggcctcggcggcggcggtggcttcgtcgagcagcgaggcgctggccaggtcgagcccggtgaggtcgatggtcagttgctggaaattcagcagcgcttccaggcggccctgggcgatttccggctggtagggcgtataggcggtgtaccagccgggattctccagcacgttgcggaggatcaccggcggcgtcacggtgccgtagtagcccatgccgatcaggctggtccagcgctggttgagcccggcgtagccgcgcaggcgcgccagggcggcctgttcgtcgagcgcggcgggcagttccagcggccggttgaggcggatcgccggcggcaccgtctgcacgatcagttcggcgcgagtggaaactccgaggaaatccagcatggcctgctgttccgccggatcggggccgaggtggcggcgcaggaaggcatcggcgggctggagctgggcgagggacggcgtctgcgacatggcttcggtctcgttgggggcggcatcgccctgccagcgatcgtcgccgaacggatatcgaatgagaaagcaacgacggcgaaaacgcatttcgccgctgcaaaaagaacaaagcctcgaatgatcgaggccttgtccaaggatagcgggttttgtcgcgactacgcggcggctcagccttccgcgtcgacggcggcctggtag

SEQ ID NO: 6009 - DNA, 1278 bp, Pseudomonas aeruginosa
cgcagttcggcgggaatattgctcatcttgttttcctcgaagtcgggggcgacggcggtcgccattgccaggttagatcaggggcttgccgtgacgcacgaaactgggctggaccacccgtaccgggtaccacttgccgcggatttccacctcggcgcggtcgccggtggcggccggcacgcgggccagcgcgatggacttgttcagggtaggcgaaaagctgccgctggtgatctccccctcaccaatgccagctacccgcaccacctggtgggcgcgcagcacgccgcgctcctccagtaccaggccgaccagcttcggctggtcgccggcggccttctgcgcttccagcgcgcggcggccgacgaagtcccgcgcaaccggctcccaggctacggtccagcccatgttggcggcaagcggggaaacgctttcgtccatgtcctggccgtagagattgagcccggcctccaggcgcagcgtatcgcgcgcacccaggcccgccggggagatcccggcgccaaccagctcgttgaggaaacccggcgcttcggcggccggcagcatgatttccaggccgtcctcgccggtgtagccagtgcgagcgatgaaccagtcgccctcggcacggccctggaacggcttgagttcgcgtatcagcgcggcgcgtgccggggataccagttcggagctgtgcacgcgggcgttggggccctggatggcgagcatcgccaggtcgccgcgttcctgcaggtcgaccttgaagccggcggcctgcgcctgcatccaggcgatgtccttgtcgcgggtggaagcattgaccaccacccggtagccgtgctcggtcaggtagacgatcaggtcgtcgaccaccccgccctcttcgttgagcatcgcgctgtagagcgccttgccggtttcgccgagacgcgccacgtcgttcgccaggagatgctgcagataggccgtggcctgctcgccggcgacgtcgaccacggtcatgtgggacacgtcgaagacgccgcagtcacgccggacctgatggtgctcctcgacctgcgaaccgtagtgcagcggcatgtcccaaccgccgaaatcgaccatcttggcgccgagcgcgacgtgcagctcgtaaagcggggtgcgcaatcccatgggtattctccttccgggcgtagcgggtgccgtcggcagggaccgccggcacgaaatcgcgcgcattgtagccgcaagccccggagcaggacaccatggaagcgtgccgcgatccgtgcatag

SEQ ID NO: 6010 - DNA, 1371 bp, Pseudomonas aeruginosa
caggccgaccagcaccagggtcagggccggcagcgaggcgcgcgcccattcgccctcgctggtcatctcgaagatccgtacggccagggtgtcccaaccgaagggacgcatcagcagggtcgccggcatctccttgagcacgtcgacgaagaccagcagcgcggcgctcagcgaggccggcagcaacagcggcaggtagacccgcaggaacagcagcgggccgcccacgccgaggctgcgcgaagcttccggcagcgacgggcggatccgcgccagcccgctttccagcggcccgtaggccaccgccatgaaacggatcaggtaggccagcagcagggcgaacagactgcccagcagcagcggcttgccggcgccgccgagggcgctggaaagcgggatcacccagtgattgtccagccagctgaaggccagcatgatcgaaaccgccaggaccgagcccggcagcgcataaccgaggttgcccaggcccaccgcgccgcggatagcgcgagtcggcgccaggcgcacggcgaaggccagcagcagggccacggcgaccgtcgccagcgcggcgatgccgcccagcgtcagggtatggccgatcaggtcccagtagcgctcgtcgaggtcgaaacggccctggcgccagaaccagacaaccagttgcgccacgggaatcacgaaggcgcagaggaacaccagcccgcaccaggcgctcgccgccagcgccctggcgccgcgcaggcgatacagcggcgcgccgcgcggacgctcgctggcggccttggctcggcctcgcgtgtggcgctcgccgagcagcaccaggcataccccgagcaacaacaggctggccagctgggcggcgctggagaggctgtagaagccgtaccaggttttgtagatggcggtggtgaaggtgtcgaagttgaacaccgataccgcgccgaagtcggccagggtttccatcaccgccagcgccaggccggcgccgatcgccggccgcgccatcggcagggcgacccgcaggaacgcctgccagggcgacaggccgagaacccgcgcggcttccatcaggcccttgccctgggcgatgaaggcgctgcgcgcgagcaggtagacatagggatagaacaccagcaccaggaccaggatcaccccgccggtggagcgtacgcgcggcaaccgcaggccgctgccgaaccactcgcgcagcaggctctgcaccggtccggcgaaatccagcaggccgacgaagacgaacgccaggacgtaggccgggatcgcgaacggcaacatcagcgcccagtccagccagcgccgcccggggaattcgcagaggctggtgagccaggccaggctgaccccgagtag

SEQ ID NO: 6011 - DNA, 567 bp, Pseudomonas aeruginosa
ggccaagcgcctggcggacgaacagcgccttcgcctcgtgatggccgtcgaccaggcgcaggccggcgttgcgcagccagcgcagcggcaaccggtcggcctggaacaggcgctcgaagccttccatcgccgtcatcatgcccaggttgtgcggcatccgccgccgctcgaagcgactcagcacgcgttcgtcggcaagccgttcgccgcgctccagggcgtgcaacaggacctcggacagcaccgccgcatcgaggaagcccaggttcacgccctgtccggccagcgggtggatggtgtgcgcagcgtcgccgaccagcgccaggcccggctcgacgtaacgcttggggtgccgctggcgcagcgggatgcacaggcgccggtcggcatgcaggatggcgcccaggcgctgttcgaaggcttcgccgagggcggcgcggaagccatcctcgtccaacgccatcaggcgttctgcctgttccggggtggtcgaccagacgatcgagcaccagtgctcgtcgccgcggtccggcaggggcaggaaggccagcggaccgtcgtcggtga

SEQ ID NO: 6012 - DNA, 1350 bp, Pseudomonas aeruginosa
agattcatggcgaagcgcagcaggcgggccttgcgcgccctcgaccagaccggcatggcgctacagcggccgcgcgccgaggcccatggcctggcgggcgaaccagcgcttggccggcggcagcaggtcgagcccgagcaggccgaggttgcgcccggcgccgagcagcgcgcggtcgttggagaacagccgggtcacccggtcggagaagccgacggtcatctgctggtccaggcgctgcccatcgaggtagcgctgcagcacggcgaactcgcccagcggcgcgtcgtcgtggagcagggcgtcgaccagcgccagggtgtcgcgcaacgacaggttgaagccctggccggcgatggggtgcagactgtgcgcagcgttgcccagcaccaccaggtgcggacgcacctgctcgcgggcctcgaccaggtgcaaggggtagcagtgccgtgcgccgacctggcggaaggcgccgaggcggtagccgaaggcagcctgcagctcgccgaggaaggccgcgtcatcgaggccacgcaggcgttcggcgtccttgcctgggcgggtccagatcagcgcgcaacggttatccggcaacggcaggagggccatcggaccgctgggggtgaagcgctcgaaggcctgcccgaggtgcgcctcggagggcgatacgttggcgatcagcgcagtctgccggtacggcgtctgctccacggcgatgccaagttgttcgcgcagcccggaacgaccgccatcggcgaggatcgccagctcgcaatcgagttgcgtctcgtcgtcgagggtaagccggtaaccgccctcccgggcttccagggtcttcacttcggccgggcagtgccagcgcaccacctcggggtcgagcgccttccacaggcactggccgagccaggcgttctccaccacgtagcccagcgccggcacgccttcctcgatggcggtcaggcgggtggcgccgaagcggccgcggtcggaaacatggatatgcaggatcggctcggcgcgctcggcgatcgccggccacaggccgagtcgctcgtagatctgccggctgccgtaggacagcgccgaagagcgggcgtcgtagctgggctggtaggcattgccgggggcgaagggttcgatcagcacgatcgaccagccgcgctcccgagcgccggcctgcagggccagcgccagcgaggcgccgaccaggcccccgccgatgatcgccaggttgaccttgctcatcgtcacctcaggctgcctcgctcttggccgcggccatcagcgcctcgatctcggcgacggtcttcggcacgccgttggtcagcacttcgcagccattgcgggtga

SEQ ID NO: 6013 - DNA, 354 bp, Pseudomonas aeruginosa
aatgaagatggttatcctagcaccgcccgccccggcaagaccatgcgaccggttgccggcgcgccggcccagccggggcattggccccgaccggggacgatcctatatagttgtccaatcaccccaattcccaagcgagagcccatggaagacgccgatctgcaattgttgacggccaagttcgaccagctgctccagaagctggaacagctcaaggcggagaaccggctgctgcgggcgaacgaaaagtcctggcgcgaggagcgcgctcatctgatcgaaaagaacgaaatggcgagacacaaggtcgaagcgatgattttgcgtctgaaagccttggagcaggacacatga

SEQ ID NO: 6014 - DNA, 642 bp, Pseudomonas aeruginosa
ctgcaacaacggaggttgccagttggaccggtgtgcatgtccgcacgacggaaagccttaaggtctactgcaaccgccaccttgaactttcgggttcaagggctaacccgacagcggcacgaccggggagctacctttccacatgatcgaatcgcaagacctcagccgcccggccctgcgccgcaagctccgccaggcgcgccgcgcgctctcccccctgcagcaacgcctcgccgcccgtgccctctatcgacaactggcgcagcatccccttttccgccgtgcccgccatatcgccctgtacctgcccaacgacggcgagatcgacccgcgtccgctgctgcgtgcggcgcagaaccgcgggcaaggccacctacctgccggtgctggcgccctggccgcagacgcgcatggtattccagcgggtcggcagcggcgaacgctggacccgcaaccgcttccgcatcagcgaaccgctggccgacgccggccgccagcgcaaggcctgggcgctggacctggtactgctgccgctggtggggttcgacgaacagggcgggcgcctgggcatgggcggcggcttctacgaccgcagcctggcctacctggcgaggcgcaaaaatggtcacaaaccgacgctga

SEQ ID NO: 6015 - DNA, 738 bp, Pseudomonas aeruginosa
tgccggtcagcgccgaggaatggcaggcgatcctgccgctggcgaaacgctgaagccatcgctcaggccatctgcgagatggtccggcggaaacgccagagcgcgccgaagaagaacgccgaaccgatcaccacgataccggcgaactgcggccagacgatgtcgaaaccggcgccgcggaacaggatcgcctgggccaggctgacgaaatgcgtggtcggcgccgccagcatgatgttctgcagcagttccggcatgctttcccgtggcgtggtgccgcccgaaaggatgttcagcggcagcagcacgaggatggtcaacagtccgagctgcggcatcgaacgcgccaccgtgccgaggaatatgcccatggaggtggtggcgaacagatgcaatccggcgccgagcaggaacagtcccaccgagccgctgatcggcacgtccagccagccacgcaccacccactgcaacgagagccccgccgccaccagcaccaccaaccccatcgaccagaccttggccatcatgatctcgaaggccgacagcggcatcaccagcaggtgctcgacggtgccgtgctcgcgctcgcggatcagcgcggcgccggtgaggatgatcgacagcatagtgatctggttgatcacttccatcaccccaccgaaccaggcctgggtcaggttcgggttgaattccatgcgcacctcgatctgcgccggcatgctcggctccgcgcggtag

SEQ ID NO: 6016 - DNA, 357 bp, Pseudomonas aeruginosa
gcctcgttcatgaagtgggtggaaatgaagatggtcaccccgtcgcggcgcgacagctcgaccatcagctcccagaagccgtcgcgagccaccgggtcgacccccgaagtgggctcgtcgaggatcaggatttccggcttgtggatcaccgccaccgccagcgacagacgctggcgaatgcccagcggcaggtcgttgggcagctcgtcggccaccttctccaggtcgaagcgccggagcatttcgccgacccgtgccgggatgccatccgccggcaggtggaacagccgggcgtgcaacaccaggttctgccgcacgctcagctcggcatacagggaaaaggcctgggacatgtag

SEQ ID NO: 6017 - DNA, 1671 bp, Pseudomonas aeruginosa
catttccgctattttttcatttacgaaaaatgtagtgttcgcaaccgcgtaaaaaggcgcgacacaacaacaagcggagctcgcgatgttcggaatctttcgtcccgcgccacaccaggcgccactgcccgatgccgaggtggacagcacctaccggcgcctgcgctggcagatcttcgccggtatcttcatcggctacgcgggttactacctgctgcgcaagaacttctccctggccatgccctacctcatcgaggacggctacagccgcggtcaactgggcgtcgcgatgtcggccatcgccatcgcctacggcctgtcgaaattcatcatgggcctggtctcggatcgttccaacccacgggtcttcctgccgttcggcctgttggtgtcggcggcggtgatgttcattttcggattcgcgcactgggctacctccagcgtcgccatcatgttcgtcctgctcttcatcaacggctgggcccagggcatgggctggccgccgagcggacggaccatggtccactggtggtcgcagaaggagcgcggcagcgtggtctcggtgtggaacgtcgcccacaacgtcggcggcggcctgatcggcccgctgttcctgctcggcctggcgctgttcggcgactggcgctcggccttctacgtgccggccatcgtcgccgtgggcgtagccgtattcgcctatttcgccatgcgcgacaccccgcaatcctgcggcctgccgccgatcgagaagcacaaggacgactaccccgaaggctacgacgaacaccacgagcgcgagctgtcgaccaaggagatcttcgtcacctacgtgctgcgcaacaagctgctctggtacatcgccctggccaacgtgttcgtctacctgctgcgctacggtgtgctcgactgggcgccgacctacctcaaggaggccaagcacttcaacgtcgacaagtcgtcctgggcgtacttcttctacgaatgggcggggattcccggcaccctgctctgcggctggctgtcggacaagctgttcaagggcaatcgcggcgccaccggcgtggtgttcatgatcctggtgaccgtcggcaccctgatctactggctgaacccggccggcaacccggcgatcgacatggccgcgctgatcatgatcggcttcctgatctacggcccggtgatgctgatcggcttgcaggccctggagctggcgccgaagaaagcggccggcaccgccgccggcttcaccggtctgttcggctacctcggcggctcggtggcggccaacgccctggtcggctacacggtggatcacttcggctgggacggtggcttcaagctgctgatcggcgcctgcctgctggccatcctgttcctctgcctgaccctgcgcaaacccgcggtccaggccgcgccgcagcaagccggctgatgacgcggcggctccggcgccaggccggagccgcgttcagtcccgcggcgcgtaggcgaacacgtcggcgcgcatctggtgcgcgtccatccctgcttcgaccagggcatccagggtcgcgtagaccatcgccggcgagccgctggcatacacatgcaggctcgacaggtcggcgaaatcctcgcgcaccgcctcgtgcagcaagccgcagcgcccctcccagccacagaggtcgctga

SEQ ID NO: 6018 - DNA, 1662 bp, Pseudomonas aeruginosa
agagttcgccatgatcgcgtacctctccgttctggcgtacccgcccctccaccagcagcgccgcgcagatatggcagttgccgttgcggcagctctgcggacagtcgtagccgagccgccgggcgccatcgaggatgcgttcccccggcagcagctcgaggcaggcgccggacggttgcaggacgatacgcatcagtcgatcccgaggctcgaccagagcgcgtcgatgcgccgtgtcaccgcttcgtccttgacgatggcgcgcccccattcgcggctggtctcgcccggccacttgtgggtggcatcaagccccatcttcgagccgaggccggagaccggcgaggcgaagtcgaggtagtcgatgggcgtgttgtcgatcatcaccgtgtcgcgcttggggtccatccgcgtggtgatggcccagatcacatcgttccagtcgcgcgcatcgatgtcatcgtcggtgacgatgacgaacttggtgtacatgaactgccgcaggaacgaccagaccccgagcatcacgcgcttggcgtgccctgggtactgcttcttcatggtcaccaccgccatccggtaggaacaaccttccggcggcaggtagaaatcgacgatttccgggaactgcttctgcaggatcggcacgaacacttcgttcagcgccaccccgaggatcgccggctcgtccggcggacgcccggtgtaggtgctgtggtagatcggtttctgccggcgggtgacgcgctcgacggtgaacaccgggaagcgatcgacctcgttgtagtagccggtgtgatcgccatagggaccttcgtcggccatctcgccggggtggatcaccccttcgaggacgatctcggcgctggccggcacctgcaagtcgctcccgcgacacttgaccagctcggtacgatgcccgcgcaacaggccggcgaaagcgtattcggaaagggtgtccggcaccggcgtcaccgcaccgaggatggtcgccggatcggcgcccagcgccacggctaccggatagggctggcccggatgcttctggcaccactcgcggtagtccagtgcgccgccgcgatggctgagccagcgcatgatcaccttgttgcggccgatcacctgctggcggtagatgcccaggttctgccgttccttgttcggcccgcgggtaacggtcaggccccaggtgatcagcggcccgacatcgcccggccagcaggtctggaccggcagccggccgaggtcgacgtcctcgccctcctcgaccacttcctggcagggggcgtccttgagcaccttcggcgccatggacaggaccttcctgtacatcggcagcttggcccaggcgtccttgaggcccttcggcggctcgggctccttgagttgcgccagcagcttgccgatctcgcgcagcgcgccgacgtcctcggcgcccatgcccagcgccacgcgctccggcgtaccgaacaggttgccgagcaccggcatgtcgaagccggtcggcttttcgaacagcaatgccgggcccttggcgcgcaacgtgcggtcgcacacctcggtcatctcgagcacgggggaaatcggcacctggatgcgcttcaacgcaccgcgctgctccaactgggcgatgaaatcgcggagatccttgaacgtcattag

SEQ ID NO: 6019 - DNA, 1425 bp, Pseudomonas aeruginosa
catcggctcgaacaaaggcccgagttcatgggccccctgggtcgaaaggtggttgttatccatgtacagcgaccagccatcacgttcggcgaaacaatccaggccatcgcagagcacgctggaggggtcgagcacgctcacccgcgggttgccttcggccagcgcatcgaacagcgcattcacgtaggcgacgcgcgcagcgtgctcagcgaagggaaaacgtgcgcgcccgacatcctccccgctcagactcagccgcaccagccgcgccggtgccttgaatggcagcagcggtacgtccttgaccagccagacatgtacgtcggccgcgttcagcctttcgatcatcccgctcaggcgttgccgcagcagcgcctcggcgatcgagctgtccggcgtgtcgtccggctcgcggagaatgttgcgggtaccgtcctgcgagtcgccgtagacatacatgtcccagcgtccggcgaggatcaccccgcccggccgctgctgttcgacgaactcgagcatctgctggttgaaacgcaggcaattgtccttttccagcatccccagcaacggcggacagcccgccagcgaagcctgccagatcggcacccggcgactggcagccagttcgcgcagcagcgggctcaacgccgcggaatggctgtcgccccaactgaccagcagcggtcgttcggcagccagttccgccgggaagcggcagatgctttcctgactgagcgccttcttgtcgaacatgcagtcggtctgcccatcgcgccacttggacgccttggcataacgcaaggcttcctcggaaagacgcgacggcacgccgtcgtaatgccgcaccaactggccgacgactcccagcagcagcaagctgcacagcgccgcgccaagcatctgccggcgcccggcgaacagcttgcgctcgcggaacggtgcctcgacgtagtacagcgacagtgccgccaggccgatgctcgccgccagcaaccccaggcgtgccggcaggcccagggtctccagtgcgtggtactggacgaagacgtacaacggccagtgccagaggtacagcgaataggagatcagaccgaaccagaccagcggttgccagcccagcaggcggcgagcccaggtgtcgccggcgccgttggcccagatcagcagggcggtgccaagcaccgccggcagcgccgcgaggccggggaaaggagtgtcgctgtcgtagaagaacaccggcaggagaatcgccgctatcccgagggtggccgccagttgcagggaccactgcgaatgaccgcggctaccgcccggcagcaatgccagcgcggcacccgccaggagttcccaggcgcgcatcggcaggaggaagaatgcactgccaggtcgctggttcaccgcccagacgctggccgccagcgatag

SEQ ID NO: 6020 - DNA, 2328 bp, Pseudomonas aeruginosa
cccaggccgacttcgcccaggaagccgaatggctcaagcgggtcggctacagcctcaacgtgcggtaagcaccggcgcggccagcttctccagcagggtcgcctgggtattgcgggggttctggttaccggtgggactgagccgctggtagctaccgtcggcctgcaacacccaggcctgggtgttgtcggtcaggtacgtttccagttccttcttgacccgctgcaccagcttcttgccttccaccgggaagcaggtctcgacgcgcatgtcgaggttgcgctccatccagtcggcgctggagagatagagcttctcgtcgccgccgttgaggaagtagtagatgcggctgtgctcgaggaagcgcccgataatcgagcgcacgtggatattgtgcgagacccccgggatgcccggccgcaggcagcacatgccacgcaccaccaggtcgatcctgaccccggcctggctggccttgtacagggcgcggatgaccttcggatcggtcagcgagttgaccttggccatgatgtgcgcaggctggccgagcgccgcctgggccgcctcgcggttgatcatttccagcaggttcttcttcagggtgaacggcgcatgcaacagcttcttcatgcgcagcgtcttgcccatcccgatcagttggttgaacagcttgtgcaggtcctcgcagagcgccacgtcggcggtcagcaggctgtagtcggtgtacaggcgagcgttgccggcatggtagttgccggtgcccaggtgcgcgtagcggcgcagttcgccgtcctcgcgacggaggatcagcatcatcttggcgtgggtcttgaagccgaccacgccgtagatcaccaccgcgccggcctgttgcaggcggctggccagttgcaggttggactcttcgtcgaagcgggcgcgcagctcgatcaccgcggtgacctccttgccgttgcgtgccgcctcgaccagggcgtcgacgatctcagagttggcaccgctgcggtacagggtctgcttgatcgccagcacgttcggatccttggcggcctggcgcagcaggtcgatcaccggggtgaaggattcgaacgggtgcatcagcaacacgtcgagcttgctgaggacgttgaagaggttttccttcttctgcaaaagacgcgggatcgccggggtgaagggcgggtactgcagctccggatggctttccaggccggtgacgctgaacaggcgggtcaggttgaccgggccgctgaccttgtacaactcgctttcggacaggccgaactgcttgagcaggtagttggtcaggttctgcgggcaggtatccaccacctccaggcgtaccgcatccccgtagcgacgcgagaacagctcgccgcgcagcgcgcgggccaggtcctcgacatcctcggtgtccaccgacaggtcggcgttgcgggtcaggcggaactggtagcagcccttcaccttcatgccggggaacaggtcgtcggcgtgggcgtggatcatcgacgacaggaacacgtagttgtcaccctcgccgccaacgtcttccggcagcctgatgatccgtggcagcaggcgcggcgccgggatgatcgccaggccggagtcgcggccgaaggcatccatcccctccagctcgacgatgaagttgaggctcttgttcaccagcagcgggaacgggtgggtcgggtcgaggccgatcggggtgatgatcggcgcgatctcgtcgcggaagaagcgccgcacccaggtcttgatcttcagcgtccagtgacgccggcggatgaagcggatctggtgcttggccagctccggcaacagggtctcgttgaggatccggtactgccgcgacacctgctcgtggaccagctcgctgatccgcgccagtgcctggtgcggcagcaggccgtcggcgccggcctgctcgcgggcgaaggtgatctgcttcttcaggccggcgatgcggatctcgaagaattcgtcgaggttgctcgagaagatgaggaggaacttcagccgctccaggagcgggtaggactcgtccagcgcctgctccagcacgcggatgttgaactgcaactgggagagctcgcgatgaatgtacaggctgctgtcatccacgctgggaaccaccgcaggtggcgtttccaccgggatcgtttcggccatcttcacttctgcttcgctttccacgttcgccactacggtttcgtcggcggcgatacgttcgatctcatcaagtccttgctgcgtattcattcatcttcccgagggggtcaacgcccccgtcttaattgttctgcggcctgcttggcgaagtag

SEQ ID NO: 6021 - DNA, 1491 bp, Pseudomonas aeruginosa
tcgtgctgggcctgctgctctggctatggcggcgtttcaagacaccgcgcggcaacggcgcgggcggcaacgccgacaaatccgagtgaacccgcgccggcgcgactgaacagccggccccttcgcacactccaactccttgtaccctccgctccggctggccgccggggccggcggctcgctatgcttgcgcgataccgaccccggccaggcccgtccggtccggatcctgcgttcccaaggagtaagcctcatgcacaagaaagttgccgtcatcctctccggttgtggcgtctacgatggcgcggaaatccacgaaagcgtgatcaccctgctccgcctcagccagcgtggcgccgaggcacaatgcttcgcgccgaacatcgcccagcaccatgtggtcaaccacctgaccggcgaggaaatgccggaaagccgcaatgtcctggtcgagtccgcgcgtatcgcccgcggcgaagtcaaggacctgcgcgaagcccgcgccgaggactacgacgcgctgatcgtgcccggtggcttcggcgctgcgaagaacctcagcgactttgccatcaacggcgcgcaatgccaggtgcagccggacgtgctggcgctggccaaggctttcgccgaagccggcaagccagtcgggctgatctgcatcgctccggcgatggcggcgaagatctacggcgccggcgtccaatgcaccatcggcaacgacgccgacaccgccgacgcgctgaagcagatgggtgccgagcacatcgacgcgccggtggacgagatcgtcgaagacagcgcgcgcaagctggtgaccaccccggcctacatgctcgcccagtcgatagccgaagccgcttccgggatcaacaagctggtcgaccgggtgctcgaactggtggaccaggacaaggcctgatcggccaagcacgagggcggtcgcgccgccgcccttttcaaatccgtgccgctacgccagcgtgcgtctcgaaaccatcgagtcgagacgccgcgatgcgcgaaacgccctcccccgccctgcctgacgacgtccaccaactggtggcggatttcttccagcgcatccccttcaaccgcatgctcggcatccgcgtggtgagcctcggccgcgagcgggtagtcctcgacctgccgatgaaggacgaactgatcggcaacttcgttcagggcattctccacggcggggtgatctccagcctgctcgacgtcaccggcggagcgatggccctgatcggcgccctcgaacggcatcgcgaactgccaggccacgagcgcatggcgcggctgtcgaaactcggcaccatcgacttgcgcgtcgactacctgcgcccgggacgcggccggacgttcaccgcccatgcggtgccgcttcgctcgggcaacaaggtcgcagtggtgcgctcggaactgcatagcaacgacggcacgctggtcgccgtcggtaccggtacctatctgtgcggctga

SEQ ID NO: 6022 - DNA, 765 bp, Pseudomonas aeruginosa
atctccatggtgctcttgaacagcaggaacaggccgccgaagaagaggatcaggtcacgcccggagatgccctggccgaacaggtggaacaggtcggtggtcaggcgcatgacccaggtgatcgagagcaacagcaggatccgcgtgcccatggccagggccaggccgaagaagcgcgccttcggttgctgggccggcggcaggcgcccgaccaggatcgagatgaagatgatgttgtcgatgccgaggacgatttccagggcggtcagggtcaggaacgcgacccagatttcaggactggcgagccattccatagatggttatttcccgttttttgttggagttgaaaaacctggcccacgccagcgacgcacggctttctggaagaacaggctgttgggaatctgcagcagcgggcccggcgagccatcctcgagggtttcttccagtgtcgtatacaagagattgatggcaaccacgcgtccggtgacgcccggtttgtcggcgctatcgatcagctccacgcggtcgccgatgcggaacggcccgacggtgaagatcagcaacgcacagaacaggttggagagcacgctccagatggcgaagaaggctaccgccgccaccgcggcgaaaccggtcagcgcggtccacagcacttcggcggacacgcccaggcgctccagcaccatgatcagtgcgctgaccatgatcagccagcgcaggcccccacgcagcggcaggagcagctccggcggcaccggataa

SEQ ID NO: 6023 - DNA, 1806 bp, Pseudomonas aeruginosa
ggagtcggatcatggcggcggagtttatcagtttcgcccttgcggagcgtgaggctgtatgactggaaatgtctggaaattcgcggtggacgtctatgcccggccgggcgtggaaacggcttgcctcgcgcttcaggagcaaggtgcggacgtctgcctgttgctggtcgccgcctggcttggcaggcgcggtgtgagctgctcgaaagaacgcgcccagatcctggagaacgccgcgcgtccctggcgcgaaacggtcatcgaacccctgcgcagattgcgttgcgcctggcgcgaagcggcaacccacgacgcctgcctggccgaactccgcgaggaaatgaaggcccaggaactacgagcggaacgggaacacctgcaacgcctggccgacctggccacagcctggctggagggccaggaagcgaatcgcagtgcggatgcctggctgcaagcctgcagccgggacatctgcacggaagcagagcgccgggctttgctggtgcttggctcggcggctttgcagacagcgccttaggaggcgctggtcggggcggcgccgttgctgcccgcggcaggcgttgccgaagcagcgctggaggcggctgccggggcgctgggagtcgccgcaggcttcgcagcaggagcggtggcgggcttggttgcggcaggtttcgcggctacgggtttcgccgcaggcttggccgccggtttcgccgcaggcttcgcagccggcttggctgcaggcttcgcggccgcggatttcgccacaggcttggccgccggtttcgccgcaggcttcgcagctggcttggctgcgggcttcgcggctgcggttttcgccgcgggcttggccgtcggtttcgcgacaggcttcgctgccggcttggcggcgggcttcgcggctgcggttttcgccgcaggcttggccgccggtttcgccacaggcttcgccgccggcttggctgcgggcttcgcggctgcggttttcgccgcgggcttggccgccggtttcgcagcaggcttcgccgtcggcttggctgcgggcttcgctgccgcggttttcgccgcaggcttggccgccggtttcgcagcaggcttcgcagccggcttggccgcaggcttcgccgctacggttttcaccgcaggcttggctgccgccttcgcagcaggtttggtcgcgggtttcgccttgcggctctccagagccttgccagcagcttccttcaccttgccgacaccctgcgccagcttgaggctttcctgtacgtcacgcttgaggccgacgatgtaggtacgggtgtccgcctgccgggccttcagggtatccaacgcctcttccaggtcgctgatggtctcgcgcgccttggcctgtgccttggtcttgccggccttggcagcatcctgcagcttggtgcgagccttgtgcagcttttcctgggctttgccacgttgcttttcaagtttggccaggagcttttccgaatcgaccagcgcttgtttgcacgcaccttccaggtgctcgacaaggctgtgggaaagttgctgcaacaggtgcaagggggtggtgacgggcttcttgttggccgacatgacgtgcctccaggcggacgtggttgcgcccatactagacccgcacaccccctctcgccaacgggttcgatgtgctacaagcgacgtgcgccaggattgcccgccgattcgtttggagaaaccgcatgccgcgccgccttttcatcggtctttttctactgccgctgccgcttttcgccgcgcctcccaaggacgaactggcctatgccgtag

SEQ ID NO: 6024 - DNA, 648 bp, Pseudomonas aeruginosa
cgactcgccggtgaatcagaccggtactgccgaaccctctgcgccgctctggctgtgggcgttgtgcaggacttcgatgaggcagtcctccagctcgaagcgttcgtgcaactgttgccgcaggaccttcagctccgcgatgaggcaggctccttcacggcaatcgccgttgtcgcagcggtcgttgaagttcagcgcggattcggtgatggcttccagccgggggaagatctgcttggccagctccaggccgcgctgatcgccgaaggccttgccttccgccgtcagttgctcgtagacctcgaagtgtccggcagatacatagtccagcagcaattggcagaaatgctggagttcttcggcgttgggcgccggtgcctgaataccgctcagggcatcgaaggcctgcaccagttgctggcgctcatgcagccagcgatcgatcagttggtgcacacccccccaccgctcttgggcattacggcagctttcgagcatgttgtcctcgcttccctcttcggacgtcccggagaatcatcgtccgctccgagacgcattgctgacgcactctctgcgctctgtgggagaacgcctgtgcaaggggcggactccggcgctatggaaagccagattatgcccccgggatga

SEQ ID NO: 6025 - DNA, 708 bp, Pseudomonas aeruginosa
agtgccgggcttcgccaggctggcccggaacaggtcggacaggtccagcaccgcatgctcggccttcagcgggtccagctcgatcaggctggcgatgctgttcaggctgttgaacaggaagtgcgggcgaatccgcgcctgcagcgattccaggcgcgcctgcaactcggcctgctgctgccggcgccactggctctgcaggtaaaagtagcgcagcaccagggcggacatgatcagcgcgatcagcgcgtgccgcagatacagattgacctcgccggcacgcgtcagttctccgcccagctgatagtgctcggcgaccgccgtgcagcccagggtgagggccaccaccaacaggcagcaggcactccccgccagcgccaccggcaggcgtgcgagcaatggccgcaggcggcagaacagcgccgccgagagcagtacgatccactgcacgaacagcgacgccagggccaggcgcacccagttgaagctcggcgtcatcggctccgccagcaccagcacgagcaccagcagctccgccagcagcaccagggtgaacagggcttcggcttcgcagagctcgggaatgaagaagtcgtcttggacggccggccgggtcgagcggccgggcttgaatcggataggcatcgacagagtttccgcaaggcccgtggcgcccgcaagacagccgcgggcgtacgggcgaaataa

SEQ ID NO: 6026 - DNA, 651 bp, Pseudomonas aeruginosa
ccacggcgctatgggtcatcgagggcacgacggccagcaaggctggccccgtgcggcggtcgcggctcagccggcgaccggggagcgccagtcgtcggagccggaggtgccggagacttcgtgggtccaggtgatcttgcggtaggtgaagtgcacgtcttccaggtgggtgaagtgggcgttgcccgggtcctggcagttgtgcatgtagtccttgatgtcgacgatgatcgcgtcttccaggacggtggtgtagtagtgctcctgggtgccggcggcggaggtgcggtaccactggatctcgaccttggtcaggcgctcgccggaggtcagggcggccagcagcagcggcgaggccttgtcgaagaccttggtgatgaccaccggcttgtgcacgcgctggccggtcggctggccggactgcgggtcgcgcgggatgatcacttcgtggttgaagccctggaccatcacctggtcctcgtggccttcctggtaggtgttgccgaccgaatcctcggtgaaggcgccggcggtgatcaggccctgcttggtgccggtgatggacatataggcgggggttgccatggatgctctccttgcgtgagtaggaaatcccgcgggttggaccacccctcgggcaacttcacctaa

SEQ ID NO: 6027 - DNA, 186 bp, Pseudomonas aeruginosa
tgtccaggccagtattttcaagggctgtgggctgttattggggatgtttcttggttttcattgtgcaacttcttgcacaatcgctattacgctctaaatcagctgttggtccgcttggaaggcctatgtttcgaggctctccagaggaatccactgttgcctgccttattttttataaatttttaa

SEQ ID NO: 6028 - DNA, 1293 bp, Pseudomonas aeruginosa
ctggttgaaaatcctggaaaacagcgaagcgctgcttcgtgcccaatccaaggacctgcgtgttgcagcctggttgacctgggccctctaccaacgggaatcctttcccggtttgctggccggactgggattgctggaacgtctgtgcagccggcattgggtcgagatccatccgctcaaggcgcgcactcgcgccgcggccattgcctggctggtgccccggctggagcaggcgctgaacgagaacgtaccgatcaaggagcaactccccctgttccggcgtctcgccgagcacctggaaaaactcgataccgcgctgaccgcgcaactgggcgacgacgcgcccttgttgctgccgatcagtcgacgcctttcgggcatgctccagcgcgccgccgacaaccagcccgaacctggcgtggtcggcgccgtggtggcccaggtcaagcaggcggccagccagttgctggcgcctggtgcgcccatcgacaacgagcgcgacgcccacaaggccatgcgcgcccagcaggaggctgcacgccccctgtgcgcctggtggctgaagcagaaagccaccgatctgcgcgcgctgcgcctcaaccgaacgatgctctggctgcccatcgagtccatgcccgagcgcaatgccgaacaggtcaccgcgctaaggggagtgccggcggacaagctgaaaagctaccaggagcgtttcgcccagggcctgtacgccgatctcctggtggagctggaggcgagcctggcacgggcgccgttctggttcgacggccagcgcctggtctgggagtgcctgcaagggctcaacgccgagcaggcgatgcgggaagtcgaaatgcatttcgccttgctcctgcagcgtctgccggggctggtggagctgcgtttccacgatggcagcgcattcgccgatgcggccacccgcggctggatcagcgcccatgtcatgccccatctccagaacgacagtgcgccgcgcaaggtcgagaccgtggccctgcaggccgaatgggacgtcgccctggacgaggtccagccggtgttgcgcaaggacggcctgaaggcggcggtacaggtgttgaagcagggcatgaagcgcgcccacggcggacgcgcccggttcttctggcaactgagcctcgcgcgactgtgcttcctggcgaagaagtacgagctggccaagacccagctggagagcctcgaccatcagttgcacgaatcgggattgcacgcctgggagcccgatctggcgctggatgtactgcacctgctgcatag

SEQ ID NO: 6029 - DNA, 642 bp, Pseudomonas aeruginosa
ctgctgcgagctgttgccgcagaaccacgccgtgcgagaacgcaaggaagacatttatcgcaggctgtgccacctcgatctcgaggtggtgctcgaatagggcttcgcgccctcaattctcaaggagaaaaagccatggccaaagaaggctcggtagccccaaaggaacgcatcaacgtcaccttcaagcccgccaccggcggtgcccaggaggaaatcgaactgccgttgaagctactggcgatcggcgattacacccagcgcggggatgagcgcaaggtggaggaccgcaagccgatcggcatcgacaagatgaccttcgacgaggtcctggccaagcaggagctggggctgacgctgagcgtacccaatcgtctccaggaggagggcggcagcgacgagctggcggtggggctgcagatcaactcgatgaaggacttcaacccggccagcatcgtcgagcaggtgcccgagctgaagaagctgatggagttgcgcgatgcgttggtggccctcaagggcccgctgggcaacgccccggcgttccgcaaggccatcgaaagcgtactcgccgacgacgagtcccgtagccgtgtgctgggcgagctggggctgagcgccgccccctcccaggacgcctga

SEQ ID NO: 6030 - DNA, 1380 bp, Pseudomonas aeruginosa
ccaaggaagcagatacatgagcaccagtgccgcacagcaaggccggaaccagaacggcgaatacaacattctcgacagcatcatcgccgagacccgcctgagcccggacgacgaggcctacgacatcgccaagcgcggcgtctccgccttcatcgaggaattgctcaagccgcagaacgacggcgagccggtgaagaaggcgatggtcgaccggatgatcgccgagatcgacgccaagctcagcacgcagatggacgagattctccatcatcccgatttccaggcgctggagtcggcctggcgcggcctgcaactgctggtcgaccgcaccaacttccgcgagaacatcaagatcgagattctcagcgtttccaagcaggacctgctggacgatttcgaggactcgcccgaggtgatgcagtccggcctgtacaagcacatctacaccgccgaatacggccagttcggtggccagccggtcggcgccatcatcgccaactactacatgtcgcccagttcgcccgacgtcaagctgatgcaatacgtctccagcgtggcctgcatggcccatgcgccattcgtggcggccgccggtccgaagttcttcggcctggaaagcttcaccggcctgccggacctgaaggacctgaaggatcatttcgaaggcccgcagttcgccaagtggcagagcttccgccagtccgaggattcccgctacgtggcgctgaccgtaccgcgcttcctgctgcgcacgccctacgatccggaagagaatccggtcaagtcgttcgcctacaaggagaccgtggccaacagccacgagcattacctgtggggcaacaccgcctatgccttcggcaccaagctgaccgacagcttcgccaagtatcgctggtgcccgaacatcatcgggccgcagagcggcggtgcggtagaggacctgccgttgcaccacttcgagagcatgggcgagatcgagaccaagatccccaccgaggtgctggtgtccgatcgccgcgagtacgaactggccgaggaaggcttcatttccctgaccatgcgcaagggcagcgacaacgccgcgttcttctccgccagctcggtgcagaagccgaagttcttcggcatcagcgccgaaggcaaggccgcggagctgaactacaagctcggcacccagttgccgtacatgatgatcgtcaaccgcctggcccattacctgaaggtcctgcaacgcgaacagctggggtcgtggaaggagcgtaccgacctcgagctggagctgaacaagtggatccgccagtacgtcgccgaccaggaaaaccccagcgccgaagtgcgcggccgtcgcccgctgcgcgctgcacagatcatcgtcagtga

SEQ ID NO: 6031 - DNA, 720 bp, Pseudomonas aeruginosa
cccggccctggccccgtttctcgggcaggtcggacgcgatccggatgtcgagcgcctgctcgagggctttgccttcctgaccgggcggttgcggcagaagctggacgacgagttgccggaactcagccactcgatgatgcacctgctgtggccgaactatatgcgcccgctgccggctttcagcattctccagttcgaccccctgacccgcccgggcggggcgctgcgcgtggagcgcgatacgccggtcgagagccggccggtgggcgaggtcgcctgtcgcttccgtacctgctacgccaccgaagtcctgccgctggtgctggaggcgctcaactattcggtgaccggcgagggtgcgctgctcggcctgcgcctggcgatgaactgcgacgggcatctcggcgagctgggcctgagtcggctgcgcctgcacctggccggcgagcgctacatcagccagatgctctacctgtgcctgctgcgcaacctggagagcatccagctgattccgctggatgcccatgggcggccgctggatggcgtggccggcaagccgatgtcgttccgcctgacgggcgagcgggtgcagccggtggggttcgccgaagacgaggcgttgattccctatccgctgaataccttccgtggctatcgctacctgcaggaatacttcgcgttccaggacaagttcctgttcgtcgacgtggatggccttga

SEQ ID NO: 6032 - DNA, 1965 bp, Pseudomonas aeruginosa
cctgctcggcgctctgcccgaggaaaccctcaagcaggtccgcggcctcgagttgcgcttcgatatccgcaagagcggcatccagcgcctgcacccgacgctggagaacgtcaagctgtactgtacgccggtggccaacctgttccgccacgatgcgctgccgatccgcctcgacggcaagcaggacgagtacctgctgatgccggccgaatacagcctggaggactgcggggtgttctcggtagagggcgtcaccggctggcggccgggcgggctcggctaccaggcctatgtgccgttcgagtccttcgagcacgatcccagcttcgacgtcccggaagcacggccccactacagcgtccggcaacggacctcgttgctgcacgatggcctggacacctacctgagcttcggcatccgccatcccgagcagatcgagacgctgtcggtggaactgacctgcaccaaccagaacctgccccaacggctgcgcctgggcgatatctgcgtcgcttgcgaaggtacgccggagttcctcggtttccgcaatatcaccccggcgacgccgagctacgcgccgccgctgaaccgcgatttcctctggaaactgatcagcaacatgtcgctcaactacctgtcgctggccaacgtcgacgcactcaaggtgatcctcgaaacctacgacctgccgcgctactacgaccagcatgcggcgaaggtcagcaagcgcctgctgggcgggctcaaggcggtccgccacgagcatgtcgaccgcctgcatcggggcctgccgctgcgcggcttgcgtaccgagctgacgatcgatccggaaggctacatcggcgagggcgacctgttcgtgttcgcttcggttctgaacgaatttttcgcgctttacgccagcatcaactcctaccacgagttgcgggtgaggagcacacagggagacgtgtaccaatggaaaccgcgcatgggtttgcagcccctgctgtaagcgcgctggcccggggcattcgcgagtactcgctgttccaggcggtcctgctggtcatggatcgcctgcgccaggaacatcccggcctgggagacgaggcgctctacgatcagttggaattccaggccaatcctagcctcggcttcccgggcagcgatgtcgatcgggtggagttcttcgaagagcgcggcatgctgcgggcgcggctgcgtttcaacctgatcggcttgttcggtgccagttcgccgttgccggcgttctacagcgagcaggctctgggcgacagcgaggagggcaatcctacgcggaacttcctcgatctcttccatcaccgcctgcatcggctgctgttgccgatctggcgcaagtaccgctaccgggtgagcttccagagcggcgcgagcgatgcgttttccgcccaattgttcgccctcgtcggattgggcggggaagagatccgcaaggccagggaactgaactggaaacgcctgctgccctacctgggcctgctcagcctgcgggcgcactcggcggccttgatcgagtcggtgctgcgctactacttcaagcatgccgaactggtcgccgagcagtgtatcgaacggcgcgtcgcgatcctcgaagagcagcgcaaccggctcggcctgttcaacagccagcttggcgaagacgcggtgctgggcgaacgggtccgcgaccgcagcggcaagttccgcattcatatccgccagctcgactggcagcgcttccacgagttcctgccgatcggtcccggctaccagccgctttgcgcgctggttcgcttcaccctgcgcgacccgctcgactacgacatccggctggtcttgcgccacgaggaaatccgtgagttccgcatcggcgcgcagaacgcctgccgccttggctggaccagctggctgggccgggagcgcgcggatggcgtggtgacgctgggcagcaagattcattaa

SEQ ID NO: 6033 - DNA, 2640 bp, Pseudomonas aeruginosa
ggatggatgagcatgatcaacgtagacctgcaacaactgattcaggcgctggatgccgacacccggcgcgacctcgaaggctcggccgagcgctgcgtagcccgtggtggcagcaaggtactggtggaggacctgttgctgggcctgctggagcgtccccagggactgctggcgcgcgccctgcaggatgccgcggtggacgccggcgaactcaacgccgcgttgcaagcgcggggcgagcatagtgcctcgcgcaatccggtgttcgcgcccgagctggtgcagtggctgcaggatgcgctgttgctggccaacctcgaactgggccgtagccagatcgaccaggcggcattgatcctggccctgctacgcaacccgttgcgctatgccggcagccgctaccagccgctgctggcgcggctcgacatcgagcggttgaaggatttcgcgctctcgcagccgctggagggcgcgcccagcggcaagccgggcggcggcgagtccctgttgcagcgtttcacccacaaccttacccagcaggcgcgcgacggcaagctcgatccggtgctctgtcgcgacggggctattcgccagatggtcgacatcctggcccgtcggcggaaaaacaaccccatcgtggtcggcgaggccggcgtcggcaagaccgccatcgtcgaaggcctggcctcgcggatcgccgcaggggaagtgccgccggcgctgagggacgtcgagctgttgtccctcgacatgggcctgttgcaggccggtgccagcgtgaagggcgagttcgagcggcgcctgaaaggcgtcatcgacgaagtgaaggcagcgctcaggccgaccatcctgttcatcgacgaggcccatacgcttatcggcgcgggcggtcaggccggcggctcggatgccgccaacctgctaaagccggccctggcacgtggcgagttgcgcaccatcgcggcgacgacctgggccgaatacaagaagtatttcgagaaggacccggcgctggcccggcgcttccagcccgtgcagttgcatgagccgagcgttgccgaggcggtgacgatcctgcgtggcctggcccgggtttacgaggaaagccacggtatctacttgcgcgacgacgcggtggtggccgccgccgaactgtccgcccgctacctggcgggtcgccagttgccggacaaggccgtcgacgtcctcgacaccgcctgtgcgcgggtgcgcatcagcctggcggcggcgccggagagtctcgagcgcctgcgcggcgagctggccgaaggcgagcgccagcgccaggccctgcgccgcgatgccgaggcaggcctgccgatcgaccacgatgccctgcaggcgctggaggagcgcctggcccaggcggaaagcgagcggcacgtacaggaggaccagtggagccgccagcgcgaactcgccgagcgcctgctcgccctgcgccagcaattggccagggcccgcgaggcgaaccgggaagagcagggcggcgaggcgaacgcggagactttcccggccgacgagcatggcggtgtcgaagccctggaaaaggcccttcacgaaacccgccaggcactcgccgatgcccaggcccaggggcggctggtcagcttcgaggtctgcccgcgcctggttgccgaggtgatcggcgcctggaccggcgtaccggtggaacaactggcgcgggaacacaacgccaaggtgatggggttcgctgacgacctgcgggcgcggatccgtggccaggaacaggcggtcagcgccctggaccgcgcgatgcgcgccaccgcggccgggctgaacaagcccgatgcgccggtcggcgtgtttctgctggtgggcccgagcggggtgggcaagaccgagaccgcgctggcgctggccgacctgctgtatggcggcgagcgtttcatcaccaccatcaacatgtccgagttccaggagaagcacaccgtctcgcgcctgatcggcgcgccgcccggctatgtcggctatggcgagggtggcatgctcaccgaggcggtacgccagaagccctattcggtgatattgctggacgaggtggagaaggccgatccggacgtgctcaacctgttctaccagatcttcgacaagggcgtggccaacgatggcgaagggcgcgagatcgatttccgcaataccttgatcctgatgacctccaacctcgccagcgagcacatcgccgcgctttgccaggacggcgcgcggccttccgccgaactcctggaggaaaccatccggccggcgctcagccggcatttcaagccggcgctgctggcgcgcatgcgcgtggtgccttactacccggtgggcggcccggtactgcgcgagctgatcgagatcaagctgcaacgcctcggcgagcgcctggcgcgccgtcaactggctttcgactacagccaggcgctggtgggccacctggccgagcgttgcacccagagcgacagcggcgcacggttgatcgaccacctgctggacacgcacctgctgccgctggtggccgaccgtttgctggaagcgatggcgcgcgacgagcgtctcgagcgggtccatgcgacgctgggcgagcacggccgcgtgctctgcgagttcgcctga

SEQ ID NO: 6034 - DNA, 645 bp, Pseudomonas aeruginosa
ggccggggcgcgtgcggactacgcgcggatcgacatggaaagcctggtcgtaccggagctggtgcccgccccggcggctccgcaggaacccgtggaaagtccgcctccggaacgcgacgaagccttctggcagcgtttcggccaggctctgggaatggacctcgaaggcctcgacggcgctgcgcgcgaagcgctggcgatcaacgccgccggtttgctgcggcagtgcatcggcggcttgcagcagagcctgcggacccgcagcgaactgaagaacgaactgcgcctgtcgctgagcacgttgcgcgataccggcaagaatcccttgcgcttcagcgccgatgccggcgaggcgctggggcatctgctacgggatggcaagcctggccagttgagtggcgaacaggccgtcgcacgcagtttccgcgacctccaggcgcaccaggtggcgctgctcggcgccagccgggcggcggtgcgcgcgaccctcgagcatttctcgccgcagcagctgaccctgcgtttcgagcgcgacggccgccggccgttgctggccacctcgggcagccgctggcgtgcctatggtcgctaccaccagtcgctatgccaggacgacgactggagcgagcgcctgctggcacgtga

SEQ ID NO: 6035 - DNA, 579 bp, Pseudomonas aeruginosa
tttcgcccaggcctacgaagagcaggttcgcctgatttccaccctctacaccgagcaccaaggatgatcgccatgtctcgtcgcccgattccgccagccagggcgctggccatgctcgccgtcctggcgctgctggccggctgttccacgctgtcgccgtattccagactgaccaagctcgacctcgccctgagcgccggcgagcgggtcaatcccgacctcaatggccggccgtcgccggtggtagtgcggctgttcgagctgaagcacccggtggcgttcgagaacgccgacttcttcagcctctacgaacgtcccaaggagaccctggaccccgacctggtgaccagcgaggagctggagctgcggcccggcgagcgggtcgaactcaagctcagcgtggaggaggggagccgctacgtgggcgtgctcgccgcctaccgcgatctcggcgaggcaagctggcgctacgtggtgccggtcacggcgaaagagctgacccgggtagagctgaagctgggccggaagggcatcctgaatgccggcgaactgctcggcaaggcgggtgacgcgcgatga

SEQ ID NO: 6036 - DNA, 798 bp, Pseudomonas aeruginosa
cgagcgctggcgcaacgagctgccctggtacctgctgatcggcccgcagggaagcggcaagaccagcctgctggacttttccggactggagttcccgatcaaccggatcgaccgcaagctgacccgcgataccgccggcacgcgctactgcgactggtacttcgccgaccacggcgtcctgatcgacaccgccgggcgctacctgacccaagccgacggcgaggtcgacgggggcgcctgggcgactctgctcggcctgttgcgcaagcgccgccgcgcacggccgctgaatggcgtgatggtgtcgattccggtggaaacgttgctcagcgacgacgagatggcgctggatacgctggctcgccaggtgcgcgcgcgcctgcaggaaatccagcagaccctgcacctcgatctgccggtctacctggtgctgagcaaggccgaccagttgctcggcttcgacgagttcttcgaccagttgagccgcgaggagagcgaccaggttctgggcaccagcttcggcaaggagcagaacggcacagatgtgacggtcctgcgccaggcgttcgaggaccttctgcgacgcctgaacagccaggtgatcatgcgcatccaccaggagcgcgataccctgcgtcgcggtcgcatcctcgacttcccgcaccagcttggccagatcggcgagcggttgtgcctgttcgtcgaactcgccttcaccggcaaccgctaccagcgcgccagccgcctgcgcggcttctacctgaccagcgcgccgcacctggcccagcagctggatga

SEQ ID NO: 6037 - DNA, 378 bp, Pseudomonas aeruginosa
gcaacctgcgcaacgcctccgcgcgactgccgcgaccgctcggcggatggttcagcgtgctggccgaagacgcctggcggctggtcctcggcgatgcctacctgtacctcaaccagcgctaccagagcgagctgtacggtttctacagcaaggcgatcaacaagcgctacccgttcaacgcgcacagcgccagcgatgtcgcggtcagcgatttccgcgagttcttcaaggcgcagggcgtcgccgaacgcttcttcgaaacctacatgcggcccttcgtcagcggcgacccgggcagttaccgcctgcgcagcgtggacggttacagcctgccgatgtccaaggtctatctcgaccagatgggcacggcccaggtga

SEQ ID NO: 6038 - DNA, 1152 bp, Pseudomonas aeruginosa
tgtcttcctgctctgcagcgacgggctctacgaagagctgagcgccgatgcgctgggtcgcgcgttgagcctggcatcgccgcaggtggcggtggagcggctgttcgacggtgccctgagcggcgccgcacgggacaacctgacggccgtggtgatccgccaatgaacgaaccgctgtcgtcgctggagctgctgccggaggaggagggcggcgcgaacctgacctatttcgccttcgccgccccgaccgcctcggcgccggacctgccggcggtgttgcccggtccgctgccggacgttctttccgggcgctaccgtctggagcggatgctcggcgccggcggcatggggacggtctaccgtgcccgggacctgctccatgagcagttcggcgacccggcgccgctggtagcgctgaagctgctcaacgagtcggtcgccgagtcacccgacgccagcgccttgctctatagcgagttcgccctgacccggcgcttgcgccatccgaacgtcgtgcgtctgttcaccttcgacgtcgacaccgcatgccagcgcgcctacatcgtcatggaactcatgcctggcctgccgctcgaccgcctgctctgcgagcgtcccgaaggcctgccctggtccgagctgagcgcgatcgcccggccgttgctggatgttctggcctacgtccacgaacaaggagtactgcatggcgacctgaagccgagcaacgtgatgctcggcgaagagggcgtgcggctcttcgacttcggcctcggccaggcgcaggcaggcatcctggatggcctgccgcagctcagccggggccgcatcgacgcctggactccgggctacgccgctcccgaactgctcgagggcgcgccattgtcgccggcggccgacctgtatgcgctggcctgcgtcctctacgaactggccgacggtcgccatccgttccgccgcctgccctcgaaccaggcccgggagcaggggctggagcgccagctgcgcgcgcccggacacctgcctcggcgctgctggccggcgctgcgtaccgccctgagcctcgaccccgaacggcgctgcatcggcgtccgcgaattgcaggaagcgctgggcgcgcggcgttcctggctggccggcgttcttgcccgttga

SEQ ID NO: 6039 - DNA, 750 bp, Pseudomonas aeruginosa
agcgcttcttcggctgatcgccggggaaggaaacgcaaaaccggcccagtggggccggttctttcgccagcggacctggcctcagcggatcaggctgaggaattcgctgcgggtggcggcgttgtcgcggaattcgccgagcatcaccgaagtgaccatggacgagttctgcttttccacgccgcgcatcatcatgcacatgtgctgggcctggatcaccaccgcgacgccgagggcgccggtgacctgctggaccgcctcggcgatctgccggctcatgttctcctggatctgcaggcggcgggcgtacatgtcgacgatccgcgcgaccttcgacaggccgagcaccttgccgttcgggatataggccacgtgggccttgccgatgaagggcagcaggtggtgctcgcagagcgagtacagctcgatgtccttgaccaataccatttcgctgttgtcggagctgaacagggcaccgttgacgacttcttccaggctctgttggtagccgcggcacaggtacttcatggccttggcggcacgcttgggcgtgtccagcagaccttcgcggttaacgtcctcgccgagctgggtgaggatcgaggagtagtgttgttccagggacatgggcgttccagtcagacgattaccagcgcggagggtaggacgtcgccgggccgctggcaagactcggcgcttgccggctactcgtcgcggccttcgagcatggtcctgcgcagcatcacgtag

SEQ ID NO: 6040 - DNA, 786 bp, Pseudomonas aeruginosa
cctgaactcacgcgagcggaacgccgcgccgttgtccgtcagcagtcgctgcacggtgatgcccaggcgggcgtaataggccacggcattgcgcaggaacaggaccgcctgcgccgtcttctcatcgggatgcatggcggtgaacgccaaccttgcgtgatcatcgatggccacgaacagcgtctcccagcctgcaccatcgaccgagtcgcgacggttgcctgtgacgcggtggctgggccgcacgatgcgcccgagcttcttggtgtcgatgtgcagcaggtccccgggcgcctcgtgctcgtagcgcacaacggcttcgacgggctccaggtcgctcaacctggacatgcccgctcgcgccagaacgcggctgaccgtggactccgagacgcccacactgcgtgcgatgcgagcctgcagcattcgacgtttgcgcagctcgacgatgagcaaagccttgcccgcatcgatggccctgggcgatcgcagcggcctggaagaggcatcggccaaggcggcttggccaccggccaggtaacgaccgagccacttcctggccgttggcgcagtgacgccgtgcgcggctgcggctcgcacggcatccaagccttccagcgtcatctgcttgaccatctcgagtcggcgggcaaaggtaagtcgggcatgcttatgggtgttcatccggttgggcgtcctgagtggattgggtgtttggcgacttccagtctctcaaacccaatccggatgaacaccggatacaacctattggagcttcacacctag

SEQ ID NO: 6041 - DNA, 474 bp, Pseudomonas aeruginosa
gcaacgcggcgccggctgaggtcagaaggaacagggggcgcgtcgatgcgcccctttcatgaccaagggagacaccgcatgactcacccgcttcgcctgctctggctgtgctcggcactgttcgtggtcctcggcctgggcttcgtcttcttccccggcccgctcgcctccctgctcaccagcggcgaaccgctcacccccgccgccctcaccgacctgcgcgccagctacggcggcaccagcttcggcatcggcctgctgctcggctatgccgccctgcgcccccgctacctggtgctcggcctgctcgccgccctggcggtgatcgccagcggcggcgcggcgcgtctctacggtgtgctgatcgacgcctcgccggcgctaaccaccttcctctggctcggcgccgaggcgctgctctgcgtgctgttgctggcggcactctggaagacccgccagctcgacctcgactga

SEQ ID NO: 6042 - DNA, 1836 bp, Pseudomonas aeruginosa
tgtggtacgcatgaaaacaccacacaccctcatcctgctccgccaacacgcctgcctgtgcctggtcagcccgcgactgcgtggctgagcgacgcttctcttcatctcgtcactgcgttcgcctggccccgccggcccaggaaccgactccaaaggattagccccatgagcatgttgaaagacccttcgcagaaataccgcccattcccggccatcaatctgcccgaccgcacctggccgtcgaagaccatcaccgaggtgccgatctggtgcagttccgacctgcgcgacggcaaccagtcgctgatcgaaccgatggacgcggcgaagaagatgcgattcttcaagaccctggtgcaggtcggcctgaagcagatcgaagtggccttcccgtcggcttccgataccgacttcaacttcgtccgcgagttgatcgaaggcaaccacatcccggacgacgtcaccatccaggtgctgacccaggcccgcgaagacctgatcacccgcaccttcgaatccctgcgcggggcgaagaaggccatcgtccacgtctacaacgccaccgccccgtcgttccgccgcatcgtcttcaaccaggacaagcagggcgtcgtggacatcgccaccaacgccgcgaaactgatcaagaagctggccgccgagcaaccggatacccagtggtcgttccagtactcgccggaaatcttcagctctaccgagctggagttctcggtggaggtctgcaacgcggtgatcgacgtctggcaaccgaccccggacaacaagatcatcctcaacctgccggccaccgtggagtgcgccacgccgaacgtctacgccgaccagatcgaatggttcggccgccacgtcgacaagcgtgacagcgtgatcatcagcctgcacacccacaacgaccgtggcaccggcgtggccgccaccgagctgggcctgatggccggcgccgaccgcgtcgaaggttgcctgttcggcaacggcgagcgcaccggcaacgtcgacctggtgaccctggccttgaacatgtacacccagggcctgcatccgcaactggacttctccgacatcgacgcggtgcgcaaggtggtcgaagagtgcaaccagttgccggtccacccgcgccatccatatgtcggcgacctggtccataccgctttctccggctcgcaccaggatgccattcgcaagggcttcgcccagcagaaggaagacgcgatctgggaagtgccgtacctgccgatcgatccggccgacatcggccgcgactacgaagcggtgatccgggtcaacagccagtccggcaagggcggcatcaccttcctgctcgaacaggagtacggcatcagcctgccgcggcgcatgcagatcgagttcagccaggtagtgcaaggcgagaccgaccgtctcggcctggaaatgaccgcacaacagatctactcgctgctggaaaacgaatacctcaaggcgacctcgccctacgtcctcgccagccatcgcctgcaggaagagaacggcaccagcgccgtcgacctggaagtctccttcgacggcgagaagcagcactggcgcgggatcggcaagggaccgctggaagccttggtggccgccctgccggtcaaggcggaaatcatggactaccatgagcacgccatcggcgccggcgccaatgccaaggccgcggcctatatcgagatccgcctggagggccagcgcccgctgcacggcatcggcatcgacgagaacatcaccaccgccagcttccgcgccctgttcagcgcgctgaaccgcgcggtgacccaggccgaggccaaggcggcctga

SEQ ID NO: 6043 - DNA, 1377 bp, Pseudomonas aeruginosa
ccgtcgccgaagacccgggaaatgtccgccgccgacaccgactggttcggcccaccgccgatccaggaattcagggcatcacccaggcctgcgttctggagcatctggaacaacccgccgagtccgcccagtgagccggcctccacgcccggcgccgcctgcccggcaccgcccgcggcgccaccgagcagatcgccgaggacgccacccagcccgccgctcgcggccccgccgccggcaccaccaaggatgctgcccagcgaaccgagcagaccaccgccatcgccaccgccctgtgccgcaccgcccctggcgcgacctcagcatggtcaccagcccgatcaacaggggccactttcggatcgcgagcacctccctgtccttcagagccacccagcgccgaaccgagaatcgaatcgagccagtcccattggtcttcctcctgatctgatgcccacggcgcggcgccgcgggatacgggtaactccattcccggcactgcgccatcatgcgcagcgccgggtcatggcctcggacatcgaccggaagcggacgttccggcactcaaggatggatttcgaagcgatccgcgtccatgtaggccgggaaacgctggcgataggccgccagtgccgccgcgtccagccggacgcggaacacgccgtcggcgtccgccgcgttgaacaggctgtcgccctggaagtccaggacctggctatccccagcgtagcgcaaggcgttgccgtcttcgccgatacggttcaccgccaccacgtagcaaaggttctcgatcgcccgcgccggcagcaggcggttccagtgctgtcgacgaggcgcgggccagttggcggtgtagagcaacaggtcggtgtcgtgcgggtcgcggctccacaccgggaaacgcaggtcgtagcagatcagcgggcgcacccgccagcccttgagttcgaacagttcctggcgttcgccgggactgtagtgctcgtgttcgccggccatgcggaacagatggcgcttgtcgtagtgcagcatctcgccgtccggacgcgcccagagcaggcggttgcgatggctgccgtcggcgagctggacgatcaggctgccggtgaccaccgcgccaaggcgccgggcctgctccagcagccaggcatgggtcggccccagttcgggctcggcctgctcggccgaagccatgctgaaacccgtggtgaacatctccgggaggaccaccagatcggcgccggcggcactctccagcagggcggcgaaatgctcgcggttggcctgggcgtcgtgccagaccagggaggattggaccagggcgatgtccaggtccggcagaaccgtcagatcgcgcatagcttttccgctgcctga

SEQ ID NO: 6044 - DNA, 1695 bp, Pseudomonas aeruginosa
ccacctcgcgatcattcgtcgccacgacagggaatcggcggtcaacgccggcggcctggttcgtcccgcgggctacagccgcggccaatgaaaaaggcccgacaaggatccctgccgggcctttcgacgaaggaaacgccaccctcagcggcgcttgtccttcttcttcttctcggctttcttgtggtgcgacatcagccggcgcttcttgttgacctggcgcgcggtgagcgagttcttcttgccctcgtaggggttctcgccgcccttgtactcgatgcggatcggcgtaccgaccagcttcaatacccgccggtaggtcttctccaggtagcgggtataggccttcggcaccgcgtccacctggttgccgtggatcacgatcagcggcggattggcgccgcccaggtgggcgtagcgcagcttgatccggcgaccgttgaccatcggcggctggtgcacctgcacggcgtcctcgaggatgctggtcaggcggctggtcggccagcgggtcaccgccgaacggaaggactcctggaccgacttgtagagatggccgacgccggtgccatgcagggccgaaatgaaatggatgtcggcgaagtcgacgaacagcaggcgccgctccagttcggtcttcacgtagtcacgctcggccgcctccatgccatcccatttgttcagggcgatgaccagggcacggccggtctcgaggacgaagccgagcaggttgaggtcgtgctcgaccaccccttcgcgggcgtccatgacgaagatcaccacgttggcgtcctggatcgcctggagggtcttcaccaccgagaacttttccaccgcctcgaagatcttgccgcgacgccgcacgccagcggtgtcgatcagggtgtacttctcctcgttgcgctcgaacgggatgtagatgctgtcgcgggtggtgccggcctggtcgtagacgatcacccgctcttcgccgagcatgcggttgaccagggtcgacttgcccacgttgggccggccgatgatggcaatcttgatcccgtccttctcgctgggaccgggaatccgggtcggttcctcgccttcggcgacctcttcgctcgccggctcgccctcgccctcttcctccgcgttgtccttggggaagatccccagggcttcctgcagcatatggttgatgccgcgaccgtgggcggcggcgatcggcagcgcatcgcccaggcccagcgggctgaactcggcgcgagcgagatcgggatcgatggtgtcgaccttgttggcgatcaggaagctgcgcttgttccgcttgcgcaggtgctcggcgatcatctggtcggcggcggtcatgccggcgcgcgaatcgaccaggaacaggacggcatccgcctcctcgatggcctgcaacgattgctcggccattttcgcatcaatgccttcctcatcgccggagatgcctccggtatcgatgacgatataggtgcggccctgccagcgcgcctcgccgtactggcgatcgcgagtcaggcctgcgtactccgccacgatggcgtcgcgcgacttggtcaggcggttgaacagagtggacttgccgacgttcgggcgacccaccagggcaataacgggaaccatgcggctctccacgagaattcagaaaacacaaaggccgctgacgtcggacggcagcggccggacacttga

SEQ ID NO: 6045 - DNA, 1293 bp, Pseudomonas aeruginosa
atggtggaaccatcgacggccggttcgagcaggttgtacaggtcaccctggccatcaccgaccgagcggctccactgcttgctcaacacgacttcctctttgaagtcggtcagttcggcgggcgggagttccttcttgctgttgctgctgcaacccacgaccgccagggccagggcgagcagcgccgcgtgtttccattgcaccatctcaggcctctcccttggacaggtcgtcgagcttgatctgcagggcatcgccggcaccgtcttcgggcagcgactgcttggctttctcgtaggccgcgcgcgcctcgtcggtgcgcttgagctgcaccagcaggtcgcccctgagctcctcgcgggtcgagacgtaggccttgtcggcatcgccatcgagcagcttcaggccttcctcgaccttgccctgggccgccaggacccgggccaggcgctgccgcgccagttcgccgagggtggcgtcggccggcttgtccatgaccgccttcagctcggcaacggcgtcatccagcttgccgctgtcgaccgcgaccttggccacgaacaggctgccgtactgggcataatgggtgccgccgaactcgctcttcagcttgccagccagctccgccaccttcgccggatccggctggccggccggattcagcgcggtttcgatcagttgctggtagacgatcgaggcgccctgcgcctggttggtctggtacttctgccaggcctgccagccgaataccactgccagcgcgaggatgccgccggtgaccaggggcttgccgttgcgctgccaccagtccttgatctgcgccaggtcttcgtcttcggtacgcgatgtcaccccaatcactcctattctttatgttctcaagcctgtgccagacaggctgccaggtgctcgggcagagcatcccaggcaatgctttgttgctcgccctcgtcacgcaggggcttgaaacctaccacgcgattggccacctcgtcctccccgaggatcagggcaaagcgcgcgccgctcttgtcggccttcttgaactggctcttgaagctaccggcgccggcgttgaccagcaggcgtatgccgggaatggcgctgcgcaactgttcggccagggtcagggcggccagctcgggctggttcgccgaaggcgcagacgtagaggtcggccggacggttcagttcggcggggatcaccccccaaggtttccagcagcagcaccaggcgttccacgcccatggcgaaaccgacgcccggggtcggcttgccgccgaactggctga

SEQ ID NO: 6046 - DNA, 702 bp, Pseudomonas aeruginosa
tcggagaagcgctatgaatgctcattgtcctaccttcagacgggccgtttcgccgcggacgaagggggtcacgtccaccggctggccgttgtagctgacctgggcgccgcgagcgaaaccgaggcgcagctccagcggggccttgccggccagttccaggctgtcgcccttgcgcttcagcgcgctgaccaggaccttgccgttggcgtcggtgacctgggtccagcaatcggcgacgaactgtaccttgaccaccccctggccctcgccggccaccacgggcgcggcggcaggttcgctcggcgctggcggggcggccggactggccgtcgctggaacggctggagcagtaccgggagcgggagccgtgccggcaggcgcggcggtaacgggctgctggggtgcggcgggggtgccctgggccggagcggcgggaacctgcgcgccctcgctcgccaccggcggcgctccctcggcctgggcagcgacttccggagaaacctcggcgggcgcttgctcgccttccttctgcgcttcgatcaccgcctggtcttcaggctcgtccagggtatggatctcggtggtgccgtcggcgctttccacttcgacatgctcaaggctcagaccggcggtttccggcgtgcgcgcggaatgctcctgccaccagaagtagccgaagccgatcagcagggcgagcagtaa

SEQ ID NO: 6047 - DNA, 756 bp, Pseudomonas aeruginosa
cgtatcgcggatcgacctccggcttgctttcgtcgagctggatggcgatttccagcacatcggtccatttcaggctcattgcacgctcctctctaccgccgggctcagtggccttccgacacctggttgatggtgtacttgggaatctcgaccaccaggtcttcgtcggccaccactgcctggcaggatagccgcgaatcgggctccagaccccaggccttgtccagcatgtcgtcttcgagttcgtcggacggctccatggagtcgaggccttcgcggacgattacgtggcaggtcgtgcaggcgcaggatttctcacaggcatgctcgatctcgatgccattgcgcaacgcggcatccagtatggtttcgccgggcttcgcctcgaataccgccccctcggggcagtggtcggcatggggcagaatcacgatctgcggcatcttcgcttattcctcgatttcgttgagccggcggccggagagcgcggccttgacggtcgcgtccatccgccgtgcggcgaaagcgtcggtcacctgggacaggcgcttgatctggttctcgatggccgcggtgtcgctaccaccggccagttcacgcaaggtgtccatctgcgccgcgatggccaggcgctcctcttcgtccaggagccgctcgccgtcgacgtccagcgccgactgcacggcctccagcagccgctgcgcctcgacctgctgttcgcgcagggcgcgggcagccttgtcgtcgccggcgtag

SEQ ID NO: 6048 - DNA, 228 bp, Pseudomonas aeruginosa
gacggcttgacctggatgctggcctcgacgccggaactcagttcgcgtgcggacacgccgagcaagccgtcggcgtcgacctggaaggtcacccggattttcgccgcgcccgccaccatcggcggaatgccgcgcagctcgaagcgcgccagcgaacgacaatccttcaccagctcgcgctcgccctgcagcacgtggatcatcatggccgtctggccgtccttgtag

SEQ ID NO: 6049 - DNA, 414 bp, Pseudomonas aeruginosa
gtggtgaactcctgggcgcgcgccaccgggatggtggtattgcgcggaatcaccttctccatcagcccgcccatggtttccaggccgagcgacagcggaatgacgtccagcagcagcaattcctcgccgcgcttgttgccggccagggcatcggcctggatggccgcgccgatggcgaccacctggtccggatcgatatcggtcagcggctcgcagccgaacaactcgccaaccgccgtgcgcacacggggcacgcgggtcgagccgccgaccatcaccaccgagcggatttcttccagatcgacaccggagtcgcgcaccgctcggcggcaggacttcaggctgcgagcgacgaacggctcgatcaactcgtcgagcgtcgcccggctcagctcgccgctccagtcgccatag

SEQ ID NO: 6050 - DNA, 765 bp, Pseudomonas aeruginosa
cagggtttacccacgccggcctcagacgttgaagctttcgccgcagccgcattcgccacgaacgttgggattgttgaacttgaagccttcgttgagcccttcgcgagtgaagtccagctcggtgccatcgagatagaccaggcttttcgggtcgatgatgaccttcacgccatggctctcgaagaccaggtcctcggccgccagttcatcgacgaattcgaggacataggcaagcccggaacagccagtggtgcgcacgccaagacggataccctcgcccttgccgcgcccctcgagggagcgctgcacgtgtttggcggcggcttcggtcatgctgatggccattgcaactccttactcgtcacgagcggcttagagcaaacccttcttctgcttgtagtcgcgaacggcggccttgatggcgtcttcggcgagaacggagcagtggatcttcaccggcggcagggccagctcttcggcgatggtggtgttcttgatggtttccgcctcgtccagggtcttgcccttcatccactcggtggcgagggagctggaggcgatcgcggaaccgcaaccgtaggtcttgaacttggcgtcttcgatcacgccctgctcgttgaccttgatctgcaggcgcatcacgtcgccgcaggccggcgcgccgaccatgccggtgccgacgttgggatcggcagcgtcgagcttgccgacgttgcgcgggttttcgtagtggtcgatgaccttttcgctatatgccatggctaa

SEQ ID NO: 6051 - DNA, 879 bp, Pseudomonas aeruginosa
ggacctcgagtgcgttgcgagccgccggatcacggtggaatacgctttggatatcttcacgcacacgttcgaacatcagtcgtcactccgcttgtaggacaggcctcgggccaccttctgggtttcggtcaggatcccgcgcaggatattcatttccagcttgctgatcgcgctgcgcccatacaggcgccgcaaccgcgacatcaggtggcgcggcttctccggatcgaggaagccgatatcgatcagcgtcctctccagatgcgcgtaatagagttccagctcgtcggccgtcaccagctcggtgttgagcatcgaggtggactcgaacttttccatcttggtcggcttgccctgggccgccagccacgccatgcgcacctcgtaggtgagcacctggaccgcggccgccaggttcagcgagccgaactcgggatcggaggggatatgcacatggaactggcagcgctgcaattcttcgttggtcaaacccgcatattcgcgcccgaataccagggccacctcgccattcgcctccaggtgctccaggcaggtcgtcgcgcactcgcgcggatccagcagcggccagggaatccgccggtcgcgggcgctggtgccgagcaccacgctgcagccgctcagggcctcttccagggtgtccaccacccttgcggcgtcgaggatgtcggtggcgccggaagcccgcgccaccgcgtcgccgtggggaaagctttccggctgcaccagcaccagttgcgacaggcccatgttcttcatggcacgggccgccccgccgatgttgccgggatgactggtgttgaccaacaccacacgaatacggtcgagcaacgccgatgctctccaacgccaagttactga

SEQ ID NO: 6052 - DNA, 777 bp, Pseudomonas aeruginosa
actgattttccgctccatcgaacgcctggatgtcatctcggtcaacgagaaggatgccaaggactacgtgaccgaagtcgatcgcgccgccgagcagaccatcgtcgccgcgctgcgcaaggcctatccgactcacgcgatcatgggcgaggaaggcggcttcatcgaaggcagcggcgagggcgccgattacctctgggtgatcgatccgctggacggcaccaccaacttcatccatggcgtaccgcacttcgccgtgagcatcgcctgcaagtacaagggccgcctggagcacgccgtggtcctcgacccggtacgccaggaagaattcaccgccagccgcggtcgcggcgccgccctcaacggtcgccgcctgcgcgtcagcggccgcaagagcctggaaggcgccctgctcggcaccgggttcccgttccgcgacaaccagatcgacaatctcgacaactacctgaacatgttccgcagcctggtcggccagaccgccggcatccgccgcgccggcgccgccagtctggacctggcctacgtcgccgccggacgctacgacgccttctgggaattcggcctgtccgaatgggacatggcggcaggcgccctgctggtacaggaagccggcggcctggtgagcgacttcaccggcagccacgaattcctcgagaagggtcacatcgtcgccggcaacaccaaatgcttcaaggcactgctgaccaccatccagccgcacctgccgccgtcgctgaagcgctgatccgccgctga

SEQ ID NO: 6053 - DNA, 792 bp, Pseudomonas aeruginosa
cgaagaacccggcctggcgccgggtttttcatctccatgaaaatgcacaagggcgcccgcgggcgcccttgtgcatcattgcgacagtcaggctcagcgcagcgtttcgccctggctgaggatcagccggccattcttgtcgaccgggatctggctgcccggatcgcgctccatgcggatctgcccggccttgccgtcgagcatgtacttcacgtcatagccgacgaccttctcgctgctgtcgtgcacggtgctgcagcgggtttcggtggtggtgtaggtgtcacgctcctgcatgccttcctgcaccttgttgccggcgtagccgccgccgacggcgccggccacggtggcgatcttcttgccggtaccgccgccgatctggttgcccagcaagccgccgaccaccgcaccgatggcggtaccggcgatctggtgctggtccttgaccggacgctggcgggtcacggccacgtccttgcagacctggcgcggcgtcttgatggtttccttgaccggctggacagcgacgacctcggcgtagtcgggaccgcgatccaccaggctataggtggctaccgcgccacctgcggtcacgcctacggcacccagaacggccccgacgagcatcgacttgttcacatgtacctcctggctttcatccaatgcgggctatgttcgccctttgccttgcctaggactgggcaaaaaccaccaagttccaggctcccgacaaacgtttcgttggcgcagatacgaaaactcccgccaaaagcgggagtcctcgagtga

SEQ ID NO: 6054 - DNA, 984 bp, Pseudomonas aeruginosa
ccggcaggcgccggagtgccgaaccagagcgcctcaggggcgatcgtcgacggtgtccttggcctgcggcgggatcaggtcctcgctggtcaggttcagccagatcaataccacgttggcgatgtagatcgacgagtaggtacccgccattacaccgacgaacagggcgatggagaaaccgaacaggttgtcgccgccgaagaacagcagcgcggcgatagccagcagcgtggaaaccgaggtggcgatggtacgcaacagggtctggctggtggagatgttcaggttctcgaccagatcggccttgcgcagcacgcggaagttctcgcgcacccggtcgaagatcacgatggtgtcgttcagcgagtaaccgaccaccgccagcacagcggcgaggacggtcaggtcgaaggtcacctggaagaacgacagcacgcccatcacgatgatcgcatcgtgcaccagcgagaggatcgcaccgagggcgaacttccactggaagcggaagccgacgtacagcaggatgccgcccagcgccaggagcatgccgaggccgccctggtcgcgcagttcttcacccacctgcgggccgacgtactcgacccgcttcaggttcgccgggttgccggcatcggcctgctgcaaggcggtagcgaccttcttgcccagttccgggtcctcgctgggcatccgcaccagcacgtcgcgggcgtcgccgaagctctgcaccacggcgtcctcgtagccggcgccgaccatttgaccacgcaccttgccgagatcggccggttgttcgtacgtcagctcgatcagcgtaccgccggtgaagtcgaggccgaagttgatgcccttggtgaaccagctgcccagggcgatgacggtcaggatcagggtgacggcaaacgccacgttgcggatgcccatgaagttgatggtaccgatcttgatattcatctcagtccccttagatccacagcttcttga

SEQ ID NO: 6055 - DNA, 615 bp, Pseudomonas aeruginosa
cgcggcttgtcggccggcatctgcggcggcaggaaatcgagcacgcggatcatctcttccttcggctcgcccaccgacaaaccaccgatggccaggccgtcgaagccgatctcctgcaagccatccagcgagcgcaggcgcaggtcctcgtgcataccgccctggacgatgccgaacagcgccgacgggctatcgccatgggcgatcttcgagcgcttggcccagcgcagcgacagctccatggagcgcttggcgacgtcatggtcggccgggtacggcgtgcattcgtcgaagatcatcacgatgtccgagcccagggcgcgttgcaccgccatggactcctccggccccatgaagaccttggcgccgtccaccggcgaggcgaaggtcacgccctcctccttgatcttgcgcatggctcccaggctgaacacctggaaaccgccggaatcggtgaggatcgggcctttccactgcatgaagtcgtgcaggtcgccgtggcgctggatcacctcggtgcccgggcgcaaccagagatggaaggtgttgccgaggatgatctgcgcgccgatgtcctcgatgtcgcgcggcaacatgcccttcaccgtgccgtag

SEQ ID NO: 6056 - DNA, 897 bp, Pseudomonas aeruginosa
atgaagatgtcggtgtcgccgctgaagggcttcagctcaccgtcgcgtgccgcgctttgccagcgagcgcacgctggtggtgccgacggcgactacccggccgccgcgggcccggcagacggaaaccgcgtccaccacgtcctggccgacctccagccattcgcggtgcatcacatggtcctcgatacgctcgacacgcaccggctggaaggtaccggcgccgacatgcagggtaacgaaggcggtatccacccccttcgcgcggatcgcctcgagcagcgcctcatcgaagtgcaggccggcggtcggggccgccaccgcaccggcgcgctgggcgtagacggtctggtagcgctcgcggtcggccgcatcgtccggtcggtcgatatagggaggcaacggcatgtgcccgacccgctccagcaaaggcagcacgggttcggcgaacgcgagttcgaacagggcgtcgtggcgttgcagcatctccgcgctgccaccgccttcgacgaggatccgcgtgccgggcttgggcgccttgctggcgcgtatgtgggcaagcacccggtgctggtcgagcacgcgctcgaccaggacttccagcttgccgccggattccttctggccgaacaggcgcgccgggatcacccgggtattgttgaacaccatcaggtcgcccggacgcaggtagtccaggagatcggcgaattgtctgtgggcgagggttcccgtcgggccatccagcgccaacaggcggcttgcgcggcgttcaggcaggggatgacgggcgatcagggcctcgggcaagtcgaaatgaaaatcggcgacacgcatggggagactctcgaaaggccgcgtagcttaccggaaatgtgttttccccgccacgaacccgattga

SEQ ID NO: 6057 - DNA, 864 bp, Pseudomonas aeruginosa
cttgaccacctcggaacgcttttccctcggatgcagcaaggtggtggtgacctcttccagttgccagtgatcggtctcgaagcgcgcgcgcttggcgaaactggccgattccaggccacgctgctcgtcgaagcggtagcgggtcacgccgtacagcacgccattgggctgcaccgcgttgatgtggatgtactcgcgcccctggcgatgccacagaccgcgcttggagctttgcgaatcgccgccgccctgggccagggcgcggccgctctgggcgatgttctcggtccagggcgcgacgtactcgccaaccaggatgccggccagcatcagcaccagcatcggtttcatcaccgcccagacgatccgcgacagggataccccggccgcgcgcatgatggtcagttcgctgttgctggccagggtgccgaggccgaccaggcagccgatcagcgccgccatcggcagcatgtcgtaggcgcgccgtggcgcggtgaggaagatgaagcgcagggcgtcgccgatgccgtagctggcgctgatgtcgttgagttcgtcgatgaaggcgaacagcagcgccaggccaaggatcaccccgagcaccgcgaggatcgcgacgaagacggtgacaccgatgtaacgatcgagcttaaccatgcgccacgtcgcgaccggcacgggaggacgccagcttcaggcgcaagggttcccaatagaacagaagaagaccgatcgccaggaatagtccgtggacccaccacaggccgatggccatggggatcttgcctttgtccagttggccacggacagcgatcagcagggccaggtagcccatataaaggaggatcgccggcagcagcttga

SEQ ID NO: 6058 - DNA, 339 bp, Pseudomonas aeruginosa
cccgcgacagcggcaccgccagcagggtcaccacgaataccagcagcggtgtcgacaggcgccactgcaattcggcctggtagcgtgggttgtcgctgccgaacaggtcggcggtgggcaccgcgtcacgctcgctcacctcgctgctggcctcgggcttgggcagcatcacgccataggtgtcgtactggatcgcccggtagttggcctgcccgggattgccgtcgtagcggtagccgttgtgcaggatcaggtaacggctgccatccgcctggatgttctgggtgcccttctccgccaccaggatggagatgccgcgttcctggttgctgctgttga

SEQ ID NO: 6059 - DNA, 438 bp, Pseudomonas aeruginosa
ccgagatccacggcgatccgcgccaccgcttcgccagccgccaggcgtggcagggcggcggccaggcgcacctggtggcgccaatggacgaaggtcactcccagttcggagagaaacagccgtgccagggtccgcgaggacgcccccacgcagcgcgcccactcctccagcccgcgagggtcggccgggttctccagcagcgcctggcagattcttcccaggcgtcggtccgcggggtcgggcaaggccaggggctgttcccgcgaccactccagttcgtccagcagcaccgccatcaaccgcccctcccggccgcgctcgtcgtacaacaacggcaggccggcggcgcgcacgatcaactcgcgcaacaatgggctgaccatcactccgcgcggcacccgggggaattccggcgggcaggactgcggccggacatag

SEQ ID NO: 6060 - DNA, 804 bp, Pseudomonas aeruginosa
tcgacatcgccaccctcaccggcgcctgcatcgtcgccctgggcagcaacacctcgggccttatgggcaacaacgaagcgctggtcaggcaattgctcaaggccgggggagttcgccgacgaccgcgcctggcaattgcccgctgttcgacgaataccaggaacagctggacagcccgttcgccgacatcgccaacatcggcgggccgaaggccggcaccatcaccgccggctgcttcctctcgcgcttcgccaagaaataccactgggcgcacctggacatcgccggcaccgcctggatcagcggcggcaaggacaaaggcgccaccggccgcccggttccgttgttgacccagtacctgctggaacgggccaagtgacccgggtcgatttctacgtgatccccagcgccgatccgtcggcgcgcctgcaggtcgcctgccgcctggccgagaaggcctggcggcagggcatgcaggtctacctgcattgcgccgacgaggcgcagcgcagcgagttggacggccgcctgtggagcttccgcggcgaggccttcattcctcacagcctggccgaggaagacgccgaggcgcccgttgccctgggcctgggcgagcccccggggaaccatcgcgacctgctgatcaacctgaccctcgaggcccccggcttcgtcccgaacttttcgcgggtggccgaactggtggtcgaggagccggcgatccgccaggcggcacgggataaattccgcttctaccgggagcagggctatcctctacaggaccatcgcctgccgcgtatctga

SEQ ID NO: 6061 - DNA, 195 bp, Pseudomonas aeruginosa
gccgccacgacctcggccgggagaagttcctggagaaagtctgggaatggaaggaacagtccggcggcaacatcacccggcagattcgtcgcctgggctcctcggtggactggtcgcgcgagcgcttcaccatggacgacggcctctccgaagcggtcaaggaagccttcgtgcgcctgcatgaacacggcctga

SEQ ID NO: 6062 - DNA, 423 bp, Pseudomonas aeruginosa
ccgaccagtggtacgtcagcaccaagccgctggccgaagacgccatcgccgccgtggaagacggccgtatccagttcgtgcccaagcagtacgagaacatgtacttctcctggatgcgcgacatccaggactggtgcatcagccgccagctctggtggggccaccgcatcccggcctggtacgacgaggccggcaacgtctacgtcggccgcgacgaggtcgaggtgcgcaccaagcacaagctcggcaacgaggtcgagttgcgccaggacgaagacgttctcgacacctggttcagctccggcctgtggaccttctccaccctcggctggccgcagcagaccgagttcctcaagaccttccaccccaccgacgtactggtcaccggcttcgacatcatcttcttctgggtcgcgcggatga

SEQ ID NO: 6063 - DNA, 468 bp, Pseudomonas aeruginosa
tgcagccgaagctggcggagaagatcgccaagcagacccgcgccgaattccccgaaggcatcgccagctacggcaccgacgccctgcgcttcaccttctgctcgctggcctccaccggccgcgacatcaagttcgacatgggccgcgtcgaaggcttccgcaacttctgcaacaagatctggaacgccgccaacttcgtcatcgagaacaccgatggccaggacaccggggtcaacggcgagccagtcgagctgtcctcggtcgaccgctggatcatctcccagttgcagcgcaccgagcaggaagtcacccgccagctcgacgccttccgcttcgacctggccgcccaggccctctatgagttcatctgggacgagtactgcgcctggtacctggagctggtcaagccggtgctgtgggacgagaacgcccccatcgagcgccagcgcggcactcgtcgcaccctga

SEQ ID NO: 6064 - DNA, 1008 bp, Pseudomonas aeruginosa
atggttgcccctcagtgccctggcccttggcatggccctgtccttcggcgccaacgccgacgagcagaagtcggtggcggtgaccgccatcgtcgagcacccggcgctggacgccgctcgcgacggggtcaaggaggccctccaggaggccggctacgaagacggcaagaacctcaagtggcagtaccagagcgcccagggcaacaccggcaccgccgcgcagatcgcccgcaagttcatcggcgacaagcccgacgtgatcgtcggcatcgccactccgtcggcccaggcgctggtggccgcgaccaagagcatcccgatcgtcttcagcaccgtcaccgacccggtcggcgcgcacctgacgccgagctgggaagcctccggcaccaacgtcaccggggtttccgacatgctcgcgctggacaagcagatcgagctgatcaagaaagtggtgccgggcgccaagcgcatcggcatggtctacaacccgggcgaagccaactccgtggtggtggtcaaggagctgaaggaactgctgccgaagatgggcctgagcctggtcgaagcctcggcaccgcgttcggtggacgtcagctcggcggcgcgcagcctggtcggcaaggtcgacgcgatctacaccaacaccgacaacaacgtggtgtccgcctacgaggcgctggtcaaggtcggcaacgacgcgaagatcccgctgatcgcctccgacaccgacagcgtcaagcgcggcgccatcgccgccctcggcatcaactacaaggagatgggcaagcagaccggccgcatggtggtgcgcatcctcaagggcgagaagccgggcgagatcaagccggagaccagcgacaacctgcagctgttcgtcaatcccggggccgcgcagaagcaaggcgtgaccctgtccgacgaactgctcaagtcggccgcggaagtcatcaagtaaaaaaagcggccgccggccgcgggcgtcccgcccgtggccggacggcacgataa

SEQ ID NO: 6065 - DNA, 921 bp, Pseudomonas aeruginosa
tcctgccttcacgcactcggttacgaagtcatgtctctgttttccctgttcggtgccctggagatcggcctgatcttcagcctcgtggcactcggcgtattcatctccttccgcctgctgcgcttccccgacctcacggtggacggcagcttcccgctcggcggcgcggtctgcgcgaccctcatcgccctcggctgggacccgtacagcgcgaccctggcggccaccgcagccggcgcactggccgggctggccaccggcctgctcaacgtcaagctgaagatcatggacctgctcgccagcatcctgatgatgatcgcactctactcgatcaacctgcgcatcatgggcaagcccaacgtaccgctgatcgccgagccgacattgttcaccctgctgcagccggaatggctcagcgactacgtgttccggccgctgctgctggtgttcatcgtgatcgccgcgaagctgctgctggactggttcttcaccacccagaaaggcctggcgatccgcgccaccggctccaacccgcggatggcccgtgcccagggggtcaacaccggcggcatgatcctgctcggcatggccatctccaacgcgctggtggcgttggccggcgcgctgttcgcgcagacccagggcggcgccgatatctccatgggtatcggcaccatcgtcatcggcctggccgcggtgatcgtcggcgagagcatcctgccctcgcgccggctgatcctggcgaccctcgcggtgatcctcggtgccatcgtctaccgcttcttcatcgccctggcgctgaacagcgatttcatcggcttgcaggcccaggacctgaacctggtcaccgcggtgctggtcaccgtcgccctggtgattccgatgatgaagaaacgcctgctcggcaagaagggagcctga

SEQ ID NO: 6066 - DNA, 2085 bp, Pseudomonas aeruginosa
tgctgcaccagggccaggtggtgctggacgtctccggcgagcaacgcaagggcctcgacgtaccggacctgctggcgatgttcgagaaggtgcgcggcgagaagctcgccgacgacgccctcctcctcggctgacagggccgcggcgcctctccgcggcgaagcggggaggcgccgtcgacctgcagcagatcaaggcgcgatccgcgtccgtctgccacactcgcaggcatcctcccgctcagatgcccgcatgaacctcgaactgctctgggtggtcggcctgctcgccaccaccgtcgccctcttcatccacaaccgcctgcgcctggacgtgatcgccctgctggtgatcatggccttcagcgtcagcggaacccttaccctcaacgaagccctggccggcttcagcgatcccagcgtgatactgatcgccgcgctgttcgtgatcggcgaaggcctggtgcgtaccggggtggcctaccaggtcggcgactggctgatcgcccgcgccggcagcagcgaagcgcgcctgctggtactgctgatgctggcggtggccgggttgggctcggtgatgagttccaccggggtggtggcgatcttcatcccggtggtcctgagcatcgccgccaagctgaagatccctccgggccggctgatgatgccgctggccttcgccggactgatcagcggcatgatgaccctggtcgccacgccaccgaacatggtggtcaacagcgagctggcgcgcgagggtcatgccggcttcggcttcttcgccttcaccccgataggcctcatggtgctcgccatcggcgtggcctacatgctgctcacgcgcaactggctgaacgccgccagcccggcggaagtcggcgcgccgaaggcacggcggaccctgcgcgacctgatccgcgactatcgcctggccggccgcgaacggcgcctgcaggtccagctcggctcgccgttgatcggcagcaccctggaagaactgcaactgcgcacccgcctgggcgccaacgtggtcggcctggagcgggtacgcaagttccacagcgaggtggtcaaggtcggcggcagcaccgagctgaaggcgggcgacgtgttgctgctggacgtcttcgcccctccggaggacatggaccggcgctgcgccgagctgaacctggtgcgcctgccgttccgcgccagctacttcatcgaccagtcgcgggaggtcggcatggccgaggtgactctgccgccggactccaccctgctcggcaagagcgtcctggaactgggcttccgttcgcagtacgggctcaacgtggtcggcctgcgtcgcgaccacgaagcgctcaccgacggcatgctggaagagaagctgcgcctgggcgataccctgctggtgatcggcgcctggaaggcgatccgccagttgcagggacgcaaccgcgatttcctggtgctcagcctgccggcggagatcgacgaggtggcgccggccctgagcaaggcgccgcacgccctgctcagcctggccgtgatggtggcgctgatggtcagcggggtggtgcccaacgtggtcgcggcactggtcggctgcctgttgatgggcctgttccgttgcatcgacatggacggcgcctaccgcgccatccattggcaaagcctggtcctgatcgtcggcatgctgcccttcgccctggccctgcagaagaccggcggtatcgacctggtggtctcgctgctggtcgacgccctcggcgacgccggcccgcgcgtgctgctggccagcctgttcctgctcaccgcggccatcggcctgttcatctccaacaccgctaccgcggtgctgatggcgccgatcgccatcgccaccgccaagcagatcggcgcctcgccctaccccttcgccatggtggtggcggtggcggcctcggcagccttcatgacgccgatttcctcgccggtgaacaccctggtgctgggccctggccaataccgcttcggcgacttcgtccggatcggcgtgccatttaccctgctggtgatgttcgtctgcgtgctggtgattccgtggctgtttccattgtga

SEQ ID NO: 6067 - DNA, 1476 bp, Pseudomonas aeruginosa
acgttccggtttgcttgccaggtcgagagcatcgagcagtccctggctatggccactctgctcccccagggccgcctcttcgaggacccggcgggtcactccctgctcatcgctggcgctcagcagcacgcgcatgtcggtctctttgttatagagaatctctttttcattcttgtagttcgatatcccgctgacatcgattccggacctgccgaacacggtggatatcgtgccctgcccgaagctcctcgcgacaccggggttcagggaggtggagagatagccgtcgtcgtggccaaccttgccctcttccaccgcattgaaggcatccccgccacgggtgccacggaaagtcttcactacctgttcagcctgtccgctcttctcgaaggccgcggacataccttggtcgatcagcttttgtcccgcatccagctcctgcccctgacgcagagcgcgattcaggtccgcgtagtgaatgccggtgtagagaccaagcgccatcacttcggcgtcactgtggatgccaccaggctgtctgcccaggtacttttccgcatccgccccgaaccgcttcaccaggccatccgccagcgccttgtcggccgatactctgctgacctcgctctctaccgcttggcgcaacagtgcgacctcgctcattacctgatgcaactggtcggtgatttcgcgccgcagttccgggcttgcgtcgagcaccagttgactcgcggcaccgccggtggtgccccactgctgcagcgcgatcccgccgatgctccgttcgagcaggcggccagcctggatacgggactcctcgacctggctgccggcacgaatgccggccaaggcggtgctcagcgaacgcagcgccccatctccgctggccaggcgggagtgctcccgggccagtccttccggtgtcagggtcgccagctcgctcgccttgtcgagtcccttcaaggtcatgggcaatgcctgctgcagcaccatctgcttgaacacgacggccgaggacatgaccgcaggctgcgcgtcctgactgggctgcggcccggtgcgggcgtgggagcccaacagtttgcccagccagtccatgatcgccacgaagggacgcacgagcgccgcgcccaggcgagcgagcagcccctcacccttcggcgcgtcctggcgctgggccaactgctgcgcttcactgggggtggcgacctggcgggcctcaatctgtcccaaacgcccactggcggcctggtgcaattcgacggcgaaagacggactctgctggagcgattgaatatgcatgatggttgccttctcctgatgtttctccgccagtctaggaacgggaaaccccatcgcctatcaggattggccgccgttttttcactggaatcggcagcggcaaaacctaaaaaaagagaaccacgattaacagtctctccgggctggcactgctctaatggccgcctccagtga

SEQ ID NO: 6068 - DNA, 1164 bp, Pseudomonas aeruginosa
ccatgccgagccagccggagcacctgccctcgaggcagccggctgccactgcccgggggcagttccaactgcgtcagcccatgcagcgcgtgcgaacagaggggagccgagggaccgggtggcaggagcgagatgcgacttcgcgctatcgacgggcgtccggctcgctccactgtcgccgtcctcgcgtcctgctcctcgtaccggcagtccccatcagttccagcggacgttgagcacgaagaagttcgccagcacccagaccaccagcagcaggtgggtcagttgcaatccctcctggcggatccagtagccgaaccagagcccgcccagcagcatgccgaagagcaagccgagggccgcgctcaggaccaggctgagccagggccgggccgcctccatgccggcgccgaacagcagttcgcaacaaccggtccgggccgtgacgacggcagcgacctacagcgaaccgaggccgggcgcaggcggaatcgagccgttcgaggggcgccagcctggcgcctcgcgggctcagaccgacggcgtctcgaggaacaccggcaacccctccgcataatccgaatagcttgccagttccgggtattcgctggcggcgacccgctccgcgaccaccagttggctgaagcgccaggccaccgcgacggtcaccccgaccagctcgatgccaccgtcgcgtgccagcggctcctggcgcagcgctgcctccagccagtcgtaggccgccagcaactgcccctccacccgctccagccaggggccgtggcggcgttcctcgggacgcaggttcagttcgtagtagatctgcacggatttctcgcaggccaccagcgccgcgccgatcagactcaacgcccgtgcacgggcctgcggccgttgcggcagcagactgcgttcgcggccggccaggcactccaggtaatcgaggatcaggctggagtccatcagcacggtgccatcgtccagcaccagcgtgggcgccttgaccatcgggttgaacaggctgaacgcctggaaattgcggaacaccgacagcggccggtgctcgtagggcaggtccagcaggcgcagggcgatggcgacccggcgcacaaaaggcgaatccagcataccgatcagttgcatcgcggcatcctttgtcgatga

SEQ ID NO: 6069 - DNA, 999 bp, Pseudomonas aeruginosa
ttaagcgccgctaagagggcgacgcctgggaaaatcactctagtcgttgcacaacgcgaaaaatatcgagataaattcagcgaatcctttagaaaaacttacatgagcgacctccctcccctcaccgccctgcgcagcttcgaagcggtcgcccggctcggcagcatcagccaggccgccagcgagctgcacgtcacccactcagcgatcagccagcagatcaagctgctggaaaacctcctcggcctggccctgttcgtccgcgaggggcgcggcctgcgcctgagcgagaacggccggttctacgccctgcaggtacgcgcctcgctgggcgagatcgccgacgccacgcgggtggtgcgggcgcgtccacgggagggtgagctggtggtcacggtgatgccgtccttcggcctgaactggctgctgccgcgcctgccgcgctttcgcgagcgccatccgcactgtcgcgtgcggctggtggccagtcttgacgtgcagaacctgcgccagggcctggccgacctcggcgtacgcatcggcaagggcgactgggaaggggtcggtcgggaacgcctgttcgacgacgagttgctgatggtcgccgcgcccgacttcaacggcggccgcctgccgcgcacgccgagcgagatcgtcgcctgccctacactgcgctccaccgaatcctgggcgctctggtgccagcgtgccggcgtggcggaaccgcagcacggactgctgatcaatgactcgaacctgctgctggaagccgtgcgcctgggccagggcatcgccctggagcgtcgcagcctggtcgccggcgccctcgccgagggccgcctggtgcaactgggcgacatccgcgtgccctacccctatccctactggctggtctggccgcagcgcgagccgccgagcgaccgccaccaggccttcgccgactggctgcgcgaggaggcccggcgctaccaggccgagcaaccgccgctcagcgaatga

SEQ ID NO: 6070 - DNA, 627 bp, Pseudomonas aeruginosa
tctcgcggaagcggtcgctgccggcgcgttccatccattcgaaggcgaccatctcccgcgacacgatcatcgccccggcctggcgcatccgctccacggccagcgccttgtcgctcggccgccgcgagccgatcgcctcctccacgacgaacacttcgcgaccacggccaagcaggtcgagcacggtctgcagcacgcagacgtgcgcctcgctgccgcaaaccacgaactgccggcggtcgccgccgggcgcgcgcagcagggcgccgtcggcggcggccgagaagtccagcttctcgaggatctgcgtgggctccagctcatcgcgcagggccgccaccgtcggccccaggcccttgctgtactgctcgctggccagcaccggcacgtccagtgcgcgggccacgcgcaacaaccactggctgtactcgaccagcgccggaccgtcgtcgatggccggcagcaggcgttcctggatatcgaccaccagcagggtcgaggttgcggcgcggatcagcatggcgtcctccttcggttcgacgtctcggttcgtctggcttaggcttgcacggcacgggcgccatggacagcgcgtcctcccacaaccctagcaggagcctgcgatga

SEQ ID NO: 6071 - DNA, 1413 bp, Pseudomonas aeruginosa
ggagtgcgcccgcccgcatccgtcatacccttctggagagcagcacaaggaccgctcatgaatcgcatcaagcacctgctcaaggacctcgccatcctgatccgcgccaacctctggctgatcccggtgatcgccgccctggtcgccgcggtgttctatttcgtcgccccgccgccgccgatgagcgcgaccatggccaccggcgccgagggcggcggctacgccgtgttcgccggcaagctccgggaaaagctcaaggagcagggcttcgaactgaagctggtgcccagcgccggctcgcgcgacaacctggagcgcctgctcggcaccggcgaggtcgacatcgccctggtccagagcggccaggagcgccagctcgaagccgggcaggcgcgccagttgcagaccctcggcgcggtctaccaggaaccgctctggctgttccaccgcagcaacgtgcacatcgaccagctcagcgacctgctgcacctgcgcctggccatcggcagcgacggcagcggcacccgcgccgccaccgaggcgatcctgcaggccaacgacatcgccccgggacactatccgatcacctgggaagcccgcggcggcaacgcggtggtcgacgacctgctggccggcaagctggacgcggcgttcatcgtcggcccggcggagaacccggcgatccagaaattggccgacaacgaccagcttcgcctggtcaacttccgccgcagcgccgcctacgaggcgcgcctgccgttcctcaagcgggtcgaggtcggcgaaggcctgctcaacctgccgcgcaacgtgccggaacgaaacatcagcaccctgtcgccggtggccaccctggtgatcaacgaacgcttccacccggcgctgatcccgctggtgctggaagccgcgcgcgaggtgatgaaggacggcagcctgctcgacaagcccggcgccttccccagcgccgagccgcgcaccctgcgcctgcacgaggacgccgagcgctactacaagagcggcctgccgctgctgcagcgctacctgccgttccgcatcgcctccctggcggaccgctacatcatcctgctgatcccgttcatcgccatcctcatcccgctgatgaagtccatcggcccgctgtatcgctggcgcatccgcgcgcgcatctaccgctggtaccgctacatccgcgacatcgaccgcaagctcgacagcggtaccgacgccgagcaactgagaagcgagatcgagcggctggagaaactggagagcgagctgaacaccgtggaggtgccgctctcctactaccacgagctgtacgagctgcacctgcacctgaacttcgtgatcaagcgcctgcacggtctgcaggaacgccaggcgacgcaggcagaagccggcaacctcgggtaa

SEQ ID NO: 6072 - DNA, 987 bp, Pseudomonas aeruginosa
gcgttcatggccactccctggtcggtttttcctgttcccggccacgccggccgggtgtcgcagtgtaaaacggagtccccggcaggcgaaggactttcagcccaggcccacgccgagcgcggtgcccaacccataggtgaaggccgcggcaagggtaccgaccagcacctggcgcaacgccgagaacgccagcggccgcccggtgaaacgggcggtgaccgcgccgctgaacagcagcgcaagcaggctggacagcaggcttgcgaccagcgccgcggcaccgtcgaggaacaggaacggcgccaccggcaccagggcgccaagggaaaacagcaggaacgacgtgcccgccgcgttcacgggttgccgcccaactccgtcggatcgatgccgagggcctcgcgggacaaggtgtccagcgcgccacgaccgtcgttcatcagttgcagggccacgcgccgggcggacacctcgctcagccccttggcagtgaagatatcgatcagttcctgggtctcggtgttcgggcagagcctgagcaggcgttcttcctcggcgatgcgcttgctcgccatctcgcgggcgttggtcaccgacagccactcgccgagggccatcgaacaggccccggacaccagtccggccatcccggtgaggacgatggacgaatgcgccatgctcgcacccgccacgcccatcaccaggcacaggttcgacaccaggccatcgttggcaccgagcactgcggcgcgcagcttggtgccggcgtcgcggtccggcctcgcctcgggcaacgcgcactgcggcggatcggcgtccggccgcagcggcggggtctccgccggcatgcctcaacgcgcctcgatgcgaaagcccaggcgcgggaaatgcacatgcacggtacccgcccgcgggtcttcgcggcgcaggatgagttcctcgctgccggcgaagagcagttcgccctgtaccgcgtcgacaccgtag

SEQ ID NO: 6073 - DNA, 846 bp, Pseudomonas aeruginosa
cagtcgtacgccgacccggcgccgatagggggaaacgattttatggataatgcctctccgttccaagcggcctggcaatggcgcaagttcgccatctgtcatcttctggcgctcctgctgctgatcctgtggctctggggccccacccgcgagctgatgaacggcttcgacttctggctcttcgacaagctcaacggctccctcgccctcaacgaaacctggctgaaactctggggcctgctcagtacccgaccgttcgacgcggtggtcggggtgatcctgctctgcctgctgattcgcggcgactggctgctgccggcgaaccaggtacggcggctgaccttcggcttcatcgtgaccctgctgatcctggtggtgatccgcgtgctctacgcgaagatcgcccaccacctgcactggcagcacgccagcctgtcgatgctgatggacaaggccatccacctcagcgaccacttcccggactgggaacgcgtgtgggaaatcaaggaccgctccaagcgcagcttccccggcgaccacgcctcggtgctgctggtctgggcgctgttcatgtcgctgttcgctcgccgcgccgggcagttcctgctgatctggaccctggccgtgctgttcatgatgccgcgcctggtagccggcgcgcactggggccaggacgactacatcggcggcctgcagatggccctgctggccctcgcctggggctgctacacaccgctggcggcgaaggccagcggctggctggtgcaggtgaccgaaccgctgttccgcctgctggcgaaattgccgctgatcggccgcctcggcgtggtccgcgactcggcctga

SEQ ID NO: 6074 - DNA, 705 bp, Pseudomonas aeruginosa
agaagcgcgccgcccagagccacttgtccaggcgcaccttgtcgtcgtctttctcgctcactggcatttcccgtattcgttccgccgctgtctcgcgactgtcatcgacagccgctaggttcgtcttcggcatcctcgggcagccgtctggcggccgcccatagccctgctagaatgccggcaaaacgcctggaatgcctacccgtgaagacattcgaccagctttccgtcatcggtctgcgcgagtggatcgcctttcccgaactgggcatggtcgggctgcgcgcgaagatcgacaccggcgccagcacctccagcctgcatgcctcggacatcgttcccttcgagcgcgacggcgagaagtgggtgcgcttcaccgcccacctcggcacgctggtacagcgccggcaccgttgcgaagcgccgatggtcgcgcgcaagaccattcgcagctccaacggccaggcccagacccgctacgtgatccgcaccaccctggcgctgggcgatcgcatgtggccggtggagttcaccctggcctgccgcaagtccatgcgctatcgcgtgctgctcggctccaaggcgctgatcgccgggcaactggtggtcaacccggccctggcctacgtccaggatcgtcccgagtcgccggccgccctgcccgcggcgacgagcatcgacctgctcgacgggagtccggtttga

SEQ ID NO: 6075 - DNA, 1014 bp, Pseudomonas aeruginosa
agcaccgccgcaaccgatgccggaaaccccgtcgaaccccgtgctcttccggcactcgaatcctttcctgacgcttcacggaatcgccgcatgacctctcgtccctcctccgaccagacctggcagcccatcgacggccgggtggcgctgatcgcgccagcctcggccatcgccaccgacgtgctggaggcgaccctgcggcaactggaagtgcacggcgtggactaccatctcggccgccacgtcgaagcccgctaccgctacctcgccgggaccgtcgagcagcgcctggaagacctgcacaacgccttcgacatgccggacatcaccgcggtctggtgcctgcgcggcggctacggctgcggccagttgctgccgggcctggactgggggcgcctgcaggcggcctcgccgcggccactgatcggtttctccgacatctcggtgttgctcagcgctttccaccgccacggcctgcctgcgatccacggcccggtggccaccggactcggtctgtcgccgctgagcgccccccgcgagcagcaggagcggctagcctctctggcctcggtcagccgcttgctggccggaatcgaccatgaactcccggtgcagcacctcggcggacacaagcaacgcgtcgaaggcgcgctgatcggcggcaacctcaccgccctggcctgcatggccggcacactcggcggcctgcacgccccggcggggtcgatcctggtcctggaggacgtcggcgaaccctactaccgcctggagcgcagcctctggcaattgctcgaaagcatcgacgcgcgccagctcggcgcgatctgcctgggctcgttcaccgattgcccgcgcaaggaagtcgcccacagcctggagcggatcttcggcgaatacgccgccgccatcgaggtgccgctctaccaccacctgcccagcgggcatggtgcgcagaaccgagcctggccttacgggaagaccgcggtgctcgagggaaaccggttgcgctggtag

SEQ ID NO: 6076 - DNA, 642 bp, Pseudomonas aeruginosa
gctggcggacgaagatccaggcggcggcggtggagagcaggccgatgccgaggaaccagccgagcacgctccagatccgttggccacgcaagggatgcggatacagcggcaccgccagccagccttcgccgaggctcggtgcgcgcacccagagctgcgacggctggtggatacgcaggcgggtctcggtgtccggccccagctccatctgcatctgccgctggaagatttccgtgtacggccagtgctgctcgccgggctggtcggcgctgctcggcacccagcgcaggccggaagccttggcgatggccgcgcgcgactcctcgtcggcagcccagaacgcgcggatggtcagcgccgcgccgtggctgtactggcggtcgacgatcacgtcctcgttcatcagcaggtagaccagggtcagcgccttggaggacagcacgacgatcagcaccagccagagggtgcgggcgaagaagctttgcgggaaccagagcggcgttttcatcgatcggaccggttgcgcgccggcggacggggccgacgcctgttgcgggtaagacgacgcggccggtgcatcgctgcaccggccgcgcggagactcaggccttgcgcgcgttgccgtccggcacgaacacgtag

SEQ ID NO: 6077 - DNA, 807 bp, Pseudomonas aeruginosa
gccgctgaaaagcgccccgtcgcaccgcgccctggcgatcttccgcggacgcaacgaaggcatcctcagcgcctcgctgaaggtcggcgaggaagcgccgggcaccctgcacccatgcgaggtcatgatcgccgagcgcttcggcctgtccaaccagggccgcgccgccgacaagtggctggccgaggtggtgcgctggacctggaaggtcaagctctatacccacctggaaaccgacctgttcggcgagctccgcgacggcgccgaggacgaggcgatcagcgtgttcgcgcgcaacctgcacgacctgctgctggccgccccggccggcccgcgcgccaccctcggcctcgacccgggcctgcgcaccggggtcaaggtcgcggtggtcgacgccaccggcaagctgctggacaccgccaccgtctacccacatgcgccgaagaaccagtgggaccagaccctagccgtgctcgccgcgctgtgcgccaagcaccaggtcgagctgatcgccatcggcaacggcaccgccagccgcgaaaccgacaagctggccggcgaactgatcaagaaatatccgggcatgaagctgaccaagatcatggtcagcgaagccggcgcatcggtgtattccgcctccgaactggcggcgaaggagttccccgagctggacgtgtccctgcgcggcgccgtatccatcgcccgtcgcctgcaggacccgctggcggagctggtgaagatcgagcccaagtcgatcggcgtcggccagtaccagcacgacgtgtcccagctgaagctggcgcgtag

SEQ ID NO: 6078 - DNA, 1284 bp, Pseudomonas aeruginosa
cctggacgcggtggtcgaggattgcgtgaacgccgtcggcgtcgacgtcaacaccgcctccgccgccctgctggcacgcatctccggcctcaactcgacgctggcgcagaacatcgtcgcgcaccgcgacgccaacggagcgttccgcacccgcgacgagctgaagaaagtcagccgcctgggcgaaaagaccttcgagcaagccgccggcttcctccgcgtgatgaacggcgacaacccgctggacgcctcggcggtgcacccggagacctatccgctggtgcagcgcatcgccgccgacaccgagcgcgacatccgctcgctgatcggcgactcggcgttcctcaagcgcctcgacccgaagaagttcaccgacgagaccttcggcctgccgaccgtcaccgacatcctcaaggaactcgacaagcccggccgcgacccgcgtccggagttcaagaccgcagaattccaggaaggcgtcgagagcctcaaggacctcaagccgggcatggtcctggagggcgtggtgaccaacgtcaccaacttcggcgcgttcgtcgacatcggcgtccaccaggacggcctggtgcatatctcggcgctgtccgagaagttcgtcaaggatccgtacgaagtggtcaaggccggcgacatcgtcaaggtcaaggtcatggaagtggacatcccgcgcaaccgtgtcggcctgtccatgcgcatgagcgacacccccggcgagaaggtcgaaggccagcgcggcgggcgtcccaccggcagcggccagccgcgccaggagcgtggcgccccgcgcggacagagcgcgccgccggcgaacaacgccatggccgcgctgttcgccaacgccaagcaactgaagaagaagtgacggagccgtccatgagcgagatgcccgcccgcgagcagatgatcagcgcctacagcgaactggtcggcctggacccggtcagcctcggcgacggcgtcgccgaggtacgcctgccgatggccgcgcacctgcgcaaccgcggcggggtcatgcacggcggcgcgctgttctcgctgatggacgtgaccatggggctggcctgctccagttcccatggtttcgaccgccagagcgtcaccctggaatgcaagatcaactacatccgcgccgtcgccgacggcgaggtgcgctgcgtcgcccgcgtcctccatgccgggcgccgcagcctggttgtggaagccgaggtgcggcaaggcgacaaactggtcgcgaaaggacaaggtaccttcgcccagttgtaa

SEQ ID NO: 6079 - DNA, 384 bp, Pseudomonas aeruginosa
aggtctgggcgaacgagctgctcgaacgaatcgccgacaccgcggcgctgctcgaccgcgcacgcggcggcgaagcccacgcggcggcgctggcagcgccagcgggctaaggtcgccgatgccgaactgacgccttcggcgcaggtgctgaaggtcatgcgcgagcgcggcgagagcttcgaagcgttctccctgcgccagagccgcgaacacgcggagtatttccgccagcatccgctggccgccgaagagcaggcacgcttcgagaagatggccagcgactccctggccgaacagacggagctggaacgcgaccaggatggcgacttcgataccttcgtcgccgcctaccaggcgagcatcctcggcctgatcagcaactga

SEQ ID NO: 6080 - DNA, 1209 bp, Pseudomonas aeruginosa
ccgctctacgctgctgggctggaagccgcgctcgcggaaccagtgcgcggtccgcgtggtgagcacgaacagggtcttcaggccgagtccgcgcgcgcgctcctcgatccgctccaacagttcgtcgccacgcccgccgtggcggtactccgggttgaccgccagacaggccagctcgcccgcctcggaatcggcgatcgggtagagcgcggcgcaggcgatgatcagcccttcgcgctcgacgatgctgaactgttcaatctcgcgttccagcacctcgcgggaacggcgtaccaggatgccctgctcttccagcgggcggatcagctcgatcagcccgccaacgtcctcaatgcccgcctcgcgcaactgttcgaactgctcctgggcgaccagggtgccgttgccggtgcgggtgaacagctcgctgagcagcgcgccgtcctcggtgtagctgacgatatggctgcgcttgaccccggcccggcaggcctgcgccgcggcgtccagcagctcggcctggtagctgttgcccagccgttgcaggtgcgcgggcacctgctgcgggcgcagttcgcggaccagcttgccggatgcgtccagcaggccctgttcggcgccgtagagaatcagcttttccgcttccaggtcgatggcggcgcgcatggccacgtcttcgcaggccaggttgaagatttccccggtcggcgagtagcccagcggcgagagcaggacgatgctgcgctcgtcgagaaggcggccaatgcccttgcggtcgatgcgacggacctcgccggtatggtggtagtcgacaccctcgaccacgccgatcggccgcgcggtgaccaggttgccgccagcgacccgcaggcgcgcgccctgcatcggcgaggcggccatgtccatcgacagccgcgcctcgatggcgatgcgcagactacccacggcgtcgatgacgcattccagggtcggcgcatcggtcactcgcaggtcgcggtgatagcgcggagccaggccgcgcgcggccaggcgcgcctcgatctgcgggcgcgaaccgtgcaccagcaccaggcgcgcgccgaggctgtggagaaggaccaggtcgtggacgatattgccgaaattgggatgctccaccccttcgccggggagcatgaccacgaaggtgcggtcccggtgcgagttgatgtagggcgaagcgtgacgtaa

SEQ ID NO: 6081 - DNA, 756 bp, Pseudomonas aeruginosa
gctgcctcgttcgccgtgccgtccggcgcgcacccacgcgaacgaggaaaatccatgagcgaatacttccatcacgtcctggtcggcctgctcgccgtgctcccggtagccaacccgctgaccagcgtctcgctgctgctcggcctcggcggcagcctgccgccggcggagcgcaaccggcagatattcaaggccagcctctacgtggcgctgatcatgctggtcagcttctacggcggcagcctggtgatgcaggtgttcggcatctccattcccggcctgcgcatcgccggcgggctgatcgtcgcctatatcggcttcaccatgctgttccccgccaccacgccggacgagaccgaagtccagcacgacctgctgtcggacgaggaaaagatcaccccgcacttccgcgacctgtccttcgttccgctggccctgccgggtaccgcggggccggggaccatcgccctggtggtcagctcggcgtcgacgctgcaatccacctacggaagcattccgctgttcatccacctcgcggcgatcaccgtcaccctgctcaccgcgctgatcttctggatcgccctgcaaagctccgggcgcatcatgaagttcctcggcgaatccgggatcgacgccatctcgcgagtggtcggcttcctgctggtggcgatgggcgtgcagttcgtcatcaacggcggcttcgagctggtcgccggccacgccgcgcttcagtcggcggcgggcgtcaggcagtaa

SEQ ID NO: 6082 - DNA, 627 bp, Pseudomonas aeruginosa
tcgatgctcacctggtgccgttcggccagcggccgcaggcgctggcggatcgcctcgcgcaactgctcaggctgcatgccgggtagcgggcgcaggtcgaattccagcgaacactggccgcagatgcggttgggattgtcgccgccgtggatgcaaccgaagttcagggtcggctggggcacgctgaactgcgggttgttccaggcccgctgccattccccgcgcagcgccatcagctcgccgatggtcgcgtgcatggcctccagggcgctacggccgaggttcggatcggacgaatggccgctctgcccgagaatctcgatgcgctccatcatcacccccttgtgcaggcggatcggccgcaggttggtcggctcgccgatcaccgtggcgcgacccagcggtcgcccgctttcggcgagggcacgggcgccggccatcgagctttcctcgtcgcaggtggcgaggatcatcagcggctggcggaacggctggtcgagcagcggcagcaaggcctcgatggccagcgggaagaagcccttcatgtcgcaactgccgaggccgtaccagcggccgtcgcgctcgtccaggcgcagcggatcgctgctccacagcgcttcgtcgtag

SEQ ID NO: 6083 - DNA, 585 bp, Pseudomonas aeruginosa
ctggccagcaggttgaacttgcccggcgagacttcccggatctcgcagcggaagcctagatcgcccagccaggaggccagcaggtcgaccaccgggcggttggtctggtccagctcgggctgggtgcaactgacggaagacgcggcgatcagcgcgccgaactggtctttcagagacggcaacggcatgggactctccacacggatcgagccccatcatggcctatcgcggcggtggataaaaccgtccgttccggttccgcctgcgccagccgacgaagaccgcgctcaggcgccgaacagcgcgcgcaggaccaggaagcacaggatcgccagcaccgcgccggccggcagggtcactacccaggacaggaagatcgagccgatcacccgcaggttgagcgcgccgataccgcgcgccatgccgatgccgagcaccgcgccgaccagggtatgggtagtggacaccggcaggccgatggccgaggcgccaaccaccgtggaggcggtcgccagctcggcggcgaagccgcggctgggggtcagctcggtgatctcccggccgatggtcgcgatcacccggtag

SEQ ID NO: 6084 - DNA, 423 bp, Pseudomonas aeruginosa
tgccctgcgacatcagcaaggccgagcgcggctaccgcctgttcgacccgaacagctacgaggtcgatcccccggcccagaaactgctggcggaaaccccgctggacggtgccttcgccgccatcgcctggtacctgctcggcagcagccagcgactggccgaacagtatcgtttcaacggccactggcgcctgctggaggactggctgcaacacctgcaggacctgcgtaccctgctcggcagcctcggccaggcggtgccacgcgccagcagtcgcgagctgcgcgaagcgctggacgctctcctcgccgactgggcgccgcgcatcgagcgcggccgtgacgacgagacgctacgccagcaggcgccgcaactgttccgcggcgaactcgacgagacccgctggggtctgttctccctga

SEQ ID NO: 6085 - DNA, 1827 bp, Pseudomonas aeruginosa
aataagcttcgccgctaccgccatcatccgaagggagtctgcatgtccgtgttcgccaccgccgcccaggaccgcctgctggacctcggcgacctgctccgcgagctggtcgcccagggccgggtcgggcaggagcaggccgaacagtgcctggcgatccgccgcagcgcggtgcgcaaccagcagcatccgctggagttcctcgccgcgcagcaggtcgaggatctcaagcgccccggacgcaagctcgacctggagaccctcacccagtggctggccgagtacgccggccagccctacctgcgcatcgacccgctgaagatcgacgtcgccgcggtgactccgctgatgtcctacgccttcgcccagcgccatggcatcctcgccgtcgcgctgagtccggaggaagtcaccatcgccagcgcccagcccttcgtacagggctgggaaagcaacctggtgcatgtgctcaagcgaccgatcaagcgggtggtggcgaacccggcggacatccagcgctacaccgtcgagttcttccgcctggcccgctcggtcagcggcgccacctcgccggaccagaagatcagcggcgtcggcaacttcgaacagttgctcaacctcggcgccgccgaccaggagccggacgccaacgacgcgcacatcgtcaccatcgtcgactggctgttccagtacgccttccagcagcgcgccagcgacatccacatcgagccgcgccgcgagcagggcaccgtgcgcttccgtatcgacggcgtgctgcacaacgtctaccagttcccgccgcaggtgaccatggcggtggtcagccgcctgaagtcactgggacggatgaacgtggcggagaaacgcaagccgcaggacggccgggtcaagaccaagaccccggacggcgccgaggtggagctgcgcctgtcgaccctgcccaccgccttcggcgagaagatggtgatgcgcatcttcgaccccgaggtgctgctcaagagcttcgaccagctcggattctccgccgacgacctgcgccgctggcagagcatgaccagccagcccaacggcatcatcctggtcaccggccccaccggctcgggcaagaccaccacgctttacaccacgctcaagcaactggccaccgatgaggtgaacgtctgcaccatcgaggacccgatcgagatgatcgagccctcgttcaaccagatgcaggtccagcacaacatcgacctgaccttcgccagcggcgtacgcgccctgctgcggcaggacccggacatcatcatggtcggcgagatccgcgacctggagaccgccgagatggcgatccaggcggcgctcaccgggcacctggtgctctccaccctgcacaccaacgactcccccacggcgatcacccgcctgctcgaactgggcgtaccctactacctgatccgcgccacggtgctaggggtcatggcccagcgcctggtgcgcacgctctgcccgcactgcaaggcgccgatgcaactggcggacagcgactggcacgaactgacccgcccctggagcgccccgccgcccagcggcgcgcaccaggccgtgggttgcctggagtgccgcgacaccggctatcgcgggcgcgccggcgtctatgaaatcatgctgctcagcgatagcctgaaagaactgatcaccgccgacaccgacctggtcgccctgcgccgccaggcgtacaaggaaggcacccgcagcctgcgcctgtccggcgcgcagaaggtcgccgcaggtatcagtacgctggaggaagtactgcgggtgaccccgcagagcgaacagaagtag

SEQ ID NO: 6086 - DNA, 225 bp, Pseudomonas aeruginosa
ggtctctgccagatcccggtgacgtcggccagggtatgcggcgcccgtttcagcgggttgtcctccgccggccaggcgccgctctccaccttgccgatctcggccctgatgctcagcatcgcctcgacgaagcgatccagctccgccttcgactcgctctcggtcggctccaccatcagcgtgcccggcaccgggaaggacatggtcggggcgtggaagccgtag

SEQ ID NO: 6087 - DNA, 1449 bp, Pseudomonas aeruginosa
  unsure (406),(409): Identity of nucleotide at the above locations are unknown.
actgttccgggctccgctgctgtcctcctacgcggtggggttctgtgtcctcttttcccaggtcgccatgttcacctatatcggcatccatctcagccgtcagccgtacagcctggacaccgctcagctcggctcgatctacgcggtgttcctcctcgccctgctggtgattcccgccagcggccgcctggcccgcacccgcccgcaccgccagttgctgctgggcgcatcgctgctgggcgtgtgcggctcgctgctgaccctggcgccgggcctgccgacgattctcgtcggcctggccctcagcgccaccggcgtgttcctcgcacagtccacggtcaacgccttcaccgccagcaatgccgggaccgacaaggccggtgccgtcggcctatacctgacctgntantacgccggcggcagcctcggcgcggtactgccggcgccattctgggagcgctggggctggccgggctgcctgggcctgatcctcctggcccagttgctgccgttgctgctgacccgctacggctggtccgcaccacaggccgaacgcgcggccctgcgcgcgtcgcaaggaagaccgtaaccatcgcaagaacaacaagaaccgacaggaggttagccatgaaccatgtcatcaccccccacagcaagctgctcggcgtcatcgagccggtcctcaacgacatgcccgccggaaccctgcgccacgcactgttccgggccttctgggacgagacggcgtcgttgctggacatcgaggacgccttcgcccgggtcaccgcccggcgccaggcggtcgagccgctgcgcaagttcttcgccagttggtcgaagaccaacaactcggcggccagcgtttccggactggccaatcgcctgaccctgctggcccgttcggaacagggttcggcagcggcagaccagctctatcgagcctgcggcagcctgcaacggatcaccgacgaagacctcggcgccctcggcaacaccgtgcatgccgatcttttctacaccatggccaccaccctttgcggcgacgaccgctggctgctgcgcgagaactgcctgccttcggcgcaggcgttcaaggactggaccgaccgccagcgcctgcgcgagcgcgacctgatgcagggactgctgaccacgctggtacacgaggtctatacccacggcgaggtggagtacatccacccgctgtacaaggaatggttcagccgcgacatgggcgtacccgccgaacgcgcccgcgccaccgtggcctgggtaacggtgcacaccggcggcaccgagagcaatcatttcgcccacgccacgacggcggtgaacgccttcgtcgaggcgatggaaatcgaggtgaacgaagaagccgcgcgcaacctgttcgggctctacctgcgcaacaaggcgcaggtcatgcgtgactgcgcggcgctgttctga

SEQ ID NO: 6088 - DNA, 1311 bp, Pseudomonas aeruginosa
ggactggcggccctcccgtcaggggggccgccccgctcagactcgtgccagcgacggcaggtcgccgctgaggccaagcgcctggcggacgaacagcgccttcgcctcgtgatggccgtcgaccaggcgcaggccggcgttgcgcagccagcgcagcggcaaccggtcggcctggaacaggcgctcgaagccttccatcgccgtcatcatgcccaggttgtgcggcatccgccgccgctcgaagcgactcagcacgcgttcgtcggcaagccgttcgccgcgctccagggcgtgcaacaggacctcggacagcaccgccgcatcgaggaagcccaggttcacgccctgtccggccagcgggtggatggtgtgcgcagcgtcgccgaccagcgccaggcccggctcgacgtaacgcttggggtgccgctggcgcagcgggatgcacaggcgccggtcggcatgcaggatggcgcccaggcgctgttcgaaggcttcgccgagggcggcgcggaagccatcctcgtccaacgccatcaggcgttctgcctgttccggggtggtcgaccagacgatcgagcaccagtgctcgtcgccgcggtccggcaggggcaggaaggccagcggaccgtcgtcggtgaagcgctgccaggcggttgcgcggtgcgcgttctcgcagcgcacgctggtgacgatggcgtggtgcaggtaatcccattcgcgggtggcgcagccggccaggcggcgtaccgccgagttggcgccgtcggcggcgaccaccagcggcgcacgcagctggcgaccgtcggccagggtcagcagccagtcgtcgccggagtggcgcatctgttccaggcgcgcattggccagcaggccggtggtggaatcgtgcaggcgttccagcagggcgtcctgcaccacccggttttggacgatatggccgagtacctcggcgtgcacgctggcggcgctgaagccgatccgcccggtgccggagccatcccacacctgcatctcgcgatagggctcggcgcggcgcgcgacgatgccgtcccaggcatgcaggcgctggagaatccgccggctggcttcggacagcgcgctgacccgcggctcgtagggcgcctccggcttgaacggcgccacgtcgagcgagccgccgtccaccagcagcacctccaggccgctgccctccagggccagggccagggcgctaccgaccatgccggcgccgacgatgaccagatccgcgtgcatatcctcgttctccactcgtgggccctcttcaggccgcgttccgcaggcgcggcttga

SEQ ID NO: 6089 - DNA, 1494 bp, Pseudomonas aeruginosa
gcattgccgggggcgaagggttcgatcagcacgatcgaccagccgcgctcccgagcgccggcctgcagggccagcgccagcgaggcgccgaccaggcccccgccgatgatcgccaggttgaccttgctcatcgtcacctcaggctgcctcgctcttggccgcggccatcagcgcctcgatctcggcgacggtcttcggcacgccgttggtcagcacttcgcagccattgcgggtgaccaccacgtcgtcctcgatgcgtacgccgataccgcgccacttcttcgccaccgaggtattgtccggggcgatgtagatgcccggctcgacggtcatcgccatgcccggttcgagcacccgccattcgccgccgacgcggtactcgccgacgtcgtgcacgtccatccccagccagtggccggcgcggtgcatgtagaaagccttgtaggcctcgtgggcgatcagctcgtcgacgtcgccctccagcaggcccaggcgcaccagcccggcggtgatgacccgtacggtggcctcatgggcctcgttccagtggcgaccgggggcgatgtagtcgaacgccgccatgttggcttccagcaccagttcgtagatcgccttctgctcgggactgaagcggccattggcggggaaggtacgggtgatgtcgctggcgtagcagtcgatctcgcagccggcatcgatcaggatcaggtcgccgtccttgatcgccgcatcgttctcgcggtagtgcaggatgcaggcgttgcgtccggcggcgacgatcgagccgtaggccggcatcttcgccccgcccttgcggaactcgtattccagttcggcttccaggtggtactcgaacagccccggccggcacacctccatcgcccggatgtgcgcccgggcggagacctcggcggcgtagcgcatgaccttcacttcgttggcgctcttgtacagccgctggtcgtgcagcaggtggtcgagggcaacgaactcgttcggcggctgcgcgccctggcgggccttggagcggatcacgttgatccagtccatcagccggcggtcgaagtcgggattggcgccaagggcgtagtagacccggtcgcggccttcgatcaggccgggcaggatgtcgtcgatatcgccgatgggaaaggcgtcgtcggcgccgtactggccgatcgcaccgtcctggccggcgcgcaggccgtcccacagttcacgctccggatcccgctcgcggcagaacagcacgtattcgccgtgagcacggccgggaatcagcgccatcaccgcctccggctcggggaagccggtgaggtactggaagtcgctgtcctggcggtagacatgctcgacgtcgcgattgcggatgtacatcggcgccgccggcaggatggcgatgctgttgggttccatctgcgccatcagcgccttgcgccgacgggcgtactccgacttggggatacggatcatgcagaaacctcagtgcagtga

SEQ ID NO: 6090 - DNA, 396 bp, Pseudomonas aeruginosa
aagccttggagcaggacacatgagccagtcgaataccctcaccgtgcagattctcgacaaggaatactgcatcaattgcccggacgacgagcgcgccaacctggaaagcgccgcccgttacctggacggcaagatgcgcgagatccgctccagcggcaaagtcatcggcgccgaccgggttgccgtgatggccgccctcaacatcacccacgacctgctgcaccgcaaggagcgcctggaccaggaaagcagctcgacccgcgagcgcgtgcgcgaactgctcgatcgcgtcgaccgcgccctggcgaatccggccgatgccggcgaagcctgacccgggcgcggccaattcgggtatactggcctccgctccctggtgtgttggccagtcggtga

SEQ ID NO: 6091 - DNA, 552 bp, Pseudomonas aeruginosa
cccgacagcggcacgaccggggagctacctttccacatgatcgaatcgcaagacctcagccgcccggccctgcgccgcaagctccgccaggcgcgccgcgcgctctcccccctgcagcaacgcctcgccgcccgtgccctctatcgacaactggcgcagcatccccttttccgccgtgcccgccatatcgccctgtacctgcccaacgacggcgagatcgacccgcgtccgctgctgcgtgcggcgcagaaccgcgggcaaggccacctacctgccggtgctggcgccctggccgcagacgcgcatggtattccagcgggtcggcagcggcgaacgctggacccgcaaccgcttccgcatcagcgaaccgctggccgacgccggccgccagcgcaaggcctgggcgctggacctggtactgctgccgctggtggggttcgacgaacagggcgggcgcctgggcatgggcggcggcttctacgaccgcagcctggcctacctggcgaggcgcaaaaatggtcacaaaccgacgctgatcggcctggcccatga

SEQ ID NO: 6092 - DNA, 696 bp, Pseudomonas aeruginosa
gctgaagtcatacgcaattacaccggcgaccggtggtcacgcgcagacgtttcctacgtatatctacgaaagaggagcaaagttcatgcctgcctactggctgatgaaatccgagccggacgaactctcgatccgcgacctgcaacgcctcggaaccgcccgctgggatggcgtgcgcaactatcaggcgcgcaacttcatccgcagcatgaaccccggcgacctgttcttcttctaccactccagttgcccgcagcccggcatcgccggtatcgcccgcatcgaaggcgaagcctaccccgatcccacggccctggatcccgccagcccctaccacgaccccaaggccagcgccgggaagaacccctggagcgcccgcgacgtcagcttcgtcgaagccttcgccgaggtcgttccactggcccggctgaaggcccaggacgccctggccaacctcgccctggtgcagaagggcagccgcctctcggtaatgccggtcagcgccgaggaatggcaggcgatcctgccgctggcgaaacgctgaagccatcgctcaggccatctgcgagatggtccggcggaaacgccagagcgcgccgaagaagaacgccgaaccgatcaccacgataccggcgaactgcggccagacgatgtcgaaaccggcgccgcggaacaggatcgcctgggccaggctga

SEQ ID NO: 6093 - DNA, 420 bp, Pseudomonas aeruginosa
agatggtcaccccgtcgcggcgcgacagctcgaccatcagctcccagaagccgtcgcgagccaccgggtcgacccccgaagtgggctcgtcgaggatcaggatttccggcttgtggatcaccgccaccgccagcgacagacgctggcgaatgcccagcggcaggtcgttgggcagctcgtcggccaccttctccaggtcgaagcgccggagcatttcgccgacccgtgccgggatgccatccgccggcaggtggaacagccgggcgtgcaacaccaggttctgccgcacgctcagctcggcatacagggaaaaggcctgggacatgtagccgacccggcgacgggtcgccatgtcgctggcgtccaccggctggccgaacagcgcgcacgtgccttcgctggccggcagcaggccggtga

SEQ ID NO: 6094 - DNA, 651 bp, Pseudomonas aeruginosa
acgccgactcgaggctctgcgtcccggtacgctcgcgcaactcctgcggcgtaccggtggccaggacctttccgtcgtccatcgccaccagccagtcgaagcgctcggcttcctccatgtaggcggtggcgaccagcacgctcatgccttcgcggcccgcgcggatacggccgatcagctcccagaactggttgcgcgacagcgggtcgacgccggtggtcggctcgtcgaggatcagcaggtcgggatcgtggatcagcgcgcagcacagcccgagcttctgcttcatgccgccggacagcttgcccgcaggacgctcggcgaacggcgccagcccggtgctctgcagcaggtcggcgatgcgccgctcgcgctcggccttgtcgtggccgaacagccgaccgaagaagtcgacgttctcgaacaccgagagcgtcgggtagaggttcttgcccagcccctggggcatgtaggcgatgcgcgggcagaccgcccggcggtggcggcggtcgcgcatgtcgccatcgagcacgcggatctcgccatcctgcatcttccgtgcgccggccagcagcgccagcaggctggacttgccgaccccgtccggaccgatcaggccgaccatgcggttggccgggatctccaggctga

SEQ ID NO: 6095 - DNA, 1263 bp, Pseudomonas aeruginosa
cgtcgtccaccgcgcgcgtctcgccgtagcgcagcgaaacgccccggaggctcgccacgccgctcccgccagcggtcattgcggaaccttgatctgcaggttggccggccactcgacctcagggtccagtcgcaggtaggccattccgggcacgccggtcttgacgtaggtgatgtatttttccagcagcgccggatcgagccgcgccttgacccggaacatcagcttctcccgctcgttggcggtttccaccgttttcggggtgaactgggcgacgctggcgacataggaaaccttggccgggatcacgtagtccggcaccgcgtcgatcaccaagcgcacttcctggcccagtccgaccctgccggcctgcatggatggcaggaagaaagtcatgtagacgtcggccaggtcgaccatgttgagcagcttgccaccggccggcagcacttcccccggctgtgccacgcggtactgcacgcggccgttgcgcggcgccttgagcaggctgtcgtcgatatccgcctggagccgggtgacgctggccttggccgcctcgatggccgactgcgcctcgattacctgggaacgcccggcctcgatcgccgcctgcgccgaaatcacttgcgagcgtgccgcggacaacgccgcctgggcgctctgcagggtcgcccgatcgtcgtcgagttgctgttgcggcagggcattgcgcttgaccagcgcctcggtacgggtgaagcgcttctgcgccgctgtcagctcggcctggcgctgcgccaccacggcctgggcggtgctcttctcgctctcgcgctgggccaccagcgaggtcgcggtgagcttggcgttctccgcctggcgcacctgggcctgggcctgggccaactgcgcctcgagcacctgggtatccatccgcgcgacgatttcgccggccttgacgaagtcgccctcgtcgaccttgatctcggcgacccgcccgggaagcttggccgccacgtccacctcggtggcctcgatgcgtccgttgccgctggcgaatccctcgcccaggccggtcggtcgcgatacctgccagaccagcacgcctacgccgagcagcgccgccacgaccagggcacggctcagccaccgtttgctttcctgtttcatcccttctcctcgcacgttcggccaggccgcggcgatggcgctcacgctggaaagcgcggccgccgcggacttcactggctcgattgtccctccagggcggcgcgcaggtgttga

SEQ ID NO: 6096 - DNA, 1239 bp, Pseudomonas aeruginosa
accggcttgttcgcgccctcgccttccggcgcggcctcctcggccgaggcgaacgacgggaacagactcaggcacagggccagcgacagggcaatgggggttctcacgggcgcatctcctcgacgaatgccggcaagcatagccagactctcggccgggcccaagcccggggtttatggacaaccatcagttgcggcgatgctgattgacccccggcgtctccctcctacactggccggaccgcaaactggagcgtccccgatgaaagccgtcctctgcaaagccttcggcccggccagcagcctggtcctggaagaaatcgccagcccgagcccggcgaagaacgaaatcctcctcgatgtgcacgccgccggggtcaacttcccagacaccctgatcatcgagggcaagtaccagttcaagccgcccttccccttctccccgggcggcgaggcggccggggtggtcgccgcggtcggcgaaaaggtcgcccacgtcaggcccggcgaccgggtcatggccctgaccggctggggcagcttcgccgagcaggtcaaggtgcccggctataacgtgatgccgattcccgaaggcatggacttcgccagcgccgccgccttcggcatgacctacggcacctcgatgcacgccctgaaacagcgcgccaatctgcaacccggcgagaccctgctggtgctcggcgcttccggcggggtcgggctggctgccgtggagatcggcaaggccatgggcgcgcgggtgatcgctgccgccagtacccccgacaagctcgccgtggccaaggccgccggcgccgacgaactgatcaactacagcgaaggtagcctgcgcgagcagctcaaggccttgaccggcggccagggcgtcgatgtgatctacgatccggtgggcggcgaactgttcgaggaggccttccgcagcatcgcctggaacggacggatgctggtggtcggcttcgccagcggcagcatcccttcgctgccggccaacctgaccctgctcaagggcgcctcgctggtcggcgtgttctggggatcgttcgcccaacgccagccgcaggacaacgctgacaacttccgccagctgttcgcctggcacgccgaaggcaaactgaagccactggtgtcgcagcgcttcccgctggaacgggccggcgacgctatcgacgccctcggccagcgcagggcggtcggcaaggtggtggtggaggttcgctga

SEQ ID NO: 6097 - DNA, 1380 bp, Pseudomonas aeruginosa
aaaggcgcgacacaacaacaagcggagctcgcgatgttcggaatctttcgtcccgcgccacaccaggcgccactgcccgatgccgaggtggacagcacctaccggcgcctgcgctggcagatcttcgccggtatcttcatcggctacgcgggttactacctgctgcgcaagaacttctccctggccatgccctacctcatcgaggacggctacagccgcggtcaactgggcgtcgcgatgtcggccatcgccatcgcctacggcctgtcgaaattcatcatgggcctggtctcggatcgttccaacccacgggtcttcctgccgttcggcctgttggtgtcggcggcggtgatgttcattttcggattcgcgcactgggctacctccagcgtcgccatcatgttcgtcctgctcttcatcaacggctgggcccagggcatgggctggccgccgagcggacggaccatggtccactggtggtcgcagaaggagcgcggcagcgtggtctcggtgtggaacgtcgcccacaacgtcggcggcggcctgatcggcccgctgttcctgctcggcctggcgctgttcggcgactggcgctcggccttctacgtgccggccatcgtcgccgtgggcgtagccgtattcgcctatttcgccatgcgcgacaccccgcaatcctgcggcctgccgccgatcgagaagcacaaggacgactaccccgaaggctacgacgaacaccacgagcgcgagctgtcgaccaaggagatcttcgtcacctacgtgctgcgcaacaagctgctctggtacatcgccctggccaacgtgttcgtctacctgctgcgctacggtgtgctcgactgggcgccgacctacctcaaggaggccaagcacttcaacgtcgacaagtcgtcctgggcgtacttcttctacgaatgggcggggattcccggcaccctgctctgcggctggctgtcggacaagctgttcaagggcaatcgcggcgccaccggcgtggtgttcatgatcctggtgaccgtcggcaccctgatctactggctgaacccggccggcaacccggcgatcgacatggccgcgctgatcatgatcggcttcctgatctacggcccggtgatgctgatcggcttgcaggccctggagctggcgccgaagaaagcggccggcaccgccgccggcttcaccggtctgttcggctacctcggcggctcggtggcggccaacgccctggtcggctacacggtggatcacttcggctgggacggtggcttcaagctgctgatcggcgcctgcctgctggccatcctgttcctctgcctgaccctgcgcaaacccgcggtccaggccgcgccgcagcaagccggctga

SEQ ID NO: 6098 - DNA, 1506 bp, Pseudomonas aeruginosa
ggcaggctcgacatctatttttctccaggcatgaaaaaaggcgctccggtcaaaccggagcgccttcttcaattccctggaagactacttccgtttcatcgaatcgaagaactcatcgttggtcttggtctgcttgagcttgtcgatgaggaattcgatcgcggagatctcgtccatcgggtgcaggatcttgcgcaggatccacatgcgctggagctcgtcctcgctggtcagcagctcttcgcggcgggtacccgaacggttgatgttgatggccgggaacacgcgcttctcggcgatcttgcgatccaatgggagttccatgttgccggtacccttgaattcctcgtagatcacctcgtccatcttcgagccggtttccaccaacgccgtggcgagaatcgtaagagaaccgccctcttcgatgttccgcgcggcgccgaagaagcgcttcggcttctccagggcatgggcgtcgacaccgccggtgagcaccttgccggagctggggatcacggtgttgtaggcccgcgccagacgggtgatggagtcgagcaggatgaccacgtccttcttgtgctcgaccaggcgcttggccttctcgatcaccatctcggcgacctgtacgtgacgggtcggcggttcgtcaaaggtcgaggcgaccacttcgccgcgcacggtgcgctgcatttcggtcacttcctcagggcgctcgtcgatcagcagtacgatcaggtggcattcggggttgttgcgggtgatgttgctggcgatgttctgcagcatgatggtcttgcccgccttcggcggcgccacgatcaggccgcgctggcccttgccgatcggcgcgcagagatcgatgacgcggccggtcaggtcttcggtggagccgttgccggcttccatcttcatccgctcgttggggaacagcggcgtcaggttctcgaagagaatcttgttcttcgcattctccggacgatcgaagttgatcgagtcgaccttgagcagggcgaagtaacgctcgccctctttcggcggccggatcttgccgatgatggtgtcgcccgtgcgcaggttgaagcgccggatctggctcggcgagacatagatgtcgtcggggccggccaggtaggaagagtcggcggagcgcaggaagccgaagccgtcctgaagaatctccagcacgccatcgccggagatctcttcaccacttttcgcgtgcttcttcagcagggcgaagatgatgtcctgcttgcgcgaacgggccatgttttccaggcccatggcatcggacatttccagcagttcggcaatcggcttttgcttgagttcggtcagattcataggaaagagataggtacgcagaaagaggaattggagaaagcgtcgagcttgggaaagccgtgtcgcaagggggcgacaggagcgctagaaagttcgagtaggaagtgcgtccgggacggcatgcagaaggcgacggaaaaaacgtcgcgaacccgaatttaa

SEQ ID NO: 6099 - DNA, 1671 bp, Pseudomonas aeruginosa
ttcccgattgatcggctgccgcattggcgaccctcgccctatcgtggcaggatggcgcagttttccaatggacttgcaaagcatgccgcaaaaacctgccgaggcattcccgctgattgccgccctggacctgggctccaacagtttccacctctgtctggccaaggccaatatccacggcgaagtccgcatcctcgaacggctgggcgagaaggtccaactggccgccggcctcgacgaggagcgcaatctcagcgaagaggccacccagcgcggcctcgactgcctgcgccgcttcgcccagttcatcagcggcatgccccagggttccgtacgcgtggtcgcgaccaacgccttgcgcgaggcgcgcaaccgcagcgatttcatccgtcgtgcggaagaggttctcggccatcccgtggaagtcatctccggccgcgaggaagcccgcctgatctacctcggcgtcgccaacagcatgcccgacagcggcggtcgccggctggtcagcgacatcggcggcggcagcaccgagttcatcatcggccagggtttcgagtccgagctgcgggaaagcctgcagatgggttgcgtcagctacacccaacgctacttccgcgacggcaagatcaccccggcccgctacgcccaggcgtacactgctgcacgcctggaactgatgggcatcgagaacagcctgcggcgcctcggctggcaacaggcggtcggcgcctccggcaccatccgcgcagtggcgctggcgatcaaggccggcggccacggcaacggcgagatcagcccggacggactggcctggctgaagcgcaaggtgctcaagctcggcgacgtggagaagctcgatctggaagggatcaagccggaccgccggaccatcttcccggccggactggccattctcgaagcgatcttcgacgcgctggaactggaacagatggttcactccgagggcgccctgcgcgaaggcgttctctacgacctggtcggccgtcaccagcacgaggacgtgcgcgaacgcaccatcagctcgctgatgcagcgctaccacgtcgatccggagcaggcttcgcgggtggaggccaaggccctcaaggtgcttgccgaagtcggcgacgcctgggagctgaacggcgaactgcaccgcgacctgctgagctggggcgcacgggtccacgagatcggcctggacatcgcccattaccactaccacaagcacggcgcctacttgatcgagcactccgacctggctggcttctcgcgccaggaccagcagatgctgtcgctactggtacgcggccaccgccgcaacattccggcggacaagctggcggagttcgccgaggaaggcgacaagctggtacgcctgtgcatcgtgctgcgcttcgcgatcctcttccaccacattcgcggcacccaggaaatgccctcggtgcgtctgaaggcagagcccaagagcctttcggtgaccttccccgagggctggctggaagccaacccgctgacccaggccgacttcgcccaggaagccgaatggctcaagcgggtcggctacagcctcaacgtgcggtaagcaccggcgcggccagcttctccagcagggtcgcctgggtattgcgggggttctggttaccggtgggactgagccgctggtag

SEQ ID NO: 6100 - DNA, 768 bp, Pseudomonas aeruginosa
ctcaaggtcgcggcatcctgccgcaccgccaatcatcgcaaaaagccagcggcaaaggccattcattgcacaatcaatgacctgagccgtgacgatcgcgctttccccacgccctcaaccgagttaggctgcgcgttcatttcgcttcgctgccccgatgatgctccaacaattcctgcaggacttcggctatttcgccctttttctcggtactttcttcgagggcgaaaccattctcgtgctggccgggttccttgccttccgcggctacatgcagctggataccgtgattctcaccgccttcctcggcagctacgccggcgaccaactctggtacttcctcggacgccgccacggccgccggttgctggcgcgcaagccgcgctggcagaagctcggcgacaaggcgctggaccatgtgcgccgccatcccgacctgtgggtgctgagtttccgcttcgtctacggcctgcgtacggtgatgccggtggccatcggcctgtccggctatccaccggcccgctatcttcttctcaacggcatcggcgccatcgtctgggccgccgcgctgggctccgccgcctactatttcggcagcgtactggaaggcatgctcggcaacatcaagaaatacgaactcatggtcctcggcggcctgatcgtgctgggcctgctgctctggctatggcggcgtttcaagacaccgcgcggcaacggcgcgggcggcaacgccgacaaatccgagtgaacccgcgccggcgcgactga

SEQ ID NO: 6101 - DNA, 813 bp, Pseudomonas aeruginosa
acagccggccccttcgcacactccaactccttgtaccctccgctccggctggccgccggggccggcggctcgctatgcttgcgcgataccgaccccggccaggcccgtccggtccggatcctgcgttcccaaggagtaagcctcatgcacaagaaagttgccgtcatcctctccggttgtggcgtctacgatggcgcggaaatccacgaaagcgtgatcaccctgctccgcctcagccagcgtggcgccgaggcacaatgcttcgcgccgaacatcgcccagcaccatgtggtcaaccacctgaccggcgaggaaatgccggaaagccgcaatgtcctggtcgagtccgcgcgtatcgcccgcggcgaagtcaaggacctgcgcgaagcccgcgccgaggactacgacgcgctgatcgtgcccggtggcttcggcgctgcgaagaacctcagcgactttgccatcaacggcgcgcaatgccaggtgcagccggacgtgctggcgctggccaaggctttcgccgaagccggcaagccagtcgggctgatctgcatcgctccggcgatggcggcgaagatctacggcgccggcgtccaatgcaccatcggcaacgacgccgacaccgccgacgcgctgaagcagatgggtgccgagcacatcgacgcgccggtggacgagatcgtcgaagacagcgcgcgcaagctggtgaccaccccggcctacatgctcgcccagtcgatagccgaagccgcttccgggatcaacaagctggtcgaccgggtgctcgaactggtggaccaggacaaggcctga

SEQ ID NO: 6102 - DNA, 561 bp, Pseudomonas aeruginosa
tggagaaactcagcgagtcgccgccaagctgcttggcggcctctgccagcttgcccttggccagctccagctgttgcgccacctgggtttccgggaggccatcgcgcaacgcctggcggtaggccatcagctgcttctcggtggagcggcgcaaatcggcgtcgacgttgtccagcgagctttccaccagctcgaagccctccaggtaggccgccaccgacaggtcgtaggcctggtcgcggtcgccttcgcgatagaccgcgaagctcttgtccagggtggcggcggtatagtcgatcaactgcccaggaccgcgctgctccagcggcggatgcgcacgcagggcgcggaagctctccgcagcggcctcgccgtcgtgctcggcgacttcggccggagtctgcgtggccagggtcgccagcgggtaggcatgggccttgtccggctgcgcactgccggcgctcaggccggccacatagctggccaggtcccagcgctggcgttcgtcgagctggtcggcgaacgccggcatgtcggtgccggccacgcccaggccgatga

SEQ ID NO: 6103 - DNA, 930 bp, Pseudomonas aeruginosa
cacgcgcgcagccagcccggtgtagccggccatgacgatcaggtcgacgacgatcatggtgccgcccatgatcaggtattgcgccagcagcggctggtgcgggtcgatgaactgcggcagcaccgcgagcatgaagatcaccgccttgggattgctggcgttgaccaggaaaccacgcagcaccagggtcaacggtcgccccagaggccgttcgccatcggtgctcaaggcctgtggcggcgcctgccactggcgcaccgccaggtacaccaggtaggccacgccgaaccacttgatcaggctgaaagccagtgccgaggtcgccagcaacgcaccgacgccggcggcgacaatggcgatctgcagggccaggccgatctgcaggcccagcgcgttccagtagcctcgcgcaaagccgtactgcaacccgcaggacatcgaggcgatggctccggcgcccggcgacaggctgatggcccagcaggcgaggaagaaggcgaaccaggtactgacgagcattgcacacctcggaaagcgaacgcggctggcggcgggaacgaaaaagccagtgtgcaccaaggcggagcagccgcacaggttttccgaccacgcgcctcgcccaacctttgcgggcgcaacctggcggacagaaaaaacccggcagatgccgggctttcccgaggatacgtgctcagccatgttgggcagaccaccgcgatgcggctattcgccctggccccgaacgctctcagtccggcgaacccttgcgcagcttcaccggctcttcgccgcgcttgcgcgccagggctccgcgcaagcggatgttcagcgcctccaccgccagggagaaggccatggcgaagtagacgtagcctttcggcacgtgcacttcgaaggactcggccaccagcacggtgccgaccacgatga

SEQ ID NO: 6104 - DNA, 831 bp, Pseudomonas aeruginosa
acgctccagcgccttgatccggctctgcgcctggcgcgccttggtggccttggccttgaagcgggcgatgaagctttccatgtgcgcacgctgcgcctgctgtttctcgtaggcctgctgttgctgagccagccgctcggcgcgggtccgctcgaaagcggaatagccgccgcggtagagggtcagcttgcggttttccagatgcaccacgtggtccaccaccgcatcgaggaagtcgcggtcgtgggagatcagcaccagagtgccgggataacccttgagccactcttccagccagaggatggcgtccaggtcgaggtggttggtcggttcgtcgagcaacagcaggtcggacgggcacatcagcgcctgcgccaggttcaggcgcatcctccaaccaccggagaaatcaccgacccggcgctccatctgctcgctgctgaagccgagcccggccagcagcttgcgcgcccgtgcatcggcggtataaccgtcggcgttgtccagctcggtatgcaggcgcgccagggcagaaccgtcgtgcgccgcttcggcgacggccagcgccgcctggatctcgcgcaggcgactgtcgccgtcgagcacgtaatccaccgccaggcgatccagggtatcgacctcctggcgcatgtgcgcgatgcgccagtcggcgggcaacaggcagtcgccggcatcctgcccgagctggccgcgcaacagcgcgaacaagctggacttgccagcgccattggccccgatgagaccggctttctggccggcgtgcagggtcagttcagcagcttccaggaggcgctgcggcccgcgctgtag

SEQ ID NO: 6105 - DNA, 486 bp, Pseudomonas aeruginosa
ggctgtatgactggaaatgtctggaaattcgcggtggacgtctatgcccggccgggcgtggaaacggcttgcctcgcgcttcaggagcaaggtgcggacgtctgcctgttgctggtcgccgcctggcttggcaggcgcggtgtgagctgctcgaaagaacgcgcccagatcctggagaacgccgcgcgtccctggcgcgaaacggtcatcgaacccctgcgcagattgcgttgcgcctggcgcgaagcggcaacccacgacgcctgcctggccgaactccgcgaggaaatgaaggcccaggaactacgagcggaacgggaacacctgcaacgcctggccgacctggccacagcctggctggagggccaggaagcgaatcgcagtgcggatgcctggctgcaagcctgcagccgggacatctgcacggaagcagagcgccgggctttgctggtgcttggctcggcggctttgcagacagcgccttag

SEQ ID NO: 6106 - DNA, 756 bp, Pseudomonas aeruginosa
gaggcgctggtcggggcggcgccgttgctgcccgcggcaggcgttgccgaagcagcgctggaggcggctgccggggcgctgggagtcgccgcaggcttcgcagcaggagcggtggcgggcttggttgcggcaggtttcgcggctacgggtttcgccgcaggcttggccgccggtttcgccgcaggcttcgcagccggcttggctgcaggcttcgcggccgcggatttcgccacaggcttggccgccggtttcgccgcaggcttcgcagctggcttggctgcgggcttcgcggctgcggttttcgccgcgggcttggccgtcggtttcgcgacaggcttcgctgccggcttggcggcgggcttcgcggctgcggttttcgccgcaggcttggccgccggtttcgccacaggcttcgccgccggcttggctgcgggcttcgcggctgcggttttcgccgcgggcttggccgccggtttcgcagcaggcttcgccgtcggcttggctgcgggcttcgctgccgcggttttcgccgcaggcttggccgccggtttcgcagcaggcttcgcagccggcttggccgcaggcttcgccgctacggttttcaccgcaggcttggctgccgccttcgcagcaggtttggtcgcgggtttcgccttgcggctctccagagccttgccagcagcttccttcaccttgccgacaccctgcgccagcttgaggctttcctgtacgtcacgcttgaggccgacgatgtag

SEQ ID NO: 6107 - DNA, 612 bp, Pseudomonas aeruginosa
gtacgggtgtccgcctgccgggccttcagggtatccaacgcctcttccaggtcgctgatggtctcgcgcgccttggcctgtgccttggtcttgccggccttggcagcatcctgcagcttggtgcgagccttgtgcagcttttcctgggctttgccacgttgcttttcaagtttggccaggagcttttccgaatcgaccagcgcttgtttgcacgcaccttccaggtgctcgacaaggctgtgggaaagttgctgcaacaggtgcaagggggtggtgacgggcttcttgttggccgacatgacgtgcctccaggcggacgtggttgcgcccatactagacccgcacaccccctctcgccaacgggttcgatgtgctacaagcgacgtgcgccaggattgcccgccgattcgtttggagaaaccgcatgccgcgccgccttttcatcggtctttttctactgccgctgccgcttttcgccgcgcctcccaaggacgaactggcctatgccgtaggcgcccgcctgggtatgcgcctacagcaggaaatgcccggcctagagctatccgagctacttctcggactgcgccaggcctatcgcggcgaggcacttga

SEQ ID NO: 6108 - DNA, 573 bp, Pseudomonas aeruginosa
cggcatcggcgcggcaacccaggtacacgtccgttaccgcggcctgcttgccgacggtcaagtgttcgaccagagcgaaagcgccgagtggttcgccctggacagtgtgatagagggatggcggacagcgttgcgagcgatgcctgtcggcgcgcgctggcgagtggtgattccttcggcgcaagcctatggtcacgaaggcgctggcgacctgatcccgcccgacgctccgctggtcttcgagatcgacctgctgggcttccgctgaaatgcaaaaacggcgctctcccgcatggagacgcgccgtttcgtaacgactcgccggtgaatcagaccggtactgccgaaccctctgcgccgctctggctgtgggcgttgtgcaggacttcgatgaggcagtcctccagctcgaagcgttcgtgcaactgttgccgcaggaccttcagctccgcgatgaggcaggctccttcacggcaatcgccgttgtcgcagcggtcgttgaagttcagcgcggattcggtgatggcttccagccgggggaagatctgcttggccagctccaggccgcgctga

SEQ ID NO: 6109 - DNA, 438 bp, Pseudomonas aeruginosa
ataccgctcagggcatcgaaggcctgcaccagttgctggcgctcatgcagccagcgatcgatcagttggtgcacacccccccaccgctcttgggcattacggcagctttcgagcatgttgtcctcgcttccctcttcggacgtcccggagaatcatcgtccgctccgagacgcattgctgacgcactctctgcgctctgtgggagaacgcctgtgcaaggggcggactccggcgctatggaaagccagattatgcccccgggatgaccccatcaagacgcccgtacagaaaaattcatacggatgtttgatcggtatcccgcatccgctctggttttcgccaaatcgatacggccgacgctcgagagctgacgaaagaccacgcgacagcccgcatcaggcacgtcggaggaactgcacgatggagaagccgagatag

SEQ ID NO: 6110 - DNA, 399 bp, Pseudomonas aeruginosa
cgggggctggccaggggcatggcggatccacaggtacacaggggaaaggccgcctacggtagtggaaagcctccggccgtttcaagccgcaaggcagctctgcggcaaggcatcccgaatcatgccgggcgcccgcgacaagccgccacagtcctgccgatggagccgaacggggaacgccgggtggcgttccccatgctcaaatccccgccaccaccacgggcagccccggagtacgccgatcgagcaggaccaggccctcctggaacaactggttgctgcgctcgacctcgccgagctgcgccagcaggcgtcccagctcggcgcaggtctcggcactgcgctggaagctcaggctggcctccaggtattcccgggccttgccccagagcttgttga

SEQ ID NO: 6111 - DNA, 1374 bp, Pseudomonas aeruginosa
ccacccgccccgagctgccgagcaggcgcaggaccaggcgcaccagcaccaccagcagccagaccaccgccagcagggcgaggaacgaccacaggctggattcgtaacggaagctcttgtaggcgatcagcacatagccggcctgctcggagatcgccagcccaaccagcgtggcgaccagcaccaccgccagaaccaggaggtagatgcgtctcatggacggccctccgtggccggagccgcctgcgcctcgggcaccaggttgccggcggcctcgcggcgcgacacgtacgactgcaaggcgctcagggccggtgcgatgtcagggacctgcacggtgaccggctgcttcgccaactcatcgatacgcaacttcaacgcacggctgtcggccagctctacgttgaaatagccgtccaacacgtcctgggcctgcttcagcgcctgctcgtagacttcctgcttgccattcagcgccgcccactgggcttgctccagggccaggccgatggtcaggcgcacctgcgccaattgctcgccggccagcagcggacgaatgtcctggccggcattgaagtcgatgcggatgtagcgcgagatcttctcccaccacagctcccaggtgctgttgccgtcgccccaggcgacattgctggcaccgctttcgccttccttgaaggtcggcgtgagcggttgcaactggttgacctgctcgcgcaacgccgccagttgcacgaacagcccggtacggtccggctccggcaacgcacgcagggcctcgaggctggccgccagcttggcacgggcggcataggcgccgggatcgttctgcgcgcgcaggatgtcatcggcgccctgcaccagctcggtggcgctacccacgtcctgcaaggcggacaggcgcaggctggccaggcgcagcaggtgttcggcctcggccagtcgccattgctggcggctctggccgaggagcttcttcagttgctcgctgagatgctgctggtcgccctgcagctccaccacaaggcgtcgccgggcctccagttcgtccgcggtaggcaaagcgtccaggcgggcagccagttgctggttgcgctgggccagggattcggtcttgccacgggcatcttccagctgcgccagctggtcgcgctcggtgccctgcaactgctggacctgccagaagctccagccacccgcgccgagtcccgccacgccaaccagcagggcgagcaacgccaggccggtggcggtaccggaacgcctggatgcatcgggtgcaacgggagaaggggtggaagtggaagttcttgcgtcgtcttggggagtgactgcttcgctcacaggtccatcctttggtcaagaaagttctag

SEQ ID NO: 6112 - DNA, 2052 bp, Pseudomonas aeruginosa
tgctcggcgaccgccgtgcagcccagggtgagggccaccaccaacaggcagcaggcactccccgccagcgccaccggcaggcgtgcgagcaatggccgcaggcggcagaacagcgccgccgagagcagtacgatccactgcacgaacagcgacgccagggccaggcgcacccagttgaagctcggcgtcatcggctccgccagcaccagcacgagcaccagcagctccgccagcagcaccagggtgaacagggcttcggcttcgcagagctcgggaatgaagaagtcgtcttggacggccggccgggtcgagcggccgggcttgaatcggataggcatcgacagagtttccgcaaggcccgtggcgcccgcaagacagccgcgggcgtacgggcgaaataaagcaccgaaatgccatctgccgcaaaaaaccgcgaaacagcgctcgttccggcttcgtcgacgagccgccggtttttcctcccggcctgctatcatcgtcgcactttgcccgtcacgcaggccgcgcggcctgtccgtttcttgttgcagcgagagataccatgagcgtagagaagaccaaccagtcctggggcggccgcttcagcgagcccgtcgacgccttcgtcgcccgtttcaccgcctccgtcgacttcgacaagcgtctctaccgccacgacatcatgggttccatcgcccacgccacgatgctggccaaggtcggcgtgctgagcgacgccgagcgcgatgcgatcgtcgacggcctgcaacagatccaggcggaaatcgaagccggcagcttcgactggcgcgtcgacctggaagacgtgcacatgaacatcgaggcgcgcctgaccgaccgcatcggcgtcaccggcaagaagctccacaccggccgctcgcgcaacgaccaggtggccaccgacatccgcctctggctacgcgacgagatcgacaccatcctcgccgagatcacccgcctgcaggagggcctgctgggcctggccgaagcggaagccgacaccatcatgcccggtttcacccacctgcagaccgcccagccggtgaccttcggccaccacctgctggcctggttcgagatgctcggccgcgactacgagcgcctggtcgactgccgcaagcgggtcaaccgcatgccgctcggctcggcggccctggccggcaccacctacccgatccagcgcgagatcacctgccagttgctgggcttcgacgcggttggcggcaactccctggacggcgtctccgaccgcgacttcgccatcgaattctgcgccgccgccagcctggcgatgatgcacctgtcgcgcttctcggaagagctggtgctgtggaccagcgcgcagttccagttcatcgacctgcccgaccgcttctgcaccggctcctcgatcatgccgcagaagaagaaccccgacgtgccggagctggtacgcggcaagtccggccgggtgttcggcgccctcaccggcttgctgaccctgatgaagggccaaccgctggcctacaacaaggacaaccaggaagacaaggaaccgctgttcgacgccgccgacaccctgcgcgacagcctgcgcgccttcgccgacatggtcccggcgatccggccccggcgcgagatcatgcgcgaggcggcacgccgcggtttctccaccgccaccgacctggccgactacctggtgcgcaagggcctgccgttccgcgactgccacgagatcgtcggccacgcagtgaagtacggcgtagacagcggcaaggacctcgccgagatgagcctcgacgaactgcgccgcttcagcgagcagatcgacgccgacgtcttcgacgtgctgaccctggaaggctcggtcaacgcccgcgaccatatcggcggcaccgcgccgaaccaggtccgtgccgccgtcgcccgcggcagaaaactgctggcacagcgctgaagtcgcgcccagtgcccggcagatctccctgtcctacccgagacttgatcgcacggcgggacaggaacgcccttgtagatcgacagccactctag

SEQ ID NO: 6113 - DNA, 198 bp, Pseudomonas aeruginosa
gcaaaccaaggtgtagagttgctgtatgtccctcctccactctccggtggcttctcccattatgccaattcccaaagcaatccatacaaaaaaatagcacagcatcctaagcgtgaatattatataaggaattctgctagagttctggaactgccaacgcatagagttgcaatatgcctcagcacctccaacctctga

SEQ ID NO: 6114 - DNA, 411 bp, Pseudomonas aeruginosa
ccagcggctggtcgggatcgccttcgaggaaggtcaccagcacctccatgccgacccgcgggatggcgatggcaccgtagttccttcccgcccagccggaggcaacgcgtaaccagcaactgctgctgtcgtcggcctggccctcgcgatcccagtggaattgcaccttcacccgaccgtagcgatcgcagtggatttcctcgcccttcgggccggtcaccaccgcgctctgcgtgccgaggatgcgcggcttcggcggcgtcggtgggggacggaagaacgcctcccagggcgtggcctggaagcggttgcggtaaccctgccggaagtcgtccgggctcgccgaggcatcggagacgatgctttcctccagcacctgaggctgccgcccctcgtgaatcacctcggtga

SEQ ID NO: 6115 - DNA, 1566 bp, Pseudomonas aeruginosa
agggttaggatgacctattcgagcaagctctcctcgcattatctggaactcgcggaacagccgatttcaaaggatgtctttgcgggtgaggatgtgcgtttttccagcgaatacgaggcgctggaaaatgagctgggcaaggcgctctcgctccatgagaacggccagactgactggttgaaaatcctggaaaacagcgaagcgctgcttcgtgcccaatccaaggacctgcgtgttgcagcctggttgacctgggccctctaccaacgggaatcctttcccggtttgctggccggactgggattgctggaacgtctgtgcagccggcattgggtcgagatccatccgctcaaggcgcgcactcgcgccgcggccattgcctggctggtgccccggctggagcaggcgctgaacgagaacgtaccgatcaaggagcaactccccctgttccggcgtctcgccgagcacctggaaaaactcgataccgcgctgaccgcgcaactgggcgacgacgcgcccttgttgctgccgatcagtcgacgcctttcgggcatgctccagcgcgccgccgacaaccagcccgaacctggcgtggtcggcgccgtggtggcccaggtcaagcaggcggccagccagttgctggcgcctggtgcgcccatcgacaacgagcgcgacgcccacaaggccatgcgcgcccagcaggaggctgcacgccccctgtgcgcctggtggctgaagcagaaagccaccgatctgcgcgcgctgcgcctcaaccgaacgatgctctggctgcccatcgagtccatgcccgagcgcaatgccgaacaggtcaccgcgctaaggggagtgccggcggacaagctgaaaagctaccaggagcgtttcgcccagggcctgtacgccgatctcctggtggagctggaggcgagcctggcacgggcgccgttctggttcgacggccagcgcctggtctgggagtgcctgcaagggctcaacgccgagcaggcgatgcgggaagtcgaaatgcatttcgccttgctcctgcagcgtctgccggggctggtggagctgcgtttccacgatggcagcgcattcgccgatgcggccacccgcggctggatcagcgcccatgtcatgccccatctccagaacgacagtgcgccgcgcaaggtcgagaccgtggccctgcaggccgaatgggacgtcgccctggacgaggtccagccggtgttgcgcaaggacggcctgaaggcggcggtacaggtgttgaagcagggcatgaagcgcgcccacggcggacgcgcccggttcttctggcaactgagcctcgcgcgactgtgcttcctggcgaagaagtacgagctggccaagacccagctggagagcctcgaccatcagttgcacgaatcgggattgcacgcctgggagcccgatctggcgctggatgtactgcacctgctgcatagctgctgcgagctgttgccgcagaaccacgccgtgcgagaacgcaaggaagacatttatcgcaggctgtgccacctcgatctcgaggtggtgctcgaatag

SEQ ID NO: 6116 - DNA, 1530 bp, Pseudomonas aeruginosa
gcgccgccccctcccaggacgcctgagccaccccctagccaaggaagcagatacatgagcaccagtgccgcacagcaaggccggaaccagaacggcgaatacaacattctcgacagcatcatcgccgagacccgcctgagcccggacgacgaggcctacgacatcgccaagcgcggcgtctccgccttcatcgaggaattgctcaagccgcagaacgacggcgagccggtgaagaaggcgatggtcgaccggatgatcgccgagatcgacgccaagctcagcacgcagatggacgagattctccatcatcccgatttccaggcgctggagtcggcctggcgcggcctgcaactgctggtcgaccgcaccaacttccgcgagaacatcaagatcgagattctcagcgtttccaagcaggacctgctggacgatttcgaggactcgcccgaggtgatgcagtccggcctgtacaagcacatctacaccgccgaatacggccagttcggtggccagccggtcggcgccatcatcgccaactactacatgtcgcccagttcgcccgacgtcaagctgatgcaatacgtctccagcgtggcctgcatggcccatgcgccattcgtggcggccgccggtccgaagttcttcggcctggaaagcttcaccggcctgccggacctgaaggacctgaaggatcatttcgaaggcccgcagttcgccaagtggcagagcttccgccagtccgaggattcccgctacgtggcgctgaccgtaccgcgcttcctgctgcgcacgccctacgatccggaagagaatccggtcaagtcgttcgcctacaaggagaccgtggccaacagccacgagcattacctgtggggcaacaccgcctatgccttcggcaccaagctgaccgacagcttcgccaagtatcgctggtgcccgaacatcatcgggccgcagagcggcggtgcggtagaggacctgccgttgcaccacttcgagagcatgggcgagatcgagaccaagatccccaccgaggtgctggtgtccgatcgccgcgagtacgaactggccgaggaaggcttcatttccctgaccatgcgcaagggcagcgacaacgccgcgttcttctccgccagctcggtgcagaagccgaagttcttcggcatcagcgccgaaggcaaggccgcggagctgaactacaagctcggcacccagttgccgtacatgatgatcgtcaaccgcctggcccattacctgaaggtcctgcaacgcgaacagctggggtcgtggaaggagcgtaccgacctcgagctggagctgaacaagtggatccgccagtacgtcgccgaccaggaaaaccccagcgccgaagtgcgcggccgtcgcccgctgcgcgctgcacagatcatcgtcagtgacgtcgagggcgagccgggctggtaccgcgtcagcctgaacgtgcgcccgcacttcaagtacatgggggcggacttcaccctgtcgctggtcggcaagctggacaaagagtaa

SEQ ID NO: 6117 - DNA, 420 bp, Pseudomonas aeruginosa
gcggagctttccatgaccggatacggcagcctgttcgagcgcctgaacggcgacgcggataagcgcgtcggctggagccgcgaggtttccgccatggcgtcggtggctgcccatctgggcaagatgctcagcacccgggcgggcagcgtgcagacgctgtccgactacgggttgcccgatctcaacgacatgcgcctgagcctgcacgactccctgagccaggcccgctcggccatcgaaggtttcatcgaggcttacgaaccgcgcttgagcgacgtgcgtgtcgtttccctgccacgcgacaacgaccagctccgcctggccttcagcatcgaaggcttgctggaggtgggaggtttcaagcgccaggtgagtttttccgcatgcctggatggcagcggccaggtgaaggtcagctaa

SEQ ID NO: 6118 - DNA, 1791 bp, Pseudomonas aeruginosa
gccgtgtccttcaatcattactaccagagcgaactcaccgcactgcgccagctggggcgccgtttcgccgagcgtagcccggccctggccccgtttctcgggcaggtcggacgcgatccggatgtcgagcgcctgctcgagggctttgccttcctgaccgggcggttgcggcagaagctggacgacgagttgccggaactcagccactcgatgatgcacctgctgtggccgaactatatgcgcccgctgccggctttcagcattctccagttcgaccccctgacccgcccgggcggggcgctgcgcgtggagcgcgatacgccggtcgagagccggccggtgggcgaggtcgcctgtcgcttccgtacctgctacgccaccgaagtcctgccgctggtgctggaggcgctcaactattcggtgaccggcgagggtgcgctgctcggcctgcgcctggcgatgaactgcgacgggcatctcggcgagctgggcctgagtcggctgcgcctgcacctggccggcgagcgctacatcagccagatgctctacctgtgcctgctgcgcaacctggagagcatccagctgattccgctggatgcccatgggcggccgctggatggcgtggccggcaagccgatgtcgttccgcctgacgggcgagcgggtgcagccggtggggttcgccgaagacgaggcgttgattccctatccgctgaataccttccgtggctatcgctacctgcaggaatacttcgcgttccaggacaagttcctgttcgtcgacgtggatggccttgacctgctcggcgctctgcccgaggaaaccctcaagcaggtccgcggcctcgagttgcgcttcgatatccgcaagagcggcatccagcgcctgcacccgacgctggagaacgtcaagctgtactgtacgccggtggccaacctgttccgccacgatgcgctgccgatccgcctcgacggcaagcaggacgagtacctgctgatgccggccgaatacagcctggaggactgcggggtgttctcggtagagggcgtcaccggctggcggccgggcgggctcggctaccaggcctatgtgccgttcgagtccttcgagcacgatcccagcttcgacgtcccggaagcacggccccactacagcgtccggcaacggacctcgttgctgcacgatggcctggacacctacctgagcttcggcatccgccatcccgagcagatcgagacgctgtcggtggaactgacctgcaccaaccagaacctgccccaacggctgcgcctgggcgatatctgcgtcgcttgcgaaggtacgccggagttcctcggtttccgcaatatcaccccggcgacgccgagctacgcgccgccgctgaaccgcgatttcctctggaaactgatcagcaacatgtcgctcaactacctgtcgctggccaacgtcgacgcactcaaggtgatcctcgaaacctacgacctgccgcgctactacgaccagcatgcggcgaaggtcagcaagcgcctgctgggcgggctcaaggcggtccgccacgagcatgtcgaccgcctgcatcggggcctgccgctgcgcggcttgcgtaccgagctgacgatcgatccggaaggctacatcggcgagggcgacctgttcgtgttcgcttcggttctgaacgaatttttcgcgctttacgccagcatcaactcctaccacgagttgcgggtgaggagcacacagggagacgtgtaccaatggaaaccgcgcatgggtttgcagcccctgctgtaa

SEQ ID NO: 6119 - DNA, 408 bp, Pseudomonas aeruginosa
tcgagtcggtgctgcgctactacttcaagcatgccgaactggtcgccgagcagtgtatcgaacggcgcgtcgcgatcctcgaagagcagcgcaaccggctcggcctgttcaacagccagcttggcgaagacgcggtgctgggcgaacgggtccgcgaccgcagcggcaagttccgcattcatatccgccagctcgactggcagcgcttccacgagttcctgccgatcggtcccggctaccagccgctttgcgcgctggttcgcttcaccctgcgcgacccgctcgactacgacatccggctggtcttgcgccacgaggaaatccgtgagttccgcatcggcgcgcagaacgcctgccgccttggctggaccagctggctgggccgggagcgcgcggatggcgtggtga

SEQ ID NO: 6120 - DNA, 597 bp, Pseudomonas aeruginosa
cgatcctgcgtggcctggcccgggtttacgaggaaagccacggtatctacttgcgcgacgacgcggtggtggccgccgccgaactgtccgcccgctacctggcgggtcgccagttgccggacaaggccgtcgacgtcctcgacaccgcctgtgcgcgggtgcgcatcagcctggcggcggcgccggagagtctcgagcgcctgcgcggcgagctggccgaaggcgagcgccagcgccaggccctgcgccgcgatgccgaggcaggcctgccgatcgaccacgatgccctgcaggcgctggaggagcgcctggcccaggcggaaagcgagcggcacgtacaggaggaccagtggagccgccagcgcgaactcgccgagcgcctgctcgccctgcgccagcaattggccagggcccgcgaggcgaaccgggaagagcagggcggcgaggcgaacgcggagactttcccggccgacgagcatggcggtgtcgaagccctggaaaaggcccttcacgaaacccgccaggcactcgccgatgcccaggcccaggggcggctggtcagcttcgaggtctgcccgcgcctggttgccgaggtga

SEQ ID NO: 6121 - DNA, 1659 bp, Pseudomonas aeruginosa
tcgaccacctgctggacacgcacctgctgccgctggtggccgaccgtttgctggaagcgatggcgcgcgacgagcgtctcgagcgggtccatgcgacgctgggcgagcacggccgcgtgctctgcgagttcgcctgaggtgggtgcgatgttcagccgcgtaccgcaacccctggccttcgccgaagccctgctcgctcagttcggcgcgctgtcgcgggaaaccgacatcacggccctgctgggcggtttcgcacgcgcagtcggcgaactcagcggctgcgagctgagccagttgtatctgctcgaccagacccataccgcgctcaccctcaacgccgaatgccgggacggcctgttgcaggcgctggagccgtcgagcctgccggcggactacaccggcgagcagttgctgcagttcgccctgtgccagaaccgcgtggtcagtctcgtcgacctgccgtcgcggctgcacgagaccggcttcctgccggcaggggagcagccctggctgtccctgctctgcgttccgctggtgagcccggagaaaacggtcgagggcatggtggtctgcgctacccggcgcccactggacctgcagggattcgcccatccactgggccagctgggctcgttcgtgctggcccagctgcatctgctgcaacgcctctcgcaaccctccggcgagccgcagggaccgtccagcgcaccggtggtcagcggatacgggctgatcggcaggagcgcggcgatgcgtgagacctgccgcctgatcagcaaggtcctgcacaacccctataccgtgttgctgcagggcgagaccggcaccggcaaggaggtggtcgcacgggcgatccacgagtacggcccgcggcgtgcacaggcgttcgtggtgcagaactgcgcggcgtttccggaaaacctgctggaaagcgagctgttcggctaccgcaagggcgcctttaccggtgccgagcgcgatcgtcccgggttgttcgatgccgcggatggcggaaccctgctgctcgacgaaatcggcgacatgcccctctcgctccaggccaagctgttgcgcgtgttgcaggaaggcgagattcgcccgctcggcggcaacgacacgcacaaggtcgatgtacgcatcatcgccgctacccaccgtgacctcgccctgctggtacgcgatggcaagttccgcgaagacctctactaccggctggcgcagtttcccatcgagttgccgccgttgcgccagcgcgagggcgacgccctcgaactggcccggcatttcgccgagcgcgcctgcgtgttcctgcgccgcgcgccgctgggctggtccgcggaagcgctggaactgctcgacggctatggctttcccggcaacgttcgggagctgaagggactggtggaatgcgcggtactgctctgcgaaggcgagatgctgctggccgaacacttttccctgcgcgcgcccccggaagcggaggcgccgctcaagctgcgcgagcatctggagcagatcgaacgggacctgctgctcgcctgcctgcgcaggaacgctggcaaccagaccctcgccgcgcgcgaactgggtctgccgcgacgaaccctgatctatcgcatgggacgcctgaacattcatttcggcgatccccggacctga

SEQ ID NO: 6122 - DNA, 1431 bp, Pseudomonas aeruginosa
tcgagatttccttccaaccagcccagccgggcgcgcgcctggagcgcggcgtccgcggcccttccatggagactccctgatgcctgttcgtcactggcccgccgtgcttctggccctggccgtcctctgcggcctcgccggttgcagcggcaactacaaattcaacgacggcgactatcgcccgcttggcgatccgcaggcggtcaatcgcggcaagtgaccgcaaggagcgatctcatggaactggtattggaaatgctcagcgccaagcaattcgtaccgacggagctatgcagcaagaccttcggcaggaacggcggcctcatcggccgcggcggtgagtgcgactgggcgattcccgatcgcaagcggcacctgtccaagcagcatgcgcgggtcagctatcgcaacggcgcgttctacctgatcgacaccagcagcaacggcatccgcgccggcaacggcagccgcctgccgcatggcgagccgcagcgcatcgagcaggacagcgtcttcctgctcggcgacttcgagatccgcgcgcggttgctgcgcgagcccgacgagctcgccatggacgtcgggcggccgcagccggcgggcagcatcattccggacgatgccttcctggccctcgatccgttgcaggcgctcgaccaggacggtgcagatgcctacgaactcgacgacctgagcgcgatcgcccagcccagtcatgaggccggggcgcgtgcggactacgcgcggatcgacatggaaagcctggtcgtaccggagctggtgcccgccccggcggctccgcaggaacccgtggaaagtccgcctccggaacgcgacgaagccttctggcagcgtttcggccaggctctgggaatggacctcgaaggcctcgacggcgctgcgcgcgaagcgctggcgatcaacgccgccggtttgctgcggcagtgcatcggcggcttgcagcagagcctgcggacccgcagcgaactgaagaacgaactgcgcctgtcgctgagcacgttgcgcgataccggcaagaatcccttgcgcttcagcgccgatgccggcgaggcgctggggcatctgctacgggatggcaagcctggccagttgagtggcgaacaggccgtcgcacgcagtttccgcgacctccaggcgcaccaggtggcgctgctcggcgccagccgggcggcggtgcgcgcgaccctcgagcatttctcgccgcagcagctgaccctgcgtttcgagcgcgacggccgccggccgttgctggccacctcgggcagccgctggcgtgcctatggtcgctaccaccagtcgctatgccaggacgacgactggagcgagcgcctgctggcacgtgatttcgcccaggcctacgaagagcaggttcgcctgatttccaccctctacaccgagcaccaaggatga

SEQ ID NO: 6123 - DNA, 900 bp, Pseudomonas aeruginosa
actgaaattctgggccatcaggaactgaacatgatcaaggaaagggaataccacgaggacgagaagaccgtcctcctcgatcaccagggacaggtaccggcccaggggccgctgaccgatttcgccgaaccgccgcgcttcgagcagctcgaggagcggatgatctacgcggcgcgcctgcgtccgggcgaggccttcaacgtcagcctgaacccgctggtggcggcggcttccgaactgctttcggaagtggtccggctcaagcacagcagcgtgctggagaaccttgcggcgctcaaggagcggttgacctccgccatgaagctcttcgaattccgcgccgtgcaggatggcgtggaaaacagccaggtcatggcggcgcgctacgtgctgtgcacggtggtcgacgaggcggtggtgaccaccccgtggggcaacgaaagcgaatggtcgaagatcagcctgctgagcagcttccataacgagaccttcggcggcgagaagttcttccagttgctcgaccggctgtcgaagaacccggtcaagcatctgccgatgctggagctgatgtacctctgcctggccctaggcttcgagggcaagtaccgggtgatggcccgcggcgtgctcgacctggacggtatttccgatgcgctctaccggcagatccgccagttgcgcggcgacgtgccgcgcgaactgtcgccgcactggcaggggctcagcgaccagcgtcgcggcctggtgcggatcgtgccctggtggatggtggcgctgttcaccctggtctgcctggtggtgatgtattcgggattcgcctgggttctcggcgagcaacgcgacacggtgctgcagccttaccagtcgctcgatgcggcggcaggacagcccggttcgtaa

SEQ ID NO: 6124 - DNA, 1506 bp, Pseudomonas aeruginosa
acacagggacgcgaaatgaaaaacttcttcaagaaagtcggcgccttcctgcgcaagacgtgggtctggacgctgctgctggtactcctggcggcattgctggtgtggttcgtcgggccgctgctggcggtcgccgactacaagttctgggaaagcccgacctcgcggttgctgagcatcagtctgatgttcctggtctgggggctggcgatggtcttcgtcagctggcgcgccggagtgcggcgcaaggccgtcgaggacagcgacgagggccaggagcgcctgcgccgtgacggtctgatcgaagacgaacagaaggaattgcgcagccgcttcaaggacgccttgcgcaccctgaagacctccagcctgtaccgcggtcgtagcgagcgctggcgcaacgagctgccctggtacctgctgatcggcccgcagggaagcggcaagaccagcctgctggacttttccggactggagttcccgatcaaccggatcgaccgcaagctgacccgcgataccgccggcacgcgctactgcgactggtacttcgccgaccacggcgtcctgatcgacaccgccgggcgctacctgacccaagccgacggcgaggtcgacgggggcgcctgggcgactctgctcggcctgttgcgcaagcgccgccgcgcacggccgctgaatggcgtgatggtgtcgattccggtggaaacgttgctcagcgacgacgagatggcgctggatacgctggctcgccaggtgcgcgcgcgcctgcaggaaatccagcagaccctgcacctcgatctgccggtctacctggtgctgagcaaggccgaccagttgctcggcttcgacgagttcttcgaccagttgagccgcgaggagagcgaccaggttctgggcaccagcttcggcaaggagcagaacggcacagatgtgacggtcctgcgccaggcgttcgaggaccttctgcgacgcctgaacagccaggtgatcatgcgcatccaccaggagcgcgataccctgcgtcgcggtcgcatcctcgacttcccgcaccagcttggccagatcggcgagcggttgtgcctgttcgtcgaactcgccttcaccggcaaccgctaccagcgcgccagccgcctgcgcggcttctacctgaccagcgcgccgcacctggcccagcagctggatgaagacaccgccggcatcggcgccaacctggggatcgccagcggcctgttgccgaccctgcgcaacgggcgctcgcgcttcatccatcacctgctgagccaggtgatcttccccgaggccaacctggcaggtctcgatcgccgcgaacgcacgcgcatccactggggccagcgcgccctgtacgtcggttcgctggcgctccttctgctattcggcctgctctgggctggcggtttttttggccaaccacgagcgcctggagcgggtccgcgagctggcgcagcaatggacccagcagcgccaggcgcttggcgagcgcgatga

SEQ ID NO: 6125 - DNA, 852 bp, Pseudomonas aeruginosa
cgtgatggtgctcaaggccgacctgggcggcctgcgcgccaactacctgctgctcgcccagcgcacgccgaatccgttcgatctcgcggtcctgcgcagcttccgcatgccggtgcagctctgatgcaacgcaccgagccctggcgcagcgcggcacgcacggatcgcggcaaggtccgcgcgcgcaacgaggatgccttcctggactgcccggatcgcgggctctgggcggtcgccgatggcatgggcgggcaccaggccggcgacctggccagccggatgatcgtcaccagcctggcggaactgccggcccgggcgggattcgacgagcgcctgaacgcgatgcgccagtgcctgcactggctcaaccggcgcctgggcgaggaactcaccctcagcgccgaacgcggcgacaggatcatcggcagtacggtggtggcgctggtcgtggagggttcgcgggcggcctgcgtgtgggtcggcgacagccgctgctacctgtggcgcggccagcggctgtaccagctgtcccgcgaccactcgctgttgcagcgactggtcgacgaacggcggatggatatcgagcaggcccgcgcctatccctcggcgcgcgcgctgacccgtgccgtcggcgctagcgaacaactggtgctggacgtgttggaactggaggtgcatcccggtgatgtcttcctgctctgcagcgacgggctctacgaagagctgagcgccgatgcgctgggtcgcgcgttgagcctggcatcgccgcaggtggcggtggagcggctgttcgacggtgccctgagcggcgccgcacgggacaacctgacggccgtggtgatccgccaatga

SEQ ID NO: 6126 - DNA, 432 bp, Pseudomonas aeruginosa
acagggaaaagtcgtcgtcttgcatgggagcctccgcgaagcggcgcagtttaccggatcggccggacgccggcagcccgctcagtcgcgctttttcatcaggttcggcgacaggctcaggtcgctgttgcggcggctgcggcggcggctgaaacgccagaacaacacgccgaggcagagcgacagcaggccaagggccagcaagacgccgccagcggcgggttcgatatgcagcatgccgacagccggctggcggccgatcaaggccgaggtgccggccagcgacagcagcacgcccaggctcgccaccagggccgcgaacgccgccgccaggcgccagcgccagactctcggccggcgcgggcgcagccggcgcgcatcgaaactatcggacaacttcatcccgacttcctcgtgtgtcatcggggctag

SEQ ID NO: 6127 - DNA, 453 bp, Pseudomonas aeruginosa
gcaggatcgccaggcagaccgcgagcatcagcaactggttgccgaggccgaagagcttgccttcgtgcagcacgacgcccatctgcacgctcctcgccaccgcgttgtagtcctgccaacgcacgtcggcgagaaccttgccgctgtactgttcgatgtgcagggtggcgtcgtggcgcggatcgtcggggaacacggaaatcgtgtagaccccctccatcccgctcggcagggcgatcccgtagcccgccgccacgccgcgctcgcgggcgatatccaccaccctttgcagagggatgcccgccggcatcggcatgtccatcggcatcgcgtgcccggcctgggcggaatgcccgcgatgctcggcatgggcgtcggccgccggcggctgcgagcgcggcagcggagtgttctccagcggccagggcacctgctggcgcgacgcgctgttga

SEQ ID NO: 6128 - DNA, 483 bp, Pseudomonas aeruginosa
ctccggcggagtccgccagttgctgcaattgaccgtcgccgaagacccgggaaatgtccgccgccgacaccgactggttcggcccaccgccgatccaggaattcagggcatcacccaggcctgcgttctggagcatctggaacaacccgccgagtccgcccagtgagccggcctccacgcccggcgccgcctgcccggcaccgcccgcggcgccaccgagcagatcgccgaggacgccacccagcccgccgctcgcggccccgccgccggcaccaccaaggatgctgcccagcgaaccgagcagaccaccgccatcgccaccgccctgtgccgcaccgcccctggcgcgacctcagcatggtcaccagcccgatcaacaggggccactttcggatcgcgagcacctccctgtccttcagagccacccagcgccgaaccgagaatcgaatcgagccagtcccattggtcttcctcctgatctga

SEQ ID NO: 6129 - DNA, 522 bp, Pseudomonas aeruginosa
acgatcacccgctcttcgccgagcatgcggttgaccagggtcgacttgcccacgttgggccggccgatgatggcaatcttgatcccgtccttctcgctgggaccgggaatccgggtcggttcctcgccttcggcgacctcttcgctcgccggctcgccctcgccctcttcctccgcgttgtccttggggaagatccccagggcttcctgcagcatatggttgatgccgcgaccgtgggcggcggcgatcggcagcgcatcgcccaggcccagcgggctgaactcggcgcgagcgagatcgggatcgatggtgtcgaccttgttggcgatcaggaagctgcgcttgttccgcttgcgcaggtgctcggcgatcatctggtcggcggcggtcatgccggcgcgcgaatcgaccaggaacaggacggcatccgcctcctcgatggcctgcaacgattgctcggccattttcgcatcaatgccttcctcatcgccggagatgcctccggtatcgatgacgatatag

SEQ ID NO: 6130 - DNA, 519 bp, Pseudomonas aeruginosa
gtgcggccctgccagcgcgcctcgccgtactggcgatcgcgagtcaggcctgcgtactccgccacgatggcgtcgcgcgacttggtcaggcggttgaacagagtggacttgccgacgttcgggcgacccaccagggcaataacgggaaccatgcggctctccacgagaattcagaaaacacaaaggccgctgacgtcggacggcagcggccggacacttgaaacccagtctagcggatggtgtaggcgacgagcttgccaccgttgccgaacacgtacatccagctcccgaccaccagcggacgaacccgcacgccatcgctgtcgacccgctcgcgaccgacgaagcgaccgtccacctggctcagcagatgcacgtagccttccaggtcgccgaccaccacgttgctggagaacaccgccggagccgacagttggcgacgcgccagggcgtcgttgttccacagcgaagaggcaccgcgcgagtccaggccttccaccgaaccgctggcctggctga

SEQ ID NO: 6131 - DNA, 2202 bp, Pseudomonas aeruginosa
aggtcggccggacggttcagttcggcggggatcaccccccaaggtttccagcagcagcaccaggcgttccacgcccatggcgaaaccgacgcccggggtcggcttgccgccgaactggctgaccagcccgtcgtagcggccaccgccgcaaacggtgccctgggcgccaagcttgtcggtgacccattcgaaagccgtgcggcagtaatagtccaggccgcgcaccagcttctggttgatttcgtagcgcagtccgacagcatccaggcgggccttgagaccctcgaagtgggcgatcgattcttcgtcgagatagtcgtgcagggtcggcgcgccaaccagcaacgcctgggtgctctccaccttgctgtcgaggattcgcagcggattggtggtcatgcgccgctggctgtcttcgtcgagttgctcgaagcgctcctgcagataggccaccagggcctcgcgatagcgtgcgcgggcctcgctggagccgagggtgttgagctgcagggtcaccgcgtcggccatgccgagcttctgccacaggcgccaggtgaggatgatcaactcggcgtcgatgtccggaccgggcaggttgaagacttccacgccgatctggtggaactgccggtagcgacctttctgcggtttctcgtaacggaacatcggcccggtgtaccagagcttctgcacctggccaccgccgctcaggccgtgctccagcacggcgcgcacgcaaccggcggtaccttccggacgcatggtcagggattcgccgttgcggtcgaggaaggtgtacatctccttgtcgaccacgtcggtgccttcgccgatgccgcgggcgaagagttcggtgaactcgaggatgggcaggcggatctcgctgtagccgtagccgtccagcaggccggcgaaggtgcgttccagatagcgccaggccggagtctgctccggcaggatgtcgttcatgccacgaatggcttgcagggacttgctcacgtagggtccttaaacgggtcagccgcgggcgatcaggctcgcatcggcctcggccttctcggccgccttctggcggatcagccgttccagctcgtccaccaggttgtcgttggtcagtttctgcgacggcttgccgtcgatatacaccaggttcggagtgccgccggtgaggccgacatgggcctccttggcttcgcccggaccgttgacgacgcaaccgatcacggccacgtccatcggcaccagcaggtcctccaggcgcccttccagctcgttcatggtcttcaccacgtcgaagttctgccgcgaacagctcgggcaggcgatgaagttgatgccacgggagcgcaggtgcagggacttgaggatgtcgaaaccgaccttgatctcctcgaccggatcggcagccagggaaatccggatggtgtcgccgattccctcggccaggagcatgcccagccccaccgccgacttcaccgtgccggagcgcaggccgccggcctcggtgatgcccaggtgcaggggctgctcgatctgcctggccagcaggcgataggcggcgacggccatgaagacgtcggaggccttgacgctgaccttgaagttctggaagtccagcttgtcgagatgatcgacgtggcgcatggccgattcgagcagggcttccggggtcggttcgccgtatttcttctgcaggtccttttccagcgaaccggcattgacgccgatacggatcgggatgttgcgctcgcgcgcggcatcgaccacggccttgacccggtcctcgcgaccgatgttgcccggattgatgcgcaggcagtccactcccagctcggcgacgcgcagggcgatgcgatagtcgaagtggatgtcggcgaccagcggcacgttgacctgctgcttgatcttgccgaatgcctcggcggcgtccatgtcggggacggaaacccgcacgatgtccgcgccggcatcttccaggcggcggatctgcgcgacggtggcagcgacgtcgcaggtctcggtgttggtcatgctctgcacggcgatcggcgcgtcgccgcccaccgggacgttgccgacccagattttccgagacttgcggcgaatgatcggagaagcgctatgaatgctcattgtcctaccttcagacgggccgtttcgccgcggacgaagggggtcacgtccaccggctggccgttgtag

SEQ ID NO: 6132 - DNA, 579 bp, Pseudomonas aeruginosa
ctgacctgggcgccgcgagcgaaaccgaggcgcagctccagcggggccttgccggccagttccaggctgtcgcccttgcgcttcagcgcgctgaccaggaccttgccgttggcgtcggtgacctgggtccagcaatcggcgacgaactgtaccttgaccaccccctggccctcgccggccaccacgggcgcggcggcaggttcgctcggcgctggcggggcggccggactggccgtcgctggaacggctggagcagtaccgggagcgggagccgtgccggcaggcgcggcggtaacgggctgctggggtgcggcgggggtgccctgggccggagcggcgggaacctgcgcgccctcgctcgccaccggcggcgctccctcggcctgggcagcgacttccggagaaacctcggcgggcgcttgctcgccttccttctgcgcttcgatcaccgcctggtcttcaggctcgtccagggtatggatctcggtggtgccgtcggcgctttccacttcgacatgctcaaggctcagaccggcggtttccggcgtgcgcgcggaatgctcctgccaccagaagtag

SEQ ID NO: 6133 - DNA, 1764 bp, Pseudomonas aeruginosa
cgggaagcggtggctacgacttcgggctgcggcgctttcatcatttttccgcctggaattcctgatattcgggagagcctgggtacaggcgtttcaactgcaggccatagctggcggccgtgtcgcggtcttcgaagaccttcgcgagacgaatgcccagcaacagactgcgggcgttctgcccgccgccctgggcaaagagatcatagtactggcgagccggcacgtactcgcgctccttgtagagcaggtcggccatctccagcgcgacgctgggctggttacggttcagacgcagggatttctcgaagtactccttggcctgggccggtttcttcatttgcagcgaaaccaggccgaggttctcgaagacccgcgagcgctcgggatagagggtgtcctggctggcctccaggagacgctggtaggcctcctcgtagcgcttctgctcgtagaggaaaccgccgtagttgttcagtacccgggcattgcggctatcgctggcgagcgccttgcggtactcctcgtcggccagcttgggctccatctcggtctggaacaccaccgccagcgcggcgtgcgcgtcggcgctggaagggtcgatctcgagggccttgcgcagcggcaccttggcctgctcggtgttcccccgctggagatagccgaggccaagctggatataggcgtcgcgcgcctcgtcacggcccttgtcggttttcaggggattctgatctccgctcgtcacgcagcctgtcagcccaactgccaacaggaacaccagcgcggcgcgtacagtcatcggaaccctcctctcactcaatttcgattcgccgccgactcggactcggccagttggcgcacggcaatataacgttcgctccggcgggtacgatccatgacctgaccaaccagttggccacaggccgcgtcgatgtcgtcgccgcgggtggtacgcacggtcacgttgaagccgcccttgtgcaacatgtcctggaaacgccggatggcattgttgctcgggcgctcgtagccggagtgcgggaatggattaaacggaatcaggttgatcttgcaaggcgtgtctttcagcaatgcgatcatctgctcagcatgctcgggctgatcgttgacatccttgagcagggtgtattcgacggtcagcacgcgcttctcgccgagccgggaaatataccggcggcaggcatccagcagcatgcccagcggatacttcttgttgatcggcaccagcttgttgcgcaactcgtcgttcggtgcgtgcagcgacagggccagggacacgtcgatcacctcgccaagcttgtcgatcatcggcaccacgccggaggtggacagggtcaccttgcgcttggaaataccgtagccgaggtcgtccatcatgatgttcatggcgacgaccacgttgtcgaagttcagcagcggctcgcccatgcccatcatcacgacattggtgatggcgcggtcgatcttggccggaacggtaccgaacgacttgttggcgatccacacctggccgatcacctcggcggcggtgaggtcgctgttgaaaccctgcttgccggtggagcagaaactgcaatccagggcgcagcccgcctgggaggacacgcacagggtgccgcgtccgccctgggggatgtacacggtctcgacgcaactgccggacgccacccggaccacccacttgcgggtgccgtcggcggaaatatcctggctgacgatctcgggaccgcgtatctcggctga

SEQ ID NO: 6134 - DNA, 654 bp, Pseudomonas aeruginosa
ggccttgagcttttcgcgcaaggccttgccgacgttggtcatggcgtcgaaatcgtcgacgccaaagtggtgaatccacttcatgacctggccggcccggaaacgcttctcgccgatggactcgaagaactgttccagctgcggctgggtcaggcccagcaggttcaccttgccggcggtggtcgttgtcatggcttcaccctcacccacgctcgatcagcgaatgcgctcgcagacttcggtagccgcgaagaagtaggcgatctcgcgagcggcggaagcttcggaatcggaaccgtggacggcgttctcgtcgatggagacggcgaagtcggcgcggatggtaccggcgtcggctttcttcggatcggtggcgcccatcagctcgcggttcttggcgatggcgtcctcgccttccaggacctggactacaaccggaccggaagtcatgaaggaaaccaggtccttgaagaacggacgctctttgtgctcggcatagaagccgccggcttcacgctcggacagctgaaccattttagcggcgacgacgcgcaggccggctttctcgaagcgggtcaggatttcgccgatcacgttcttggaaacggcgtccggcttgatgatggacagggtgcgttgcagtgccattggtaa

SEQ ID NO: 6135 - DNA, 564 bp, Pseudomonas aeruginosa
gcaacggcgttcgtcctggcgcagcgcgacctcctggacctcctggcggctgaccagatcggccaggctgatgccgctgaggaactcatggatctgcaaactgaggtcgcaccacaggtggtgggtcagacaggtatcgccggagtggcaatcgccctgcccctggcagcgggtcgcgtcgacggattcgttgaccgcgtcgatcacctgcgccacatggatgcccgacatatggcgggacagctggtagccgccgcccgggccgcgcacgctggtcaccaggttgccacggcgcaacttggcgaacagctgttcgagataggacagggaaatgccttggcgttcggagatatcggccagcgagaccggaccttgctgagcatgcagcgccaggtcgagcatggcggttacggcgtagcggcctttggtggtcagacgcatgggcttttcccatcgggatcattcggggttgacgcggattatgctcttatccgagtaattaggtcaactataagaccgatcaaattactcaggattaggcaaattcagggcgctacatgctag

SEQ ID NO: 6136 - DNA, 819 bp, Pseudomonas aeruginosa
cagaaagccgccggccgcgcattacgcggccggattgccgtcctcgtccttgactccggcgaaatcttcctcgcgcaataccggcaggtccttcgcgcagtagtcgctacccagggcggtgagcgcctggcacatgccctcgagccggccgtcgacggcctgcaggtgatcgagcaactgaccaatggcacgcgccaccgggtccggcatgtcctggctgaccccataggcatcgaagccgagcttctccgccatcgcttggcgcttggcctgctgctcggagtcctcgcgcatgatgatccgcccgggaatgccgaccacggtggcacccggcgggacttccttggtcaccacggcgttggagccgaccttggcgccctcgccgacggtgaacgggccgagcaccttggcaccggcaccgaccactacgttgttgccgagggtggggtggcgcttgcccttgttccaggtggtgccgcccagggtaacgccctgatagagggtgacgtcgtcgccgatctcggcggtttcgccgatgacgatgcccatgccgtggtcgatgaagaagcgccggccgatcctggcccccgggtggatctcgatgccggtcatccagcggccgaaattggacaccaggcgcgccagccacttccagccggacgtccacaagccgtgggccagccgatgcagccagacggcgtgcaggcccggataacaggtgaggacctcgagtgcgttgcgagccgccggatcacggtggaatacgctttggatatcttcacgcacacgttcgaacatcagtcgtcactccgcttgtag

SEQ ID NO: 6137 - DNA, 1005 bp, Pseudomonas aeruginosa
ctggtgttgaccaacaccacacgaatacggtcgagcaacgccgatgctctccaacgccaagttactgaagggtgtgaaatcctacagcagaggtcagctttataccatgcggccgacaggtcgcccttcaaacgccatcggtttctgctagaatggccggctttctttaacgacccaggtgacctctccatgcagcctatgctgaatatcgccctgcgcgccgctcgcagcgccggtgaactgattttccgctccatcgaacgcctggatgtcatctcggtcaacgagaaggatgccaaggactacgtgaccgaagtcgatcgcgccgccgagcagaccatcgtcgccgcgctgcgcaaggcctatccgactcacgcgatcatgggcgaggaaggcggcttcatcgaaggcagcggcgagggcgccgattacctctgggtgatcgatccgctggacggcaccaccaacttcatccatggcgtaccgcacttcgccgtgagcatcgcctgcaagtacaagggccgcctggagcacgccgtggtcctcgacccggtacgccaggaagaattcaccgccagccgcggtcgcggcgccgccctcaacggtcgccgcctgcgcgtcagcggccgcaagagcctggaaggcgccctgctcggcaccgggttcccgttccgcgacaaccagatcgacaatctcgacaactacctgaacatgttccgcagcctggtcggccagaccgccggcatccgccgcgccggcgccgccagtctggacctggcctacgtcgccgccggacgctacgacgccttctgggaattcggcctgtccgaatgggacatggcggcaggcgccctgctggtacaggaagccggcggcctggtgagcgacttcaccggcagccacgaattcctcgagaagggtcacatcgtcgccggcaacaccaaatgcttcaaggcactgctgaccaccatccagccgcacctgccgccgtcgctgaagcgctga

SEQ ID NO: 6138 - DNA, 870 bp, Pseudomonas aeruginosa
gatgccgccgaccagcagcgaggtcaggttggcgtcgaggatcgcggtgaaggcacggttgaagccttcgtggatcgccttttggacggacatgccattggccagttcctcgcgtatccgcgagaagatcagcacgttggcgtccaccgccatgcccatggtcagcacgataccggcgatgcccggcagggtcagggtcgcgccgaggatcgacatcagcgccaccagcatgaccatgttgaaggccagcgcaacggtggcgatcacgccgaagaaacggtagatgacgatgatgaacagcgatacgaagagcatgccccagagcgacgcatcgatacccttggcgatgttgtccgcccccaggctcgggccgatggtgcgttcttcggcgaagtacatcggcgcagccaggccgccggcacgcagcagcagggccagctcggaggactcgccggggccatcgaggccggtgatacggaactggttgcccagcggcgactggatggtcgccaggctgatgatctgcttctcttccttgaacgccggaaccgcgacctccttctcgacgccatcgaccatctgcttggtgtagcgggtcaccggcttctgctcgatgaacaccaccgccatgctgcggccgacgttgttgcgggtggcgcggttcatcagctcgccgccatggccatccaggcggatgttcacctgcgggcggccgttctcgtcgaaactggcgctggcgtcggtgacctggtcgccggtgatgatcaccccgcgctccagcggcaccggcggccggcgcggctcgcggaactcgaaggtctcggtggcggacttcagggcgtccggctcggcggccaggcggaattctag

SEQ ID NO: 6139 - DNA, 606 bp, Pseudomonas aeruginosa
gttggcggtcttgccgaggatccgcttggcttccgcggtgtcctgcacgcccggcagctcgaccacgatgcgattggcgccctggcgctgaaccagcggctcggatacgcccagctcgttgacccggttgcggacggtggtgaggttctgcttgatggagtattcgcggatttccgccagtttggcctgggtcagggcgacgcgcaggacctgcaggccgttgcgctcttcgggcacgacctcgaaatcgcggaagtccttggcgatcaggctgcgcgccttgtccagggattcgctgtcggtgaaaccgagctggatcgcgcgatcgctggatcggcaggctgcggtagcgcacgcgctccttgcgcagcaggctcttcacttcgctttcatagaccttcaggcgggcatcgaccgccttgtccatgtccacttccagcaggaagtgcacaccgccggacagatccaggccgagcttcatcgggctgccgcccagcttgcgcagccactcgggagtggtctgggccaggttcagcgccaccacgtagtcgtcgcccagggtccggcgcaccacttccttggcgggaagctggtcgtcctgcttga

SEQ ID NO: 6140 - DNA, 483 bp, Pseudomonas aeruginosa
tcaccccgctgtcgacgaacaggtggccgttgcgcgcattgcgcgtcggcatcacgcagtcgaacatgtccacgccgcggcgcacgccttccaccaggtcttccggcttgcccacgcccatcaggtagcgcggcttgtcggccggcatctgcggcggcaggaaatcgagcacgcggatcatctcttccttcggctcgcccaccgacaaaccaccgatggccaggccgtcgaagccgatctcctgcaagccatccagcgagcgcaggcgcaggtcctcgtgcataccgccctggacgatgccgaacagcgccgacgggctatcgccatgggcgatcttcgagcgcttggcccagcgcagcgacagctccatggagcgcttggcgacgtcatggtcggccgggtacggcgtgcattcgtcgaagatcatcacgatgtccgagcccagggcgcgttgcaccgccatggactcctccggccccatga

SEQ ID NO: 6141 - DNA, 825 bp, Pseudomonas aeruginosa
ccgctagcctcggtccgccggaagtgcgacgacggaagccccctgcccttcctgcacagtcaggctggaaagcagactctccagcggcatcggccggccgatcaggtagccctgcaggtaatccaccccgcgggcggccaggtagtcacgctgctcgggggtctccacgccttcggcgacgatatccaggtcgagcttggcggacagctcgacgatgctgtcgagaatatgcccggaaagagtatcgatgccgatgcgggcgacgaagctctggtcgatcttcaggcagtccacctggaacttgcgcaggtaggccaggctggaatgtccagtgccgaaatcgtcgatagcgatcttcactcccagggcatgcaattcgtcgaacagacggtcggtgacttcgctcgactcgatcagctcgcgctcggtcagttccaggaccagggtgatgtgcccgggcggaaacgccgccaacagctcgcgacagtcgtccaccaaggccagttcgtggcaatgggtggcactgatgttgaaaccgatgtggaagcctggctccagcttcccggcatgcccgcccaggtcttccgcgacctggcgcatcagcgcgcgcgtcatcggtacgatcagtcccgagcgctcggcgaaaggtatgaacaggtcgggccggatcagtccctcacgcggatgacgccagcgcatgagcacctcgacgcctatccagcgtccgccctggccgggactcagcggctggtagtagggaatgaactcgttggcctccagggcccggcgcagttcgctgctgggcgaggcgacccgcctggatag

SEQ ID NO: 6142 - DNA, 609 bp, Pseudomonas aeruginosa
ttggggtctgcgcaaagactagaacagccggggaaaagcgttgcccgggtgggcggcgcaagctgcggatggacgtataatccccggctttgccccgcacggaacacgccgatgccgaaacacatgctttctccccagggcgactatgcccctgccggtctgatccgccgcctggcggcgatgttctatgacttcctgctctgcgtggcgctgatgatggtggtcaccctggtctaccagcaaggcatccttcgactgatctacggcagcgaccatctgcgcgaactggccgaccgcggcgcgctgatcggcgacccgctgctctcgaccttgctggtgttcgccctgttcggcttcttcgccaaattctggacccacaacggccagaccctgggcatgcaggtctggggactgcgcgtgcagaaccgcgacggcagcgccatcagcctgctccaggcgctgctgcgcttcatgatcgccatcgcctcctggctgtgcctcggcctcggcttcctctggatgctctgggacaaggacaagcgtacgtggcacgaccgctattcggagagccaggtggtcaggctgccgaagaacactcacaagaagtga

SEQ ID NO: 6143 - DNA, 1053 bp, Pseudomonas aeruginosa
tccgtggacccaccacaggccgatggccatggggatcttgcctttgtccagttggccacggacagcgatcagcagggccaggtagcccatataaaggaggatcgccggcagcagcttgaggaagcgcccctggcgtgggttgacccgcgacagcggcaccgccagcagggtcaccacgaataccagcagcggtgtcgacaggcgccactgcaattcggcctggtagcgtgggttgtcgctgccgaacaggtcggcggtgggcaccgcgtcacgctcgctcacctcgctgctggcctcgggcttgggcagcatcacgccataggtgtcgtactggatcgcccggtagttggcctgcccgggattgccgtcgtagcggtagccgttgtgcaggatcaggtaacggctgccatccgcctggatgttctgggtgcccttctccgccaccaggatggagatgccgcgttcctggttgctgctgttgaggtccttctgcgaaatgaagatgccggccagttcgccgcgatccttcgacagttcctcggtataggtcacccgggtaccgtcgcgcattgcctggaaacggcccgggaccagggtgtcgaactcggtcagggtatcctgcttgttcaacagcagggcgaactggttgatgccctggggcgccaggaacaggctcagccaggccaccaggatcgccaccagcagcgccggggccatggtatagccgagcaggcgcttctggctcatgccggtcgccgagagcacggtcatctcgctttccagatagagtcgcccgtaggccagcaggatgccgaggaacaggccaagcggcaggatcagctgcaggaagccgggaatccggaacgccatgatcaggaacagcgaaccggggtcgagcaacccctgcgccgcttgcgccaggtacttgatgaaacggccactcatgatgatcaccagcagcacggcgctgacggcgctcatggtgaccagcacttcacgggacaaataacggaaaacgatcaatccggacactcctgggttgccaggctctga

SEQ ID NO: 6144 - DNA, 1473 bp, Pseudomonas aeruginosa
aagcgtacgcccggaaaccctgaaaaccgccaccctggtgctcgccgtaggcgaaggccgcaagctcggcgccagcgccaaggcggtcgacgacgccaccggcggcgccatcagcgcagtgctcaagcgtggcgacctggccggcaaggtcggccagaccatgctcctgcagagcctgcccaatctcaaggccgagcgcgtgctgctggtcggcgccggcaaggagcgcgaactgggcgaccgccagtaccgcaagctggcctccgccgtgctgtcgaccctcaagggcctggccggcgccgatgccgcgctggccctcggcgatctcgcggtgaaaggccgcgatgcccacgcgaaggcgcgtctgctggtggaaaccctggccgatggcctgtacgtgttcgatcgctacaagagccagaaagccgagccgctgaaactgaagaagctgaccctgctcgccgacaaggccgacagcgccgccgtcgagcaaggcagcaaggaagctcaggccatcgccaatggcatggccctgacccgcgatctcggcaacctgccgccgaacgtctgccatccgacgttcctcggcgagcaggccaagggcctggccaaggagttcaagggcctgaaggtcgaggtcctcgacgagaagaaactgcgcgagctgggcatgggctcgttcctcgccgtcgcccagggcagcgaccagccgccgcggctgatcgtcctgcaatacaacggcgcgaagaaggaccaggccccgcacgtgctggtcggcaagggcatcaccttcgacaccggcggcatcagcctcaagccgggcctgggcatggacgagatgaagttcgacatgtgcggcgccgccagcgtcttcggcaccttccgcgcggtgctcgaactgcagttgccgatcaacctggtcggcctgctggcctgcgccgagaacatgcccagcggcggagccacccgtccgggcgacatcgtcaccaccatgagcgggcagaccgtcgagatcctcaacaccgacgccgaagggcgcctggtgctgtgcgacgcactgacctacgccgagcgcttcaagccgcagtcggtgatcgacatcgccaccctcaccggcgcctgcatcgtcgccctgggcagcaacacctcgggccttatgggcaacaacgaagcgctggtcaggcaattgctcaaggccgggggagttcgccgacgaccgcgcctggcaattgcccgctgttcgacgaataccaggaacagctggacagcccgttcgccgacatcgccaacatcggcgggccgaaggccggcaccatcaccgccggctgcttcctctcgcgcttcgccaagaaataccactgggcgcacctggacatcgccggcaccgcctggatcagcggcggcaaggacaaaggcgccaccggccgcccggttccgttgttgacccagtacctgctggaacgggccaagtga

SEQ ID NO: 6145 - DNA, 918 bp, Pseudomonas aeruginosa
cctggagtcgatccacgacctgctctacgaacggaacgagccgcccttgctgaccgaatccttcgagccggacaacattcccctgctctccgacgtcgtctcccccggtaccgccccgcgcgcgccagagccgcagaccgcggcagccaccacggcagggctggcgcccgccgaacaggagcgcctggacgacgagttgcgagcgtccgccgaactgatcctgcaggaagtcatcgacgacttcgccccgcagatcgaagccgaactgcgccgccgcctgcaagcccgcctgggtcgcctgctcggccaacgcaacggctgatccggacgcggcgggcgcccgccgcggcccgcggccttacccccgggctgccatccccgctatactcccggactttcttcgcattttccccagccatattcagctttggtcccctttcgcatggacaagacttaccagccgcacgccatcgagacttcctggtacgagacctgggagtccaacgactacttcgctccgagcggcgaaggccagccctacaccatcatgatcccgccgccgaacgtgaccggcagcctgcacatgggccatggcttcaacaacgcgatcatggacgcgctgatccgctaccgccgcatgcagggccgcaacaccctgtggcagccgggcaccgatcacgccggcatcgccacccagatggtggtcgagcgccagctcggcgcccagggcgtgagccgccacgacctcggccgggagaagttcctggagaaagtctgggaatggaaggaacagtccggcggcaacatcacccggcagattcgtcgcctgggctcctcggtggactggtcgcgcgagcgcttcaccatggacgacggcctctccgaagcggtcaaggaagccttcgtgcgcctgcatga

SEQ ID NO: 6146 - DNA, 861 bp, Pseudomonas aeruginosa
gttcatctgggacgagtactgcgcctggtacctggagctggtcaagccggtgctgtgggacgagaacgcccccatcgagcgccagcgcggcactcgtcgcaccctgatccgcgtgctggagacggccctgcgcctggcgcacccgttcatgccgttcatcaccgaggaaatctggcagcgcatcaagggccaggccggcaaggaaggtccgaccctgatgctgcaaccctggccggtggccgacgaaggcaggatcgacgccgccgccgaaggcgacatcgagtgggtcaaggcgctgatgctaggcgtgcggcagatccgcggcgagatgaacatctccatggccaagcgcatcgacatcatcctcaggaacgcctcgcccagcgaccaccgccgcctggccgacaacgagccgctgctgatgaaactggccaagctggaaagcatccgcgtgctggaagccggcgaggaagcgccgatgtccgccaccgccctggtcggcgacatggaagtattggtgccgatggccggcctgatcgacaagagcgccgaactggggcgcctggacaaggagatccagcgcctggaaggcgaggtcaagcgcgtcggcggcaagctgtccaacgaaggcttcgtcgccaaggccccggccgacgtgatcgagaaggaacgcgccaagctagccgaggccgaacaggccctggccaagctggccgagcaacggcagaagatcgccgcgctctaagcactctcgccaaggtacggggctgcggcctcgtacctttctcccctcaggcgccgctgtctatctgcgccgaagtgatctggcataccgcgttcaccgtggcgctggccgaatag

SEQ ID NO: 6147 - DNA, 294 bp, Pseudomonas aeruginosa
agtatagttaggaatctcagcacgcggcaaataagtagccatgccttcaatatcacctgcaagtctcggattaatttttgcagcctgcgccaaaccagcccaatcacccaattcaataaatcgaccggtttcatccagaatattaattccaggccttggaagagttatgtacgtcccatcaggcacccaaaaatccccgctaccgaaaacatatttaccgtgccctgcgaacgctttcccattacccccagaaagtataccagcagcatatttatggccaccacgccctcctag

SEQ ID NO: 6148 - DNA, 1194 bp, Pseudomonas aeruginosa
ccttctgttcggaggccacgcggggcctcatcgaattttcgcaaagggcaggcactcccccttgcccgcccccccagcggtaatcccgccgcaagaaaaaacatcaaacctgctgacgacttgcgcgaaaaatgcgatgtttcggccacgctgtacccgcaccgcccaatcagaacaattcgctacagcgcgccaatacaatcaggagatcgccgcatgatgcaggcctataagaataaatggttgcccctcagtgccctggcccttggcatggccctgtccttcggcgccaacgccgacgagcagaagtcggtggcggtgaccgccatcgtcgagcacccggcgctggacgccgctcgcgacggggtcaaggaggccctccaggaggccggctacgaagacggcaagaacctcaagtggcagtaccagagcgcccagggcaacaccggcaccgccgcgcagatcgcccgcaagttcatcggcgacaagcccgacgtgatcgtcggcatcgccactccgtcggcccaggcgctggtggccgcgaccaagagcatcccgatcgtcttcagcaccgtcaccgacccggtcggcgcgcacctgacgccgagctgggaagcctccggcaccaacgtcaccggggtttccgacatgctcgcgctggacaagcagatcgagctgatcaagaaagtggtgccgggcgccaagcgcatcggcatggtctacaacccgggcgaagccaactccgtggtggtggtcaaggagctgaaggaactgctgccgaagatgggcctgagcctggtcgaagcctcggcaccgcgttcggtggacgtcagctcggcggcgcgcagcctggtcggcaaggtcgacgcgatctacaccaacaccgacaacaacgtggtgtccgcctacgaggcgctggtcaaggtcggcaacgacgcgaagatcccgctgatcgcctccgacaccgacagcgtcaagcgcggcgccatcgccgccctcggcatcaactacaaggagatgggcaagcagaccggccgcatggtggtgcgcatcctcaagggcgagaagccgggcgagatcaagccggagaccagcgacaacctgcagctgttcgtcaatcccggggccgcgcagaagcaaggcgtgaccctgtccgacgaactgctcaagtcggccgcggaagtcatcaagtaa

SEQ ID NO: 6149 - DNA, 951 bp, Pseudomonas aeruginosa
agaaacgcctgctcggcaagaagggagcctgaccatgctcagcgcgaagaacctgaagatcaccttcaaccccggcacccccatcgagacccgcgccctgcgcggcctgtcgctggacatcccggccggccagttcgtcaccgtgatcggctccaacggcgccggcaagtcgaccttcctcaacgcagtctccggcgacctgccgatcgacagcggacagatcctgatcgacgacgaagacgtcacccgcaagccggtctgggcccgcgccaaccgcgtcgcgcgggtgttccaggaccccatggcgggtacctgcgaggacctcaccatcgaggagaacatggccctggcgcaacgtcgcggtgccgggcgcggcctcggcagggcggtgcaggcatcgatgcgcgacggtttccgggaaagcctggcgaccctcggcctcggcctggagaaccgcctcggcgaccgcatcggcctgctctccggcggccagcgccaggccgtcagcctgctgatggcggcgctgcagccgtcgcgtatcctgttgctcgacgaacacaccgcggcgctcgacccgcgcaccgccgacttcgtcctgcatctcaccgcacggatcgtcgccgagaagaaactcaccaccatgatggtcacccacagcatgcgccaggcgctggacgtgggcgagcgcacggtgatgctgcaccagggccaggtggtgctggacgtctccggcgagcaacgcaagggcctcgacgtaccggacctgctggcgatgttcgagaaggtgcgcggcgagaagctcgccgacgacgccctcctcctcggctgacagggccgcggcgcctctccgcggcgaagcggggaggcgccgtcgacctgcagcagatcaaggcgcgatccgcgtccgtctgccacactcgcaggcatcctcccgctcagatgcccgcatga

SEQ ID NO: 6150 - DNA, 1125 bp, Pseudomonas aeruginosa
ttccgtggctgtttccattgtgaccgggccaggagcgcgccgctcggcagaaacactggccagcctccggcggatgtgaataatgcccgcctcgccgtcacggaaaccgagaacatgccccgcccgaccagcccgcatcccgacgccgagcgcaagagcgccagcccgctgcacccgcgcaatcgccacctgggacgctacgactttccgcgcctgatcgccggcagcccggaactggagcgcttcgtcatcctcaatccgtacggcaggcagagcatcgacttcgccgatccggcggcggtgaaagccttcaaccgcgcgctgctgcaacagttctacgacgtacgcgagtgggatatacccgatggttacctgtgcccgcccatccccggtcgcgccgactacctgcactacctggccgacctgctcggcgccagccacgatggcctgattccacgcggtcccggcctgcgtgcgctggacgtcggaaccggagccaactgcatctacccgctgctcggccaccacgaatacggctggcgcttcgtcggcgccgacatcgacccgcaatcgctggcctcggccgctgcgatcctcgccgccaacccacgcttcgccgctgccatcgagttgcgccggcagcctgatcgcaggcagatattccagggcctgatcggcgtcgatgagcgcttcgacatgaccctctgcaacccgcccttccacgcctcgctggacgaagccacgcgcggcagccggcgcaagtggaagaacctcggcaagctcgacccgacccgtaccctgccgctactgaactttggcggccagggcgccgagctgtactgcgagggcggcgaagcggccttcctggccggcatggccgaggaaagccgggcgttcgccacgcaggtgttctggttcaccaccctggtatccaaggcgagcaacctgccgaacctccaggagcgcctgaagacgttgggcgccagcgatatccgcgtggtggacatggcccagggacagaagcagagccgcttcgtcgcctggacctacctcgacaagaagcagcgccgggcctggcgcaaggagcgttggacagcagccctcctggaaccactgggcgaatag

SEQ ID NO: 6151 - DNA, 408 bp, Pseudomonas aeruginosa
cagtctctccgggctggcactgctctaatggccgcctccagtgactcggaacacgccatgaatccactctaccgcgccgccatccaccagctttttctcgctctcgatctcccgacgcccaatgacgaggagagcgtactcagcctgcaggtgggcccgcatctctgccatctggcagaacatccgaccgatcacctgttgatgttcacccgcctggaaggacaaggagacgctacggccagcgagcagaacctgttcagccaggacccttgcaagccgatcctgggccgcgaccccgaaagcggcgaacggctgctctggaaccgccagcccttgcagttgctggacagggcccagatccaccatcaactcgaacaactggtcgccgccgccgaagagctgcgctga

SEQ ID NO: 6152 - DNA, 582 bp, Pseudomonas aeruginosa
agctggtgcccagcgccggctcgcgcgacaacctggagcgcctgctcggcaccggcgaggtcgacatcgccctggtccagagcggccaggagcgccagctcgaagccgggcaggcgcgccagttgcagaccctcggcgcggtctaccaggaaccgctctggctgttccaccgcagcaacgtgcacatcgaccagctcagcgacctgctgcacctgcgcctggccatcggcagcgacggcagcggcacccgcgccgccaccgaggcgatcctgcaggccaacgacatcgccccgggacactatccgatcacctgggaagcccgcggcggcaacgcggtggtcgacgacctgctggccggcaagctggacgcggcgttcatcgtcggcccggcggagaacccggcgatccagaaattggccgacaacgaccagcttcgcctggtcaacttccgccgcagcgccgcctacgaggcgcgcctgccgttcctcaagcgggtcgaggtcggcgaaggcctgctcaacctgccgcgcaacgtgccggaacgaaacatcagcaccctgtcgccggtggccaccctggtga

SEQ ID NO: 6153 - DNA, 750 bp, Pseudomonas aeruginosa
caaggactacggcctgtcgccggaaatcccggcggacaagcgcaccctcaaccagttccgccgcttcaccggccgcgccgaaggcctgtcgatcagcttcgaggcgcacctgctgggctccaaggtggaatacgacgaagagcgcgacatgctgatcatccgccagttgccgacccagttgaaggaccagctcaagcggcgcaaggactgacccgcgccgccccggagcgccgccggcgctccctttccctcctcagccgcaggcccagtcgaagcgcatgtcgcggaaatcgagctgggcgttgccgccgccgaagttgtagccgcccaggtattcctcgaactctacgtagaagggactcatctccggcacgccctgcaccggacgcatggtgccgccgatatggttcggcaggtgcccttccacccagggatgctcgcggtagttgtcgcgctcgatcttgccgtccagccagtagtgcggcagctggtagccgccgtcgccgtattcgctgggcaccaccccggcgttggggtcttgcgcccgcgccgtccagcgcagcgggtagcgctgctggtggccggccgccgggcggccaccgagggcgcgcagcaggtagtagtcgtcctccgcccagtccggcacgaagctggccgccgaaccagcctccagccactgcggcggctcggtctgcgccaacagcgggttgcccgccggcagcgccggcggctggcagggcgcgccgctga

SEQ ID NO: 6154 - DNA, 1455 bp, Pseudomonas aeruginosa
accgaccaacacttcccgatcgccgccgtagcggccgtcgcctcactcactccagacccgctcccgcatccgctcgcaatacgccaccaggcgcggatagcctcgcgccacatggctgagtggggtatccagggtcgcctcgatgaggttggcgaggataccgtaagcggcggcatcggcgctgcacggatgttcgccgccgtagtacgggacctggccaagcaggccgtcgagggcatcgaggtcgtcgcgggcgaaggccagcagttcgtccctgccgtggaccccgagcccctgcgccctgagggtagcgcggaccttgcggcgcatggcccaggccaccgcgtcgcgcacgccgaatggcagcgagccgaagaacaccggcttgagcacgcgccagctgtcctcgtcgaaccagcggaaatacagcatcaggtagtacaggtgttcgtcgcacaggcgcgtgatcgcccgtgcccagcccttgccccgggcatccaggccggcgtcgagtgtgaccccgtagcgctcgccgagggtacggatgacgatctcgctgtcaccgatcgcctcgccctcgatacgcacgtagggcagcttgcccttgggcgccttgcgcgggtcgctgacgaccttcacctgatactccaggccggccaggcgcaaccaggtttccagtttcaggcagtagggactggcattgggtacgttgaatgcggcggggaactggaagagcgtgatcatcgcggcgtcctgcgggttgtccgcggcgagcttaggagattatccgcgcttcggccaccgacagcctcagccggccgccggatgggcagcctggtaggcggccaggcccttgcgcgcctgcccgcggatcgcccgctgcaccggcggcgcccagcccagcagcaggcccttggcgccaagcgcctggcggctccagcgccacaggtcgaactggtcgcgatgctcgacgatcaaaccgtcggcgaagcggaaacgggcctcgatgcgattctccaccctgcgcccggtctgggtgaacaggtagtgggccacccattgcgcacgcccctcgttctcgtcggcgcggacgttcgcgtagtccaggcggaagtcccgcgcccggctggtcagcaggcgccacatgtcgcccacctcgcgcccgcgcagttcgccgaaggccgggtcgtggaaggtcgcctggggagcgtagcaggccgccatggcctcgccgtcgaggcgctggaaggcctggtagaagcgctcgatcagttcggcgttggggtgggccatgcggggttccttgcgatgatagggacttgccaggcgtccccaggcgggaacgccgtcgtgccgggtcgtttcagccgaaccactcgcgggcgctgcgccagaggcagatctgctcgccctggggcgcgacgaacaccggcaggtcgccgtattcgcgcatga

SEQ ID NO: 6155 - DNA, 477 bp, Pseudomonas aeruginosa
gaaggaattttcctaaggaattgtcctatattccactccaatgccagcgcctgggagagggcccctcccgggacgcacgaacgcagaaaaataaggatgaactcacgtaggagtaagctcatgaacaggatgggccaactggctttgttcggtcttcttgtaggaacttccagcaacctgttcgccgcccccggcagcatcagcggcgtcatccgcttcaccggcgccattgtcgagccaccatgctcgatgagcgctccccgccaagacgaaagcaagggcagtttccacctcagtggctgtcccatgcaggcgcgcaccgcggatgtcagcatccgttcgatgaagaccggcgaggtgcgccacttgcaacccagcgatacggtcatcggtgaacgggatttctcggcgcactatgagctggccggaagcgatcgccgctccggcaactacctgatcaccgtcacctacccctga

SEQ ID NO: 6156 - DNA, 1707 bp, Pseudomonas aeruginosa
cgttcgcccatgaaaaaaccgcccgaaggcggttttttcatggtgccgaaacgtggcttacagctgcgggccggcggccttgatcgcatcggaaacctcgaatttcttgaagttttcgatgaactgcttggccaggcccttcgccgcctcgtcgtaggcagccttgtcagcccaggtgttgcgcgggttgagcagattggtctcgacgcccggaacggccttcggcacgtccaggttgatgatgtccaggtgctcggtttccgcgccgatcagcgcgccgctctggatcgccgcgatcacgccacgggtggtcgggatgttgaagcgcttgccgacgccgtagccaccaccggtccagccagtgttgaccaggtagaccttggagccgaaggccttgatgcgcttgatcagcagctcggcatagacgccggccggacgcgggaagaaaggagcaccgaagcaggtggagaaggtcgacttgataccgccgccggaacccatctcggtggagccgaccagcgcggtgtagccggacaggaagtggtaggccgcctgctcattgttcaggatcgataccggcggcagtacgccggtcaggtcgcaggtcaggaagatcaccgcgttgggctcgccgccgaggttcttctccgaacgcttctcgacgtgctccagcgggtaggcggcgcggctgttctgggtcaggctgtcatcggcgtagttgggcacgcgctcttcgtcgagaaccacgttctccagcacggcgccgaacttgatggctttccagatgaccggctcgttcttctcggacaggtcgatgcacttggcatagcaaccgccttcgacgttgaacaccacgccctcgccccagccgtgctcgtcgtcaccgatcaggtaacggctttcatcggcggacagggtggtcttgccggtgccggacaggccgaagaacagggtcacatcgcccgcttcgccgatgttggcagcgcagtgcatcggcagcacgtcgcgctcgggcagcaggaagttctgcacggagaacatggctttcttcatctcgccggcatagcgcatgcctgcgatcagcactttcttctgggcgaaattgaggatcacgcaaccgtcggagttggtgccgtcgcgctcgggcacgcattcgaagttggcgacattgaggacctgccactcgtccttgccggccgggttgtactgctccggctcgatgaacaggcaacggccgaacagattctgccaggcggtagcggtggtcatcttcaccggcaggtagtaagcctcggcggaacctacatgaacatgggaaacgaaatggtcctgggcgttgttgaacgcttccacgcgggcccacagcgcatcgaacttgtcggccgggaacggacggttgatgttgccccaggcgatcgcgtccttggtgctcggctcttcgacgatgaaacggtcgaccggcgaacggccggtgcgatggccggtgcgtacgaccagcgagccgttggcggccagttcgccctcaccgcggcgaatggcttcttctaccagttgggcggcgctgatatcggtgtacacggcgttgttggcttgcgtcatgtggttccccgtcggccagaggccgagtcctccaaacttcgtagcgcttcaaaaaactcactacaggaaaaaagtggcgggattatgccagaaaagcccgctggatga

SEQ ID NO: 6157 - DNA, 798 bp, Pseudomonas aeruginosa
gcacgagagggggcgggaagtgccgctggaacggcacaaacccgtcaggtatcaggccgcgccgcgcggcagcagcaaccccagcggcaggcagacccgcgcttccaggccgccgccatcgcggttgcgcagttcgacgctgccgccgtgctgggcggcgatgcgcttgacgatcgccaggccgaggccggtgcccttgccgccacgcgccttgtcgccacggatgaagggattgaagatgctgtccacttccgcgggatcgatgccctggccgcgatcgagcacgctcagcaccacgtagggcgccgcgctttcgccggccacgtagctggccacctccaccgaaccgccgccgtggttcagggcattgtcgatcaggttgcccagcagacgcttcatcgacacacgccgcaacggcatcgccggtaccggttgcaaggccatgcgcacctgctcgcgagtctggttgaacggcgccacgacctcgcgcaccaggtcggtcaggtcgccctcctccaccggctcgtcgcggccgtcgcggatgaaggcgaggaactggtcgaggatcgcgtccatgtcctcgatgtcgcggatcatgtcctcgaccatctcccgttcgctctccggcagcaactccagcgacaggcgcaggcgcgtcagcggggtgcgcaggtcgtgggagacaccggccaacatcaattcgcgttcgcgcccgccctgctcgatgtcctcggccatctggttgaaggcgcgatacacctcggccatttcactcggcgtctccggtcccagcggtag

SEQ ID NO: 6158 - DNA, 2406 bp, Pseudomonas aeruginosa
tgcggcgcttttgcggcggggcgttgtctacacggcccgttttcgttcgttttaccaggtggatcaatggacagcatcaacacccgtatcgccgaagagctctccgcactgccctccggccgcgttcaaccgcagcaagtcgccgctgccgtcgccctgctcgacgaaggctccaccgttcccttcatcgcccgttaccgcaaagaggtcaccggcagcctcgacgatacccagttgcgcatgctggaagagcgcctgcgctacctgcgcgaactggaagaacgccgcggcgcgatcctcgccagcatcgaggaacagggcaagctgacccccgaactggcccgcgacatcaagctcgccgacaccaagacccgtctcgaagacctctacctgccttataagcagaagcgccgcaccaagggccagatcgccctggaagccggcctcggcgagctggccgacgcactgttcgacgacccgaccctggtcccggaaagcgaggccgcgcgtttcgtcgacgccgagaaaggcttcgccgacgtcaaggcggtgctggaaggcgccaagtacatcctcatggagcgcttcgccgaagacgccacgctgctcgacaagctgcgcgtgttcatgaagaacgaagcgaccctgaccgcccgcgtggtccccggcaaggaacaggaaggcgccaagttcagcgactacttcgaacacgatgagccgctgaaaagcgccccgtcgcaccgcgccctggcgatcttccgcggacgcaacgaaggcatcctcagcgcctcgctgaaggtcggcgaggaagcgccgggcaccctgcacccatgcgaggtcatgatcgccgagcgcttcggcctgtccaaccagggccgcgccgccgacaagtggctggccgaggtggtgcgctggacctggaaggtcaagctctatacccacctggaaaccgacctgttcggcgagctccgcgacggcgccgaggacgaggcgatcagcgtgttcgcgcgcaacctgcacgacctgctgctggccgccccggccggcccgcgcgccaccctcggcctcgacccgggcctgcgcaccggggtcaaggtcgcggtggtcgacgccaccggcaagctgctggacaccgccaccgtctacccacatgcgccgaagaaccagtgggaccagaccctagccgtgctcgccgcgctgtgcgccaagcaccaggtcgagctgatcgccatcggcaacggcaccgccagccgcgaaaccgacaagctggccggcgaactgatcaagaaatatccgggcatgaagctgaccaagatcatggtcagcgaagccggcgcatcggtgtattccgcctccgaactggcggcgaaggagttccccgagctggacgtgtccctgcgcggcgccgtatccatcgcccgtcgcctgcaggacccgctggcggagctggtgaagatcgagcccaagtcgatcggcgtcggccagtaccagcacgacgtgtcccagctgaagctggcgcgtagcctggacgcggtggtcgaggattgcgtgaacgccgtcggcgtcgacgtcaacaccgcctccgccgccctgctggcacgcatctccggcctcaactcgacgctggcgcagaacatcgtcgcgcaccgcgacgccaacggagcgttccgcacccgcgacgagctgaagaaagtcagccgcctgggcgaaaagaccttcgagcaagccgccggcttcctccgcgtgatgaacggcgacaacccgctggacgcctcggcggtgcacccggagacctatccgctggtgcagcgcatcgccgccgacaccgagcgcgacatccgctcgctgatcggcgactcggcgttcctcaagcgcctcgacccgaagaagttcaccgacgagaccttcggcctgccgaccgtcaccgacatcctcaaggaactcgacaagcccggccgcgacccgcgtccggagttcaagaccgcagaattccaggaaggcgtcgagagcctcaaggacctcaagccgggcatggtcctggagggcgtggtgaccaacgtcaccaacttcggcgcgttcgtcgacatcggcgtccaccaggacggcctggtgcatatctcggcgctgtccgagaagttcgtcaaggatccgtacgaagtggtcaaggccggcgacatcgtcaaggtcaaggtcatggaagtggacatcccgcgcaaccgtgtcggcctgtccatgcgcatgagcgacacccccggcgagaaggtcgaaggccagcgcggcgggcgtcccaccggcagcggccagccgcgccaggagcgtggcgccccgcgcggacagagcgcgccgccggcgaacaacgccatggccgcgctgttcgccaacgccaagcaactgaagaagaagtga

SEQ ID NO: 6159 - DNA, 1221 bp, Pseudomonas aeruginosa
cgacggcaagctggcgctcaccccccacccccgggccctgggttcgaccctgacccatccgcagatcactaccgactactccgaggccttgctggagttcatcacgcccacggaaaccgacgtcgccgacactctgggcgatctcgagcgcatccaccgcttcgccagttcgaaactggacggcgaatacctgtggagcccatcgatgccctgcgagctgccggacgaggagagcatcccgatcgcccgctacggcagctcgatgatcggccgcctgaagtacgtctaccgcaagggcctggcgctgcgctacggcaagaccatgcagtgcatcgccggcatccactacaacttctccctgccggagaggctctggccgctgctgcgccaggccgaaggcagcgagctgtcggaacgcgactaccagtccgccgcctacatcgccctgattcgcaatttccgccgctacagctggctgctgatgtacctgttcggcgcctcgccggccctcgacgccggcttcctgcgtggccgcccgagccagttggagcgcctcgacgaacacacgctctacctgccctacgccaccagcctgcggatgagcgacctgggctaccagaacaacgcccaggccggcctgacgccctgctacaacgacctgcagagctacatcgacagcctgcgccaggcggtcagcacgccctacccgccctacgagaaggtcggcaccaagcaggatggcgagtgggtgcagctgaacaccaacatcctgcagatcgaaaacgagtactactcgagcatccggccaaagcgcgtcacctacaccggcgagcgtccggtgcaggccctggccgctcgcggcgtgcagtacgtggaagtgcgctgcctggacatcaacccgttcctgccgctgggcatcgacctggacgaggcgcgcttcctcgacgccttcctgctgttctgcgcgttcagcgacagcccgctgctgaatggcgagtgcagcgacgccaccgacaacttcctcgccgtggtcaaggaaggcaggcggccgggcctgcaattgcaacgtcgcggccagccggtggaattgaaggtctgggcgaacgagctgctcgaacgaatcgccgacaccgcggcgctgctcgaccgcgcacgcggcggcgaagcccacgcggcggcgctggcagcgccagcgggctaaggtcgccgatgccgaactga

SEQ ID NO: 6160 - DNA, 510 bp, Pseudomonas aeruginosa
actgcgggttgttccaggcccgctgccattccccgcgcagcgccatcagctcgccgatggtcgcgtgcatggcctccagggcgctacggccgaggttcggatcggacgaatggccgctctgcccgagaatctcgatgcgctccatcatcacccccttgtgcaggcggatcggccgcaggttggtcggctcgccgatcaccgtggcgcgacccagcggtcgcccgctttcggcgagggcacgggcgccggccatcgagctttcctcgtcgcaggtggcgaggatcatcagcggctggcggaacggctggtcgagcagcggcagcaaggcctcgatggccagcgggaagaagcccttcatgtcgcaactgccgaggccgtaccagcggccgtcgcgctcgtccaggcgcagcggatcgctgctccacagcgcttcgtcgtagggcacggtatcggtgtggccggccagcaccagcccgccggaaccgctgccgtagctggccagcaggttga

SEQ ID NO: 6161 - DNA, 1173 bp, Pseudomonas aeruginosa
acctgttcgacctgcgcccagtcctcggcgatcaccgcgcggaagaacggcaacaggccggccgcgcattcgtgggccttggcgatgtgctgctgcatcggcccgatcggcgaacggccgaacaggctgatgaacggattggtcggcatggaacgcctccctggtggaaatgccgaaaagtataggccacccaccccgcgcgcctttgatctggaacaccttcacccgcggacgcctggcgtcccgagccggacatcgccccatgcagaaagaaaccgaaatcaaactccgcgtcagccgcgccaccctggaagccttgcaggagcacccgttgctgaagaagcgcaacaaatcgggctgggagcgccgcgaactgtacaaccagtactacgacacccccggccgcgagctggcccgggccaaggtcgcgctgcgcatgcgccgcgacggcgagcagtacatccagacgctgaagagccgcgggcagagcgtggccgggttgtccgaacgcaacgagtgggactggtacctggaaaagaacaagctcgacctaaagaaactcgacgacaagtgctggccggcggccctcaaggacctcgacaagaagcagctcaagccgatcttcagcaccgacttcgtccgccagcgcgccgagatcgcctggggccgcggcaaggccagggtagtcgtggaggcggcgctcgacctgggcaaggtggtcgccggcgacaaccaggaggaaatctgcgaactggagctggaactgcgccagggcgatgccgccgcgctgctcgagctggccgcggaactggccgccgacctgccgctgatgccctgcgacatcagcaaggccgagcgcggctaccgcctgttcgacccgaacagctacgaggtcgatcccccggcccagaaactgctggcggaaaccccgctggacggtgccttcgccgccatcgcctggtacctgctcggcagcagccagcgactggccgaacagtatcgtttcaacggccactggcgcctgctggaggactggctgcaacacctgcaggacctgcgtaccctgctcggcagcctcggccaggcggtgccacgcgccagcagtcgcgagctgcgcgaagcgctggacgctctcctcgccgactgggcgccgcgcatcgagcgcggccgtga

SEQ ID NO: 6162 - DNA, 768 bp, Pseudomonas aeruginosa
cgacgagacgctacgccagcaggcgccgcaactgttccgcggcgaactcgacgagacccgctggggtctgttctccctgaatgcctcgcgctggctgctggccaaggcctggaccgagtcgcgcaacgagcgcggcaaccgccagggcgccgccgcgctgggcaaatggctgctgcgcagccttgccgaagaagcccaggccacgccgctggcgcgcgcccaccagcatcccgagctgctccccgaccaagcgccgcgcctgcagcgcatgcttacctggttgcgcctggcgcgcggcgtgctcgacctgccggaagccgaccgcctctacggcgaactggccaagttgctggagctgctgcggcaacctgtcgatgtcgagcgcctggctgcccgcgccacgcaggcccatactgtgctgacgctcaaaccctggaaggcgctgatgaaataagcttcgccgctaccgccatcatccgaagggagtctgcatgtccgtgttcgccaccgccgcccaggaccgcctgctggacctcggcgacctgctccgcgagctggtcgcccagggccgggtcgggcaggagcaggccgaacagtgcctggcgatccgccgcagcgcggtgcgcaaccagcagcatccgctggagttcctcgccgcgcagcaggtcgaggatctcaagcgccccggacgcaagctcgacctggagaccctcacccagtggctggccgagtacgccggccagccctacctgcgcatcgacccgctga

SEQ ID NO: 6163 - DNA, 411 bp, Pseudomonas aeruginosa
gtccggaggaagtcaccatcgccagcgcccagcccttcgtacagggctgggaaagcaacctggtgcatgtgctcaagcgaccgatcaagcgggtggtggcgaacccggcggacatccagcgctacaccgtcgagttcttccgcctggcccgctcggtcagcggcgccacctcgccggaccagaagatcagcggcgtcggcaacttcgaacagttgctcaacctcggcgccgccgaccaggagccggacgccaacgacgcgcacatcgtcaccatcgtcgactggctgttccagtacgccttccagcagcgcgccagcgacatccacatcgagccgcgccgcgagcagggcaccgtgcgcttccgtatcgacggcgtgctgcacaacgtctaccagttcccgccgcaggtga

SEQ ID NO: 6164 - DNA, 363 bp, Pseudomonas aeruginosa
tgtaacacgcagccccctatcaggagttcccccatgcgttccgtcaaactcgccgccgccaccctggtcatcgccgccctgccgctgggctcggccatggccgataccttctggcgcaacatcatttcctcgggtgccaccacggcctccacctacctgaccttccgccacgaccacaagctgatcgtcgccgcgcaggacgacgccggcagctacatcgccagcgacggcgcgatccgcgggccgtacctggaagccgccctgcaaaagctgcgcaacgacaacccggacctgcaggccagcgacatggaactggccagcgcgatcctcgccggcggcgagcagtccgccgtccagcagtag

SEQ ID NO: 6165 - DNA, 603 bp, Pseudomonas aeruginosa
cgggttttgtcgcgactacgcggcggctcagccttccgcgtcgacggcggcctggtagccagcggcatcgagcagcttgtccagctcggccggattgctcggcttgagcttgaagaaccaggacgcgtacgggtcgttgttgacgtcttccggggtgtcggccagggcttcgttgatggcgatgacttcgccgccgatcggcgaatagatgtcggaggcggccttcaccgactcgaccacgcccgcttcctgcccggcggcgagggtcttgcccagctccggcagctcgatgaagaccacatcgccaagggcttcctgggcatggtcggaaatgcccacggtaacgctgccgtcggcttccaggcgagcccattcgtggctctgggcgtaacgcagttcggcgggaatattgctcatcttgttttcctcgaagtcgggggcgacggcggtcgccattgccaggttagatcaggggcttgccgtgacgcacgaaactgggctggaccacccgtaccgggtaccacttgccgcggatttccacctcggcgcggtcgccggtggcggccggcacgcgggccagcgcgatggacttgttcagggtag

SEQ ID NO: 6166 - DNA, 408 bp, Pseudomonas aeruginosa
cgcgagtcggcgccaggcgcacggcgaaggccagcagcagggccacggcgaccgtcgccagcgcggcgatgccgcccagcgtcagggtatggccgatcaggtcccagtagcgctcgtcgaggtcgaaacggccctggcgccagaaccagacaaccagttgcgccacgggaatcacgaaggcgcagaggaacaccagcccgcaccaggcgctcgccgccagcgccctggcgccgcgcaggcgatacagcggcgcgccgcgcggacgctcgctggcggccttggctcggcctcgcgtgtggcgctcgccgagcagcaccaggcataccccgagcaacaacaggctggccagctgggcggcgctggagaggctgtagaagccgtaccaggttttgtagatggcggtggtga

SEQ ID NO: 6167 - DNA, 945 bp, Pseudomonas aeruginosa
gcacgaatgataagaaatctcgcttgcgaacccgcgcgactaaatgtgtcggggtgtttcgcctgcgtccaagccaccgaggatggcgaggaacgcctccaccgcggcgctgcggccatggcggcgggtgaagacgaggaaatcggccagcgcctcgggctcggccagcgggcgatagacgactccggcccgggccagcgcggtgctgcaacgcggcaccagggcaacgccctggccggccgcgaccagggcgatgatcgaggtgatctggcgtccggccggtcccctcgtcagcgccagcccggccttccggtagaggcgctcgatcagttcgttgaggccggagccgtagtccagtggaaacaggatcagcggccgatcacgcagatcgtacaggtcgatccgctcttgccgcgccagcggatcgccgttgggcacggccaccaccagcggctcgccgcccagggccagcacctcgatgccgacctggccttccggcggcggcaggcgccccagccccacatcgatgccgccttcggcgatctgcgcccattgcgccgccgaagcgccttcgagcagctccagttgcacctccggatggcgctcgcggaacagtcggatcgcctcggtgaacaggtccgacagggcgatggagctggcgtagccgagggtcaggtggccggccagcccctgcgccagcttgcgggcgaagccggcggtgcgctccagttggtccagcagggcgcgtgcgtaaggcaggaacaggctgccctcggcggtgagggtcaccgcccggctggagcggtcgaacaggcgaaagcccagctcttcctccagcgcggatatctgccgggtcaagggcggctgcgccatgtgcaggcgctgggcggcgcggccgaaatgcagggtttcggcaacggctgcgaagcagcgcaggcggcgtag

SEQ ID NO: 6168 - DNA, 1299 bp, Pseudomonas aeruginosa
  unsure (1116),(1119): Identity of nucleotide at the above locations are unknown.
gtcgagcatgcggttcctcggtatcgatcggtcctgaatcggtattggccagcccgtcgggagcgcccctataacagggggtttctcgtccaggcagagcgttccatgaattcgtcccagggtttcccccgcctcgcgctgtttctctgcggttgcgctgcgttcctcaatctctataccacccagggcatcttcgacgaactggcggcgagcttccacatcagcgcccatcaatcgaactggagcatcaccgccaccaccctggcggtggctctcgccgcgcccttcgtcggccgactcagcggcggccgcgagcgcagccgggtgatcgccttcgccgccagcctgctctgcgtgcccatgctgctggccgcccatgccggcagcttcgccgccttcctgctctggcgcttcgccgaagggatgctgattcccctgctgttcgccagcagcgtggcctacatcggcgagcgctggagcggcggcgcggtcatcgagctgaccagcctctatgtcgccgggaccatcctcggcggcttcgccggacgcttcctcaccggcctgctgaccgaggagtgggattggcgcgtcgccttccggatcctcgccgggctgaccctgctcatcgctgtcgccatccgtgcgctgctccctgccaattctggcaggcacgcgcccgcactcgggaaacgccccttagtatcccgtgaactgttccgggctccgctgctgtcctcctacgcggtggggttctgtgtcctcttttcccaggtcgccatgttcacctatatcggcatccatctcagccgtcagccgtacagcctggacaccgctcagctcggctcgatctacgcggtgttcctcctcgccctgctggtgattcccgccagcggccgcctggcccgcacccgcccgcaccgccagttgctgctgggcgcatcgctgctgggcgtgtgcggctcgctgctgaccctggcgccgggcctgccgacgattctcgtcggcctggccctcagcgccaccggcgtgttcctcgcacagtccacggtcaacgccttcaccgccagcaatgccgggaccgacaaggccggtgccgtcggcctatacctgacctgntantacgccggcggcagcctcggcgcggtactgccggcgccattctgggagcgctggggctggccgggctgcctgggcctgatcctcctggcccagttgctgccgttgctgctgacccgctacggctggtccgcaccacaggccgaacgcgcggccctgcgcgcgtcgcaaggaagaccgtaa

SEQ ID NO: 6169 - DNA, 933 bp, Pseudomonas aeruginosa
ggcgcctccggcttgaacggcgccacgtcgagcgagccgccgtccaccagcagcacctccaggccgctgccctccagggccagggccagggcgctaccgaccatgccggcgccgacgatgaccagatccgcgtgcatatcctcgttctccactcgtgggccctcttcaggccgcgttccgcaggcgcggcttgagccgcacgtacagggttttctgaacccgcgccaccagggtgccggcgtcgtcgcgcacttcggcgtgcagccggggcaggtacttctcgccgccggcggtccgctcgcggacctcgtcgagcagcttctggtcgatgctgaaatgcgcatgcaccgggcccttgcccgggctgacgaactcgatgttggccgccttgtcccagaccacgtagtcgcggcccaggttctccatcagcatcagcatgaagaacgggtcggtcatcgcgtagaggctgccgccgaactgggtgcatacatagttgcgattgagccggttcaggcccatgcgcacccgaacctcgcggaaatcgccagcgatgtgccgcacacggatgcccgcccccaggaagggcgggtagagattcatggcgaagcgcagcaggcgggccttgcgcgccctcgaccagaccggcatggcgctacagcggccgcgcgccgaggcccatggcctggcgggcgaaccagcgcttggccggcggcagcaggtcgagcccgagcaggccgaggttgcgcccggcgccgagcagcgcgcggtcgttggagaacagccgggtcacccggtcggagaagccgacggtcatctgctggtccaggcgctgcccatcgaggtagcgctgcagcacggcgaactcgcccagcggcgcgtcgtcgtggagcagggcgtcgaccagcgccagggtgtcgcgcaacgacaggttga

SEQ ID NO: 6170 - DNA, 420 bp, Pseudomonas aeruginosa
gccggtaaccgccctcccgggcttccagggtcttcacttcggccgggcagtgccagcgcaccacctcggggtcgagcgccttccacaggcactggccgagccaggcgttctccaccacgtagcccagcgccggcacgccttcctcgatggcggtcaggcgggtggcgccgaagcggccgcggtcggaaacatggatatgcaggatcggctcggcgcgctcggcgatcgccggccacaggccgagtcgctcgtagatctgccggctgccgtaggacagcgccgaagagcgggcgtcgtagctgggctggtaggcattgccgggggcgaagggttcgatcagcacgatcgaccagccgcgctcccgagcgccggcctgcagggccagcgccagcgaggcgccgaccaggcccccgccgatga

SEQ ID NO: 6171 - DNA, 423 bp, Pseudomonas aeruginosa
tccgtctcgccgtcctcgctgtcttccagctggccctggacctgggcgatggcggccatgtcctgcagcacttcctcggcttcgccggtcaggctgccttcgcgggcggtgaggccgaaaccggcgaggaaaccctggcaccattggccgagcgcctcggtgcgctgggcgagcggggtttcgtcgtcgggcaggagcatgacgacggcgacctcgccggcggaaaagtcctgccggaccatgccgagcaggccggacaacgcggccttgagtcgttcgcccggcgcgccgccgagcagttcggcggcagcgtgttgccaggcggcctcgtcgaagccggcgccggcgcagacccgacccagcagatggccgtgcagttcggccggcgagaccggcatggccgcctcggcgagaagggagtaa

SEQ ID NO: 6172 - DNA, 555 bp, Pseudomonas aeruginosa
ttgtccaatcaccccaattcccaagcgagagcccatggaagacgccgatctgcaattgttgacggccaagttcgaccagctgctccagaagctggaacagctcaaggcggagaaccggctgctgcgggcgaacgaaaagtcctggcgcgaggagcgcgctcatctgatcgaaaagaacgaaatggcgagacacaaggtcgaagcgatgattttgcgtctgaaagccttggagcaggacacatgagccagtcgaataccctcaccgtgcagattctcgacaaggaatactgcatcaattgcccggacgacgagcgcgccaacctggaaagcgccgcccgttacctggacggcaagatgcgcgagatccgctccagcggcaaagtcatcggcgccgaccgggttgccgtgatggccgccctcaacatcacccacgacctgctgcaccgcaaggagcgcctggaccaggaaagcagctcgacccgcgagcgcgtgcgcgaactgctcgatcgcgtcgaccgcgccctggcgaatccggccgatgccggcgaagcctga

SEQ ID NO: 6173 - DNA, 609 bp, Pseudomonas aeruginosa
tcgaatcgcaagacctcagccgcccggccctgcgccgcaagctccgccaggcgcgccgcgcgctctcccccctgcagcaacgcctcgccgcccgtgccctctatcgacaactggcgcagcatccccttttccgccgtgcccgccatatcgccctgtacctgcccaacgacggcgagatcgacccgcgtccgctgctgcgtgcggcgcagaaccgcgggcaaggccacctacctgccggtgctggcgccctggccgcagacgcgcatggtattccagcgggtcggcagcggcgaacgctggacccgcaaccgcttccgcatcagcgaaccgctggccgacgccggccgccagcgcaaggcctgggcgctggacctggtactgctgccgctggtggggttcgacgaacagggcgggcgcctgggcatgggcggcggcttctacgaccgcagcctggcctacctggcgaggcgcaaaaatggtcacaaaccgacgctgatcggcctggcccatgaatgtcagaaggtggatcgactggcgctggccagctgggacattcccctggcgggaacggtgaccgatgcgggctggtacgtggcagggaaacgctag

SEQ ID NO: 6174 - DNA, 564 bp, Pseudomonas aeruginosa
aaaacggcattttccgataagctgaagtcatacgcaattacaccggcgaccggtggtcacgcgcagacgtttcctacgtatatctacgaaagaggagcaaagttcatgcctgcctactggctgatgaaatccgagccggacgaactctcgatccgcgacctgcaacgcctcggaaccgcccgctgggatggcgtgcgcaactatcaggcgcgcaacttcatccgcagcatgaaccccggcgacctgttcttcttctaccactccagttgcccgcagcccggcatcgccggtatcgcccgcatcgaaggcgaagcctaccccgatcccacggccctggatcccgccagcccctaccacgaccccaaggccagcgccgggaagaacccctggagcgcccgcgacgtcagcttcgtcgaagccttcgccgaggtcgttccactggcccggctgaaggcccaggacgccctggccaacctcgccctggtgcagaagggcagccgcctctcggtaatgccggtcagcgccgaggaatggcaggcgatcctgccgctggcgaaacgctga

SEQ ID NO: 6175 - DNA, 3948 bp, Pseudomonas aeruginosa
  unsure (1855): Identity of nucleotide at the above locations are unknown.
agccatcgctcaggccatctgcgagatggtccggcggaaacgccagagcgcgccgaagaagaacgccgaaccgatcaccacgataccggcgaactgcggccagacgatgtcgaaaccggcgccgcggaacaggatcgcctgggccaggctgacgaaatgcgtggtcggcgccgccagcatgatgttctgcagcagttccggcatgctttcccgtggcgtggtgccgcccgaaaggatgttcagcggcagcagcacgaggatggtcaacagtccgagctgcggcatcgaacgcgccaccgtgccgaggaatatgcccatggaggtggtggcgaacagatgcaatccggcgccgagcaggaacagtcccaccgagccgctgatcggcacgtccagccagccacgcaccacccactgcaacgagagccccgccgccaccagcaccaccaaccccatcgaccagaccttggccatcatgatctcgaaggccgacagcggcatcaccagcaggtgctcgacggtgccgtgctcgcgctcgcggatcagcgcggcgccggtgaggatgatcgacagcatagtgatctggttgatcacttccatcaccccaccgaaccaggcctgggtcaggttcgggttgaattccatgcgcacctcgatctgcgccggcatgctcggctccgcgcggtagcggctgacgaattcgcgcacctcggtggcgacgatgttctggatgtagcccgcgccagagaaggcctgcccggtctgggtcgcgtcgacgttgacctggatcgagggcttgcgcccggcgagcacgtcgcgctggaagtccggcgggatatcgagggtgaaggtatacaggccgacgtccatgccgcgatccatctcggcatgaccgatcatttccggcggccggaagtatgggggctggaaggcattgacgatacgcgacgagagctgcgagcggtcctcgtcgaccaccgcgatcggcgcgtgatgcaaggtttccggaataccggtggcggaactgtagacgcccagggtgaaggcccagacgatcagtgccagcatcgcgtagtcgcggccgagactgcggaactccttgatgcccaggttgaagatgttggccaggctgcgcatcgctcagtcctcctgcttcttcaggcaggccacgctgagcagggtcagcaccacgatggaagcggcaagcggcaggtagtaggcccagagatcggacaggcccagcgatttggaaaaggcgccgcggctgaccaccaggaaatgcgaggtcggatagagcttgccgatccaggccgccgcaccctccagcgaggacaccgggtggatcagcccggagaactggatcgccgggatcatggtggcgatcgccacgccgaatacagcggcgatctggctgcgcatgaacgtcgagaggaacagcccgaggccagtgctggtgaccacatagaggaaagcgccgatggtcaacgccaggaagctgcccttgagcggcacgcgaaataccacgatggccaggaccagcatcagcaggaagttgatcatgcccatggcgacgtagggcagctgcttgccgaccaggaactccaggcgcgtcaccggggtgacatagaggttggtgatcgaacccagttccttttcgcgcaccacgccgagggcggtgagcatggccgggatcatgatcagcagcagcgggatcaccgccggcaccatcgccttcaggctttccacgtcggggttgtagcgatagcgcacctcggtgctggccgccgcgctggcctcggccccacccgcctggcgcgagaagtgccgccaggtactggtgtgcagggcctgcacgtanccgagcacggtgttggcacgggtcggcatcgctccgtcgatccacacgccgatggccggatcggagccacgcttgagatcgcgcccgaagttcggcggaatctccaccgccaggctcagctcgccgctgcgcaggcgccggtcgaggtcgtccgggtcggtgatcggcgcatgttcgacgaaatagcgcgagccggcgatgttcagcgcgtaggcctggctggtggtggtctggtcacggtcgatgaccgcccaggagaggtcctcgacgtccatgttgatgccatagccgatgatgaacatcagcagcgcggtgccgagcagggccagggtcaggcggatcgggtcgcggcgcagctccatggcttcgcggcgcgcatagctgaacagccgcagggggctgaagcgttcgcgttgcgcctggcgctcctggccatcgccgggctgctccgcgacggccggcgcctcggccggttgcgctggcgcggcggcacccgcggcttcctccaggtaagcgatgaaggtcgcttccagggtcggcagaccacgctggcgcaccagctcatcgggagtatcgctggccagtaccttgccggcatgcatcagcgagatgcgatcgcagcgctgagcctcgttcatgaagtgggtggaaatgaagatggtcaccccgtcgcggcgcgacagctcgaccatcagctcccagaagccgtcgcgagccaccgggtcgacccccgaagtgggctcgtcgaggatcaggatttccggcttgtggatcaccgccaccgccagcgacagacgctggcgaatgcccagcggcaggtcgttgggcagctcgtcggccaccttctccaggtcgaagcgccggagcatttcgccgacccgtgccgggatgccatccgccggcaggtggaacagccgggcgtgcaacaccaggttctgccgcacgctcagctcggcatacagggaaaaggcctgggacatgtagccgacccggcgacgggtcgccatgtcgctggcgtccaccggctggccgaacagcgcgcacgtgccttcgctggccggcagcaggccggtgagcatcttcatggtggtggacttgccgcagccgttggagccgagaaagccgaagatttccccacgctcgatacggaagctgacgtgatcgaccgcgacgaagtcgccgaaacgacaggtcaggccctcggcctcgatggcgatccgcggcgcgccttcgctctgcggtcgcggcgggatcaccaatcgatggtggccggcgcgcttgctttccggcagcagggcgatgaacgccgactcgaggctctgcgtcccggtacgctcgcgcaactcctgcggcgtaccggtggccaggacctttccgtcgtccatcgccaccagccagtcgaagcgctcggcttcctccatgtaggcggtggcgaccagcacgctcatgccttcgcggcccgcgcggatacggccgatcagctcccagaactggttgcgcgacagcgggtcgacgccggtggtcggctcgtcgaggatcagcaggtcgggatcgtggatcagcgcgcagcacagcccgagcttctgcttcatgccgccggacagcttgcccgcaggacgctcggcgaacggcgccagcccggtgctctgcagcaggtcggcgatgcgccgctcgcgctcggccttgtcgtggccgaacagccgaccgaagaagtcgacgttctcgaacaccgagagcgtcgggtagaggttcttgcccagcccctggggcatgtaggcgatgcgcgggcagaccgcccggcggtggcggcggtcgcgcatgtcgccatcgagcacgcggatctcgccatcctgcatcttccgtgcgccggccagcagcgccagcaggctggacttgccgaccccgtccggaccgatcaggccgaccatgcggttggccgggatctccaggctgacgtcgtccaccgcgcgcgtctcgccgtagcgcagcgaaacgccccggaggctcgccacgccgctcccgccagcggtcattgcggaaccttgatctgcaggttggccggccactcgacctcagggtccagtcgcaggtag

SEQ ID NO: 6176 - DNA, 972 bp, Pseudomonas aeruginosa
acgtcggccaggtcgaccatgttgagcagcttgccaccggccggcagcacttcccccggctgtgccacgcggtactgcacgcggccgttgcgcggcgccttgagcaggctgtcgtcgatatccgcctggagccgggtgacgctggccttggccgcctcgatggccgactgcgcctcgattacctgggaacgcccggcctcgatcgccgcctgcgccgaaatcacttgcgagcgtgccgcggacaacgccgcctgggcgctctgcagggtcgcccgatcgtcgtcgagttgctgttgcggcagggcattgcgcttgaccagcgcctcggtacgggtgaagcgcttctgcgccgctgtcagctcggcctggcgctgcgccaccacggcctgggcggtgctcttctcgctctcgcgctgggccaccagcgaggtcgcggtgagcttggcgttctccgcctggcgcacctgggcctgggcctgggccaactgcgcctcgagcacctgggtatccatccgcgcgacgatttcgccggccttgacgaagtcgccctcgtcgaccttgatctcggcgacccgcccgggaagcttggccgccacgtccacctcggtggcctcgatgcgtccgttgccgctggcgaatccctcgcccaggccggtcggtcgcgatacctgccagaccagcacgcctacgccgagcagcgccgccacgaccagggcacggctcagccaccgtttgctttcctgtttcatcccttctcctcgcacgttcggccaggccgcggcgatggcgctcacgctggaaagcgcggccgccgcggacttcactggctcgattgtccctccagggcggcgcgcaggtgttgatgcacgtcagacgcgcccgaccgaacttcacaggaaagcagaatccccggtgcctcgcatccgggagcgcgggacagaacggatagttgacctcagggctggacgatga

SEQ ID NO: 6177 - DNA, 249 bp, Pseudomonas aeruginosa
actgccgcaggaacgaccagaccccgagcatcacgcgcttggcgtgccctgggtactgcttcttcatggtcaccaccgccatccggtaggaacaaccttccggcggcaggtagaaatcgacgatttccgggaactgcttctgcaggatcggcacgaacacttcgttcagcgccaccccgaggatcgccggctcgtccggcggacgcccggtgtaggtgctgtggtagatcggtttctgccggcgggtga

SEQ ID NO: 6178 - DNA, 822 bp, Pseudomonas aeruginosa
gcgccttcttgtcgaacatgcagtcggtctgcccatcgcgccacttggacgccttggcataacgcaaggcttcctcggaaagacgcgacggcacgccgtcgtaatgccgcaccaactggccgacgactcccagcagcagcaagctgcacagcgccgcgccaagcatctgccggcgcccggcgaacagcttgcgctcgcggaacggtgcctcgacgtagtacagcgacagtgccgccaggccgatgctcgccgccagcaaccccaggcgtgccggcaggcccagggtctccagtgcgtggtactggacgaagacgtacaacggccagtgccagaggtacagcgaataggagatcagaccgaaccagaccagcggttgccagcccagcaggcggcgagcccaggtgtcgccggcgccgttggcccagatcagcagggcggtgccaagcaccgccggcagcgccgcgaggccggggaaaggagtgtcgctgtcgtagaagaacaccggcaggagaatcgccgctatcccgagggtggccgccagttgcagggaccactgcgaatgaccgcggctaccgcccggcagcaatgccagcgcggcacccgccaggagttcccaggcgcgcatcggcaggaggaagaatgcactgccaggtcgctggttcaccgcccagacgctggccgccagcgatagcgccaggaccgcgaggaggatggcgagccgccagcgcagcagacgcccggagaccgcggccagcagtagagggaagagaatgtagaactgctcttccaccgacaacgaccaggtatgcaatagcggcttga

SEQ ID NO: 6179 - DNA, 1674 bp, Pseudomonas aeruginosa
aacgcgaaagtgccgaccatcatatcccgccttgaccctcgccggaaggcgcagccgattgagagtctctatcgttggtcggctgattcccgattgatcggctgccgcattggcgaccctcgccctatcgtggcaggatggcgcagttttccaatggacttgcaaagcatgccgcaaaaacctgccgaggcattcccgctgattgccgccctggacctgggctccaacagtttccacctctgtctggccaaggccaatatccacggcgaagtccgcatcctcgaacggctgggcgagaaggtccaactggccgccggcctcgacgaggagcgcaatctcagcgaagaggccacccagcgcggcctcgactgcctgcgccgcttcgcccagttcatcagcggcatgccccagggttccgtacgcgtggtcgcgaccaacgccttgcgcgaggcgcgcaaccgcagcgatttcatccgtcgtgcggaagaggttctcggccatcccgtggaagtcatctccggccgcgaggaagcccgcctgatctacctcggcgtcgccaacagcatgcccgacagcggcggtcgccggctggtcagcgacatcggcggcggcagcaccgagttcatcatcggccagggtttcgagtccgagctgcgggaaagcctgcagatgggttgcgtcagctacacccaacgctacttccgcgacggcaagatcaccccggcccgctacgcccaggcgtacactgctgcacgcctggaactgatgggcatcgagaacagcctgcggcgcctcggctggcaacaggcggtcggcgcctccggcaccatccgcgcagtggcgctggcgatcaaggccggcggccacggcaacggcgagatcagcccggacggactggcctggctgaagcgcaaggtgctcaagctcggcgacgtggagaagctcgatctggaagggatcaagccggaccgccggaccatcttcccggccggactggccattctcgaagcgatcttcgacgcgctggaactggaacagatggttcactccgagggcgccctgcgcgaaggcgttctctacgacctggtcggccgtcaccagcacgaggacgtgcgcgaacgcaccatcagctcgctgatgcagcgctaccacgtcgatccggagcaggcttcgcgggtggaggccaaggccctcaaggtgcttgccgaagtcggcgacgcctgggagctgaacggcgaactgcaccgcgacctgctgagctggggcgcacgggtccacgagatcggcctggacatcgcccattaccactaccacaagcacggcgcctacttgatcgagcactccgacctggctggcttctcgcgccaggaccagcagatgctgtcgctactggtacgcggccaccgccgcaacattccggcggacaagctggcggagttcgccgaggaaggcgacaagctggtacgcctgtgcatcgtgctgcgcttcgcgatcctcttccaccacattcgcggcacccaggaaatgccctcggtgcgtctgaaggcagagcccaagagcctttcggtgaccttccccgagggctggctggaagccaacccgctgacccaggccgacttcgcccaggaagccgaatggctcaagcgggtcggctacagcctcaacgtgcggtaa

SEQ ID NO: 6180 - DNA, 1167 bp, Pseudomonas aeruginosa
ttgttctgcggcctgcttggcgaagtaggtcagaatgccatcggcgccggcacgtttgaaggcggtaagggactcgaggatcaccgattcggccagccagccgttctggatggcgcccatgtgcatcgcatactcgccactgacctggtagacaaaggtcggggcgcggaattcatccttcacccgacgcacgatgtcgaggtagggcatgcccggcttgaccatcaccatgtcggcgccttcggccaggtcggcggccacttcgtgaagtgcctcgtcgctgttcgccggatccatctggtaggtggccttgttgcccttgccgaggttcgaagccgagccgaccgcatcgcggaacggaccgtagtaggcgctggcgtacttggccgagtaggccatgatccgcacattggtgtggccggcagactccagggcctcgcggatcgcaccgatgcgaccgtccatcatgtccgagggcgctaccacctgggcgcctgcctcggcgtgggacagcgcctgccgtaccagcacgtcgatgctgacgtcgttgaggacgtagccatcgtcatccaggatgccgtcctggccatgggtggtgaacgggtcgagcgccacgtcggtgatgatgcccagctccggaaagcgctcgcgcagggcgcgggtggcgcgctgggcgatgccttccgggttgtatgcctcggcggcgtccagggacttcttctccaccggggtcaccgggaacagcgccagcgccggaatgcccagggccacccactcttccgcctcgatcagcaactggtcgatggacaggcgctcgacgccgggcatcgacggaatgctttcacgctggttgaccccatcgaggacgaacaccggcaggatcaggtcgtcgacggtgaggacattctcgcggaccaggcggcgggagaagtcatcgcggcgattgcgccgcaggcgggtgtagggataggcgcgattggcgggagtgaagctcacggtttactccagggcccagataacgggcacagtgtgacagttatagtccctgattatgacggattggcaacaagcgacgacagtgactcaaggtcgcggcatcctgccgcaccgccaatcatcgcaaaaagccagcggcaaaggccattcattgcacaatcaatgacctga

SEQ ID NO: 6181 - DNA, 621 bp, Pseudomonas aeruginosa
gctgcgcgttcatttcgcttcgctgccccgatgatgctccaacaattcctgcaggacttcggctatttcgccctttttctcggtactttcttcgagggcgaaaccattctcgtgctggccgggttccttgccttccgcggctacatgcagctggataccgtgattctcaccgccttcctcggcagctacgccggcgaccaactctggtacttcctcggacgccgccacggccgccggttgctggcgcgcaagccgcgctggcagaagctcggcgacaaggcgctggaccatgtgcgccgccatcccgacctgtgggtgctgagtttccgcttcgtctacggcctgcgtacggtgatgccggtggccatcggcctgtccggctatccaccggcccgctatcttcttctcaacggcatcggcgccatcgtctgggccgccgcgctgggctccgccgcctactatttcggcagcgtactggaaggcatgctcggcaacatcaagaaatacgaactcatggtcctcggcggcctgatcgtgctgggcctgctgctctggctatggcggcgtttcaagacaccgcgcggcaacggcgcgggcggcaacgccgacaaatccgagtga

SEQ ID NO: 6182 - DNA, 2499 bp, Pseudomonas aeruginosa
atcggcttcccgctgcaggcgggtgagcaggcgatccagggcgttggcgaacgcctggcggtcacgctcaccgtagggcgcctggccgccgcccatctgcccctggtcacgcaggtcggccatcaggttgcgcatggccagcttatcgcccatgttccgcgcgtcgaactcgcggccgcgaggatcgagggcggcaacctgtttcttgatcagccgatcggccagcggtacgtcgctgcagatcgccaggtcgcccggctcggcctgctccaccaggtaatcgtcagccgcatccatcccgctttccaccaccaccagacgcacgcaggcgaacggcggcttgacctgcggctggccggcgaccatccagacttccagcttgcgcttgagagcgaacttgcagaccagttccttggccgccttggggcaggcgtcggcatcgatccagatacgcatgaacggacttccgtagaaatgacgacggccagtatcgcactggccgtcgtggttgcgcgaacccgctcagtcggccgcgttggccgccgcacgccggcgctcgacgatccggctacgtccgtagagcagcgcgatggccaccagcgccatggcctgggccgacagcgaataggcgtcagccttgatccccagccagtcgaagtcgaagaacggcaccggacgggtgccgatcaccccggcttcctgcaaggcgatgacgccatgtccggcgaacaccaccgagagcgcacagagcaacgccgcgttgatgctgaagaacaaccccagcggcagtttcgccgaaccacgcaggatcacccaggccaggccgatcagcaggaccacggcggtcgccgcgccgccgatcacggcattgtgcccggccggtccggcctgcaaccagagggtttcgtagaacaggatgacctcgaacaactcgcggtagaccgagaagaacgccagcactgcgaagccgaagcgtccgccaccgcccaccaggctgctgcggatgtagtcctgccaggctgccgcgtggcggcggtcgtgcatccagacgccgagccagagcaccatcacgcaggcgaacagagaggtgaagccctccatcagctcgcgctgggcaccgccgatatcgatcacataggcggccaacgcccaggtggcgaaaccggcgacgaaggccagcccccagccgacgtgcacgccacgcacggcactttcctgcccggtattgcgcaggaaggcgaggatggcggcaagcaccaggattgcctctaccccttcgcgcaacaggatcaacaaggcggaaacgaaactgatggagaaactcagcgagtcgccgccaagctgcttggcggcctctgccagcttgcccttggccagctccagctgttgcgccacctgggtttccgggaggccatcgcgcaacgcctggcggtaggccatcagctgcttctcggtggagcggcgcaaatcggcgtcgacgttgtccagcgagctttccaccagctcgaagccctccaggtaggccgccaccgacaggtcgtaggcctggtcgcggtcgccttcgcgatagaccgcgaagctcttgtccagggtggcggcggtatagtcgatcaactgcccaggaccgcgctgctccagcggcggatgcgcacgcagggcgcggaagctctccgcagcggcctcgccgtcgtgctcggcgacttcggccggagtctgcgtggccagggtcgccagcgggtaggcatgggccttgtccggctgcgcactgccggcgctcaggccggccacatagctggccaggtcccagcgctggcgttcgtcgagctggtcggcgaacgccggcatgtcggtgccggccacgcccaggccgatgacgttacgcaggtcgtagaggctcaggtggtcgaggcgctggcgatcggtgaggttcgctggcggcggttccaggccgatgccggcggggccgtcgcccttgcccgcatcgccatggcagatcgcgcactgctgggcatagatcggcgccgcgcggctcgggtcgggggtgatcgcgggggtctgcaccacctggtagatatccgccacccgtgcctcgaggttgcgcgcctggagggccacgtcccttcccggcaagcgctgctcgatggcctggcgcaggctggcgacgcccctctccagctcggcgcgctcggggcgcatcggcagggtcaggaccaatgcctgcaggttgccgacgaactccacctgttcctggtattcgctggggtcgacgatcttgccgtcagccacggtcggcggatagtcggccgccaggtaactcaacagatgcaaggcttgggaggggtcgacggccgtgtcggcaagagctccaaggctgaacgcgcagaccagcggcagcagccacagcaggattttcggagggtgcatggcgaagacgaagtgagaatggaagagattaaattgtcccttcgccttcccgcccatgcaagaaatactctgtaa

SEQ ID NO: 6183 - DNA, 1137 bp, Pseudomonas aeruginosa
cctcgcgcaaagccgtactgcaacccgcaggacatcgaggcgatggctccggcgcccggcgacaggctgatggcccagcaggcgaggaagaaggcgaaccaggtactgacgagcattgcacacctcggaaagcgaacgcggctggcggcgggaacgaaaaagccagtgtgcaccaaggcggagcagccgcacaggttttccgaccacgcgcctcgcccaacctttgcgggcgcaacctggcggacagaaaaaacccggcagatgccgggctttcccgaggatacgtgctcagccatgttgggcagaccaccgcgatgcggctattcgccctggccccgaacgctctcagtccggcgaacccttgcgcagcttcaccggctcttcgccgcgcttgcgcgccagggctccgcgcaagcggatgttcagcgcctccaccgccagggagaaggccatggcgaagtagacgtagcctttcggcacgtgcacttcgaaggactcggccaccagcacggtgccgaccacgatgaggaacgacagggcgagcatcttcagcgaggggtgtttctcgatgaagtcgctgatggtgcctgccgccagcatcatcacgccgaccgagatgacgatcgccgcgaccatcaccggcacgttctgcaccagaccgacggcggtgatcaccgagtccagggagaagatgatgtcgatgatcgcgatctggacgatgatgcccatgaagccgtggaccttgccgccgctcttctgctcttcttccgcgccttccaggctgtggtagatctccatggtgctcttgaacagcaggaacaggccgccgaagaagaggatcaggtcacgcccggagatgccctggccgaacaggtggaacaggtcggtggtcaggcgcatgacccaggtgatcgagagcaacagcaggatccgcgtgcccatggccagggccaggccgaagaagcgcgccttcggttgctgggccggcggcaggcgcccgaccaggatcgagatgaagatgatgttgtcgatgccgaggacgatttccagggcggtcagggtcaggaacgcgacccagatttcaggactggcgagccattccatagatggttatttcccgttttttgttggagttga

SEQ ID NO: 6184 - DNA, 444 bp, Pseudomonas aeruginosa
cagccaggcgaccagcaggatgagcaggatctgcatcgccaccaccagcggcccgctccaggtctgcgtcaacacctgcaagtcttccatcactcactggcctctagttctttctgcagggcttcgagggtttccagggcctccagccaacgttcctccagctcgccttcgcgaaccttcaggctcgattgttcggacagcaactcgcgcaattcgtcctttcgcgatacgtcgtacagggcgctgtcgcccagccgcgcctcgatagcggctagcttttcgtgcaggccgccgagttcgcgctccagcttgtcggcctcgcgcttgtgcggcgccagctgctggcgcagcgcggccgctgcctggcgctgggcgcgcttgtcggtgcgttcggtcggcgcacccggcgcggtctcggcctgcggcgccttgcgcgcgcgatag

SEQ ID NO: 6185 - DNA, 579 bp, Pseudomonas aeruginosa
tcgtcgagatcgccatcgaacggcaccacgcgcccatcggcgaccaggaggaattcatcggtggtgcttttgagcaggtgccggtcgtgggaaaccaccaggaccgccccggaaaactcctgtagagccatggtcaaggccaggcgcatttccaggtcgaggtggttggtcggctcgtcgagcagcagcaggttgggcttctgccaggcgatcagcgccagggccaggcgcgctttctcgccaccggagaagttcaataccggctcgtccacccgaacgccgcggaagtcgaagccgccgaggaagtccttgagggtctgttcgcgctcgccgggggcgatacgctgcagatgtagcaacgggctggcctgtggatccagcgaatcgagctggtgctgggcgaagtacccgatggccaggttctcgccgcgcagcaggcggccgcccagctcgggcaggtccccggccagggtcttgatcagcgtcgacttgccggcgccgttgggaccgagcaggccgatccgcgcaccgggcaccagttgcagcttgaccttctccagcaccgccttgtcgccatag

SEQ ID NO: 6186 - DNA, 912 bp, Pseudomonas aeruginosa
aggcccaggaactacgagcggaacgggaacacctgcaacgcctggccgacctggccacagcctggctggagggccaggaagcgaatcgcagtgcggatgcctggctgcaagcctgcagccgggacatctgcacggaagcagagcgccgggctttgctggtgcttggctcggcggctttgcagacagcgccttaggaggcgctggtcggggcggcgccgttgctgcccgcggcaggcgttgccgaagcagcgctggaggcggctgccggggcgctgggagtcgccgcaggcttcgcagcaggagcggtggcgggcttggttgcggcaggtttcgcggctacgggtttcgccgcaggcttggccgccggtttcgccgcaggcttcgcagccggcttggctgcaggcttcgcggccgcggatttcgccacaggcttggccgccggtttcgccgcaggcttcgcagctggcttggctgcgggcttcgcggctgcggttttcgccgcgggcttggccgtcggtttcgcgacaggcttcgctgccggcttggcggcgggcttcgcggctgcggttttcgccgcaggcttggccgccggtttcgccacaggcttcgccgccggcttggctgcgggcttcgcggctgcggttttcgccgcgggcttggccgccggtttcgcagcaggcttcgccgtcggcttggctgcgggcttcgctgccgcggttttcgccgcaggcttggccgccggtttcgcagcaggcttcgcagccggcttggccgcaggcttcgccgctacggttttcaccgcaggcttggctgccgccttcgcagcaggtttggtcgcgggtttcgccttgcggctctccagagccttgccagcagcttccttcaccttgccgacaccctgcgccagcttga

SEQ ID NO: 6187 - DNA, 717 bp, Pseudomonas aeruginosa
acccgcacaccccctctcgccaacgggttcgatgtgctacaagcgacgtgcgccaggattgcccgccgattcgtttggagaaaccgcatgccgcgccgccttttcatcggtctttttctactgccgctgccgcttttcgccgcgcctcccaaggacgaactggcctatgccgtaggcgcccgcctgggtatgcgcctacagcaggaaatgcccggcctagagctatccgagctacttctcggactgcgccaggcctatcgcggcgaggcacttgaaatcccccccgaacgcatcgaacaacttctgctgcaacacgagaacgccacgacggaaacaccgcggaccacacccgccgaggcccgcttcctggccaacgaaaaagcccgcttcggcgtccgcgaattgaccggcggcgtcctcgtcagcgaattacgtcgtggccaaggtaacggcatcggcgcggcaacccaggtacacgtccgttaccgcggcctgcttgccgacggtcaagtgttcgaccagagcgaaagcgccgagtggttcgccctggacagtgtgatagagggatggcggacagcgttgcgagcgatgcctgtcggcgcgcgctggcgagtggtgattccttcggcgcaagcctatggtcacgaaggcgctggcgacctgatcccgcccgacgctccgctggtcttcgagatcgacctgctgggcttccgctga

SEQ ID NO: 6188 - DNA, 1671 bp, Pseudomonas aeruginosa
tggcgacgcaggccaggaacgcgagaaggaaaagctgacgggggctggccaggggcatggcggatccacaggtacacaggggaaaggccgcctacggtagtggaaagcctccggccgtttcaagccgcaaggcagctctgcggcaaggcatcccgaatcatgccgggcgcccgcgacaagccgccacagtcctgccgatggagccgaacggggaacgccgggtggcgttccccatgctcaaatccccgccaccaccacgggcagccccggagtacgccgatcgagcaggaccaggccctcctggaacaactggttgctgcgctcgacctcgccgagctgcgccagcaggcgtcccagctcggcgcaggtctcggcactgcgctggaagctcaggctggcctccaggtattcccgggccttgccccagagcttgttgatcaggcacaggcgccccagggtcagcagcaggccgggatcgttcggatgttccttgagccaaccttccgcggcctgcaattgcttgcccggatcgcgcccgcgcacctgcccgtagagttgcaccagggtcgcgtcgaagccttgcttgagcgcatggcggaggacttcttcagcctcttcctcggcgcccaggcgaagcagttgggcggcatagcccgcgacgatcgccgggtctgcacgcagcgccgaaggcacgttctgccagcgctgggtcagcggctgcaacgccgtttcgccctcgttcagtccacgctcgccggcttcctgcaaggaagccacccaggcacggcgttcgaggtcgcgcagttcggaatccttcagcacacgctccttgcgcagctccggcagcaggacgcaaagggcctgccagtcgtgctgggtgacgtacagctgctgcatcagccgcaataccgtgcggtgctgcggctggagcccgtgcagctcttcgagggtattgcgtgcctgcgggtagtcgccgcgattgatcagcagttgcgcacgggtcaggccgaccagcaattgggcatccggctcgcgctcgcgagcccggttcagcaggtcgtcggcctcgtcgtagcgctcgagttcgttggcggcccgcgccgcgccgaggtaatgcatcagcggccgctcgcccatctccgcagcccgccgcaaatgacgcagcgcctgcggccagttgccttcgccgagatcgcgcaggccgctgtgctcggccatctgcacgcgacgccggcggttgtagcgcgaccaggggttgaccacccgccccgagctgccgagcaggcgcaggaccaggcgcaccagcaccaccagcagccagaccaccgccagcagggcgaggaacgaccacaggctggattcgtaacggaagctcttgtaggcgatcagcacatagccggcctgctcggagatcgccagcccaaccagcgtggcgaccagcaccaccgccagaaccaggaggtagatgcgtctcatggacggccctccgtggccggagccgcctgcgcctcgggcaccaggttgccggcggcctcgcggcgcgacacgtacgactgcaaggcgctcagggccggtgcgatgtcagggacctgcacggtgaccggctgcttcgccaactcatcgatacgcaacttcaacgcacggctgtcggccagctctacgttgaaatag

SEQ ID NO: 6189 - DNA, 1998 bp, Pseudomonas aeruginosa
ccaccaccaccgcgcagtagcggtccaggtcgagcatcagcgtacgctgctccggggtttcttccagcggatcgatcgccaacagcggcaggctgctgctatggacgcccgcctcgccgaggctggcggccagggccgcgcactcctcgtcggggcgcgtcagcaggagccgccagccgctcacggatgtccggcctcgccgtagacggcttcgagaatcgcttcggcgccctgctccagcaggtcctcggccacccgcacgcccagcgcctcggcgtccgccagtggcgcccgcccctcggcgcgcagcaactgggtgccatcaggctggccgaccaggccgcgcagccacagttggtcgccctcgcggatggcgtagcaggcgatcggcacctggcaaccgccgttgagccgcttgttcagcgcgcgctcggcagtgacccgcagagccgtgtcggtatggtgcaagggttccagcaaggcatgcaggtcgctgtcggccgtacggcattcgatgccgacggcgccttgtccgccggcgggcaggctgtcgtcgacactgatcgaggagcggatgcgcgactcgaagccgaggcggatcaggccggcggcggcgaggatgatcgcgtcgtattcgccggcatccagcttggccaggcgggtattgacgttgccccgcaggaaacggatctgcaggtccggccggcgcgccagcagctgcgcctggcggcgcaggctggaggtgccgaccacgctcccggctggcagttgctcgaggctggcgtaggtgttcgagacgaaagcgtcacgcgggtcttcgcgctcgcagatggtgtagaggccgagcccctcgggaaagtccatcggcacgtccttcatcgaatgcaccgcgatgtcggcggcgccttcgagcagggcggtttccagttccttgacgaacaggcccttgccgccgatcttcgccagcggtgcgtcgagcagcttgtcgccgcgactggtcatcggcagcagggtgacggtcaagccgggatgcgcctgttccaggcgcgccttgacgtattcggcctgccacaaggcgagggcgctctggcgagtggcgatgcggatttcgcgggacgacatgggatattccgtgcacagggatgcgcccatgataacagttcgaacccgagtgcgcggacgctgggcccgatagccgcacccgggtcgctggcgaaccgccgaccgccgtcagagctgatgcatcagacgcctgaccccggccacgtgccgccggctgacggtcagcgcatcgccgtcgaggcctttcaggtagagctggaaatgccccagcggcgtacgctgcaggcgttcgatccgttcgcgggcgaccagcgcgttgcggtggatgcgcacgaagcgctcgccgaactcgtcttccagcgccttcaacggctcgtccagcagcacctcgccctgcgcatggcgcaaggtcacgtacttgtggtcggcaatgaagaagatcacctcttccagcgggatcagctcgatccccttgcgggtccgtgcactgatgtggctgcgcggaccgctgccgccggaggccgggggcttggtcagcgcggccagttgcacgcggttcggtcgcgaggctttcttcaacgcctcggccaggtcttcgctgcgcaccggcttgaccaggtagcccacggcgctgacctggaaggcttccagggcgaattcgtcatgggccgtgcagaagatcacagccggcggcgcttcccgctcgcagagtctggccgcgacctggaggccgtccagaccgggcatgcggatatccagcaggacgatatcgggcttgaggctgtcgatcagcgtcagcgcttcttcgccattgctggccgagggctcgaggacgcgatagccgtccagctgccctaccaatcgggccaggcgctctcgcgccagaggttcgtcatcgacaatcaggacattcataagctcaggcttcctgcatga

SEQ ID NO: 6190 - DNA, 1623 bp, Pseudomonas aeruginosa
gcatcgacagagtttccgcaaggcccgtggcgcccgcaagacagccgcgggcgtacgggcgaaataaagcaccgaaatgccatctgccgcaaaaaaccgcgaaacagcgctcgttccggcttcgtcgacgagccgccggtttttcctcccggcctgctatcatcgtcgcactttgcccgtcacgcaggccgcgcggcctgtccgtttcttgttgcagcgagagataccatgagcgtagagaagaccaaccagtcctggggcggccgcttcagcgagcccgtcgacgccttcgtcgcccgtttcaccgcctccgtcgacttcgacaagcgtctctaccgccacgacatcatgggttccatcgcccacgccacgatgctggccaaggtcggcgtgctgagcgacgccgagcgcgatgcgatcgtcgacggcctgcaacagatccaggcggaaatcgaagccggcagcttcgactggcgcgtcgacctggaagacgtgcacatgaacatcgaggcgcgcctgaccgaccgcatcggcgtcaccggcaagaagctccacaccggccgctcgcgcaacgaccaggtggccaccgacatccgcctctggctacgcgacgagatcgacaccatcctcgccgagatcacccgcctgcaggagggcctgctgggcctggccgaagcggaagccgacaccatcatgcccggtttcacccacctgcagaccgcccagccggtgaccttcggccaccacctgctggcctggttcgagatgctcggccgcgactacgagcgcctggtcgactgccgcaagcgggtcaaccgcatgccgctcggctcggcggccctggccggcaccacctacccgatccagcgcgagatcacctgccagttgctgggcttcgacgcggttggcggcaactccctggacggcgtctccgaccgcgacttcgccatcgaattctgcgccgccgccagcctggcgatgatgcacctgtcgcgcttctcggaagagctggtgctgtggaccagcgcgcagttccagttcatcgacctgcccgaccgcttctgcaccggctcctcgatcatgccgcagaagaagaaccccgacgtgccggagctggtacgcggcaagtccggccgggtgttcggcgccctcaccggcttgctgaccctgatgaagggccaaccgctggcctacaacaaggacaaccaggaagacaaggaaccgctgttcgacgccgccgacaccctgcgcgacagcctgcgcgccttcgccgacatggtcccggcgatccggccccggcgcgagatcatgcgcgaggcggcacgccgcggtttctccaccgccaccgacctggccgactacctggtgcgcaagggcctgccgttccgcgactgccacgagatcgtcggccacgcagtgaagtacggcgtagacagcggcaaggacctcgccgagatgagcctcgacgaactgcgccgcttcagcgagcagatcgacgccgacgtcttcgacgtgctgaccctggaaggctcggtcaacgcccgcgaccatatcggcggcaccgcgccgaaccaggtccgtgccgccgtcgcccgcggcagaaaactgctggcacagcgctga

SEQ ID NO: 6191 - DNA, 1269 bp, Pseudomonas aeruginosa
ccagcaccggcaccaggatcagcgcttgtgtcttgcctacggccggacgcttgtccgcacgctggctgcgcccctgcaggagatcgacttcgaacaggttgcccttgccatcacattccagttcgcgccacaacttgccgtcctggaacaggtagatccgtcccgcccgcggtagcgcgccggcgggcagctggtcgccataaccggccttgcccagcgttggcaggcggaccagcggcatcacagccaggaaggtgttctgctggatacgctcgtgctcctcatggccgagcatatcgctggccaccggaatctgcaggataccgccgtcctgtcgctcgacgttcaatgccagtcgtgcacgccgatcgttctggtaggcggtgcgcttgcgcacgccttcgtcgatactctggtcctggaatccgctcatgcctcgctctccggtggcaacagtacgacctggcttccttgcgccgggtctccccagacatcgacgatcaattgttccggccccttccgctcgggacggctacgcgccgggttgtccagtacctggcccgctgtcgccgcatccgcgtcgagcggcggccccggcaacagcggcgccgcgccgctgccgttgcccgggctgccgccggagttgacccggacgttggccccggagagggtcacgccgctggcgtcgagcttgaggaagctgccgccgcccttgagggtcagttcggcgccggcctccagcaccaccttcagaccgctgctcaggtggatctcctggccggcctcgacgaactggccgctggcgatcttcaggtgctggtcgttggctacggtgaggtggtcgctggctcggacctccaccttgcgctcggcgtgggtggtgcggtgttcctcggccttgaactcgctgtagctgttcgcctgcacggtgtcgtggcgttggtgaccgacgcggatcttctggtcgtgctcgatgttttcgtcccagtcgcgctgggcatggacgaagatctgctcctggcccttgcggtcctcgatgcgcagctcgttgtagccaccgccgccagggctgctgaggctcttgaagacgctgcgggtcttgtgccccggcagttcgtagggcaccggatgttccctgtgaaacaggcagccggtgaccagcggctggtcgggatcgccttcgaggaaggtcaccagcacctccatgccgacccgcgggatggcgatggcaccgtagttccttcccgcccagccggaggcaacgcgtaa

SEQ ID NO: 6192 - DNA, 1503 bp, Pseudomonas aeruginosa
ccagcaactgctgctgtcgtcggcctggccctcgcgatcccagtggaattgcaccttcacccgaccgtagcgatcgcagtggatttcctcgcccttcgggccggtcaccaccgcgctctgcgtgccgaggatgcgcggcttcggcggcgtcggtgggggacggaagaacgcctcccagggcgtggcctggaagcggttgcggtaaccctgccggaagtcgtccgggctcgccgaggcatcggagacgatgctttcctccagcacctgaggctgccgcccctcgtgaatcacctcggtgagcagccagaggtcgttccagcccgcctggggatgggcggccagcggcaggaagtggccgctgagcagcaacggttggtcgctgcggccctcggccaggcggtagtcgctgcgctgccgttcgagggcgcgcctggccaggtgctttccgcgctcgcggtcgacgaagcgaccgggatagtcgtagtcctcgaggtccggccgggcttcgccgcgggcggcgctttccagcgtcaggcgcggtttctcgaagtcgtagtcgcggcgggtgacgcggctggtgcgggtttccaggcgtacgccgaagcgcttgaccgccggccggtcggcgaccaggccggagtcctgctggtaggccaccggcgcgagccgcgggaacaccgtctggtcgtcgccgaacaccagcaggtgcgccgtggcgctgtgctggaaatgaaaatggatgccctcctcgcagcacaggcgctggacgaactgcaggtcgctctcgtcgtactgcacgcagtattcgcgctcggggtagcgggtgccgagctggaagcggtaggcgtcggcgaggatgccgtgttcctccagcacccggccgacgatctgcggcaccgtgaggtgctggaagatgcgctggttggtgcgctgggcgaggtaggccagttgcgggacgagggtgatgcggtagcgggtcaggcgcttgcccgagtcgccctgtccggcgctgcgcaccaggccgtggataccgttgccggcgggcccgagggtaaggaaggcgggtttgtgcagcaggctttcgaggtccggcacggggcgttcgccgaccagctccaggtcgaaggcgaacggctggctgatggcttcgcggccgctgaaggagagcacctgcaggtcgatggcgaggccgtcgatggcgaggctgaagtgggtctggttggctgctgcgaacatccgttgtccctcactggcgcaggcgaccgattcgattgtcctgcctggcgcgggcgagacaagggcgcgcaggctcgatcggaagctgcctacaacaaacaaagcggcatcgacccggcgcgggctttcctgaccacggcgctatgggtcatcgagggcacgacggccagcaaggctggccccgtgcggcggtcgcggctcagccggcgaccggggagcgccagtcgtcggagccggaggtgccggagacttcgtgggtccaggtga

SEQ ID NO: 6193 - DNA, 198 bp, Pseudomonas aeruginosa
aggtcagctaaggaggtttcgatgtccggcaaacccgcagcccgcgtttccgatcccaccgcttgtccgctccccgggcacggcagcaatcccatcggcgtcggttccgccgacgtgttcttcgacggcctcgcggcggcccgccagggtgacgcctcggcctggcgctgtaccgctcgatgcctggttcgtccatga

SEQ ID NO: 6194 - DNA, 693 bp, Pseudomonas aeruginosa
gccgagcgttgccgaggcggtgacgatcctgcgtggcctggcccgggtttacgaggaaagccacggtatctacttgcgcgacgacgcggtggtggccgccgccgaactgtccgcccgctacctggcgggtcgccagttgccggacaaggccgtcgacgtcctcgacaccgcctgtgcgcgggtgcgcatcagcctggcggcggcgccggagagtctcgagcgcctgcgcggcgagctggccgaaggcgagcgccagcgccaggccctgcgccgcgatgccgaggcaggcctgccgatcgaccacgatgccctgcaggcgctggaggagcgcctggcccaggcggaaagcgagcggcacgtacaggaggaccagtggagccgccagcgcgaactcgccgagcgcctgctcgccctgcgccagcaattggccagggcccgcgaggcgaaccgggaagagcagggcggcgaggcgaacgcggagactttcccggccgacgagcatggcggtgtcgaagccctggaaaaggcccttcacgaaacccgccaggcactcgccgatgcccaggcccaggggcggctggtcagcttcgaggtctgcccgcgcctggttgccgaggtgatcggcgcctggaccggcgtaccggtggaacaactggcgcgggaacacaacgccaaggtgatggggttcgctga

SEQ ID NO: 6195 - DNA, 1053 bp, Pseudomonas aeruginosa
cgacctgcgggcgcggatccgtggccaggaacaggcggtcagcgccctggaccgcgcgatgcgcgccaccgcggccgggctgaacaagcccgatgcgccggtcggcgtgtttctgctggtgggcccgagcggggtgggcaagaccgagaccgcgctggcgctggccgacctgctgtatggcggcgagcgtttcatcaccaccatcaacatgtccgagttccaggagaagcacaccgtctcgcgcctgatcggcgcgccgcccggctatgtcggctatggcgagggtggcatgctcaccgaggcggtacgccagaagccctattcggtgatattgctggacgaggtggagaaggccgatccggacgtgctcaacctgttctaccagatcttcgacaagggcgtggccaacgatggcgaagggcgcgagatcgatttccgcaataccttgatcctgatgacctccaacctcgccagcgagcacatcgccgcgctttgccaggacggcgcgcggccttccgccgaactcctggaggaaaccatccggccggcgctcagccggcatttcaagccggcgctgctggcgcgcatgcgcgtggtgccttactacccggtgggcggcccggtactgcgcgagctgatcgagatcaagctgcaacgcctcggcgagcgcctggcgcgccgtcaactggctttcgactacagccaggcgctggtgggccacctggccgagcgttgcacccagagcgacagcggcgcacggttgatcgaccacctgctggacacgcacctgctgccgctggtggccgaccgtttgctggaagcgatggcgcgcgacgagcgtctcgagcgggtccatgcgacgctgggcgagcacggccgcgtgctctgcgagttcgcctgaggtgggtgcgatgttcagccgcgtaccgcaacccctggccttcgccgaagccctgctcgctcagttcggcgcgctgtcgcgggaaaccgacatcacggccctgctgggcggtttcgcacgcgcagtcggcgaactcagcggctgcgagctga

SEQ ID NO: 6196 - DNA, 249 bp, Pseudomonas aeruginosa
gccagttgtatctgctcgaccagacccataccgcgctcaccctcaacgccgaatgccgggacggcctgttgcaggcgctggagccgtcgagcctgccggcggactacaccggcgagcagttgctgcagttcgccctgtgccagaaccgcgtggtcagtctcgtcgacctgccgtcgcggctgcacgagaccggcttcctgccggcaggggagcagccctggctgtccctgctctgcgttccgctggtga

SEQ ID NO: 6197 - DNA, 621 bp, Pseudomonas aeruginosa
tcagcaaggtcctgcacaacccctataccgtgttgctgcagggcgagaccggcaccggcaaggaggtggtcgcacgggcgatccacgagtacggcccgcggcgtgcacaggcgttcgtggtgcagaactgcgcggcgtttccggaaaacctgctggaaagcgagctgttcggctaccgcaagggcgcctttaccggtgccgagcgcgatcgtcccgggttgttcgatgccgcggatggcggaaccctgctgctcgacgaaatcggcgacatgcccctctcgctccaggccaagctgttgcgcgtgttgcaggaaggcgagattcgcccgctcggcggcaacgacacgcacaaggtcgatgtacgcatcatcgccgctacccaccgtgacctcgccctgctggtacgcgatggcaagttccgcgaagacctctactaccggctggcgcagtttcccatcgagttgccgccgttgcgccagcgcgagggcgacgccctcgaactggcccggcatttcgccgagcgcgcctgcgtgttcctgcgccgcgcgccgctgggctggtccgcggaagcgctggaactgctcgacggctatggctttcccggcaacgttcgggagctga

SEQ ID NO: 6198 - DNA, 1338 bp, Pseudomonas aeruginosa
cgcgcgatgaacgtgcacaagatcgtctggcaggaaggcatgctgctgcgcccgcagcatctgcaacacaacgaccgctactacgacaaccagatgaaggcccggacccagttgctgggcagctacaactggggcttcctcgccctggagctggaccgccagttcctcaacatgggcaagctggtgatcagccaggcctccggcgtactgcccgacggcagcctgttcgaactcggcggcaacaccgagccgctcgccctcgacgtgccgcccaatacctcgaacgtgccgatctacctggccctgccgctggtcaccggtaaccacatcgaggcgcgccggccggagcaggccgaggtcctggcgcgctataccgcctacgatctggaggtggcggactccaacgccggcgaggattccatggtgcaggtcagctgcgcgcggccggattttcgcctgctgctcggcgagcagcaaaacgaccaggcctacgtcaaactgaaggtggcggtggtgctggataccacgccggacggggtgatcagcctcgaccccgacttcgtgccgagctacctccatgcccacgcatccgcctacctgctgtcctgcctgaaggaggtgattagcatgctcggccatcgcggcgacaccatcgccgagcgtatccggtccaatggcaaggtcggcggcgcggaggtcggcgatttcatgatgctgcaactgatcaatcgcaccgagttgctgctgcgccactacctgggattggagcaggtgcatccggagcagttgtaccgggtgctgctgaccatgctcggcgacctcgccaccttcggcagcgagagcaagcgtccgcgcctggacagccgttaccagcacagcgaccagggcgccagcttccgcaggctgatggaggcgattcgccaggtcctgtcgatggtgctcgagcagcatgccatcgaactgcctctccaggcccgccagtacggcatcctggtctcgcccctgcacgaccacaagctgctcggcagcgcctcgttcgtgctcgccgccagtgccaattgcgagtcggaggaactgcgccagcgcctgcccgcgcatctcaaggtgggtgcggtcgagcacattcgccagttggtcaacctgcacctgccggggatccgggtcaagccgctgccggtggcgccgcggcagatcccgttccactccaacaagacctatttcattctcgaacccaacgccgaggacatgacccagctggagcgctccggcggtttcgcgttccacgtatccggcgagttctccgagcttgaactgaaattctgggccatcaggaactga

SEQ ID NO: 6199 - DNA, 2256 bp, Pseudomonas aeruginosa
tcttccccgaggccaacctggcaggtctcgatcgccgcgaacgcacgcgcatccactggggccagcgcgccctgtacgtcggttcgctggcgctccttctgctattcggcctgctctgggctggcggtttttttggccaaccacgagcgcctggagcgggtccgcgagctggcgcagcaatggacccagcagcgccaggcgcttggcgagcgcgatgacgccatggcggcgctgaagacgctggatagcagctatgcggcgaccaccgtgtttccgcccaaaggggaagtctcgctgcacgagcgcgccgggctgtaccagggcaacgaggtcaacccgccgctggccgcggcctatcgccgcgagctggagacgcaactgctgccgcgcgtggcgcggatgctcgaagcgcagatccgcggcaacatgcagaatcgcgaacgcctgctcaacagcctgcgggcctacctgatgctgaatctgcgcgagcgccgcgagaacggatggctcaaggactgggtggctaccgactggtcgcagcgctatgccggcaacggcaccgtgcagaatggcctgaacacgcatttcgcccgtctgctcgagcaaccgttcagctatccgctgaacgagaccctggtggcccaggcacgccaggtgctgcgcagcgagtccctggccaacgtggtctaccgggtgctgcgcgaacaggcgcgaagcctgcccgagtatcgcttcggccagcacctggggccgcaggccggtctgttcgtcggcaccgactacgtgattccggggttctacacccagcagggctaccagcagtacttcgtggtccagggcgccagcctggtcaacgacatccttcgcgacaactgggtcctgggcgagggcagcgggattagcgacatggacctgcggcgcctgatggtcgaactcgagcagctgtatttccgcgactacgcgaacttctggagcgaggcggtcggacgcctgggcctgctgccgttcaacgatgccggcgagggcgccgaccaggtttccgggctgctcgccgccaactcgccgatcctccagttgttgctggaggtccgtgagaacacccgtttcccggtcctggcggagagcgccgaggcgctggcagaggccagcgacaaggccgcggaaaagggcggcaagctgggcaatgcggccgccgcggcggccggcaatgccatggacgcgttggcgaagaacctgccggataccgcgaagaaatccctgcaacgccgcttcgagcccctgcatcgcctgctcgacgataacaacggcccggcggccgacctcaccccgctgttgcaggcgctcaacgagttgcagttgcaactcgccggactggcgcgcgccagccagccggagcaggcggctttcgacatggcgaagagccgcatgggcggccagcgcgatgccctgagcaacctgcgcaacgcctccgcgcgactgccgcgaccgctcggcggatggttcagcgtgctggccgaagacgcctggcggctggtcctcggcgatgcctacctgtacctcaaccagcgctaccagagcgagctgtacggtttctacagcaaggcgatcaacaagcgctacccgttcaacgcgcacagcgccagcgatgtcgcggtcagcgatttccgcgagttcttcaaggcgcagggcgtcgccgaacgcttcttcgaaacctacatgcggcccttcgtcagcggcgacccgggcagttaccgcctgcgcagcgtggacggttacagcctgccgatgtccaaggtctatctcgaccagatgggcacggcccaggtgatccgccagagcttcttcgccgagaacccggccgagccacaggtgcgcttccgcctggagccctataccctcgatcctggcgtcagccgcgccgagttccgtttcgacggtcagtccatggagtaccgccacggcccgatcgtgccgatgtcgttcaagtggcccagcgacgccgacggcggccgcaccagcctggtgctggagaagatggccggacgaccggtaggaatcgaacgcaataccgggccctggtcgctgttcaggctgttcgacctgatgcagaccgagtacctcagcgggcgtgacgtgatggtgctcaaggccgacctgggcggcctgcgcgccaactacctgctgctcgcccagcgcacgccgaatccgttcgatctcgcggtcctgcgcagcttccgcatgccggtgcagctctga

SEQ ID NO: 6200 - DNA, 765 bp, Pseudomonas aeruginosa
cgagttcgccctgacccggcgcttgcgccatccgaacgtcgtgcgtctgttcaccttcgacgtcgacaccgcatgccagcgcgcctacatcgtcatggaactcatgcctggcctgccgctcgaccgcctgctctgcgagcgtcccgaaggcctgccctggtccgagctgagcgcgatcgcccggccgttgctggatgttctggcctacgtccacgaacaaggagtactgcatggcgacctgaagccgagcaacgtgatgctcggcgaagagggcgtgcggctcttcgacttcggcctcggccaggcgcaggcaggcatcctggatggcctgccgcagctcagccggggccgcatcgacgcctggactccgggctacgccgctcccgaactgctcgagggcgcgccattgtcgccggcggccgacctgtatgcgctggcctgcgtcctctacgaactggccgacggtcgccatccgttccgccgcctgccctcgaaccaggcccgggagcaggggctggagcgccagctgcgcgcgcccggacacctgcctcggcgctgctggccggcgctgcgtaccgccctgagcctcgaccccgaacggcgctgcatcggcgtccgcgaattgcaggaagcgctgggcgcgcggcgttcctggctggccggcgttcttgcccgttgagccggcggcgctcggtttgcaggacctctacggccgctctccgcaagcgctctgcagggcgatacgattgccttcgctgtccctga

SEQ ID NO: 6201 - DNA, 552 bp, Pseudomonas aeruginosa
ccggcgtcaatacccgtactgcgtcacaaaaataccctggccccaggccgttcggaaaggccgttcgctgttcgcttgggggaagtcatcatggcgcatctggtctggcaggatgacctgaataccggtattcaggtcatcgacaatcaacacaaacgcatcgtcgagatgatcaatcacctgcacgacgcccagcaaggcaaggaacacgcggcgatcgccgaggtgatcgaggagctggtggactacacgctgtcgcacttcgccttcgaggaaaccctgatggaggacgccggctaccagttttcccgggcgcacaagaagatccacgagctgttcatccgccgggtctccgaataccgggtgcgcttccaggccggcgaggatgtcggcgacgaactcaagggcttgctctcgcgctggctgttcaaccacatccgcaacgacgacgccggatatgtggatgcggtacgccacagcatgtccgaactggtcaaggacaagagcgagggcggttggttgtcgcgctcgatgaagcgcttcttcggctga

SEQ ID NO: 6202 - DNA, 918 bp, Pseudomonas aeruginosa
gtggattgggtgtttggcgacttccagtctctcaaacccaatccggatgaacaccggatacaacctattggagcttcacacctagccttcgtttccacgctgttgctcgccgctttctgcgccctgcccgcccaggccgacagcttcatcatgcgcctgctgaacaagccggtgcccggcggggtggcggtggtcgacctcggcgaggaaggcccgccgccgcgggccttctaccagggcaagccggtgctggtggtgcgcgaggaaggccgccgctggatcgccgtggtcggcatcccgctgagcaccaagcccggcccgcagaagctggaagtgcgagcggcgaccggcaaccacgaggagcgcttcagcgtcggcagcaagcactaccgcgagcagcgcatcaccctgaagaacaagcgccaggtcaatccgctgccggaagacctcaagcgcatcgagcgcgaactcgccgagcagaccgccgcctaccgccgcttcagtcccggcctgcccagcaacctgatgctcgacaagccggtcgacggtccgctctccagccccttcggcctgcgccgcttcttcaacggcgaagagcgcaacccgcattccggtctagacttcgcggtaccggccggtacgccgatcaaggcgccggcggccggcaaggtgatcctcatcggcgactacttcttcaacggcaagacggtgttcgtcgaccatggccagggcttcatcagcatgttctgccacctgtcgaagatcgacgtgaagctcggccagcaggtgccgcgcggcggcgtactcggcaaggtcggcgccaccggcagggccaccggaccgcacatgcactggaacgtcagcctgaacgacgcgcgagtcgacccggcgatcttcatcggtgccttccagccctga

SEQ ID NO: 6203 - DNA, 1272 bp, Pseudomonas aeruginosa
ccaagggagacaccgcatgactcacccgcttcgcctgctctggctgtgctcggcactgttcgtggtcctcggcctgggcttcgtcttcttccccggcccgctcgcctccctgctcaccagcggcgaaccgctcacccccgccgccctcaccgacctgcgcgccagctacggcggcaccagcttcggcatcggcctgctgctcggctatgccgccctgcgcccccgctacctggtgctcggcctgctcgccgccctggcggtgatcgccagcggcggcgcggcgcgtctctacggtgtgctgatcgacgcctcgccggcgctaaccaccttcctctggctcggcgccgaggcgctgctctgcgtgctgttgctggcggcactctggaagacccgccagctcgacctcgactgagcgccgggcagcaggtctcaagccaggacccggcgaaccgccggcagccgcgacagcaccagccagtccagcgcccagaccagcaggagcgaggcccccaccaacgggaaggccacgcccagcgccagcatgatggcgatgccgctcttccagcgcggcagctcgtggcgcagcggcggcacgccaaggcgtccggccggcttgcgcttccaccagatccacaggccgctcgccgagctgagcaggatcgccaggcagaccgcgagcatcagcaactggttgccgaggccgaagagcttgccttcgtgcagcacgacgcccatctgcacgctcctcgccaccgcgttgtagtcctgccaacgcacgtcggcgagaaccttgccgctgtactgttcgatgtgcagggtggcgtcgtggcgcggatcgtcggggaacacggaaatcgtgtagaccccctccatcccgctcggcagggcgatcccgtagcccgccgccacgccgcgctcgcgggcgatatccaccaccctttgcagagggatgcccgccggcatcggcatgtccatcggcatcgcgtgcccggcctgggcggaatgcccgcgatgctcggcatgggcgtcggccgccggcggctgcgagcgcggcagcggagtgttctccagcggccagggcacctgctggcgcgacgcgctgttgaggctaccggcctgcatgtcggaggtcggcacatcgttccacatcgccgccgggaagcggttccagacatcggcgaactgcttgccccagtagccggtccaggtcatcccgctgagcagcatgaacagcaacagcaggctgccccagaacccggcgaccacatgtaa

SEQ ID NO: 6204 - DNA, 777 bp, Pseudomonas aeruginosa
cagcgtgatcatcagcctgcacacccacaacgaccgtggcaccggcgtggccgccaccgagctgggcctgatggccggcgccgaccgcgtcgaaggttgcctgttcggcaacggcgagcgcaccggcaacgtcgacctggtgaccctggccttgaacatgtacacccagggcctgcatccgcaactggacttctccgacatcgacgcggtgcgcaaggtggtcgaagagtgcaaccagttgccggtccacccgcgccatccatatgtcggcgacctggtccataccgctttctccggctcgcaccaggatgccattcgcaagggcttcgcccagcagaaggaagacgcgatctgggaagtgccgtacctgccgatcgatccggccgacatcggccgcgactacgaagcggtgatccgggtcaacagccagtccggcaagggcggcatcaccttcctgctcgaacaggagtacggcatcagcctgccgcggcgcatgcagatcgagttcagccaggtagtgcaaggcgagaccgaccgtctcggcctggaaatgaccgcacaacagatctactcgctgctggaaaacgaatacctcaaggcgacctcgccctacgtcctcgccagccatcgcctgcaggaagagaacggcaccagcgccgtcgacctggaagtctccttcgacggcgagaagcagcactggcgcgggatcggcaagggaccgctggaagccttggtggccgccctgccggtcaaggcggaaatcatggactaccatga

SEQ ID NO: 6205 - DNA, 954 bp, Pseudomonas aeruginosa
cgcatgaccacacgcaaactcggcaactccggcctggagataccggcactggtattcggcggcaacgtcttcggctggactgccgacgaaagcacctccttcaggctgctggacgccctgctcgacgccggcctgaactgcatcgacaccgccgacgtatattcgcgctgggttcccgggcaccagggcggcgagtcggaaaccctcatcggcaagtggctgaaacgcaccggcaaacgcgaccgcatggtgatcgccagcaaggtcgggatggacatgggcaatggccacaaaggtctctccgccgcctatatcgagcaggccctggagcgctcgctacgacgcctgcagaccgactacctggacctctaccagtcgcacaccgacgatccccacaccgacctggaggaaaccctttccacctatggcgaactgatcaagaaaggcaaggtacgggtcatcggcgcctccaactacgacgcccggcgcctcctcgaagcacgccaggtcagcgcccggcttaacctgccgagctaccagagcctgcaacccgaatacaacctgtacgatcgcgccgactacgagaccaacctggagccgacggtggaagaactcggtatcggggtgatcagctactactcgctggccagcggcttcctcagcggcaagtaccgcaaccaggccgacaccgccgggcgagcccggggagagaaggtgaagggttatctcaacgagcgcggcgtggccatcctcgcggcgctcgacgaagtggccgagcagtacaacgccaacccgacgcaggtcgccctggcctggctcatcgctcgtccgacggtgaccgcgccgatcgccagcgccaccagcctggaacagctcgacgacctgatcgccgccacccacctgaagctcgacgaacaggcgatccaccgcctggacagcgccagcgcctattga

SEQ ID NO: 6206 - DNA, 312 bp, Pseudomonas aeruginosa
gccggcctccacgcccggcgccgcctgcccggcaccgcccgcggcgccaccgagcagatcgccgaggacgccacccagcccgccgctcgcggccccgccgccggcaccaccaaggatgctgcccagcgaaccgagcagaccaccgccatcgccaccgccctgtgccgcaccgcccctggcgcgacctcagcatggtcaccagcccgatcaacaggggccactttcggatcgcgagcacctccctgtccttcagagccacccagcgccgaaccgagaatcgaatcgagccagtcccattggtcttcctcctga

SEQ ID NO: 6207 - DNA, 1197 bp, Pseudomonas aeruginosa
cttttccgctgcctgacgcagcgtctcctcgcgtttggcgtaacagaaccggaccagccgcatggcgtccggagccttttcataaaacaccgaaaccgggatcgccgccactccgtgttcgcgggtcagccactcggccatggccacgtcgtccaggtccggacggatggccgaatagtccacgcactggaagtaggtgcccggcgcacgggtaaaacggaagcgagagtccagcagcaggtcgcagaacaggtcgcgcttggcctggtagaagccgggcaattgccgcaagtgctccggatggccggccatgtagtccgccaatgcccattgcagcggcgtgacgccacagaagttgacgtactggtgaaccttgcgcagctccgcgctgagcgccggcggcgcgaccacgtagccggtcttccagccggtgacgtggtaggtcttgccgaacgaactgaccacgaaggaacgcggatacaactcgtcgtgggacagcacgctggtatgggcgacaccgtcgaacaccaggtgctcgtagacctcgtcgctgatcagatagatatcccggtcgcggatcagcgcggccaggcggtccagttcctcgcggctgatcagcgcgccgctggggttgtgcggggtattgatgatgaccagccgggtacgcggcccgatggcctcggccatgcgctgccagtcgatggagaagtccggcagcaccagcggcacgtgcacgcaacgcccgccggcgagttgcacggagggttcgtagctgtcgtaggacgggtcgagtaccaccacttcgtcgcccggatggaccagcgcctggatcgcgctgaagatcgcctcggtcgcccccggcgtgatggtcacctcgctgtcggcgctcacccggcgtccatagaactgctcgatcttcttcgccacctgctcgcgcagggccggcaagccggtcatcggcgcgtactggttgtgcccggcggcgatatgcctgcctaccgcctcgcgcaactccggcgggccgtcgaaatcgggaaagccctgggagaggttgatcgcgccacactcggcggccagttgcgacatgcgggtgaagatggtggtgccgacattcggcagcttgctctgaatcatcgggacttcctgcagagactcgccggacgacagcccggccagacgggtggcagggcaggatag

SEQ ID NO: 6208 - DNA, 1215 bp, Pseudomonas aeruginosa
cgtcggacggcagcggccggacacttgaaacccagtctagcggatggtgtaggcgacgagcttgccaccgttgccgaacacgtacatccagctcccgaccaccagcggacgaacccgcacgccatcgctgtcgacccgctcgcgaccgacgaagcgaccgtccacctggctcagcagatgcacgtagccttccaggtcgccgaccaccacgttgctggagaacaccgccggagccgacagttggcgacgcgccagggcgtcgttgttccacagcgaagaggcaccgcgcgagtccaggccttccaccgaaccgctggcctggctgacgtagatattgccgaagccttcggcgacgccgacgtagctcgacgcttcgcgctgccagagcaggcggccgctgttcacgtccagcgccgcggcacggccctggtagctgaccacgtagagggtgtcgccggacagcaggaggccgccgtcgatgtccaccacgcgatccagttcggaacgcccctggggaatcggtacccgctgctcccagatcggcaggccgcgctgtacgtcgaccgccaccacattgccgctggccaggccggccagggccatgttgccggcgatcagcggcgcgccggtgccgcgcagggtcagcaccggcacggtgctttcgtagatccagcgatggtcgccgctggccgcatcgaggccgatcagcttgtcgtcctgggtctgcaccaccaccacgtcgccattggtggccggcgccgacagcacttcgctgttgactcgcttggtccacttcttcttgccggtggcttcgtcgagggcgatcacgtcaccgcgcagggtacccaccagcaccaggccgtagccaacgccgacaccgccggaaaccggacgttccaggtccttcttccagagcacgtcgccggtctcgcgctggatcgccatcacccgcccttcggcggacgcggcgtagatggtggaaccatcgacggccggttcgagcaggttgtacaggtcaccctggccatcaccgaccgagcggctccactgcttgctcaacacgacttcctctttgaagtcggtcagttcggcgggcgggagttccttcttgctgttgctgctgcaacccacgaccgccagggccagggcgagcagcgccgcgtgtttccattgcaccatctcaggcctctcccttggacaggtcgtcgagcttga

SEQ ID NO: 6209 - DNA, 543 bp, Pseudomonas aeruginosa
acgggtcagccgcgggcgatcaggctcgcatcggcctcggccttctcggccgccttctggcggatcagccgttccagctcgtccaccaggttgtcgttggtcagtttctgcgacggcttgccgtcgatatacaccaggttcggagtgccgccggtgaggccgacatgggcctccttggcttcgcccggaccgttgacgacgcaaccgatcacggccacgtccatcggcaccagcaggtcctccaggcgcccttccagctcgttcatggtcttcaccacgtcgaagttctgccgcgaacagctcgggcaggcgatgaagttgatgccacgggagcgcaggtgcagggacttgaggatgtcgaaaccgaccttgatctcctcgaccggatcggcagccagggaaatccggatggtgtcgccgattccctcggccaggagcatgcccagccccaccgccgacttcaccgtgccggagcgcaggccgccggcctcggtgatgcccaggtgcaggggctgctcgatctgcctggccagcaggcgatag

SEQ ID NO: 6210 - DNA, 258 bp, Pseudomonas aeruginosa
tcgttgacatccttgagcagggtgtattcgacggtcagcacgcgcttctcgccgagccgggaaatataccggcggcaggcatccagcagcatgcccagcggatacttcttgttgatcggcaccagcttgttgcgcaactcgtcgttcggtgcgtgcagcgacagggccagggacacgtcgatcacctcgccaagcttgtcgatcatcggcaccacgccggaggtggacagggtcaccttgcgcttggaaataccgtag

SEQ ID NO: 6211 - DNA, 456 bp, Pseudomonas aeruginosa
ccgaggtcgtccatcatgatgttcatggcgacgaccacgttgtcgaagttcagcagcggctcgcccatgcccatcatcacgacattggtgatggcgcggtcgatcttggccggaacggtaccgaacgacttgttggcgatccacacctggccgatcacctcggcggcggtgaggtcgctgttgaaaccctgcttgccggtggagcagaaactgcaatccagggcgcagcccgcctgggaggacacgcacagggtgccgcgtccgccctgggggatgtacacggtctcgacgcaactgccggacgccacccggaccacccacttgcgggtgccgtcggcggaaatatcctggctgacgatctcgggaccgcgtatctcggctgaggccttgagcttttcgcgcaaggccttgccgacgttggtcatggcgtcgaaatcgtcgacgccaaagtggtga

SEQ ID NO: 6212 - DNA, 2112 bp, Pseudomonas aeruginosa
ccgcgaatcgggctccagaccccaggccttgtccagcatgtcgtcttcgagttcgtcggacggctccatggagtcgaggccttcgcggacgattacgtggcaggtcgtgcaggcgcaggatttctcacaggcatgctcgatctcgatgccattgcgcaacgcggcatccagtatggtttcgccgggcttcgcctcgaataccgccccctcggggcagtggtcggcatggggcagaatcacgatctgcggcatcttcgcttattcctcgatttcgttgagccggcggccggagagcgcggccttgacggtcgcgtccatccgccgtgcggcgaaagcgtcggtcacctgggacaggcgcttgatctggttctcgatggccgcggtgtcgctaccaccggccagttcacgcaaggtgtccatctgcgccgcgatggccaggcgctcctcttcgtccaggagccgctcgccgtcgacgtccagcgccgactgcacggcctccagcagccgctgcgcctcgacctgctgttcgcgcagggcgcgggcagccttgtcgtcgccggcgtagtcgaaggagtccttgagcatccgcgcgatctcgccgtcggtcagcccataggacggcttgacctggatgctggcctcgacgccggaactcagttcgcgtgcggacacgccgagcaagccgtcggcgtcgacctggaaggtcacccggattttcgccgcgcccgccaccatcggcggaatgccgcgcagctcgaagcgcgccagcgaacgacaatccttcaccagctcgcgctcgccctgcagcacgtggatcatcatggccgtctggccgtccttgtaggtggtgaactcctgggcgcgcgccaccgggatggtggtattgcgcggaatcaccttctccatcagcccgcccatggtttccaggccgagcgacagcggaatgacgtccagcagcagcaattcctcgccgcgcttgttgccggccagggcatcggcctggatggccgcgccgatggcgaccacctggtccggatcgatatcggtcagcggctcgcagccgaacaactcgccaaccgccgtgcgcacacggggcacgcgggtcgagccgccgaccatcaccaccgagcggatttcttccagatcgacaccggagtcgcgcaccgctcggcggcaggacttcaggctgcgagcgacgaacggctcgatcaactcgtcgagcgtcgcccggctcagctcgccgctccagtcgccataggcgacccggaccgacgcctcgtcggtaagacgctccttggccgcacaggcgatttgcagcaactgccgctggctgcccgggtccagatcggcagagaggccagcctgctcgatcacccagccagcgatggcatggtcgaagtcgtcgccacccagggccgtatcgccgccggtggccaggacttcgaagacaccgcgggtcaggcgcaggatggaaatgtcgaaggttccgccacccaggtcatagatggccaccaggccttccgcgcccttgtccaggccgtaggccacggcggcggcggtcggctcgttgagcaggcgcaggacgttcagtccggccaggcgcgcggcatccttggtagcctggcgctgggcgtcgtcgaaataggccggcacagtgatcaccgcacccaccagctcgccaccgagggtggtttcggcgcgctggcgcagctcacgcaggatgtccgccgagacttccacaggactcttcaacccctgtacggtctcgatgaagggcatgtgcgactcaccctggcggaagcggtagggcaattgctcgcccagttgcttgacgtcctccaggccgcgccccatcaggcgcttgaccgaaatgacggtattgaagggatcctccgcggcggccgcgcgggcgctctcgcccacttccgcccgctcggcgtgataacgcaccgcggaaggcaggatcaggcgtccctgcgcatccggcaagggctcggcgacgccgctacgcaccgcggcgaccagcgaattggtggtacccaggtcgatcccaaccgccaggcgacgctcatggggcttgggactctgaccgggctcggcgatctgcagtag

SEQ ID NO: 6213 - DNA, 1599 bp, Pseudomonas aeruginosa
ccttttcgctatatgccatggctaatcctcacgtttttccggggcacgaggcgctcagtgcgcctgccattcgacctgggacaggtcgacgccctctttgtacatatcccacagcggcgacagttcgcgcagcttggaaacggcctcgaccaccttcttcgcggcatagtcgatctcttcctcggtggtgaagcgaccgaaggtgaagcggatggagctatgcgccagttcgtcgttgcggcccagggcgcgcaatacgtaggacggttccagggacgccgaggtacaggccgaaccggaggagaccgcgaggtccttgagcgccatgatcagcgactcgccctcgacgtagttgaagctgacgttgaggttgtgcgggacgcgggaggtcatgctgccgttgatgtagagctcttccaggccgtcgatctgcgcgaagaagcggtcgcggagcgccagcacgcgggcgttctcctgggccatttcttccttggcgatgcggaacgcctcgcccatgccgacgatctggtgggtggccagggtgccggaacgcatgccgcgctcatggccgccaccgtgcatctgaccctcgatgcggacgcgcggcttgcgccggacgtagagcgcgccaatgcctttcgggccgtaggtcttgtgcgcggagaaggacatcaggtcgaccttgagcttgtccaggtcgatctcgaccttgccggtcgactgtgcggcgtcgacgtggaacagcacgccgcgggagcgggtcagctcgccgatggcggcgatgtcgttgacggtgccgatctcgttgttcacgtgcatgaccgagaccaggatggtgtcgtcacgcagcgccgcctcgaccagagccggagtgatcaggccatcttcgcccggctccaggtaggtcacttcgaaaccttcgcgctccagctggcggcaggtgtcgaggaccgccttgtgctcgatcttcgaggtgatgatgtgcttgcccttgcccgagtagaagtgcgcgacgcccttgatcgccaggttgtcggactcggtggcgccggaggtccagacgatctcgcggggatcggcgttgaccagttcggccacctggcgacgggcgttctccacggcttcttcggctttccagccgaacacgtgggaacgcgaagccgggttgccgaagttgccgtccatcagcaggcattcgctcattttctgggcgacgcggggatcgacgggagtggtcgcggagtaatcgaggtagatcggcaatttcatcaggtaactcctacaggctggcgccctgctcagtcgatggcggacgcttcaatcttgtcgagacgaggcgtcttgcctgagcaacggcgttcgtcctggcgcagcgcgacctcctggacctcctggcggctgaccagatcggccaggctgatgccgctgaggaactcatggatctgcaaactgaggtcgcaccacaggtggtgggtcagacaggtatcgccggagtggcaatcgccctgcccctggcagcgggtcgcgtcgacggattcgttgaccgcgtcgatcacctgcgccacatggatgcccgacatatggcgggacagctggtag

SEQ ID NO: 6214 - DNA, 267 bp, Pseudomonas aeruginosa
gcatcgaagccgagcttctccgccatcgcttggcgcttggcctgctgctcggagtcctcgcgcatgatgatccgcccgggaatgccgaccacggtggcacccggcgggacttccttggtcaccacggcgttggagccgaccttggcgccctcgccgacggtgaacgggccgagcaccttggcaccggcaccgaccactacgttgttgccgagggtggggtggcgcttgcccttgttccaggtggtgccgcccagggtaacgccctga

SEQ ID NO: 6215 - DNA, 429 bp, Pseudomonas aeruginosa
gcacctggaccgcggccgccaggttcagcgagccgaactcgggatcggaggggatatgcacatggaactggcagcgctgcaattcttcgttggtcaaacccgcatattcgcgcccgaataccagggccacctcgccattcgcctccaggtgctccaggcaggtcgtcgcgcactcgcgcggatccagcagcggccagggaatccgccggtcgcgggcgctggtgccgagcaccacgctgcagccgctcagggcctcttccagggtgtccaccacccttgcggcgtcgaggatgtcggtggcgccggaagcccgcgccaccgcgtcgccgtggggaaagctttccggctgcaccagcaccagttgcgacaggcccatgttcttcatggcacgggccgccccgccgatgttgccgggatgactggtgttga

SEQ ID NO: 6216 - DNA, 330 bp, Pseudomonas aeruginosa
ggatcagccggccattcttgtcgaccgggatctggctgcccggatcgcgctccatgcggatctgcccggccttgccgtcgagcatgtacttcacgtcatagccgacgaccttctcgctgctgtcgtgcacggtgctgcagcgggtttcggtggtggtgtaggtgtcacgctcctgcatgccttcctgcaccttgttgccggcgtagccgccgccgacggcgccggccacggtggcgatcttcttgccggtaccgccgccgatctggttgcccagcaagccgccgaccaccgcaccgatggcggtaccggcgatctggtgctggtccttga

SEQ ID NO: 6217 - DNA, 429 bp, Pseudomonas aeruginosa
atccacagcttcttgaagtcacgcccgccgaagatcaggttgaccattgcgcgggtgaccatgatggccgtgaacatcgaggtgatgatgccgagcgacatggtcacggcaaatcctttcaccgggccggtgcccatggcgtataggatgccgccgaccagcagcgaggtcaggttggcgtcgaggatcgcggtgaaggcacggttgaagccttcgtggatcgccttttggacggacatgccattggccagttcctcgcgtatccgcgagaagatcagcacgttggcgtccaccgccatgcccatggtcagcacgataccggcgatgcccggcagggtcagggtcgcgccgaggatcgacatcagcgccaccagcatgaccatgttgaaggccagcgcaacggtggcgatcacgccgaagaaacggtag

SEQ ID NO: 6218 - DNA, 1536 bp, Pseudomonas aeruginosa
ggcatcgacaaaggcggccaatgtaccctgttggattgcctcgcgcaaaccagccataacccgctgataatgccgcaagttgtggatggtattgagcatgctaccgagcatttccccgcacttgtccaagtggtgcagataggcgcgggaaaaatgtttgcaggtgtaacagtcgcaggtcgggtcgagcgtggagtcgtcgtgcttgtgtaccgagttgcggatcttgatcaccccgctgtcgacgaacaggtggccgttgcgcgcattgcgcgtcggcatcacgcagtcgaacatgtccacgccgcggcgcacgccttccaccaggtcttccggcttgcccacgcccatcaggtagcgcggcttgtcggccggcatctgcggcggcaggaaatcgagcacgcggatcatctcttccttcggctcgcccaccgacaaaccaccgatggccaggccgtcgaagccgatctcctgcaagccatccagcgagcgcaggcgcaggtcctcgtgcataccgccctggacgatgccgaacagcgccgacgggctatcgccatgggcgatcttcgagcgcttggcccagcgcagcgacagctccatggagcgcttggcgacgtcatggtcggccgggtacggcgtgcattcgtcgaagatcatcacgatgtccgagcccagggcgcgttgcaccgccatggactcctccggccccatgaagaccttggcgccgtccaccggcgaggcgaaggtcacgccctcctccttgatcttgcgcatggctcccaggctgaacacctggaaaccgccggaatcggtgaggatcgggcctttccactgcatgaagtcgtgcaggtcgccgtggcgctggatcacctcggtgcccgggcgcaaccagagatggaaggtgttgccgaggatgatctgcgcgccgatgtcctcgatgtcgcgcggcaacatgcccttcaccgtgccgtaggtgcccaccggcatgaaggccggggtctcgaccacgccgcgggggaaggtcaggcggccgcgacgggccttgccgtcggtcgccagcagctcgaagttcatgaagctcatggatcagtcctcgggtccgcggggcgcgggattgcgggtgatgaacatggcatcaccgtaactgaagaagcgatagccctgcgccaccgccgcggcgtaggcggccatggtctccgggtagccggcgaaggccgagaccagcatcagcagggtggattcgggcaggtggaagttggtgaccagggcatcgaccacatggaacggccggcccgggtagatgaagatgtcggtgtcgccgctgaagggcttcagctcaccgtcgcgtgccgcgctttgccagcgagcgcacgctggtggtgccgacggcgactacccggccgccgcgggcccggcagacggaaaccgcgtccaccacgtcctggccgacctccagccattcgcggtgcatcacatggtcctcgatacgctcgacacgcaccggctggaaggtaccggcgccgacatgcagggtaa

SEQ ID NO: 6219 - DNA, 1512 bp, Pseudomonas aeruginosa
cggatgccgccccttgcgccatcccgactgtctgtattggggacctcttccatggaattccttgttaaaagcgtacgcccggaaaccctgaaaaccgccaccctggtgctcgccgtaggcgaaggccgcaagctcggcgccagcgccaaggcggtcgacgacgccaccggcggcgccatcagcgcagtgctcaagcgtggcgacctggccggcaaggtcggccagaccatgctcctgcagagcctgcccaatctcaaggccgagcgcgtgctgctggtcggcgccggcaaggagcgcgaactgggcgaccgccagtaccgcaagctggcctccgccgtgctgtcgaccctcaagggcctggccggcgccgatgccgcgctggccctcggcgatctcgcggtgaaaggccgcgatgcccacgcgaaggcgcgtctgctggtggaaaccctggccgatggcctgtacgtgttcgatcgctacaagagccagaaagccgagccgctgaaactgaagaagctgaccctgctcgccgacaaggccgacagcgccgccgtcgagcaaggcagcaaggaagctcaggccatcgccaatggcatggccctgacccgcgatctcggcaacctgccgccgaacgtctgccatccgacgttcctcggcgagcaggccaagggcctggccaaggagttcaagggcctgaaggtcgaggtcctcgacgagaagaaactgcgcgagctgggcatgggctcgttcctcgccgtcgcccagggcagcgaccagccgccgcggctgatcgtcctgcaatacaacggcgcgaagaaggaccaggccccgcacgtgctggtcggcaagggcatcaccttcgacaccggcggcatcagcctcaagccgggcctgggcatggacgagatgaagttcgacatgtgcggcgccgccagcgtcttcggcaccttccgcgcggtgctcgaactgcagttgccgatcaacctggtcggcctgctggcctgcgccgagaacatgcccagcggcggagccacccgtccgggcgacatcgtcaccaccatgagcgggcagaccgtcgagatcctcaacaccgacgccgaagggcgcctggtgctgtgcgacgcactgacctacgccgagcgcttcaagccgcagtcggtgatcgacatcgccaccctcaccggcgcctgcatcgtcgccctgggcagcaacacctcgggccttatgggcaacaacgaagcgctggtcaggcaattgctcaaggccgggggagttcgccgacgaccgcgcctggcaattgcccgctgttcgacgaataccaggaacagctggacagcccgttcgccgacatcgccaacatcggcgggccgaaggccggcaccatcaccgccggctgcttcctctcgcgcttcgccaagaaataccactgggcgcacctggacatcgccggcaccgcctggatcagcggcggcaaggacaaaggcgccaccggccgcccggttccgttgttga

SEQ ID NO: 6220 - DNA, 441 bp, Pseudomonas aeruginosa
attccgcttctaccgggagcagggctatcctctacaggaccatcgcctgccgcgtatctgaagtgcacgaccatggacagccacaaaccgacacaacccccggagcagttgctcgatgacctggagtcgatccacgacctgctctacgaacggaacgagccgcccttgctgaccgaatccttcgagccggacaacattcccctgctctccgacgtcgtctcccccggtaccgccccgcgcgcgccagagccgcagaccgcggcagccaccacggcagggctggcgcccgccgaacaggagcgcctggacgacgagttgcgagcgtccgccgaactgatcctgcaggaagtcatcgacgacttcgccccgcagatcgaagccgaactgcgccgccgcctgcaagcccgcctgggtcgcctgctcggccaacgcaacggctga

SEQ ID NO: 6221 - DNA, 2973 bp, Pseudomonas aeruginosa
tccggacgcggcgggcgcccgccgcggcccgcggccttacccccgggctgccatccccgctatactcccggactttcttcgcattttccccagccatattcagctttggtcccctttcgcatggacaagacttaccagccgcacgccatcgagacttcctggtacgagacctgggagtccaacgactacttcgctccgagcggcgaaggccagccctacaccatcatgatcccgccgccgaacgtgaccggcagcctgcacatgggccatggcttcaacaacgcgatcatggacgcgctgatccgctaccgccgcatgcagggccgcaacaccctgtggcagccgggcaccgatcacgccggcatcgccacccagatggtggtcgagcgccagctcggcgcccagggcgtgagccgccacgacctcggccgggagaagttcctggagaaagtctgggaatggaaggaacagtccggcggcaacatcacccggcagattcgtcgcctgggctcctcggtggactggtcgcgcgagcgcttcaccatggacgacggcctctccgaagcggtcaaggaagccttcgtgcgcctgcatgaacacggcctgatctaccgcggcaaacgcctggtgaactgggacaccaagctgcacaccgcgatttccgacctggaagtggaaaaccacgacgagaaggaccacctctggcacctgcgctacccgctggtgaacggcgcgaagaccagcgaaggcctggattacctggtggtcgccaccacccgtccggaaaccctgctgggcgacgccgcggtcgcggtgcacccggaagacgagcgctacgccaagctgatcggccagttcgccgaactgccgatcgtcggccggcacatcccgatcatcgccgacgagtacgtcgaccgcgaattcggcaccggctgcgtgaagatcaccccggcccacgacttcaacgactacgaagtgggcaagcgccacgacctgccgctgatcaacattttcgacaagaacgccgcggtgctggcccaggcccaggtgttccaccttgacggcagtgtcaacccgaaccttgaccccagcctgccgcagagctacgccggcatggaccgcttcgccgcgcgcaaggccattgtcgccgagttcgaggccatgggcttgctcgagaaggtcgacgaccacgcgctgaaagtaccgaagggcgaccgctccggcaccgtcatcgagccctggctgaccgaccagtggtacgtcagcaccaagccgctggccgaagacgccatcgccgccgtggaagacggccgtatccagttcgtgcccaagcagtacgagaacatgtacttctcctggatgcgcgacatccaggactggtgcatcagccgccagctctggtggggccaccgcatcccggcctggtacgacgaggccggcaacgtctacgtcggccgcgacgaggtcgaggtgcgcaccaagcacaagctcggcaacgaggtcgagttgcgccaggacgaagacgttctcgacacctggttcagctccggcctgtggaccttctccaccctcggctggccgcagcagaccgagttcctcaagaccttccaccccaccgacgtactggtcaccggcttcgacatcatcttcttctgggtcgcgcggatgatcatgctcaccatgcacctggtgaagaaccccgacggcaccccgcagatcccgttcaagaccgtctatgtccacggcctggtgcgcgacggtcagggccagaagatgtccaagtccaagggcaacgtactcgacccgctggacatcgtcgacggcatcgacctcgataccctgctgcaaaagcgcaccagcggcatgatgcagccgaagctggcggagaagatcgccaagcagacccgcgccgaattccccgaaggcatcgccagctacggcaccgacgccctgcgcttcaccttctgctcgctggcctccaccggccgcgacatcaagttcgacatgggccgcgtcgaaggcttccgcaacttctgcaacaagatctggaacgccgccaacttcgtcatcgagaacaccgatggccaggacaccggggtcaacggcgagccagtcgagctgtcctcggtcgaccgctggatcatctcccagttgcagcgcaccgagcaggaagtcacccgccagctcgacgccttccgcttcgacctggccgcccaggccctctatgagttcatctgggacgagtactgcgcctggtacctggagctggtcaagccggtgctgtgggacgagaacgcccccatcgagcgccagcgcggcactcgtcgcaccctgatccgcgtgctggagacggccctgcgcctggcgcacccgttcatgccgttcatcaccgaggaaatctggcagcgcatcaagggccaggccggcaaggaaggtccgaccctgatgctgcaaccctggccggtggccgacgaaggcaggatcgacgccgccgccgaaggcgacatcgagtgggtcaaggcgctgatgctaggcgtgcggcagatccgcggcgagatgaacatctccatggccaagcgcatcgacatcatcctcaggaacgcctcgcccagcgaccaccgccgcctggccgacaacgagccgctgctgatgaaactggccaagctggaaagcatccgcgtgctggaagccggcgaggaagcgccgatgtccgccaccgccctggtcggcgacatggaagtattggtgccgatggccggcctgatcgacaagagcgccgaactggggcgcctggacaaggagatccagcgcctggaaggcgaggtcaagcgcgtcggcggcaagctgtccaacgaaggcttcgtcgccaaggccccggccgacgtgatcgagaaggaacgcgccaagctagccgaggccgaacaggccctggccaagctggccgagcaacggcagaagatcgccgcgctctaa

SEQ ID NO: 6222 - DNA, 1818 bp, Pseudomonas aeruginosa
ccctgtccgacgaactgctcaagtcggccgcggaagtcatcaagtaaaaaaagcggccgccggccgcgggcgtcccgcccgtggccggacggcacgataatcctgccttcacgcactcggttacgaagtcatgtctctgttttccctgttcggtgccctggagatcggcctgatcttcagcctcgtggcactcggcgtattcatctccttccgcctgctgcgcttccccgacctcacggtggacggcagcttcccgctcggcggcgcggtctgcgcgaccctcatcgccctcggctgggacccgtacagcgcgaccctggcggccaccgcagccggcgcactggccgggctggccaccggcctgctcaacgtcaagctgaagatcatggacctgctcgccagcatcctgatgatgatcgcactctactcgatcaacctgcgcatcatgggcaagcccaacgtaccgctgatcgccgagccgacattgttcaccctgctgcagccggaatggctcagcgactacgtgttccggccgctgctgctggtgttcatcgtgatcgccgcgaagctgctgctggactggttcttcaccacccagaaaggcctggcgatccgcgccaccggctccaacccgcggatggcccgtgcccagggggtcaacaccggcggcatgatcctgctcggcatggccatctccaacgcgctggtggcgttggccggcgcgctgttcgcgcagacccagggcggcgccgatatctccatgggtatcggcaccatcgtcatcggcctggccgcggtgatcgtcggcgagagcatcctgccctcgcgccggctgatcctggcgaccctcgcggtgatcctcggtgccatcgtctaccgcttcttcatcgccctggcgctgaacagcgatttcatcggcttgcaggcccaggacctgaacctggtcaccgcggtgctggtcaccgtcgccctggtgattccgatgatgaagaaacgcctgctcggcaagaagggagcctgaccatgctcagcgcgaagaacctgaagatcaccttcaaccccggcacccccatcgagacccgcgccctgcgcggcctgtcgctggacatcccggccggccagttcgtcaccgtgatcggctccaacggcgccggcaagtcgaccttcctcaacgcagtctccggcgacctgccgatcgacagcggacagatcctgatcgacgacgaagacgtcacccgcaagccggtctgggcccgcgccaaccgcgtcgcgcgggtgttccaggaccccatggcgggtacctgcgaggacctcaccatcgaggagaacatggccctggcgcaacgtcgcggtgccgggcgcggcctcggcagggcggtgcaggcatcgatgcgcgacggtttccgggaaagcctggcgaccctcggcctcggcctggagaaccgcctcggcgaccgcatcggcctgctctccggcggccagcgccaggccgtcagcctgctgatggcggcgctgcagccgtcgcgtatcctgttgctcgacgaacacaccgcggcgctcgacccgcgcaccgccgacttcgtcctgcatctcaccgcacggatcgtcgccgagaagaaactcaccaccatgatggtcacccacagcatgcgccaggcgctggacgtgggcgagcgcacggtgatgctgcaccagggccaggtggtgctggacgtctccggcgagcaacgcaagggcctcgacgtaccggacctgctggcgatgttcgagaaggtgcgcggcgagaagctcgccgacgacgccctcctcctcggctga

SEQ ID NO: 6223 - DNA, 2007 bp, Pseudomonas aeruginosa
cagggccgcggcgcctctccgcggcgaagcggggaggcgccgtcgacctgcagcagatcaaggcgcgatccgcgtccgtctgccacactcgcaggcatcctcccgctcagatgcccgcatgaacctcgaactgctctgggtggtcggcctgctcgccaccaccgtcgccctcttcatccacaaccgcctgcgcctggacgtgatcgccctgctggtgatcatggccttcagcgtcagcggaacccttaccctcaacgaagccctggccggcttcagcgatcccagcgtgatactgatcgccgcgctgttcgtgatcggcgaaggcctggtgcgtaccggggtggcctaccaggtcggcgactggctgatcgcccgcgccggcagcagcgaagcgcgcctgctggtactgctgatgctggcggtggccgggttgggctcggtgatgagttccaccggggtggtggcgatcttcatcccggtggtcctgagcatcgccgccaagctgaagatccctccgggccggctgatgatgccgctggccttcgccggactgatcagcggcatgatgaccctggtcgccacgccaccgaacatggtggtcaacagcgagctggcgcgcgagggtcatgccggcttcggcttcttcgccttcaccccgataggcctcatggtgctcgccatcggcgtggcctacatgctgctcacgcgcaactggctgaacgccgccagcccggcggaagtcggcgcgccgaaggcacggcggaccctgcgcgacctgatccgcgactatcgcctggccggccgcgaacggcgcctgcaggtccagctcggctcgccgttgatcggcagcaccctggaagaactgcaactgcgcacccgcctgggcgccaacgtggtcggcctggagcgggtacgcaagttccacagcgaggtggtcaaggtcggcggcagcaccgagctgaaggcgggcgacgtgttgctgctggacgtcttcgcccctccggaggacatggaccggcgctgcgccgagctgaacctggtgcgcctgccgttccgcgccagctacttcatcgaccagtcgcgggaggtcggcatggccgaggtgactctgccgccggactccaccctgctcggcaagagcgtcctggaactgggcttccgttcgcagtacgggctcaacgtggtcggcctgcgtcgcgaccacgaagcgctcaccgacggcatgctggaagagaagctgcgcctgggcgataccctgctggtgatcggcgcctggaaggcgatccgccagttgcagggacgcaaccgcgatttcctggtgctcagcctgccggcggagatcgacgaggtggcgccggccctgagcaaggcgccgcacgccctgctcagcctggccgtgatggtggcgctgatggtcagcggggtggtgcccaacgtggtcgcggcactggtcggctgcctgttgatgggcctgttccgttgcatcgacatggacggcgcctaccgcgccatccattggcaaagcctggtcctgatcgtcggcatgctgcccttcgccctggccctgcagaagaccggcggtatcgacctggtggtctcgctgctggtcgacgccctcggcgacgccggcccgcgcgtgctgctggccagcctgttcctgctcaccgcggccatcggcctgttcatctccaacaccgctaccgcggtgctgatggcgccgatcgccatcgccaccgccaagcagatcggcgcctcgccctaccccttcgccatggtggtggcggtggcggcctcggcagccttcatgacgccgatttcctcgccggtgaacaccctggtgctgggccctggccaataccgcttcggcgacttcgtccggatcggcgtgccatttaccctgctggtgatgttcgtctgcgtgctggtgattccgtggctgtttccattgtgaccgggccaggagcgcgccgctcggcagaaacactggccagcctccggcggatgtga

SEQ ID NO: 6224 - DNA, 360 bp, Pseudomonas aeruginosa
agcgccaggccaccgcgacggtcaccccgaccagctcgatgccaccgtcgcgtgccagcggctcctggcgcagcgctgcctccagccagtcgtaggccgccagcaactgcccctccacccgctccagccaggggccgtggcggcgttcctcgggacgcaggttcagttcgtagtagatctgcacggatttctcgcaggccaccagcgccgcgccgatcagactcaacgcccgtgcacgggcctgcggccgttgcggcagcagactgcgttcgcggccggccaggcactccaggtaatcgaggatcaggctggagtccatcagcacggtgccatcgtccagcaccagcgtgggcgccttga

SEQ ID NO: 6225 - DNA, 291 bp, Pseudomonas aeruginosa
aaaaacttacatgagcgacctccctcccctcaccgccctgcgcagcttcgaagcggtcgcccggctcggcagcatcagccaggccgccagcgagctgcacgtcacccactcagcgatcagccagcagatcaagctgctggaaaacctcctcggcctggccctgttcgtccgcgaggggcgcggcctgcgcctgagcgagaacggccggttctacgccctgcaggtacgcgcctcgctgggcgagatcgccgacgccacgcgggtggtgcgggcgcgtccacgggagggtga

SEQ ID NO: 6226 - DNA, 873 bp, Pseudomonas aeruginosa
ctcgaacctgctgctggaagccgtgcgcctgggccagggcatcgccctggagcgtcgcagcctggtcgccggcgccctcgccgagggccgcctggtgcaactgggcgacatccgcgtgccctacccctatccctactggctggtctggccgcagcgcgagccgccgagcgaccgccaccaggccttcgccgactggctgcgcgaggaggcccggcgctaccaggccgagcaaccgccgctcagcgaatgaagttgcggctgatctcgcggaagcggtcgctgccggcgcgttccatccattcgaaggcgaccatctcccgcgacacgatcatcgccccggcctggcgcatccgctccacggccagcgccttgtcgctcggccgccgcgagccgatcgcctcctccacgacgaacacttcgcgaccacggccaagcaggtcgagcacggtctgcagcacgcagacgtgcgcctcgctgccgcaaaccacgaactgccggcggtcgccgccgggcgcgcgcagcagggcgccgtcggcggcggccgagaagtccagcttctcgaggatctgcgtgggctccagctcatcgcgcagggccgccaccgtcggccccaggcccttgctgtactgctcgctggccagcaccggcacgtccagtgcgcgggccacgcgcaacaaccactggctgtactcgaccagcgccggaccgtcgtcgatggccggcagcaggcgttcctggatatcgaccaccagcagggtcgaggttgcggcgcggatcagcatggcgtcctccttcggttcgacgtctcggttcgtctggcttaggcttgcacggcacgggcgccatggacagcgcgtcctcccacaaccctag

SEQ ID NO: 6227 - DNA, 483 bp, Pseudomonas aeruginosa
caggagcctgcgatgaatatcagcctgcatttcgaatcgcgcctgcaggccagccccgaacagctctggcggtggatcacctcggtggacgggatactccgcgagatacgcccgttgctgagcatgagcgtaccgcccggtatccgcagcctcgaagacctggaggtggtgccccggcgcccgctgttccgcagccacatgcgcctgttcggcttgctgccgctgggcacttcgcaactgaccctgctggagttgacgcccggccgcggcttcatcgaacagtcgccgatgaccggcatgcgcctctggcgccacgagcgacgcatcctgccgacaccgggcgaggccggggaatgcctgctggtcgaccagttgaccgtgcgcccgctattcgccgccggactggtacgctggttcctcacccgcatcttccggcatcgccaccgggtgctctgccggcagttccgcacggaccgccggtga

SEQ ID NO: 6228 - DNA, 1506 bp, Pseudomonas aeruginosa
ccctcggctacgctgaggagtgcgcccgcccgcatccgtcatacccttctggagagcagcacaaggaccgctcatgaatcgcatcaagcacctgctcaaggacctcgccatcctgatccgcgccaacctctggctgatcccggtgatcgccgccctggtcgccgcggtgttctatttcgtcgccccgccgccgccgatgagcgcgaccatggccaccggcgccgagggcggcggctacgccgtgttcgccggcaagctccgggaaaagctcaaggagcagggcttcgaactgaagctggtgcccagcgccggctcgcgcgacaacctggagcgcctgctcggcaccggcgaggtcgacatcgccctggtccagagcggccaggagcgccagctcgaagccgggcaggcgcgccagttgcagaccctcggcgcggtctaccaggaaccgctctggctgttccaccgcagcaacgtgcacatcgaccagctcagcgacctgctgcacctgcgcctggccatcggcagcgacggcagcggcacccgcgccgccaccgaggcgatcctgcaggccaacgacatcgccccgggacactatccgatcacctgggaagcccgcggcggcaacgcggtggtcgacgacctgctggccggcaagctggacgcggcgttcatcgtcggcccggcggagaacccggcgatccagaaattggccgacaacgaccagcttcgcctggtcaacttccgccgcagcgccgcctacgaggcgcgcctgccgttcctcaagcgggtcgaggtcggcgaaggcctgctcaacctgccgcgcaacgtgccggaacgaaacatcagcaccctgtcgccggtggccaccctggtgatcaacgaacgcttccacccggcgctgatcccgctggtgctggaagccgcgcgcgaggtgatgaaggacggcagcctgctcgacaagcccggcgccttccccagcgccgagccgcgcaccctgcgcctgcacgaggacgccgagcgctactacaagagcggcctgccgctgctgcagcgctacctgccgttccgcatcgcctccctggcggaccgctacatcatcctgctgatcccgttcatcgccatcctcatcccgctgatgaagtccatcggcccgctgtatcgctggcgcatccgcgcgcgcatctaccgctggtaccgctacatccgcgacatcgaccgcaagctcgacagcggtaccgacgccgagcaactgagaagcgagatcgagcggctggagaaactggagagcgagctgaacaccgtggaggtgccgctctcctactaccacgagctgtacgagctgcacctgcacctgaacttcgtgatcaagcgcctgcacggtctgcaggaacgccaggcgacgcaggcagaagccggcaacctcgggtaaactggccgatccgcgggcgcgccagcggcgtgtcccgcagcgtcgcggaaacctgcgcggcgccgccgattacctga

SEQ ID NO: 6229 - DNA, 1020 bp, Pseudomonas aeruginosa
aaggtcgaacctgacatgccgatccatcacgccatcgtccacctgatcgagaagaagcccgacggcaccccggccgtgctccacgcgcgcgacgccgagctgggcgactcccaggccatcgagaacctgctggccgacctcaacgaaagctacaacgccaagaacaaggcctggggcttcttccagggcgagtccggggcctacccgttcagcggctggctcggtgagtacctggagggcgatcgcgacttcgtcggcttcagccgcgaagcggtcgagcacctgcagaagctgatggaggagtccaatctctccaccggcggccacatcctgttcgcccactaccagcaaggcatgaccgactacctggcgatcgccctgctgcaccacagcgaaggcgtggcggtgaacgagtcgctggaggtcaccccgtcgcgccacctggacctcggccagttgcacctggccgcgcggatcaatatctccgaatggcgcaacaacaagcagtcgaagcagtacatctcgttcatcaagggcaagggcgggaagaaggtctccgactatttccgcgacttcatcggctgccaggaaggggtggattcgccgagcgagacgcgcaccctgctgaaagccttcagcgatttcgtggaaagcgaggacatggccgaggaacaggcccgcgagaagaccgagacgctggtcgactacgccacctcccaggcgcgcatcggcgagccgatgaccctcgacgcgctttcggaactgatggacgaccagcaaccgcgggcgttctacgactacatccgtaacaaggactacggcctgtcgccggaaatcccggcggacaagcgcaccctcaaccagttccgccgcttcaccggccgcgccgaaggcctgtcgatcagcttcgaggcgcacctgctgggctccaaggtggaatacgacgaagagcgcgacatgctgatcatccgccagttgccgacccagttgaaggaccagctcaagcggcgcaaggactga

SEQ ID NO: 6230 - DNA, 696 bp, Pseudomonas aeruginosa
tgctgtatttccgctggttcgacgaggacagctggcgcgtgctcaagccggtgttcttcggctcgctgccattcggcgtgcgcgacgcggtggcctgggccatgcgccgcaaggtccgcgctaccctcagggcgcaggggctcggggtccacggcagggacgaactgctggccttcgcccgcgacgacctcgatgccctcgacggcctgcttggccaggtcccgtactacggcggcgaacatccgtgcagcgccgatgccgccgcttacggtatcctcgccaacctcatcgaggcgaccctggataccccactcagccatgtggcgcgaggctatccgcgcctggtggcgtattgcgagcggatgcgggagcgggtctggagtgagtgaggcgacggccgctacggcggcgatcgggaagtgttggtcggtctacctggtgagggcggaaaacggcgcgttgtactgcggcatcagcgacgatccgctgcgccgcttcgacactcattgcagcggcaagggcgcgcggttcttccattccagccccgcccgcgcgctggtttacgtcgaggcctgcgccagcaagggcgacgccctgcgccgcgagcgggcgatcaaggccctgagcaagcgcgccaaggagcgcctgttggtcggcgtaccggtgttgcgcgaggtcggcgagccggcaatctag

SEQ ID NO: 6231 - DNA, 1722 bp, Pseudomonas aeruginosa
gctggtgcctcacatccgcccggaggcgcccatgtcagagctgatcctgcatcactatcccacttcgccctttgccgagaaggcgcgcctgctgctcggtttcaagcaactgtcctggcgttcggtgatgattccgccggtgatgcccaagccggacctggtggcgctgaccggcggctatcggaagaccccggtgttgcaggtcggcgccgatgtgtattgcgataccgcgttgatcgcccgtcgcctggagcaggaaaaggcggttccggcgctgtttcccgaaggccaggagatggtcgccgcgagcttcgcccagtgggccgatgcggtgctgttccagcacgcggtaagcctggcgttcgccccggagtccatcgccgtgcgtttcggcaagctgccgccggaattcctcaaggccttcatggccgatcgcagccagctattcagcggcggcagcgccggccgcctgccgctggaacaggcgcgccaccagtggccggcattcatggcgcgactggagcgccagttgtcgcgcgaggacggcgatttcctgttcggcgaagcgtccgtcgccgacttcgccgtggcgcactgcctgtggttcctcaagggcacgccggtcaccgcgccgctggtcgacgattacccgcaggtgcaggcctggttgggacgggtgctcggcttcggccatggcgcgccagccgagatgagtgcggaggaagccctggaggtggctcgcggcagccagcccgcggcattgccggacgaatccttcagcgaccccaacggtttcctgcccggccaggcggtcgccatcgccgccaccgactacggtgtcgacgcggtacagggcgaactgctcttcgccggcagcgaggaactcatcctgcgccgcgaagacccgcgggcgggtaccgtgcatgtgcatttcccgcgcctgggctttcgcatcgaggcgcgttgaggcatgccggcggagaccccgccgctgcggccggacgccgatccgccgcagtgcgcgttgcccgaggcgaggccggaccgcgacgccggcaccaagctgcgcgccgcagtgctcggtgccaacgatggcctggtgtcgaacctgtgcctggtgatgggcgtggcgggtgcgagcatggcgcattcgtccatcgtcctcaccgggatggccggactggtgtccggggcctgttcgatggccctcggcgagtggctgtcggtgaccaacgcccgcgagatggcgagcaagcgcatcgccgaggaagaacgcctgctcaggctctgcccgaacaccgagacccaggaactgatcgatatcttcactgccaaggggctgagcgaggtgtccgcccggcgcgtggccctgcaactgatgaacgacggtcgtggcgcgctggacaccttgtcccgcgaggccctcggcatcgatccgacggagttgggcggcaacccgtgaacgcggcgggcacgtcgttcctgctgttttcccttggcgccctggtgccggtggcgccgttcctgttcctcgacggtgccgcggcgctggtcgcaagcctgctgtccagcctgcttgcgctgctgttcagcggcgcggtcaccgcccgtttcaccgggcggccgctggcgttctcggcgttgcgccaggtgctggtcggtacccttgccgcggccttcacctatgggttgggcaccgcgctcggcgtgggcctgggctga

SEQ ID NO: 6232 - DNA, 1491 bp, Pseudomonas aeruginosa
tcggcggcgccgcgcaggtttccgcgacgctgcgggacacgccgctggcgcgcccgcggatcggccagtttacccgaggttgccggcttctgcctgcgtcgcctggcgttcctgcagaccgtgcaggcgcttgatcacgaagttcaggtgcaggtgcagctcgtacagctcgtggtagtaggagagcggcacctccacggtgttcagctcgctctccagtttctccagccgctcgatctcgcttctcagttgctcggcgtcggtaccgctgtcgagcttgcggtcgatgtcgcggatgtagcggtaccagcggtagatgcgcgcgcggatgcgccagcgatacagcgggccgatggacttcatcagcgggatgaggatggcgatgaacgggatcagcaggatgatgtagcggtccgccagggaggcgatgcggaacggcaggtagcgctgcagcagcggcaggccgctcttgtagtagcgctcggcgtcctcgtgcaggcgcagggtgcgcggctcggcgctggggaaggcgccgggcttgtcgagcaggctgccgtccttcatcacctcgcgcgcggcttccagcaccagcgggatcagcgccgggtggaagcgttcgttgatcaccagggtggccaccggcgacagggtgctgatgtttcgttccggcacgttgcgcggcaggttgagcaggccttcgccgacctcgacccgcttgaggaacggcaggcgcgcctcgtaggcggcgctgcggcggaagttgaccaggcgaagctggtcgttgtcggccaatttctggatcgccgggttctccgccgggccgacgatgaacgccgcgtccagcttgccggccagcaggtcgtcgaccaccgcgttgccgccgcgggcttcccaggtgatcggatagtgtcccggggcgatgtcgttggcctgcaggatcgcctcggtggcggcgcgggtgccgctgccgtcgctgccgatggccaggcgcaggtgcagcaggtcgctgagctggtcgatgtgcacgttgctgcggtggaacagccagagcggttcctggtagaccgcgccgagggtctgcaactggcgcgcctgcccggcttcgagctggcgctcctggccgctctggaccagggcgatgtcgacctcgccggtgccgagcaggcgctccaggttgtcgcgcgagccggcgctgggcaccagcttcagttcgaagccctgctccttgagcttttcccggagcttgccggcgaacacggcgtagccgccgccctcggcgccggtggccatggtcgcgctcatcggcggcggcggggcgacgaaatagaacaccgcggcgaccagggcggcgatcaccgggatcagccagaggttggcgcggatcaggatggcgaggtccttgagcaggtgcttgatgcgattcatgagcggtccttgtgctgctctccagaagggtatgacggatgcgggcgggcgcactcctcagcgtag

SEQ ID NO: 6233 - DNA, 876 bp, Pseudomonas aeruginosa
tcgtgtcgcgggagatggtcgccttcgaatggatggaacgcgccggcagcgaccgcttccgcgagatcagccgcaacttcattcgctgagcggcggttgctcggcctggtagcgccgggcctcctcgcgcagccagtcggcgaaggcctggtggcggtcgctcggcggctcgcgctgcggccagaccagccagtagggataggggtagggcacgcggatgtcgcccagttgcaccaggcggccctcggcgagggcgccggcgaccaggctgcgacgctccagggcgatgccctggcccaggcgcacggcttccagcagcaggttcgagtcattgatcagcagtccgtgctgcggttccgccacgccggcacgctggcaccagagcgcccaggattcggtggagcgcagtgtagggcaggcgacgatctcgctcggcgtgcgcggcaggcggccgccgttgaagtcgggcgcggcgaccatcagcaactcgtcgtcgaacaggcgttcccgaccgaccccttcccagtcgcccttgccgatgcgtacgccgaggtcggccaggccctggcgcaggttctgcacgtcaagactggccaccagccgcacgcgacagtgcggatggcgctcgcgaaagcgcggcaggcgcggcagcagccagttcaggccgaaggacggcatcaccgtgaccaccagctcaccctcccgtggacgcgcccgcaccacccgcgtggcgtcggcgatctcgcccagcgaggcgcgtacctgcagggcgtagaaccggccgttctcgctcaggcgcaggccgcgcccctcgcggacgaacagggccaggccgaggaggttttccagcagcttgatctgctggctgatcgctga

SEQ ID NO: 6234 - DNA, 633 bp, Pseudomonas aeruginosa
tcatcgacaaaggatgccgcgatgcaactgatcggtatgctggattcgccttttgtgcgccgggtcgccatcgccctgcgcctgctggacctgccctacgagcaccggccgctgtcggtgttccgcaatttccaggcgttcagcctgttcaacccgatggtcaaggcgcccacgctggtgctggacgatggcaccgtgctgatggactccagcctgatcctcgattacctggagtgcctggccggccgcgaacgcagtctgctgccgcaacggccgcaggcccgtgcacgggcgttgagtctgatcggcgcggcgctggtggcctgcgagaaatccgtgcagatctactacgaactgaacctgcgtcccgaggaacgccgccacggcccctggctggagcgggtggaggggcagttgctggcggcctacgactggctggaggcagcgctgcgccaggagccgctggcacgcgacggtggcatcgagctggtcggggtgaccgtcgcggtggcctggcgcttcagccaactggtggtcgcggagcgggtcgccgccagcgaatacccggaactggcaagctattcggattatgcggaggggttgccggtgttcctcgagacgccgtcggtctga

SEQ ID NO: 6235 - DNA, 243 bp, Pseudomonas aeruginosa
gtcgctgccgtcgtcacggcccggaccggttgttgcgaactgctgttcggcgccggcatggaggcggcccggccctggctcagcctggtcctgagcgcggccctcggcttgctcttcggcatgctgctgggcgggctctggttcggctactggatccgccaggagggattgcaactgacccacctgctgctggtggtctgggtgctggcgaacttcttcgtgctcaacgtccgctggaactga

SEQ ID NO: 6236 - DNA, 1419 bp, Pseudomonas aeruginosa
gcgatggggtttcccgttcctagactggcggagaaacatcaggagaaggcaaccatcatgcatattcaatcgctccagcagagtccgtctttcgccgtcgaattgcaccaggccgccagtgggcgtttgggacagattgaggcccgccaggtcgccacccccagtgaagcgcagcagttggcccagcgccaggacgcgccgaagggtgaggggctgctcgctcgcctgggcgcggcgctcgtgcgtcccttcgtggcgatcatggactggctgggcaaactgttgggctcccacgcccgcaccgggccgcagcccagtcaggacgcgcagcctgcggtcatgtcctcggccgtcgtgttcaagcagatggtgctgcagcaggcattgcccatgaccttgaagggactcgacaaggcgagcgagctggcgaccctgacaccggaaggactggcccgggagcactcccgcctggccagcggagatggggcgctgcgttcgctgagcaccgccttggccggcattcgtgccggcagccaggtcgaggagtcccgtatccaggctggccgcctgctcgaacggagcatcggcgggatcgcgctgcagcagtggggcaccaccggcggtgccgcgagtcaactggtgctcgacgcaagcccggaactgcggcgcgaaatcaccgaccagttgcatcaggtaatgagcgaggtcgcactgttgcgccaagcggtagagagcgaggtcagcagagtatcggccgacaaggcgctggcggatggcctggtgaagcggttcggggcggatgcggaaaagtacctgggcagacagcctggtggcatccacagtgacgccgaagtgatggcgcttggtctctacaccggcattcactacgcggacctgaatcgcgctctgcgtcaggggcaggagctggatgcgggacaaaagctgatcgaccaaggtatgtccgcggccttcgagaagagcggacaggctgaacaggtagtgaagactttccgtggcacccgtggcggggatgccttcaatgcggtggaagagggcaaggttggccacgacgacggctatctctccacctccctgaaccccggtgtcgcgaggagcttcgggcagggcacgatatccaccgtgttcggcaggtccggaatcgatgtcagcgggatatcgaactacaagaatgaaaaagagattctctataacaaagagaccgacatgcgcgtgctgctgagcgccagcgatgagcagggagtgacccgccgggtcctcgaagaggcggccctgggggagcagagtggccatagccagggactgctcgatgctctcgacctggcaagcaaaccggaacgttcaggcgaggtccaggaacaggatgtacgcctgaggatgcgtggccttgatctggcctga

SEQ ID NO: 6237 - DNA, 2019 bp, Pseudomonas aeruginosa
cgtcccaggtggcgattgcgcgggtgcagcgggctggcgctcttgcgctcggcgtcgggatgcgggctggtcgggcggggcatgttctcggtttccgtgacggcgaggcgggcattattcacatccgccggaggctggccagtgtttctgccgagcggcgcgctcctggcccggtcacaatggaaacagccacggaatcaccagcacgcagacgaacatcaccagcagggtaaatggcacgccgatccggacgaagtcgccgaagcggtattggccagggcccagcaccagggtgttcaccggcgaggaaatcggcgtcatgaaggctgccgaggccgccaccgccaccaccatggcgaaggggtagggcgaggcgccgatctgcttggcggtggcgatggcgatcggcgccatcagcaccgcggtagcggtgttggagatgaacaggccgatggccgcggtgagcaggaacaggctggccagcagcacgcgcgggccggcgtcgccgagggcgtcgaccagcagcgagaccaccaggtcgataccgccggtcttctgcagggccagggcgaagggcagcatgccgacgatcaggaccaggctttgccaatggatggcgcggtaggcgccgtccatgtcgatgcaacggaacaggcccatcaacaggcagccgaccagtgccgcgaccacgttgggcaccaccccgctgaccatcagcgccaccatcacggccaggctgagcagggcgtgcggcgccttgctcagggccggcgccacctcgtcgatctccgccggcaggctgagcaccaggaaatcgcggttgcgtccctgcaactggcggatcgccttccaggcgccgatcaccagcagggtatcgcccaggcgcagcttctcttccagcatgccgtcggtgagcgcttcgtggtcgcgacgcaggccgaccacgttgagcccgtactgcgaacggaagcccagttccaggacgctcttgccgagcagggtggagtccggcggcagagtcacctcggccatgccgacctcccgcgactggtcgatgaagtagctggcgcggaacggcaggcgcaccaggttcagctcggcgcagcgccggtccatgtcctccggaggggcgaagacgtccagcagcaacacgtcgcccgccttcagctcggtgctgccgccgaccttgaccacctcgctgtggaacttgcgtacccgctccaggccgaccacgttggcgcccaggcgggtgcgcagttgcagttcttccagggtgctgccgatcaacggcgagccgagctggacctgcaggcgccgttcgcggccggccaggcgatagtcgcggatcaggtcgcgcagggtccgccgtgccttcggcgcgccgacttccgccgggctggcggcgttcagccagttgcgcgtgagcagcatgtaggccacgccgatggcgagcaccatgaggcctatcggggtgaaggcgaagaagccgaagccggcatgaccctcgcgcgccagctcgctgttgaccaccatgttcggtggcgtggcgaccagggtcatcatgccgctgatcagtccggcgaaggccagcggcatcatcagccggcccggagggatcttcagcttggcggcgatgctcaggaccaccgggatgaagatcgccaccaccccggtggaactcatcaccgagcccaacccggccaccgccagcatcagcagtaccagcaggcgcgcttcgctgctgccggcgcgggcgatcagccagtcgccgacctggtaggccaccccggtacgcaccaggccttcgccgatcacgaacagcgcggcgatcagtatcacgctgggatcgctgaagccggccagggcttcgttgagggtaagggttccgctgacgctgaaggccatgatcaccagcagggcgatcacgtccaggcgcaggcggttgtggatgaagagggcgacggtggtggcgagcaggccgaccacccagagcagttcgaggttcatgcgggcatctga

SEQ ID NO: 6238 - DNA, 402 bp, Pseudomonas aeruginosa
gcaccagagagggatgtgatggctgattttgaatattatattaaaggtgatatggcgctacggtgtaattcagaagggttgtggtatttgtccgtggggggatcaggtttttttctccaggaggaagagagtttttggagggttctggttttattggagaaaccttacgaagaggttagggaaaagcttgggcggggattttgttacttaaatgttgttttggcgggactagatagtgagtctgactactggattggtttggcactttcttgggtagagcaaggaggagcagaagccagtgatgtactactagcacgcttgaagggggtggttgaggggcggagcgccaatcaaaaaaacaggcataaagctttttcagtattgagaaaaataggtgggtaa

SEQ ID NO: 6239 - DNA, 396 bp, Pseudomonas aeruginosa
agaaatgctttgtatatcgttgaaaaatggcatttaggaggttatatgggcaagagagtggttgtattgctatggctgctattcacatcaatgtcagcccacgccatcgataaaaaagtcaacaacgttaccatcatgcgcgtgggcttcatggtggacgcgaattctccgggtggaggctggggctgcatcgtcagcaagccgggagcggcggattgcggctttggcctgatgcgcctgccgccgatgaataccgatgccggcaaggccatgctgtcgctgatgctgagcgcccaggccacacagaacaaactgccggagatcgcctattcggccagcgccacggtgaacgcggtatgccagatcacttcggcgcagatagacagcggcgcctga

SEQ ID NO: 6240 - DNA, 2169 bp, Pseudomonas aeruginosa
caaggaattccatggaagaggtccccaatacagacagtcgggatggcgcaaggggcggcatccgttagcggtaagcgattgttccgagcacgattcgtcccgaggactgacggtcgccgccggggcggtgacgcaggcagcgacagcttagtcgttgcggcgggggtcgttccatgccgaggatggcaaccgaggttctacagcgccggagccgggttggcggtgcctcccggccgttgccgcacatggtcgcacaactgcggcgtgtctggcacgactgtgtacgcatgggaacccgcggccatgccgcgtccctataatgaacgtttcgttccgcaggagtcgcaccgtgcccgccagcaaaccagtcgcggatcccgcccggagtaccgacccacgcgattaccagcgagtcggccggccgctcggggtcatggccaagaccttcccggcggggttcgtggtcgccgagcaccggcacgagcgggcgcagttgatccatgccctgtcgggcgtgatcgaactgcatgtcggtcgcacgctatggctggtcccgccgcagcgcgcggtatggatgccggcggggatggcgcacgcgatgctggcgcgcggcgaggtccgcttgcacactgtctatgtccggccgcagtcctgcccgccggaattcccccgggtgccgcgcggagtgatggtcagcccattgttgcgcgagttgatcgtgcgcgccgccggcctgccgttgttgtacgacgagcgcggccgggaggggcggttgatggcggtgctgctggacgaactggagtggtcgcgggaacagcccctggccttgcccgaccccgcggaccgacgcctgggaagaatctgccaggcgctgctggagaacccggccgaccctcgcgggctggaggagtgggcgcgctgcgtgggggcgtcctcgcggaccctggcacggctgtttctctccgaactgggagtgaccttcgtccattggcgccaccaggtgcgcctggccgccgccctgccacgcctggcggctggcgaagcggtggcgcggatcgccgtggatctcggctaccagacgcccagcgcattcagtgccatgttccgacgcctgaccgggagcacgccgagccgctacttcgccttgtccgattcggcgtagccttcgtccgttggcggacggcgccgacgcggcaggattcctatgctgggcccgtttccagacgaccgccccgggaggcaagcatgcaacgactgaacgtggaattccgctccgagggtgtcgccctgcgcggctggctgtatttgccggaggcgcgtgccgagcggccggcgatcgtcatgacgcacggtttttccggggtgaaggagcagtacctggaccgttacgccgaggtattcgccgccgccggcttcgtcgtgctcctctacgatcatccgaacttcggcgacagcgacggcgagccgcgccaggaaatcgatccggtgatgcagcgtcgcggctatcgcgacgcgatcacctggttgggcgcccaggcacgggtcgacgcgaggcgcatcggcatctggggaaccagctacagcggcggacatgtgctggaagtggccgcactggatcggcgggtgaaatgcgtggtggcgcaggtgccgaccgtcagcggccacgcctcggcgttgcgccggacccgcgccgagcagttgccggcattgctggcaagcttcgacgcggaccgcctgcggcgcttcgaggacttgccgccggcgctgttgccggcggtcgccgcgggccccgacgagccttgcgcgatggccggcgcggacgcccaccggttcttcaccgacagcgcggcgctggcgccgaactggtgcaaccgggtgaccctgcgtagcgccgagctggcgcgggagaacgagccaggcattcacatggcgcggatcagccccacgccgctgctgatgatcgtcgccgaccgggacctgctcacgcccacggacctttgcctggaggcctaccagcgggcattgccgcccaagcggctgctgatgctcgccggcggccatttcacgccgtacatcgagcatttcgacgccaccagccaggctgcggcagactggttcgtccgtcatctcggagagggcggcgagcagccagcgacagtcgtcgaataa

SEQ ID NO: 6241 - DNA, 1104 bp, Pseudomonas aeruginosa
agctggcgtcctcccgtgccggtcgcgacgtggcgcatggttaagctcgatcgttacatcggtgtcaccgtcttcgtcgcgatcctcgcggtgctcggggtgatccttggcctggcgctgctgttcgccttcatcgacgaactcaacgacatcagcgccagctacggcatcggcgacgccctgcgcttcatcttcctcaccgcgccacggcgcgcctacgacatgctgccgatggcggcgctgatcggctgcctggtcggcctcggcaccctggccagcaacagcgaactgaccatcatgcgcgcggccggggtatccctgtcgcggatcgtctgggcggtgatgaaaccgatgctggtgctgatgctggccggcatcctggttggcgagtacgtcgcgccctggaccgagaacatcgcccagagcggccgcgccctggcccagggcggcggcgattcgcaaagctccaagcgcggtctgtggcatcgccaggggcgcgagtacatccacatcaacgcggtgcagcccaatggcgtgctgtacggcgtgacccgctaccgcttcgacgagcagcgtggcctggaatcggccagtttcgccaagcgcgcgcgcttcgagaccgatcactggcaactggaagaggtcaccaccaccttgctgcatccgagggaaaagcgttccgaggtggtcaagctaccgaccgaacgctgggatgcccagctcagcccgcaactgctgaacactgtggtgatggagcccgaggcgctgtctatcagcggtctctggcagtacatccactatctcgccgaccagggcctgaacaacaaccgctactggctggcgttctggaccaaggtcctgcaaccgctggtgaccgccgcgctggtgctgatggcgatttccttcatcttcggtccgttgcgctcggtgaccctgggccagcggatcttcaccggcgtgctggtgggcttcgtcttccgcatcgcccaggacctgctcggaccctccagcctggtgttcgacttcccgccgctgctggcggtggtgatccccgcctcgatctgcgcactggcgggtgtctggctgctacgccgggcgggctga

SEQ ID NO: 6242 - DNA, 822 bp, Pseudomonas aeruginosa
gctacgcggcctttcgagagtctccccatgcgtgtcgccgattttcatttcgacttgcccgaggccctgatcgcccgtcatcccctgcctgaacgccgcgcaagccgcctgttggcgctggatggcccgacgggaaccctcgcccacagacaattcgccgatctcctggactacctgcgtccgggcgacctgatggtgttcaacaatacccgggtgatcccggcgcgcctgttcggccagaaggaatccggcggcaagctggaagtcctggtcgagcgcgtgctcgaccagcaccgggtgcttgcccacatacgcgccagcaaggcgcccaagcccggcacgcggatcctcgtcgaaggcggtggcagcgcggagatgctgcaacgccacgacgccctgttcgaactcgcgttcgccgaacccgtgctgcctttgctggagcgggtcgggcacatgccgttgcctccctatatcgaccgaccggacgatgcggccgaccgcgagcgctaccagaccgtctacgcccagcgcgccggtgcggtggcggccccgaccgccggcctgcacttcgatgaggcgctgctcgaggcgatccgcgcgaagggggtggataccgccttcgttaccctgcatgtcggcgccggtaccttccagccggtgcgtgtcgagcgtatcgaggaccatgtgatgcaccgcgaatggctggaggtcggccaggacgtggtggacgcggtttccgtctgccgggcccgcggcggccgggtagtcgccgtcggcaccaccagcgtgcgctcgctggcaaagcgcggcacgcgacggtga

SEQ ID NO: 6243 - DNA, 519 bp, Pseudomonas aeruginosa
tgccatgttcatcacccgcaatcccgcgccccgcggacccgaggactgatccatgagcttcatgaacttcgagctgctggcgaccgacggcaaggcccgtcgcggccgcctgaccttcccccgcggcgtggtcgagaccccggccttcatgccggtgggcacctacggcacggtgaagggcatgttgccgcgcgacatcgaggacatcggcgcgcagatcatcctcggcaacaccttccatctctggttgcgcccgggcaccgaggtgatccagcgccacggcgacctgcacgacttcatgcagtggaaaggcccgatcctcaccgattccggcggtttccaggtgttcagcctgggagccatgcgcaagatcaaggaggagggcgtgaccttcgcctcgccggtggacggcgccaaggtcttcatggggccggaggagtccatggcggtgcaacgcgccctgggctcggacatcgtgatgatcttcgacgaatgcacgccgtacccggccgaccatga

SEQ ID NO: 6244 - DNA, 495 bp, Pseudomonas aeruginosa
cggggcgcgcaaggcgccccgcgtcataacgggcggtgtcatgctcaacaagtatcctctgtggaaatatctgctgatcctggcggtcctcgccgtcgggttcatctattccgcacccaacctctacccggacgacccggcggtgcagatcagcggcgccagcacggcgctgcaggtcacccaggccgatgtcgaccgcgctgccaaggcgctgaccgacgccggtatcgcggtgaaggccgacagcctgtcgaagaagggcggcctgatccgcctggtcaagcaggacgaccagcttcccgccaaggaagtggtgcgccggaccctgggcgacgactacgtggtggcgctgaacctggcccagaccactcccgagtggctgcgcaagctgggcggcagcccgatgaagctcggcctggatctgtccggcggtgtgcacttcctgctggaagtggacatggacaaggcggtcgatgcccgcctgaaggtctatga

SEQ ID NO: 6245 - DNA, 969 bp, Pseudomonas aeruginosa
tcttcggcgggcgtgacttcaagaagctgtggatctaaggggactgagatgaatatcaagatcggtaccatcaacttcatgggcatccgcaacgtggcgtttgccgtcaccctgatcctgaccgtcatcgccctgggcagctggttcaccaagggcatcaacttcggcctcgacttcaccggcggtacgctgatcgagctgacgtacgaacaaccggccgatctcggcaaggtgcgtggtcaaatggtcggcgccggctacgaggacgccgtggtgcagagcttcggcgacgcccgcgacgtgctggtgcggatgcccagcgaggacccggaactgggcaagaaggtcgctaccgccttgcagcaggccgatgccggcaacccggcgaacctgaagcgggtcgagtacgtcggcccgcaggtgggtgaagaactgcgcgaccagggcggcctcggcatgctcctggcgctgggcggcatcctgctgtacgtcggcttccgcttccagtggaagttcgccctcggtgcgatcctctcgctggtgcacgatgcgatcatcgtgatgggcgtgctgtcgttcttccaggtgaccttcgacctgaccgtcctcgccgctgtgctggcggtggtcggttactcgctgaacgacaccatcgtgatcttcgaccgggtgcgcgagaacttccgcgtgctgcgcaaggccgatctggtcgagaacctgaacatctccaccagccagaccctgttgcgtaccatcgccacctcggtttccacgctgctggctatcgccgcgctgctgttcttcggcggcgacaacctgttcggtttctccatcgccctgttcgtcggtgtaatggcgggtacctactcgtcgatctacatcgccaacgtggtattgatctggctgaacctgaccagcgaggacctgatcccgccgcaggccaaggacaccgtcgacgatcgcccctga

SEQ ID NO: 6246 - DNA, 579 bp, Pseudomonas aeruginosa
cccgcattggatgaaagccaggaggtacatgtgaacaagtcgatgctcgtcggggccgttctgggtgccgtaggcgtgaccgcaggtggcgcggtagccacctatagcctggtggatcgcggtcccgactacgccgaggtcgtcgctgtccagccggtcaaggaaaccatcaagacgccgcgccaggtctgcaaggacgtggccgtgacccgccagcgtccggtcaaggaccagcaccagatcgccggtaccgccatcggtgcggtggtcggcggcttgctgggcaaccagatcggcggcggtaccggcaagaagatcgccaccgtggccggcgccgtcggcggcggctacgccggcaacaaggtgcaggaaggcatgcaggagcgtgacacctacaccaccaccgaaacccgctgcagcaccgtgcacgacagcagcgagaaggtcgtcggctatgacgtgaagtacatgctcgacggcaaggccgggcagatccgcatggagcgcgatccgggcagccagatcccggtcgacaagaatggccggctgatcctcagccagggcgaaacgctgcgctga

SEQ ID NO: 6247 - DNA, 1038 bp, Pseudomonas aeruginosa
tccttggcatccttctcgttgaccgagatgacatccaggcgttcgatggagcggaaaatcagttcaccggcgctgcgagcggcgcgcagggcgatattcagcataggctgcatggagaggtcacctgggtcgttaaagaaagccggccattctagcagaaaccgatggcgtttgaagggcgacctgtcggccgcatggtataaagctgacctctgctgtaggatttcacacccttcagtaacttggcgttggagagcatcggcgttgctcgaccgtattcgtgtggtgttggtcaacaccagtcatcccggcaacatcggcggggcggcccgtgccatgaagaacatgggcctgtcgcaactggtgctggtgcagccggaaagctttccccacggcgacgcggtggcgcgggcttccggcgccaccgacatcctcgacgccgcaagggtggtggacaccctggaagaggccctgagcggctgcagcgtggtgctcggcaccagcgcccgcgaccggcggattccctggccgctgctggatccgcgcgagtgcgcgacgacctgcctggagcacctggaggcgaatggcgaggtggccctggtattcgggcgcgaatatgcgggtttgaccaacgaagaattgcagcgctgccagttccatgtgcatatcccctccgatcccgagttcggctcgctgaacctggcggccgcggtccaggtgctcacctacgaggtgcgcatggcgtggctggcggcccagggcaagccgaccaagatggaaaagttcgagtccacctcgatgctcaacaccgagctggtgacggccgacgagctggaactctattacgcgcatctggagaggacgctgatcgatatcggcttcctcgatccggagaagccgcgccacctgatgtcgcggttgcggcgcctgtatgggcgcagcgcgatcagcaagctggaaatgaatatcctgcgcgggatcctgaccgaaacccagaaggtggcccgaggcctgtcctacaagcggagtgacgactga

SEQ ID NO: 6248 - DNA, 396 bp, Pseudomonas aeruginosa
ggattagccatggcatatagcgaaaaggtcatcgaccactacgaaaacccgcgcaacgtcggcaagctcgacgctgccgatcccaacgtcggcaccggcatggtcggcgcgccggcctgcggcgacgtgatgcgcctgcagatcaaggtcaacgagcagggcgtgatcgaagacgccaagttcaagacctacggttgcggttccgcgatcgcctccagctccctcgccaccgagtggatgaagggcaagaccctggacgaggcggaaaccatcaagaacaccaccatcgccgaagagctggccctgccgccggtgaagatccactgctccgttctcgccgaagacgccatcaaggccgccgttcgcgactacaagcagaagaagggtttgctctaa

SEQ ID NO: 6249 - DNA, 333 bp, Pseudomonas aeruginosa
ggagttgcaatggccatcagcatgaccgaagccgccgccaaacacgtgcagcgctccctcgaggggcgcggcaagggcgagggtatccgtcttggcgtgcgcaccactggctgttccgggcttgcctatgtcctcgaattcgtcgatgaactggcggccgaggacctggtcttcgagagccatggcgtgaaggtcatcatcgacccgaaaagcctggtctatctcgatggcaccgagctggacttcactcgcgaagggctcaacgaaggcttcaagttcaacaatcccaacgttcgtggcgaatgcggctgcggcgaaagcttcaacgtctga

SEQ ID NO: 6250 - DNA, 1203 bp, Pseudomonas aeruginosa
tctctttgcccagggcggcgggcagaacgcccgcagtctgttgctgggcattcgtctcgcgaaggtcttcgaagaccgcgacacggccgccagctatggcctgcagttgaaacgcctgtacccaggctctcccgaatatcaggaattccaggcggaaaaatgatgaaagcgccgcagcccgaagtcgtagccaccgcttcccgtcagaaccccggggaaaccctgcgccaggcgcgcgagcagaagggcctgtcgctgtcgcaggtggccgggcaactgaacctgaccgagaattcgctgcgtcagctggaaaacggcgcgttcgacaagctgccgggacacaccttctcgcgcggttacatccgcgcctacgccaagctcatgggcctcgaccaggccgagctggtcaacagcttcgaccatttcaccggcaccaatgccagcggcagcaccgtacagagcctgggacgggtcgccgagccggtgcgcctgtcgcgcaacgtgctgcgtatcgtcagtctgttactgctcgccctgctgatcggcttcggctacttctggtggcaggagcattccgcgcgcacgccggaaaccgccggtctgagccttgagcatgtcgaagtggaaagcgccgacggcaccaccgagatccataccctggacgagcctgaagaccaggcggtgatcgaagcgcagaaggaaggcgagcaagcgcccgccgaggtttctccggaagtcgctgcccaggccgagggagcgccgccggtggcgagcgagggcgcgcaggttcccgccgctccggcccagggcacccccgccgcaccccagcagcccgttaccgccgcgcctgccggcacggctcccgctcccggtactgctccagccgttccagcgacggccagtccggccgccccgccagcgccgagcgaacctgccgccgcgcccgtggtggccggcgagggccagggggtggtcaaggtacagttcgtcgccgattgctggacccaggtcaccgacgccaacggcaaggtcctggtcagcgcgctgaagcgcaagggcgacagcctggaactggccggcaaggccccgctggagctgcgcctcggtttcgctcgcggcgcccaggtcagctacaacggccagccggtggacgtgacccccttcgtccgcggcgaaacggcccgtctgaaggtaggacaatga

SEQ ID NO: 6251 - DNA, 555 bp, Pseudomonas aeruginosa
ccaacaccgagacctgcgacgtcgctgccaccgtcgcgcagatccgccgcctggaagatgccggcgcggacatcgtgcgggtttccgtccccgacatggacgccgccgaggcattcggcaagatcaagcagcaggtcaacgtgccgctggtcgccgacatccacttcgactatcgcatcgccctgcgcgtcgccgagctgggagtggactgcctgcgcatcaatccgggcaacatcggtcgcgaggaccgggtcaaggccgtggtcgatgccgcgcgcgagcgcaacatcccgatccgtatcggcgtcaatgccggttcgctggaaaaggacctgcagaagaaatacggcgaaccgaccccggaagccctgctcgaatcggccatgcgccacgtcgatcatctcgacaagctggacttccagaacttcaaggtcagcgtcaaggcctccgacgtcttcatggccgtcgccgcctatcgcctgctggccaggcagatcgagcagcccctgcacctgggcatcaccgaggccggcggcctgcgctccggcacggtga

SEQ ID NO: 6252 - DNA, 663 bp, Pseudomonas aeruginosa
agaataggagtgattggggtgacatcgcgtaccgaagacgaagacctggcgcagatcaaggactggtggcagcgcaacggcaagcccctggtcaccggcggcatcctcgcgctggcagtggtattcggctggcaggcctggcagaagtaccagaccaaccaggcgcagggcgcctcgatcgtctaccagcaactgatcgaaaccgcgctgaatccggccggccagccggatccggcgaaggtggcggagctggctggcaagctgaagagcgagttcggcggcacccattatgcccagtacggcagcctgttcgtggccaaggtcgcggtcgacagcggcaagctggatgacgccgttgccgagctgaaggcggtcatggacaagccggccgacgccaccctcggcgaactggcgcggcagcgcctggcccgggtcctggcggcccagggcaaggtcgaggaaggcctgaagctgctcgatggcgatgccgacaaggcctacgtctcgacccgcgaggagctcaggggcgacctgctggtgcagctcaagcgcaccgacgaggcgcgcgcggcctacgagaaagccaagcagtcgctgcccgaagacggtgccggcgatgccctgcagatcaagctcgacgacctgtccaagggagaggcctga

SEQ ID NO: 6253 - DNA, 852 bp, Pseudomonas aeruginosa
cgtgatcgccctcgacgaagccaccggcaagaagaagtggaccaagcgagtcaacagcgaagtgctgtcggcgccggccaccaatggcgacgtggtggtggtgcagacccaggacgacaagctgatcggcctcgatgcggccagcggcgaccatcgctggatctacgaaagcaccgtgccggtgctgaccctgcgcggcaccggcgcgccgctgatcgccggcaacatggccctggccggcctggccagcggcaatgtggtggcggtcgacgtacagcgcggcctgccgatctgggagcagcgggtaccgattccccaggggcgttccgaactggatcgcgtggtggacatcgacggcggcctcctgctgtccggcgacaccctctacgtggtcagctaccagggccgtgccgcggcgctggacgtgaacagcggccgcctgctctggcagcgcgaagcgtcgagctacgtcggcgtcgccgaaggcttcggcaatatctacgtcagccaggccagcggttcggtggaaggcctggactcgcgcggtgcctcttcgctgtggaacaacgacgccctggcgcgtcgccaactgtcggctccggcggtgttctccagcaacgtggtggtcggcgacctggaaggctacgtgcatctgctgagccaggtggacggtcgcttcgtcggtcgcgagcgggtcgacagcgatggcgtgcgggttcgtccgctggtggtcgggagctggatgtacgtgttcggcaacggtggcaagctcgtcgcctacaccatccgctagactgggtttcaagtgtccggccgctgccgtccgacgtcagcggcctttgtgttttctga

SEQ ID NO: 6254 - DNA, 1500 bp, Pseudomonas aeruginosa
attctcgtggagagccgcatggttcccgttattgccctggtgggtcgcccgaacgtcggcaagtccactctgttcaaccgcctgaccaagtcgcgcgacgccatcgtggcggagtacgcaggcctgactcgcgatcgccagtacggcgaggcgcgctggcagggccgcacctatatcgtcatcgataccggaggcatctccggcgatgaggaaggcattgatgcgaaaatggccgagcaatcgttgcaggccatcgaggaggcggatgccgtcctgttcctggtcgattcgcgcgccggcatgaccgccgccgaccagatgatcgccgagcacctgcgcaagcggaacaagcgcagcttcctgatcgccaacaaggtcgacaccatcgatcccgatctcgctcgcgccgagttcagcccgctgggcctgggcgatgcgctgccgatcgccgccgcccacggtcgcggcatcaaccatatgctgcaggaagccctggggatcttccccaaggacaacgcggaggaagagggcgagggcgagccggcgagcgaagaggtcgccgaaggcgaggaaccgacccggattcccggtcccagcgagaaggacgggatcaagattgccatcatcggccggcccaacgtgggcaagtcgaccctggtcaaccgcatgctcggcgaagagcgggtgatcgtctacgaccaggccggcaccacccgcgacagcatctacatcccgttcgagcgcaacgaggagaagtacaccctgatcgacaccgctggcgtgcggcgtcgcggcaagatcttcgaggcggtggaaaagttctcggtggtgaagaccctccaggcgatccaggacgccaacgtggtgatcttcgtcatggacgcccgcgaaggggtggtcgagcacgacctcaacctgctcggcttcgtcctcgagaccggccgtgccctggtcatcgccctgaacaaatgggatggcatggaggcggccgagcgtgactacgtgaagaccgaactggagcggcgcctgctgttcgtcgacttcgccgacatccatttcatttcggccctgcatggcaccggcgtcggccatctctacaagtcggtccaggagtccttccgttcggcggtgacccgctggccgaccagccgcctgaccagcatcctcgaggacgccgtgcaggtgcaccagccgccgatggtcaacggtcgccggatcaagctgcgctacgcccacctgggcggcgccaatccgccgctgatcgtgatccacggcaaccaggtggacgcggtgccgaaggcctatacccgctacctggagaagacctaccggcgggtattgaagctggtcggtacgccgatccgcatcgagtacaagggcggcgagaacccctacgagggcaagaagaactcgctcaccgcgcgccaggtcaacaagaagcgccggctgatgtcgcaccacaagaaagccgagaagaagaagaaggacaagcgccgctga

SEQ ID NO: 6255 - DNA, 876 bp, Pseudomonas aeruginosa
aaaggctccggacgccatgcggctggtccggttctgttacgccaaacgcgaggagacgctgcgtcaggcagcggaaaagctatgcgcgatctgacggttctgccggacctggacatcgccctggtccaatcctccctggtctggcacgacgcccaggccaaccgcgagcatttcgccgccctgctggagagtgccgccggcgccgatctggtggtcctcccggagatgttcaccacgggtttcagcatggcttcggccgagcaggccgagcccgaactggggccgacccatgcctggctgctggagcaggcccggcgccttggcgcggtggtcaccggcagcctgatcgtccagctcgccgacggcagccatcgcaaccgcctgctctgggcgcgtccggacggcgagatgctgcactacgacaagcgccatctgttccgcatggccggcgaacacgagcactacagtcccggcgaacgccaggaactgttcgaactcaagggctggcgggtgcgcccgctgatctgctacgacctgcgtttcccggtgtggagccgcgacccgcacgacaccgacctgttgctctacaccgccaactggcccgcgcctcgtcgacagcactggaaccgcctgctgccggcgcgggcgatcgagaacctttgctacgtggtggcggtgaaccgtatcggcgaagacggcaacgccttgcgctacgctggggatagccaggtcctggacttccagggcgacagcctgttcaacgcggcggacgccgacggcgtgttccgcgtccggctggacgcggcggcactggcggcctatcgccagcgtttcccggcctacatggacgcggatcgcttcgaaatccatccttga

SEQ ID NO: 6256 - DNA, 462 bp, Pseudomonas aeruginosa
tgccctgaattcctggatcggcggtgggccgaaccagtcggtgtcggcggcggacatttcccgggtcttcggcgacggtcaattgcagcaactggcggactccgccggagtcagccagggcgaggcggccgaacacctgagcagcctgctgccggaactggtcaacaagctgacgccggacggccaggcgccgcagggcgacctggacatcggttcgctgctggcgcgcttcagctaaggctttcccgtcgatgcggagcggatagccgcgatacggttatccgctccactcaacggggcgaggccgccctcgacggcaggtcggtcaataggcgctggcgctgtccaggcggtggatcgcctgttcgtcgagcttcaggtgggtggcggcgatcaggtcgtcgagctgttccaggctggtggcgctggcgatcggcgcggtcaccgtcggacgagcgatga

SEQ ID NO: 6257 - DNA, 339 bp, Pseudomonas aeruginosa
ctggccatgactacacaacgctacctgctcgatgaactggaaaccgccgacatgctcgagatcgacggtctgcacgcctggcgcttcgaactcaacgagaacctgctggaccaggcggacctggcggcggaagccgaccagccgttcgccagcgaagactgggtgctggcggtggaaagcctggatggacgcacccgtcgcgagtggcgtttttcctacaacgcggtgatggaagccgagccccaggccgatggcgagtcctggcgcctgaccacaggggagggggcgtaccagctccgttgcctgggagcggtcagcgccagcggcgaggatgagtga

SEQ ID NO: 6258 - DNA, 1911 bp, Pseudomonas aeruginosa
aaaaagggagccgcctggctccctttttcccttccgtgccggtcaggccgccttggcctcggcctgggtcaccgcgcggttcagcgcgctgaacagggcgcggaagctggcggtggtgatgttctcgtcgatgccgatgccgtgcagcgggcgctggccctccaggcggatctcgatataggccgcggccttggcattggcgccggcgccgatggcgtgctcatggtagtccatgatttccgccttgaccggcagggcggccaccaaggcttccagcggtcccttgccgatcccgcgccagtgctgcttctcgccgtcgaaggagacttccaggtcgacggcgctggtgccgttctcttcctgcaggcgatggctggcgaggacgtagggcgaggtcgccttgaggtattcgttttccagcagcgagtagatctgttgtgcggtcatttccaggccgagacggtcggtctcgccttgcactacctggctgaactcgatctgcatgcgccgcggcaggctgatgccgtactcctgttcgagcaggaaggtgatgccgcccttgccggactggctgttgacccggatcaccgcttcgtagtcgcggccgatgtcggccggatcgatcggcaggtacggcacttcccagatcgcgtcttccttctgctgggcgaagcccttgcgaatggcatcctggtgcgagccggagaaagcggtatggaccaggtcgccgacatatggatggcgcgggtggaccggcaactggttgcactcttcgaccaccttgcgcaccgcgtcgatgtcggagaagtccagttgcggatgcaggccctgggtgtacatgttcaaggccagggtcaccaggtcgacgttgccggtgcgctcgccgttgccgaacaggcaaccttcgacgcggtcggcgccggccatcaggcccagctcggtggcggccacgccggtgccacggtcgttgtgggtgtgcaggctgatgatcacgctgtcacgcttgtcgacgtggcggccgaaccattcgatctggtcggcgtagacgttcggcgtggcgcactccacggtggccggcaggttgaggatgatcttgttgtccggggtcggttgccagacgtcgatcaccgcgttgcagacctccaccgagaactccagctcggtagagctgaagatttccggcgagtactggaacgaccactgggtatccggttgctcggcggccagcttcttgatcagtttcgcggcgttggtggcgatgtccacgacgccctgcttgtcctggttgaagacgatgcggcggaacgacggggcggtggcgttgtagacgtggacgatggccttcttcgccccgcgcagggattcgaaggtgcgggtgatcaggtcttcgcgggcctgggtcagcacctggatggtgacgtcgtccgggatgtggttgccttcgatcaactcgcggacgaagttgaagtcggtatcggaagccgacgggaaggccacttcgatctgcttcaggccgacctgcaccagggtcttgaagaatcgcatcttcttcgccgcgtccatcggttcgatcagcgactggttgccgtcgcgcaggtcggaactgcaccagatcggcacctcggtgatggtcttcgacggccaggtgcggtcgggcagattgatggccgggaatgggcggtatttctgcgaagggtctttcaacatgctcatggggctaatcctttggagtcggttcctgggccggcggggccaggcgaacgcagtgacgagatgaagagaagcgtcgctcagccacgcagtcgcgggctgaccaggcacaggcaggcgtgttggcggagcaggatgagggtgtgtggtgttttcatgcgtaccacactagtgagactgcatttgaatggcaagcattaa

SEQ ID NO: 6259 - DNA, 309 bp, Pseudomonas aeruginosa
tcaagggcccgcagacggtgctctgggggccgggcgcgtcggccgggacgatcctcttcgagcgtgagccggagcgcttcggagaactcggctcgcgggtcaacgccagcctgctggccggctccaatggccgcttcgacaaggtgctggacgccgccgccggcaaccggctcggctacctgcgcttcaccggcaaccacgcgcagtccgacgattacgaggacggcgccgggaataccgtgccgtcgcgctggaagaagtggaacggcgacgtcgcggtcggctggacccccgacgaggacaccctga

SEQ ID NO: 6260 - DNA, 372 bp, Pseudomonas aeruginosa
  unsure (369),(372): Identity of nucleotide at the above locations are unknown.
tcgaactcaccgccggcaagggcgacggcgaggcacgctacgccgggcgcggcatggacggctcgcagttcaagcgcgagagcctgggcctgcgcttcgtcaaatcgaacgtcagcgatgtgctggagaaggtcgaggcacaggtttactacaattaccccgaccacatcagggacaagttccgcctgggcactcccggacccatccggcatgatgcccatgccgatggcgtcccaggtggacagaggcaccctcggcggtggcctggcggccacttggcgctgggacgacttcaagctggtcaccggggtggacgccatgcgcaacgagcaccgcgcgcgcggctccaagtacgacatgatgaccgantan

SEQ ID NO: 6261 - DNA, 999 bp, Pseudomonas aeruginosa
tacaccgacgccgaccagttcccctggagcaaggacgcggtgttccacaactacggggccttcggcgaactgacctggttcgccgccgagcgcgaccggctgatcggcgggttgcgcctggaccgcgcctcggtcaaggactaccggcagaccctgaagtccgggcacatgggccacgccatggccaacccgacggccaacgacacccgcgccgataccctgcccagcggcttcgtgcgctacgagcacgacctcgccgactcgccgaccaccctatacgccggcctcggccatgccgagcgcttccccgactactgggagctgttctcgcccaagcgcgggccgaacgggtcggtcaacgccttcgacaagatcaagccggaaaagaccacccagctcgacttcggcctccagtacaacggcgacaagctgcaggcctgggcctccggctacgtcggggtggtccaggacttcatcctgttcagctatcgcgagggcatgatgggttcctcgacccaggcgaccaacgtcgacgcgcggatcatgggcggcgagctgggcgcttcctaccagctcaccggcaactggaagaccgacgccagcctggcctatgcctggggcaagaacagctcggacgaccgcgcgctgccgcagatcccgccgctggaagcgcgcttcggcctgacctacgaggaaggcgactggagtgccggcagcctgtggcgggtggtcgcgccgcagaatcgcatcgccagggaccagggcaacgtggtcggcaaggacttcgacaagagcgccggcttcggcgtcttctcgctcaacggcgcctaccgggtgactcgcaacgtcaagctgagcgccggtgtcgataacctgttcgacaaggactacaccgagcacctgaacaaggccggcgacgccggcttcggtttctccgccaacgaaacggttcccgagccgggccggaccttctggaccaaggtcgacttcagcttctga

SEQ ID NO: 6262 - DNA, 789 bp, Pseudomonas aeruginosa
cctcaacagcgcgtcgcgccagcaggtgccctggccgctggagaacactccgctgccgcgctcgcagccgccggcggccgacgcccatgccgagcatcgcgggcattccgcccaggccgggcacgcgatgccgatggacatgccgatgccggcgggcatccctctgcaaagggtggtggatatcgcccgcgagcgcggcgtggcggcgggctacgggatcgccctgccgagcgggatggagggggtctacacgatttccgtgttccccgacgatccgcgccacgacgccaccctgcacatcgaacagtacagcggcaaggttctcgccgacgtgcgttggcaggactacaacgcggtggcgaggagcgtgcagatgggcgtcgtgctgcacgaaggcaagctcttcggcctcggcaaccagttgctgatgctcgcggtctgcctggcgatcctgctcagctcggcgagcggcctgtggatctggtggaagcgcaagccggccggacgccttggcgtgccgccgctgcgccacgagctgccgcgctggaagagcggcatcgccatcatgctggcgctgggcgtggccttcccgttggtgggggcctcgctcctgctggtctgggcgctggactggctggtgctgtcgcggctgccggcggttcgccgggtcctggcttgagacctgctgcccggcgctcagtcgaggtcgagctggcgggtcttccagagtgccgccagcaacagcacgcagagcagcgcctcggcgccgagccagaggaaggtggttag

SEQ ID NO: 6263 - DNA, 999 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtcgaatgctgcaggctcgcatcgcacgcagtgtgggcgtctcggagtccacggtcagccgcgttctggcgcgagcgggcatgtccaggttgagcgacctggagcccgtcgaagccgttgtgcgctacgagcacgaggcgcccggggacctgctgcacatcgacaccaagaagctcgggcgcatcgtgcggcccagccaccgcgtcacaggcaaccgtcgcgactcggtcgatggtgcaggctgggagacgctgttcgtggccatcgatgatcacgcaaggttggcgttcaccgccatgcatcccgatgagaagacggcgcaggcggtcctgttcctgcgcaatgccgtggcctattacgcccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccagtcagcgttgcgcgagtgggcctacggctggacctaccagaactcagcccatcgaaccgatgccctggcaagctggcaacaccactacaactggcatcgcccgcacagcggcatcggcggcatcgcgcctatgtccagactcaactcgtcaagaaataacctcttgacgcttcacaactag

SEQ ID NO: 6264 - DNA, 900 bp, Pseudomonas aeruginosa
cctcgacctgcacggcatgagcgtggagaaggcccggcagacgctatgggacttccttgccgaggccacccgcctggaaatccgctgcgtgcgcgtgacccatggcaaggccgcgcgcaaggacggacgcagcccgctggtgaaaagccacgtcaatacctggttgcgccagcacccgcaggtgctcggtttcacctcctgcctgccacgccacggcggcaccggctcggtctacgtgatgctgcgcaggaccatgctcgaaggccgcgacgagtagccggcaagcgccgagtcttgccagcggcccggcgacgtcctaccctccgcgctggtaatcgtctgactggaacgcccatgtccctggaacaacactactcctcgatcctcacccagctcggcgaggacgttaaccgcgaaggtctgctggacacgcccaagcgtgccgccaaggccatgaagtacctgtgccgcggctaccaacagagcctggaagaagtcgtcaacggtgccctgttcagctccgacaacagcgaaatggtattggtcaaggacatcgagctgtactcgctctgcgagcaccacctgctgcccttcatcggcaaggcccacgtggcctatatcccgaacggcaaggtgctcggcctgtcgaaggtcgcgcggatcgtcgacatgtacgcccgccgcctgcagatccaggagaacatgagccggcagatcgccgaggcggtccagcaggtcaccggcgccctcggcgtcgcggtggtgatccaggcccagcacatgtgcatgatgatgcgcggcgtggaaaagcagaactcgtccatggtcacttcggtgatgctcggcgaattccgcgacaacgccgccacccgcagcgaattcctcagcctgatccgctga

SEQ ID NO: 6265 - DNA, 441 bp, Pseudomonas aeruginosa
acatccgccatcgtcgccggaaagcggcgtcaccagtggtcccggcaggacaggaaggaaatgaacctgatcgcgcacgtggaaataccggtgtccgacctggagagggcgatgcgtttctacgcctcggtgttcggagtggcgttcggcgaggtagccaccctgcacggaagcagaatggcgcatttccccttcgaggaaggccgtgacggtgccagcggcgcactcgccgagggcgacgtctacgtgcctacgctacatggggcgatcatctacctgaatgtcgcggacctggatgccgtcattgcccgggccctcggcgaaggcagcgaaatcctcttcccgaagacgccgcttggcgacggcgtgttcatcgccgagatcagggacagcgaaggcaatcgtatcgccctgcagagcgcttgcggagagcggccgtag

SEQ ID NO: 6266 - DNA, 240 bp, Pseudomonas aeruginosa
ccaggctggcgccctggaccacgaagtactgctggtagccctgctgggtgtagaaccccggaatcacgtagtcggtgccgacgaacagaccggcctgcggccccaggtgctggccgaagcgatactcgggcaggcttcgcgcctgttcgcgcagcacccggtagaccacgttggccagggactcgctgcgcagcacctggcgtgcctgggccaccagggtctcgttcagcggatagctga

SEQ ID NO: 6267 - DNA, 1779 bp, Pseudomonas aeruginosa
gcgagcagggcttcggcgaaggccaggggttgcggtacgcggctgaacatcgcacccacctcaggcgaactcgcagagcacgcggccgtgctcgcccagcgtcgcatggacccgctcgagacgctcgtcgcgcgccatcgcttccagcaaacggtcggccaccagcggcagcaggtgcgtgtccagcaggtggtcgatcaaccgtgcgccgctgtcgctctgggtgcaacgctcggccaggtggcccaccagcgcctggctgtagtcgaaagccagttgacggcgcgccaggcgctcgccgaggcgttgcagcttgatctcgatcagctcgcgcagtaccgggccgcccaccgggtagtaaggcaccacgcgcatgcgcgccagcagcgccggcttgaaatgccggctgagcgccggccggatggtttcctccaggagttcggcggaaggccgcgcgccgtcctggcaaagcgcggcgatgtgctcgctggcgaggttggaggtcatcaggatcaaggtattgcggaaatcgatctcgcgcccttcgccatcgttggccacgcccttgtcgaagatctggtagaacaggttgagcacgtccggatcggccttctccacctcgtccagcaatatcaccgaatagggcttctggcgtaccgcctcggtgagcatgccaccctcgccatagccgacatagccgggcggcgcgccgatcaggcgcgagacggtgtgcttctcctggaactcggacatgttgatggtggtgatgaaacgctcgccgccatacagcaggtcggccagcgccagcgcggtctcggtcttgcccaccccgctcgggcccaccagcagaaacacgccgaccggcgcatcgggcttgttcagcccggccgcggtggcgcgcatcgcgcggtccagggcgctgaccgcctgttcctggccacggatccgcgcccgcaggtcgtcagcgaaccccatcaccttggcgttgtgttcccgcgccagttgttccaccggtacgccggtccaggcgccgatcacctcggcaaccaggcgcgggcagacctcgaagctgaccagccgcccctgggcctgggcatcggcgagtgcctggcgggtttcgtgaagggccttttccagggcttcgacaccgccatgctcgtcggccgggaaagtctccgcgttcgcctcgccgccctgctcttcccggttcgcctcgcgggccctggccaattgctggcgcagggcgagcaggcgctcggcgagttcgcgctggcggctccactggtcctcctgtacgtgccgctcgctttccgcctgggccaggcgctcctccagcgcctgcagggcatcgtggtcgatcggcaggcctgcctcggcatcgcggcgcagggcctggcgctggcgctcgccttcggccagctcgccgcgcaggcgctcgagactctccggcgccgccgccaggctgatgcgcacccgcgcacaggcggtgtcgaggacgtcgacggccttgtccggcaactggcgacccgccaggtagcgggcggacagttcggcggcggccaccaccgcgtcgtcgcgcaagtagataccgtggctttcctcgtaaacccgggccaggccacgcaggatcgtcaccgcctcggcaacgctcggctcatgcaactgcacgggctggaagcgccgggccagcgccgggtccttctcgaaatacttcttgtattcggcccaggtcgtcgccgcgatggtgcgcaactcgccacgtgccagggccggctttag

SEQ ID NO: 6268 - DNA, 555 bp, Pseudomonas aeruginosa
caggttggcggcatccgagccgccggcctgaccgcccgcgccgataagcgtatgggcctcgtcgatgaacaggatggtcggcctgagcgctgccttcacttcgtcgatgacgcctttcaggcgccgctcgaactcgcccttcacgctggcaccggcctgcaacaggcccatgtcgagggacaacagctcgacgtccctcagcgccggcggcacttcccctgcggcgatccgcgaggccaggccttcgacgatggcggtcttgccgacgccggcctcgccgaccacgatggggttgtttttccgccgacgggccaggatgtcgaccatctggcgaatagccccgtcgcgacagagcaccggatcgagcttgccgtcgcgcgcctgctgggtaaggttgtgggtgaaacgctgcaacagggactcgccgccgcccggcttgccgctgggcgcgccctccagcggctgcgagagcgcgaaatccttcaaccgctcgatgtcgagccgcgccagcagcggctggtagcggctgccggcatagcgcaacgggttgcgtag

SEQ ID NO: 6269 - DNA, 1419 bp, Pseudomonas aeruginosa
cagggccaggatcaatgccgcctggtcgatctggctacggcccagttcgaggttggccagcaacagcgcatcctgcagccactgcaccagctcgggcgcgaacaccggattgcgcgaggcactatgctcgccccgcgcttgcaacgcggcgttgagttcgccggcgtccaccgcggcatcctgcagggcgcgcgccagcagtccctggggacgctccagcaggcccagcaacaggtcctccaccagtaccttgctgccaccacgggctacgcagcgctcggccgagccttcgaggtcgcgccgggtgtcggcatccagcgcctgaatcagttgttgcaggtctacgttgatcatgctcatccatccttaatgaatcttgctgcccagcgtcaccacgccatccgcgcgctcccggcccagccagctggtccagccaaggcggcaggcgttctgcgcgccgatgcggaactcacggatttcctcgtggcgcaagaccagccggatgtcgtagtcgagcgggtcgcgcagggtgaagcgaaccagcgcgcaaagcggctggtagccgggaccgatcggcaggaactcgtggaagcgctgccagtcgagctggcggatatgaatgcggaacttgccgctgcggtcgcggacccgttcgcccagcaccgcgtcttcgccaagctggctgttgaacaggccgagccggttgcgctgctcttcgaggatcgcgacgcgccgttcgatacactgctcggcgaccagttcggcatgcttgaagtagtagcgcagcaccgactcgatcaaggccgccgagtgcgcccgcaggctgagcaggcccaggtagggcagcaggcgtttccagttcagttccctggccttgcggatctcttccccgcccaatccgacgagggcgaacaattgggcggaaaacgcatcgctcgcgccgctctggaagctcacccggtagcggtacttgcgccagatcggcaacagcagccgatgcaggcggtgatggaagagatcgaggaagttccgcgtaggattgccctcctcgctgtcgcccagagcctgctcgctgtagaacgccggcaacggcgaactggcaccgaacaagccgatcaggttgaaacgcagccgcgcccgcagcatgccgcgctcttcgaagaactccacccgatcgacatcgctgcccgggaagccgaggctaggattggcctggaattccaactgatcgtagagcgcctcgtctcccaggccgggatgttcctggcgcaggcgatccatgaccagcaggaccgcctggaacagcgagtactcgcgaatgccccgggccagcgcgcttacagcaggggctgcaaacccatgcgcggtttccattggtacacgtctccctgtgtgctcctcacccgcaactcgtggtag

SEQ ID NO: 6270 - DNA, 591 bp, Pseudomonas aeruginosa
gaattgttaggtgaagttgcccgaggggtggtccaacccgcgggatttcctactcacgcaaggagagcatccatggcaacccccgcctatatgtccatcaccggcaccaagcagggcctgatcaccgccggcgccttcaccgaggattcggtcggcaacacctaccaggaaggccacgaggaccaggtgatggtccagggcttcaaccacgaagtgatcatcccgcgcgacccgcagtccggccagccgaccggccagcgcgtgcacaagccggtggtcatcaccaaggtcttcgacaaggcctcgccgctgctgctggccgccctgacctccggcgagcgcctgaccaaggtcgagatccagtggtaccgcacctccgccgccggcacccaggagcactactacaccaccgtcctggaagacgcgatcatcgtcgacatcaaggactacatgcacaactgccaggacccgggcaacgcccacttcacccacctggaagacgtgcacttcacctaccgcaagatcacctggacccacgaagtctccggcacctccggctccgacgactggcgctccccggtcgccggctga

SEQ ID NO: 6271 - DNA, 1983 bp, Pseudomonas aeruginosa
gggacaacggatgttcgcagcagccaaccagacccacttcagcctcgccatcgacggcctcgccatcgacctgcaggtgctctccttcagcggccgcgaagccatcagccagccgttcgccttcgacctggagctggtcggcgaacgccccgtgccggacctcgaaagcctgctgcacaaacccgccttccttaccctcgggcccgccggcaacggtatccacggcctggtgcgcagcgccggacagggcgactcgggcaagcgcctgacccgctaccgcatcaccctcgtcccgcaactggcctacctcgcccagcgcaccaaccagcgcatcttccagcacctcacggtgccgcagatcgtcggccgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccggccggcggtcaagcgcttcggcgtacgcctggaaacccgcaccagccgcgtcacccgccgcgactacgacttcgagaaaccgcgcctgacgctggaaagcgccgcccgcggcgaagcccggccggacctcgaggactacgactatcccggtcgcttcgtcgaccgcgagcgcggaaagcacctggccaggcgcgccctcgaacggcagcgcagcgactaccgcctggccgagggccgcagcgaccaaccgttgctgctcagcggccacttcctgccgctggccgcccatccccaggcgggctggaacgacctctggctgctcaccgaggtgattcacgaggggcggcagcctcaggtgctggaggaaagcatcgtctccgatgcctcggcgagcccggacgacttccggcagggttaccgcaaccgcttccaggccacgccctgggaggcgttcttccgtcccccaccgacgccgccgaagccgcgcatcctcggcacgcagagcgcggtggtgaccggcccgaagggcgaggaaatccactgcgatcgctacggtcgggtgaaggtgcaattccactgggatcgcgagggccaggccgacgacagcagcagttgctggttacgcgttgcctccggctgggcgggaaggaactacggtgccatcgccatcccgcgggtcggcatggaggtgctggtgaccttcctcgaaggcgatcccgaccagccgctggtcaccggctgcctgtttcacagggaacatccggtgccctacgaactgccggggcacaagacccgcagcgtcttcaagagcctcagcagccctggcggcggtggctacaacgagctgcgcatcgaggaccgcaagggccaggagcagatcttcgtccatgcccagcgcgactgggacgaaaacatcgagcacgaccagaagatccgcgtcggtcaccaacgccacgacaccgtgcaggcgaacagctacagcgagttcaaggccgaggaacaccgcaccacccacgccgagcgcaaggtggaggtccgagccagcgaccacctcaccgtagccaacgaccagcacctgaagatcgccagcggccagttcgtcgaggccggccaggagatccacctgagcagcggtctgaaggtggtgctggaggccggcgccgaactgaccctcaagggcggcggcagcttcctcaagctcgacgccagcggcgtgaccctctccggggccaacgtccgggtcaactccggcggcagcccgggcaacggcagcggcgcggcgccgctgttgccggggccgccgctcgacgcggatgcggcgacagcgggccaggtactggacaacccggcgcgtag

SEQ ID NO: 6272 - DNA, 3369 bp, Pseudomonas aeruginosa
ccgtcccgagcggaaggggccggaacaattgatcgtcgatgtctggggagacccggcgcaaggaagccaggtcgtactgttgccaccggagagcgaggcatgagcggattccaggaccagagtatcgacgaaggcgtgcgcaagcgcaccgcctaccagaacgatcggcgtgcacgactggcattgaacgtcgagcgacaggacggcggtatcctgcagattccggtggccagcgatatgctcggccatgaggagcacgagcgtatccagcagaacaccttcctggctgtgatgccgctggtccgcctgccaacgctgggcaaggccggttatggcgaccagctgcccgccggcgcgctaccgcgggcgggacggatctacctgttccaggacggcaagttgtggcgcgaactggaatgtgatggcaagggcaacctgttcgaagtcgatctcctgcaggggcgcagccagcgtgcggacaagcgtccggccgtaggcaagacacaagcgctgatcctggtgccggtgctggtcaaggggcagttcgtgatcccacgctacaccatggcctatagcgaaactccctggccttggtcgtacatcgactggctggaggaggacccgcagcgggtcaaccggcgctgccagcagatggcgtccgcttggaacgcctcggtggccaaccagcactggaaagcctccatccatcaacccgcgctggtcattgatcatcacgcccagggtttgcgacctcgcgacttcaacgtcgagagcgcgctggaagacccggcggaattcacacctgcgttcgccgcctttcgcgaagagtcgctggtgtgccagttgcagcgacgccagcaggaattggcgcccctgctgaagcaggctccgccctctgcgctacctactctggaagccggagaggacgtactggaaaccctcaagctgcgtggccatcccaacctcatcgggctgatgctcgacgactcgctgttcgccttgcgccacgctgcggcgcaggcgcgccactgcgccgcctacttgcgcagcctcaatgcactgctgccgcaccgtcccaacggacgctatgcacaggtgctgagcaacatgctcgacggcccgctcgccaagctcaggggcgaggtcgatcaggccgaactggacgaggcgatcttcgccgaggagcgacagtcttgccgaatccacctgacgcagcaggtcgagcatctggttgccctgctggaaggccccttgcacccggtgttgcaggactggacccaccagtgcgacgaagccctgctggagccctacagcctgatgagcgaggcactggctgcgctgaaccagcttcccgaccgctgcgacgcactgtacagcggtaccgcctaccgggcgctggcggcacatgtcgagcgggtggtcagcacggttctgcaggcaagccacccgcttggcgccatgctcctggccaaggacgaaggacaacttcccgagccggttcggcgcctgcaggcgctgcgcgatagcccgcggacgccggaccccgacgcaatgggcctcagcacgctgatgctgggagccagtctgctgggcgaggtcgaccagcccagcgccggcaagagcctcgcctacttcctcggcgacctgctggacgtgttcggcgccagcgtagtcgagcaactcggccggctgtcccagggtgccacccagatccagctcgaccgcttgttcgcaccgaccttcaatactctgagcgccctctcggtgaagatgaaaggtatccgcctgctgcccgacagtcaggtgccgctcgacatggttgtcgtcggcgtgcgcggagccggcctgcgcaacggtctgaccgaggtcgagcgccaggagctgaggcgcaagagctatcggcgcgccatcgttcaggacggtgccggcaatcccctggccggcaccagtccccgcgacaccggcatgagtcgcgccaacctgcgcaacgtcatggtggtggcggtacccaaggatcacccggacctgcttgcctacacgaaattccgtacgcagttaggcacgttgacccaggtgatggagaacactcgcatcgtgccgacgatgatgctggggtttgcgatttataacttgaatgtgcaggtgcaggcatacagtggctttgtagacagtggagaaaagcacagagggacgatcggggctgtcggtgcagtaatcgatttaacagccgctggaggaagccatgcaaagctgcttttcggaccatctactgcaaagtatctagaaaccccacgtatatcggtagcccaaatatcccctcgatgggccaggaatctagaagttcaaacaggcagccctaagttagggttgctacgtgggcttggtggcgcagccacactattcggtgcaggcatcagtgtatgggatggctaccgagctttgaggcagggagatagcgatgcggctgcggcctacggtgtggccgcagtgggtgggggcctttggggtgcctacgtcctaggatggatagtaaacccttatgctttgctggctggtgcggttttggcgatcggaggcactgtggtcgctaatctactgactgacagcgatgcggaaaccatcgtcaagaaaggccccttcggccggcaattcgccgaggctggcctgctcgattcgctgatgggccaggaccagcgcttcgcccatctgaaagacccgcaaacggcctatcgccaattgctgggagtcctcggccatccgcgggtctttgtccatcgcctggaagactggcgcaaattggcgccggcggcgcatcgatctgtcttgcaggaagcggaacggggtcgccaagcggtcagccgcactgcgctatcctgcatcgaccccaagttgcaggcgctggaggcaaacgattgggccgtggtgctgagttccccgctcctggccatgttcgagaatggccagaaggcgttccgcctggtggcccaggagtttctcagcagcttgccgatcgatccgggcaccctgttcggcgtcaagcgctaccatcgggtccccgcgggccccgccaagctcgaagccttgccgttggatgctgccagcgtgctctatgtgctgccggccagcctgccgattccgcagttgtctcctcgggcccgctatagcatgcgcatgacccagggtttgaagatcagcgcacagttcgaactcaatgccgaccagcctgagcagcggcttgtcctgcctcaacccagcccgaagagttggagtgcattcacatccgccaatcggtaccttcccccggacgacttgggcccccatgctgcgccaccttattggttgatagagaacagtgagttcaacgtatga

SEQ ID NO: 6273 - DNA, 1341 bp, Pseudomonas aeruginosa
agcggccgccccaggactggttggtcttctctacgctcatggtatctctcgctgcaacaagaaacggacaggccgcgcggcctgcgtgacgggcaaagtgcgacgatgatagcaggccgggaggaaaaaccggcggctcgtcgacgaagccggaacgagcgctgtttcgcggttttttgcggcagatggcatttcggtgctttatttcgcccgtacgcccgcggctgtcttgcgggcgccacgggccttgcggaaactctgtcgatgcctatccgattcaagcccggccgctcgacccggccggccgtccaagacgacttcttcattcccgagctctgcgaagccgaagccctgttcaccctggtgctgctggcggagctgctggtgctcgtgctggtgctggcggagccgatgacgccgagcttcaactgggtgcgcctggccctggcgtcgctgttcgtgcagtggatcgtactgctctcggcggcgctgttctgccgcctgcggccattgctcgcacgcctgccggtggcgctggcggggagtgcctgctgcctgttggtggtggccctcaccctgggctgcacggcggtcgccgagcactatcagctgggcggagaactgacgcgtgccggcgaggtcaatctgtatctgcggcacgcgctgatcgcgctgatcatgtccgccctggtgctgcgctacttttacctgcagagccagtggcgccggcagcagcaggccgagttgcaggcgcgcctggaatcgctgcaggcgcggattcgcccgcacttcctgttcaacagcctgaacagcatcgccagcctgatcgagctggacccgctgaaggccgagcatgcggtgctggacctgtccgacctgttccgggccagcctggcgaagcccggcactttagtttcctgggaggaggaactggcgctggcaaggcgctatctttccattgagcagtatcgtcttggcgatcgcctgcaactggactggcaggtgcacggggtgccggccaacctgccgatcccccaactgaccttgcagccgctgctggaaaatgcgcttatttatggcatccagccgcgggtcgaaggtggcctggtgcaggtcgaggcggtttatcgtgaaggagtgttccagctatgtgtgagcaacccctacgacgaggcgctcgagtcgcccccgtcgaaaggcacgcgacaggcgttacacaatatcgatgcacgacttggggcacttttcgggcctaaagcgagtctcagcgtcgagcgccgtgacggacggcactacacctgtctacgctatccatgtgcgcgactcatgcaggaagcctga

SEQ ID NO: 6274 - DNA, 918 bp, Pseudomonas aeruginosa
cgaattcgccctggaagccttccaggtcagcgccgtgggctacctggtcaagccggtgcgcagcgaagacctggccgaggcgttgaagaaagcctcgcgaccgaaccgcgtgcaactggccgcgctgaccaagcccccggcctccggcggcagcggtccgcgcagccacatcagtgcacggacccgcaaggggatcgagctgatcccgctggaagaggtgatcttcttcattgccgaccacaagtacgtgaccttgcgccatgcgcagggcgaggtgctgctggacgagccgttgaaggcgctggaagacgagttcggcgagcgcttcgtgcgcatccaccgcaacgcgctggtcgcccgcgaacggatcgaacgcctgcagcgtacgccgctggggcatttccagctctacctgaaaggcctcgacggcgatgcgctgaccgtcagccggcggcacgtggccggggtcaggcgtctgatgcatcagctctgacggcggtcggcggttcgccagcgacccgggtgcggctatcgggcccagcgtccgcgcactcgggttcgaactgttatcatgggcgcatccctgtgcacggaatatcccatgtcgtcccgcgaaatccgcatcgccactcgccagagcgccctcgccttgtggcaggccgaatacgtcaaggcgcgcctggaacaggcgcatcccggcttgaccgtcaccctgctgccgatgaccagtcgcggcgacaagctgctcgacgcaccgctggcgaagatcggcggcaagggcctgttcgtcaaggaactggaaaccgccctgctcgaaggcgccgccgacatcgcggtgcattcgatgaaggacgtgccgatggactttcccgaggggctcggcctctacaccatctgcgagcgcgaagacccgcgtga

SEQ ID NO: 6275 - DNA, 483 bp, Pseudomonas aeruginosa
cgctttcgtctcgaacacctacgccagcctcgagcaactgccagccgggagcgtggtcggcacctccagcctgcgccgccaggcgcagctgctggcgcgccggccggacctgcagatccgtttcctgcggggcaacgtcaatacccgcctggccaagctggatgccggcgaatacgacgcgatcatcctcgccgccgccggcctgatccgcctcggcttcgagtcgcgcatccgctcctcgatcagtgtcgacgacagcctgcccgccggcggacaaggcgccgtcggcatcgaatgccgtacggccgacagcgacctgcatgccttgctggaacccttgcaccataccgacacggctctgcgggtcactgccgagcgcgcgctgaacaagcggctcaacggcggttgccaggtgccgatcgcctgctacgccatccgcgagggcgaccaactgtggctgcgcggcctggtcggccagcctga

SEQ ID NO: 6276 - DNA, 894 bp, Pseudomonas aeruginosa
tggcacccagttgctgcgcgccgaggggcgggcgccactggcggacgccgaggcgctgggcgtgcgggtggccgaggacctgctggagcagggcgccgaagcgattctcgaagccgtctacggcgaggccggacatccgtgagcggctggcggctcctgctgacgcgccccgacgaggagtgcgcggccctggccgccagcctcggcgaggcgggcgtccatagcagcagcctgccgctgttggcgatcgatccgctggaagaaaccccggagcagcgtacgctgatgctcgacctggaccgctactgcgcggtggtggtggtcagcaagccggcggcgcgcctggggctggagcggctcgaccgctactggccgcagccgccgcagcagacctggtgcagcgtcggcgcggcgaccgcggcgatcctcgaggcctacggcctcgacgtaacctaccctgaacagggcgacgacagcgaagcgttgctggcgctgccggcgttccaggattccctgcgcgtgcacgatccgaaagtgctgatcatgcgcggcgaaggtggccgagaattcctcgccgagcgcctgcgcggccaaggcgtgcaggtggactacctgccactctaccggcgccgggctccggactatccggccggagagctgctggcaagggtgcgggcggaacgcctgaacggcctggtggtcagcagtggacagggtttgcaaaatctgtatcagttggcggcagccgattggcccgagataggccggttgccgctgttcgtacccagcccgcgggtcgccgagatggcgcgcgaactgggtgcgcaacgggtgattgattgccggggcgcgagcgcgccggccttgctggcggccctgacgagcgccgcctag

SEQ ID NO: 6277 - DNA, 465 bp, Pseudomonas aeruginosa
agaagctcctcggccagagccgccagcaatggcgactggccgaggccgaacacctgctgcgcctggccagcctgcgcctgtccgccttgcaggacgtgggtagcgccaccgagctggtgcagggcgccgatgacatcctgcgcgcgcagaacgatcccggcgcctatgccgcccgtgccaagctggcggccagcctcgaggccctgcgtgcgttgccggagccggaccgtaccgggctgttcgtgcaactggcggcgttgcgcgagcaggtcaaccagttgcaaccgctcacgccgaccttcaaggaaggcgaaagcggtgccagcaatgtcgcctggggcgacggcaacagcacctgggagctgtggtgggagaagatctcgcgctacatccgcatcgacttcaatgccggccaggacattcgtccgctgctggccggcgagcaattggcgcaggtgcgcctga

SEQ ID NO: 6278 - DNA, 957 bp, Pseudomonas aeruginosa
gcgccttgcagtcgtacgtgtcgcgccgcgaggccgccggcaacctggtgcccgaggcgcaggcggctccggccacggagggccgtccatgagacgcatctacctcctggttctggcggtggtgctggtcgccacgctggttgggctggcgatctccgagcaggccggctatgtgctgatcgcctacaagagcttccgttacgaatccagcctgtggtcgttcctcgccctgctggcggtggtctggctgctggtggtgctggtgcgcctggtcctgcgcctgctcggcagctcggggcgggtggtcaacccctggtcgcgctacaaccgccggcgtcgcgtgcagatggccgagcacagcggcctgcgcgatctcggcgaaggcaactggccgcaggcgctgcgtcatttgcggcgggctgcggagatgggcgagcggccgctgatgcattacctcggcgcggcgcgggccgccaacgaactcgagcgctacgacgaggccgacgacctgctgaaccgggctcgcgagcgcgagccggatgcccaattgctggtcggcctgacccgtgcgcaactgctgatcaatcgcggcgactacccgcaggcacgcaataccctcgaagagctgcacgggctccagccgcagcaccgcacggtattgcggctgatgcagcagctgtacgtcacccagcacgactggcaggccctttgcgtcctgctgccggagctgcgcaaggagcgtgtgctgaaggattccgaactgcgcgacctcgaacgccgtgcctgggtggcttccttgcaggaagccggcgagcgtggactgaacgagggcgaaacggcgttgcagccgctgacccagcgctggcagaacgtgccttcggcgctgcgtgcagacccggcgatcgtcgcgggctatgccgcccaactgcttcgcctgggcgccgaggaagaggctga

SEQ ID NO: 6279 - DNA, 450 bp, Pseudomonas aeruginosa
agaagtcctccgccatgcgctcaagcaaggcttcgacgcgaccctggtgcaactctacgggcaggtgcgcgggcgcgatccgggcaagcaattgcaggccgcggaaggttggctcaaggaacatccgaacgatcccggcctgctgctgaccctggggcgcctgtgcctgatcaacaagctctggggcaaggcccgggaatacctggaggccagcctgagcttccagcgcagtgccgagacctgcgccgagctgggacgcctgctggcgcagctcggcgaggtcgagcgcagcaaccagttgttccaggagggcctggtcctgctcgatcggcgtactccggggctgcccgtggtggtggcggggatttgagcatggggaacgccacccggcgttccccgttcggctccatcggcaggactgtggcggcttgtcgcgggcgcccggcatga

SEQ ID NO: 6280 - DNA, 525 bp, Pseudomonas aeruginosa
gcggcctttcccctgtgtacctgtggatccgccatgcccctggccagcccccgtcagcttttccttctcgcgttcctggcctgcgtcgccatcatgggcggggcgctgtacctggaacatgtggttggcctggaggcctgcccgctgtgcgtcgtgcagcggatcttcttcatcctgatcggcctgacctgccttgctggcgcgatccaggggcccggcctgcgtgggcggcgtatctactccgtgctggtgttcctgctcgctctcggcggcggggccacggccgcccgccaggtatggttgcagaccgttccgctggaccaactgccggcctgcctgcccagcctcgactacatgatgcaggcgcttcccttccaggaagtgatccgcctggtcctgcatggcaccgcggattgtgcccaggtgagctggacgctattcaccctgagcattccggaatggagcctgctggcgttcgttgcctatctcggcttctccatcgtgcagttcctccgacgtgcctga

SEQ ID NO: 6281 - DNA, 519 bp, Pseudomonas aeruginosa
ttctccgggacgtccgaagagggaagcgaggacaacatgctcgaaagctgccgtaatgcccaagagcggtgggggggtgtgcaccaactgatcgatcgctggctgcatgagcgccagcaactggtgcaggccttcgatgccctgagcggtattcaggcaccggcgcccaacgccgaagaactccagcatttctgccaattgctgctggactatgtatctgccggacacttcgaggtctacgagcaactgacggcggaaggcaaggccttcggcgatcagcgcggcctggagctggccaagcagatcttcccccggctggaagccatcaccgaatccgcgctgaacttcaacgaccgctgcgacaacggcgattgccgtgaaggagcctgcctcatcgcggagctgaaggtcctgcggcaacagttgcacgaacgcttcgagctggaggactgcctcatcgaagtcctgcacaacgcccacagccagagcggcgcagagggttcggcagtaccggtctga

SEQ ID NO: 6282 - DNA, 1200 bp, Pseudomonas aeruginosa
aaaggcggcgcggcatgcggtttctccaaacgaatcggcgggcaatcctggcgcacgtcgcttgtagcacatcgaacccgttggcgagagggggtgtgcgggtctagtatgggcgcaaccacgtccgcctggaggcacgtcatgtcggccaacaagaagcccgtcaccacccccttgcacctgttgcagcaactttcccacagccttgtcgagcacctggaaggtgcgtgcaaacaagcgctggtcgattcggaaaagctcctggccaaacttgaaaagcaacgtggcaaagcccaggaaaagctgcacaaggctcgcaccaagctgcaggatgctgccaaggccggcaagaccaaggcacaggccaaggcgcgcgagaccatcagcgacctggaagaggcgttggataccctgaaggcccggcaggcggacacccgtacctacatcgtcggcctcaagcgtgacgtacaggaaagcctcaagctggcgcagggtgtcggcaaggtgaaggaagctgctggcaaggctctggagagccgcaaggcgaaacccgcgaccaaacctgctgcgaaggcggcagccaagcctgcggtgaaaaccgtagcggcgaagcctgcggccaagccggctgcgaagcctgctgcgaaaccggcggccaagcctgcggcgaaaaccgcggcagcgaagcccgcagccaagccgacggcgaagcctgctgcgaaaccggcggccaagcccgcggcgaaaaccgcagccgcgaagcccgcagccaagccggcggcgaagcctgtggcgaaaccggcggccaagcctgcggcgaaaaccgcagccgcgaagcccgccgccaagccggcagcgaagcctgtcgcgaaaccgacggccaagcccgcggcgaaaaccgcagccgcgaagcccgcagccaagccagctgcgaagcctgcggcgaaaccggcggccaagcctgtggcgaaatccgcggccgcgaagcctgcagccaagccggctgcgaagcctgcggcgaaaccggcggccaagcctgcggcgaaacccgtagccgcgaaacctgccgcaaccaagcccgccaccgctcctgctgcgaagcctgcggcgactcccagcgccccggcagccgcctccagcgctgcttcggcaacgcctgccgcgggcagcaacggcgccgccccgaccagcgcctcctaa

SEQ ID NO: 6283 - DNA, 402 bp, Pseudomonas aeruginosa
ggcgctgtctgcaaagccgccgagccaagcaccagcaaagcccggcgctctgcttccgtgcagatgtcccggctgcaggcttgcagccaggcatccgcactgcgattcgcttcctggccctccagccaggctgtggccaggtcggccaggcgttgcaggtgttcccgttccgctcgtagttcctgggccttcatttcctcgcggagttcggccaggcaggcgtcgtgggttgccgcttcgcgccaggcgcaacgcaatctgcgcaggggttcgatgaccgtttcgcgccagggacgcgcggcgttctccaggatctgggcgcgttctttcgagcagctcacaccgcgcctgccaagccaggcggcgaccagcaacaggcagacgtccgcaccttgctcctga

SEQ ID NO: 6284 - DNA, 408 bp, Pseudomonas aeruginosa
ccctgcacgccggccagaaagccggtctcatcggggccaatggcgctggcaagtccagcttgttcgcgctgttgcgcggccagctcgggcaggatgccggcgactgcctgttgcccgccgactggcgcatcgcgcacatgcgccaggaggtcgataccctggatcgcctggcggtggattacgtgctcgacggcgacagtcgcctgcgcgagatccaggcggcgctggccgtcgccgaagcggcgcacgacggttctgccctggcgcgcctgcataccgagctggacaacgccgacggttataccgccgatgcacgggcgcgcaagctgctggccgggctcggcttcagcagcgagcagatggagcgccgggtcggtgatttctccggtggttggaggatgcgcctga

SEQ ID NO: 6285 - DNA, 402 bp, Pseudomonas aeruginosa
cggcaagatcgtcgaccccagcgaataccaggaacaggtggagttcgtcggcaacctgcaggcattggtcctgaccctgccgatgcgccccgagcgcgccgagctggagaggggcgtcgccagcctgcgccaggccatcgagcagcgcttgccgggaagggacgtggccctccaggcgcgcaacctcgaggcacgggtggcggatatctaccaggtggtgcagacccccgcgatcacccccgacccgagccgcgcggcgccgatctatgcccagcagtgcgcgatctgccatggcgatgcgggcaagggcgacggccccgccggcatcggcctggaaccgccgccagcgaacctcaccgatcgccagcgcctcgaccacctgagcctctacgacctgcgtaa

SEQ ID NO: 6286 - DNA, 1245 bp, Pseudomonas aeruginosa
cgtcatcggcctgggcgtggccggcaccgacatgccggcgttcgccgaccagctcgacgaacgccagcgctgggacctggccagctatgtggccggcctgagcgccggcagtgcgcagccggacaaggcccatgcctacccgctggcgaccctggccacgcagactccggccgaagtcgccgagcacgacggcgaggccgctgcggagagcttccgcgccctgcgtgcgcatccgccgctggagcagcgcggtcctgggcagttgatcgactataccgccgccaccctggacaagagcttcgcggtctatcgcgaaggcgaccgcgaccaggcctacgacctgtcggtggcggcctacctggagggcttcgagctggtggaaagctcgctggacaacgtcgacgccgatttgcgccgctccaccgagaagcagctgatggcctaccgccaggcgttgcgcgatggcctcccggaaacccaggtggcgcaacagctggagctggccaagggcaagctggcagaggccgccaagcagcttggcggcgactcgctgagtttctccatcagtttcgtttccgccttgttgatcctgttgcgcgaaggggtagaggcaatcctggtgcttgccgccatcctcgccttcctgcgcaataccgggcaggaaagtgccgtgcgtggcgtgcacgtcggctgggggctggccttcgtcgccggtttcgccacctgggcgttggccgcctatgtgatcgatatcggcggtgcccagcgcgagctgatggagggcttcacctctctgttcgcctgcgtgatggtgctctggctcggcgtctggatgcacgaccgccgccacgcggcagcctggcaggactacatccgcagcagcctggtgggcggtggcggacgcttcggcttcgcagtgctggcgttcttctcggtctaccgcgagttgttcgaggtcatcctgttctacgaaaccctctggttgcaggccggaccggccgggcacaatgccgtgatcggcggcgcggcgaccgccgtggtcctgctgatcggcctggcctgggtgatcctgcgtggttcggcgaaactgccgctggggttgttcttcagcatcaacgcggcgttgctctgtgcgctctcggtggtgttcgccggacatggcgtcatcgccttgcaggaagccggggtgatcggcacccgtccggtgccgttcttcgacttcgactggctggggatcaaggctga

SEQ ID NO: 6287 - DNA, 735 bp, Pseudomonas aeruginosa
ccgccaggcgttcgccaacgccctggatcgcctgctcacccgcctgcagcgggaagccgatctacgcgcgagtcagccgcacagataggtaccggtaccgacggcgaccagcgtgccgtcgttgctatgcagttccgagcgcaccactgcgaccttgttgcccgagcgaagcggcaccgcatgggcggtgaacgtccggccgcgtcccgggcgcaggtagtcgacgcgcaagtcgatggtgccgagtttcgacagccgcgccatgcgctcgtggcctggcagttcgcgatgccgttcgagggcgccgatcagggccatcgctccgccggtgacgtcgagcaggctggagatcaccccgccgtggagaatgccctgaacgaagttgccgatcagttcgtccttcatcggcaggtcgaggactacccgctcgcggccgaggctcaccacgcggatgccgagcatgcggttgaaggggatgcgctggaagaaatccgccaccagttggtggacgtcgtcaggcagggcgggggagggcgtttcgcgcatcgcggcgtctcgactcgatggtttcgagacgcacgctggcgtagcggcacggatttgaaaagggcggcggcgcgaccgccctcgtgcttggccgatcaggccttgtcctggtccaccagttcgagcacccggtcgaccagcttgttgatcccggaagcggcttcggctatcgactgggcgagcatgtag

SEQ ID NO: 6288 - DNA, 2211 bp, Pseudomonas aeruginosa
atgaatacgcagcaaggacttgatgagatcgaacgtatcgccgccgacgaaaccgtagtggcgaacgtggaaagcgaagcagaagtgaagatggccgaaacgatcccggtggaaacgccacctgcggtggttcccagcgtggatgacagcagcctgtacattcatcgcgagctctcccagttgcagttcaacatccgcgtgctggagcaggcgctggacgagtcctacccgctcctggagcggctgaagttcctcctcatcttctcgagcaacctcgacgaattcttcgagatccgcatcgccggcctgaagaagcagatcaccttcgcccgcgagcaggccggcgccgacggcctgctgccgcaccaggcactggcgcggatcagcgagctggtccacgagcaggtgtcgcggcagtaccggatcctcaacgagaccctgttgccggagctggccaagcaccagatccgcttcatccgccggcgtcactggacgctgaagatcaagacctgggtgcggcgcttcttccgcgacgagatcgcgccgatcatcaccccgatcggcctcgacccgacccacccgttcccgctgctggtgaacaagagcctcaacttcatcgtcgagctggaggggatggatgccttcggccgcgactccggcctggcgatcatcccggcgccgcgcctgctgccacggatcatcaggctgccggaagacgttggcggcgagggtgacaactacgtgttcctgtcgtcgatgatccacgcccacgccgacgacctgttccccggcatgaaggtgaagggctgctaccagttccgcctgacccgcaacgccgacctgtcggtggacaccgaggatgtcgaggacctggcccgcgcgctgcgcggcgagctgttctcgcgtcgctacggggatgcggtacgcctggaggtggtggatacctgcccgcagaacctgaccaactacctgctcaagcagttcggcctgtccgaaagcgagttgtacaaggtcagcggcccggtcaacctgacccgcctgttcagcgtcaccggcctggaaagccatccggagctgcagtacccgcccttcaccccggcgatcccgcgtcttttgcagaagaaggaaaacctcttcaacgtcctcagcaagctcgacgtgttgctgatgcacccgttcgaatccttcaccccggtgatcgacctgctgcgccaggccgccaaggatccgaacgtgctggcgatcaagcagaccctgtaccgcagcggtgccaactctgagatcgtcgacgccctggtcgaggcggcacgcaacggcaaggaggtcaccgcggtgatcgagctgcgcgcccgcttcgacgaagagtccaacctgcaactggccagccgcctgcaacaggccggcgcggtggtgatctacggcgtggtcggcttcaagacccacgccaagatgatgctgatcctccgtcgcgaggacggcgaactgcgccgctacgcgcacctgggcaccggcaactaccatgccggcaacgctcgcctgtacaccgactacagcctgctgaccgccgacgtggcgctctgcgaggacctgcacaagctgttcaaccaactgatcgggatgggcaagacgctgcgcatgaagaagctgttgcatgcgccgttcaccctgaagaagaacctgctggaaatgatcaaccgcgaggcggcccaggcggcgctcggccagcctgcgcacatcatggccaaggtcaactcgctgaccgatccgaaggtcatccgcgccctgtacaaggccagccaggccggggtcaggatcgacctggtggtgcgtggcatgtgctgcctgcggccgggcatcccgggggtctcgcacaatatccacgtgcgctcgattatcgggcgcttcctcgagcacagccgcatctactacttcctcaacggcggcgacgagaagctctatctctccagcgccgactggatggagcgcaacctcgacatgcgcgtcgagacctgcttcccggtggaaggcaagaagctggtgcagcgggtcaagaaggaactggaaacgtacctgaccgacaacacccaggcctgggtgttgcaggccgacggtagctaccagcggctcagtcccaccggtaaccagaacccccgcaatacccaggcgaccctgctggagaagctggccgcgccggtgcttaccgcacgttga

SEQ ID NO: 6289 - DNA, 447 bp, Pseudomonas aeruginosa
gccattcggcttcctgggcgaagtcggcctgggtcagcgggttggcttccagccagccctcggggaaggtcaccgaaaggctcttgggctctgccttcagacgcaccgagggcatttcctgggtgccgcgaatgtggtggaagaggatcgcgaagcgcagcacgatgcacaggcgtaccagcttgtcgccttcctcggcgaactccgccagcttgtccgccggaatgttgcggcggtggccgcgtaccagtagcgacagcatctgctggtcctggcgcgagaagccagccaggtcggagtgctcgatcaagtaggcgccgtgcttgtggtagtggtaatgggcgatgtccaggccgatctcgtggacccgtgcgccccagctcagcaggtcgcggtgcagttcgccgttcagctcccaggcgtcgccgacttcggcaagcaccttga

SEQ ID NO: 6290 - DNA, 1989 bp, Pseudomonas aeruginosa
atgtcgagcctgccttatcgaagagatatcgatggattgcgcgcactggccatcttgccggtggtgttctatcacttgggcttgggcggtttcaccggcgggtatgtcggcgtcgatgtctttctggtgatttccggctacctgatcacttcgatcatccggcgcgatcggcaggccgggcgtttcagcttcgtcgatttctgggctcgccgggcgcgacgcatcctccccgctttgttcgttatgatggccgtcagcctggcggccggctggttcctgatggagccgcgggactacgagcaactgggtcgtgcggtgcgttaccagacgatgttcgcctcgaatatcctgttctggaagcaggatggctatttcgacgccgcgtccgaattcaagccgctattgcatacctggtcgttgtcggtggaagagcagttctacattctcttccctctactgctggccgcggtctccgggcgtctgctgcgctggcggctcgccatcctcctcgcggtcctggcgctatcgctggcggccagcgtctgggcggtgaaccagcgacctggcagtgcattcttcctcctgccgatgcgcgcctgggaactcctggcgggtgccgcgctggcattgctgccgggcggtagccgcggtcattcgcagtggtccctgcaactggcggccaccctcgggatagcggcgattctcctgccggtgttcttctacgacagcgacactcctttccccggcctcgcggcgctgccggcggtgcttggcaccgccctgctgatctgggccaacggcgccggcgacacctgggctcgccgcctgctgggctggcaaccgctggtctggttcggtctgatctcctattcgctgtacctctggcactggccgttgtacgtcttcgtccagtaccacgcactggagaccctgggcctgccggcacgcctggggttgctggcggcgagcatcggcctggcggcactgtcgctgtactacgtcgaggcaccgttccgcgagcgcaagctgttcgccgggcgccggcagatgcttggcgcggcgctgtgcagcttgctgctgctgggagtcgtcggccagttggtgcggcattacgacggcgtgccgtcgcgtctttccgaggaagccttgcgttatgccaaggcgtccaagtggcgcgatgggcagaccgactgcatgttcgacaagaaggcgctcagtcaggaaagcatctgccgcttcccggcggaactggctgccgaacgaccgctgctggtcagttggggcgacagccattccgcggcgttgagcccgctgctgcgcgaactggctgccagtcgccgggtgccgatctggcaggcttcgctggcgggctgtccgccgttgctggggatgctggaaaaggacaattgcctgcgtttcaaccagcagatgctcgagttcgtcgaacagcagcggccgggcggggtgatcctcgccggacgctgggacatgtatgtctacggcgactcgcaggacggtacccgcaacattctccgcgagccggacgacacgccggacagctcgatcgccgaggcgctgctgcggcaacgcctgagcgggatgatcgaaaggctgaacgcggccgacgtacatgtctggctggtcaaggacgtaccgctgctgccattcaaggcaccggcgcggctggtgcggctgagtctgagcggggaggatgtcgggcgcgcacgttttcccttcgctgagcacgctgcgcgcgtcgcctacgtgaatgcgctgttcgatgcgctggccgaaggcaacccgcgggtgagcgtgctcgacccctccagcgtgctctgcgatggcctggattgtttcgccgaacgtgatggctggtcgctgtacatggataacaaccacctttcgacccagggggcccatgaactcgggcctttgttcgagccgatgctacagagcctcgacgactcgaggatcgccagccagcagtga

SEQ ID NO: 6291 - DNA, 1479 bp, Pseudomonas aeruginosa
atggttaggctaatgacgttcaaggatctccgcgatttcatcgcccagttggagcagcgcggtgcgttgaagcgcatccaggtgccgatttcccccgtgctcgagatgaccgaggtgtgcgaccgcacgttgcgcgccaagggcccggcattgctgttcgaaaagccgaccggcttcgacatgccggtgctcggcaacctgttcggtacgccggagcgcgtggcgctgggcatgggcgccgaggacgtcggcgcgctgcgcgagatcggcaagctgctggcgcaactcaaggagcccgagccgccgaagggcctcaaggacgcctgggccaagctgccgatgtacaggaaggtcctgtccatggcgccgaaggtgctcaaggacgccccctgccaggaagtggtcgaggagggcgaggacgtcgacctcggccggctgccggtccagacctgctggccgggcgatgtcgggccgctgatcacctggggcctgaccgttacccgcgggccgaacaaggaacggcagaacctgggcatctaccgccagcaggtgatcggccgcaacaaggtgatcatgcgctggctcagccatcgcggcggcgcactggactaccgcgagtggtgccagaagcatccgggccagccctatccggtagccgtggcgctgggcgccgatccggcgaccatcctcggtgcggtgacgccggtgccggacaccctttccgaatacgctttcgccggcctgttgcgcgggcatcgtaccgagctggtcaagtgtcgcgggagcgacttgcaggtgccggccagcgccgagatcgtcctcgaaggggtgatccaccccggcgagatggccgacgaaggtccctatggcgatcacaccggctactacaacgaggtcgatcgcttcccggtgttcaccgtcgagcgcgtcacccgccggcagaaaccgatctaccacagcacctacaccgggcgtccgccggacgagccggcgatcctcggggtggcgctgaacgaagtgttcgtgccgatcctgcagaagcagttcccggaaatcgtcgatttctacctgccgccggaaggttgttcctaccggatggcggtggtgaccatgaagaagcagtacccagggcacgccaagcgcgtgatgctcggggtctggtcgttcctgcggcagttcatgtacaccaagttcgtcatcgtcaccgacgatgacatcgatgcgcgcgactggaacgatgtgatctgggccatcaccacgcggatggaccccaagcgcgacacggtgatgatcgacaacacgcccatcgactacctcgacttcgcctcgccggtctccggcctcggctcgaagatggggcttgatgccacccacaagtggccgggcgagaccagccgcgaatgggggcgcgccatcgtcaaggacgaagcggtgacacggcgcatcgacgcgctctggtcgagcctcgggatcgactga

SEQ ID NO: 6292 - DNA, 486 bp, Pseudomonas aeruginosa
accccgggcttgggcccggccgagagtctggctatgcttgccggcattcgtcgaggagatgcgcccgtgagaacccccattgccctgtcgctggccctgtgcctgagtctgttcccgtcgttcgcctcggccgaggaggccgcgccggaaggcgagggcgcgaacaagccggtctacgtcgacctgaccccggcgctggtcggcaactacggcagcgggccgcgcctgcagtactacaaggccgacatcgccctgcaggtggccgacaaggacgcggcgaccaaggtcgagcatcacgagcccttgatccgcaaccagttgatcatgctgttcgcccagcagaccgaccagagcctgggtacggtcgaggccaaggaaagcctgcgccaggaggcgctgaagcaggtccagcagaccctcgagcaggaagagggcaagccgctggtgaccgacctgctgttcaacaacctcatcgtccagccctga

SEQ ID NO: 6293 - DNA, 1614 bp, Pseudomonas aeruginosa
tgttccgggtcaaggcgcggctcgatccggcgctgctggaaaaatacatcacctacgtcaagaccggcgtgcccggaatggcctacctgcgactggaccctgaggtcgagtggccggccaacctgcagatcaaggttccgcaatgaccgctggcgggagcggcgtggcgagcctccggggcgtttcgctgcgctacggcgagacgcgcgcggtggacgacgtcagcctggagatcccggccaaccgcatggtcggcctgatcggtccggacggggtcggcaagtccagcctgctggcgctgctggccggcgcacggaagatgcaggatggcgagatccgcgtgctcgatggcgacatgcgcgaccgccgccaccgccgggcggtctgcccgcgcatcgcctacatgccccaggggctgggcaagaacctctacccgacgctctcggtgttcgagaacgtcgacttcttcggtcggctgttcggccacgacaaggccgagcgcgagcggcgcatcgccgacctgctgcagagcaccgggctggcgccgttcgccgagcgtcctgcgggcaagctgtccggcggcatgaagcagaagctcgggctgtgctgcgcgctgatccacgatcccgacctgctgatcctcgacgagccgaccaccggcgtcgacccgctgtcgcgcaaccagttctgggagctgatcggccgtatccgcgcgggccgcgaaggcatgagcgtgctggtcgccaccgcctacatggaggaagccgagcgcttcgactggctggtggcgatggacgacggaaaggtcctggccaccggtacgccgcaggagttgcgcgagcgtaccgggacgcagagcctcgagtcggcgttcatcgccctgctgccggaaagcaagcgcgccggccaccatcgattggtgatcccgccgcgaccgcagagcgaaggcgcgccgcggatcgccatcgaggccgagggcctgacctgtcgtttcggcgacttcgtcgcggtcgatcacgtcagcttccgtatcgagcgtggggaaatcttcggctttctcggctccaacggctgcggcaagtccaccaccatgaagatgctcaccggcctgctgccggccagcgaaggcacgtgcgcgctgttcggccagccggtggacgccagcgacatggcgacccgtcgccgggtcggctacatgtcccaggccttttccctgtatgccgagctgagcgtgcggcagaacctggtgttgcacgcccggctgttccacctgccggcggatggcatcccggcacgggtcggcgaaatgctccggcgcttcgacctggagaaggtggccgacgagctgcccaacgacctgccgctgggcattcgccagcgtctgtcgctggcggtggcggtgatccacaagccggaaatcctgatcctcgacgagcccacttcgggggtcgacccggtggctcgcgacggcttctgggagctgatggtcgagctgtcgcgccgcgacggggtgaccatcttcatttccacccacttcatgaacgaggctcagcgctgcgatcgcatctcgctgatgcatgccggcaaggtactggccagcgatactcccgatga

SEQ ID NO: 6294 - DNA, 2136 bp, Pseudomonas aeruginosa
  unsure (235): Identity of nucleotide at the above locations are unknown.
ccagaccaccaccagccaggcctacgcgctgaacatcgccggctcgcgctatttcgtcgaacatgcgccgatcaccgacccggacgacctcgaccggcgcctgcgcagcggcgagctgagcctggcggtggagattccgccgaacttcgggcgcgatctcaagcgtggctccgatccggccatcggcgtgtggatcgacggagcgatgccgacccgtgccaacaccgtgctcggntacgtgcaggccctgcacaccagtacctggcggcacttctcgcgccaggcgggtggggccgaggccagcgcggcggccagcaccgaggtgcgctatcgctacaaccccgacgtggaaagcctgaaggcgatggtgccggcggtgatcccgctgctgctgatcatgatcccggccatgctcaccgccctcggcgtggtgcgcgaaaaggaactgggttcgatcaccaacctctatgtcaccccggtgacgcgcctggagttcctggtcggcaagcagctgccctacgtcgccatgggcatgatcaacttcctgctgatgctggtcctggccatcgtggtatttcgcgtgccgctcaagggcagcttcctggcgttgaccatcggcgctttcctctatgtggtcaccagcactggcctcgggctgttcctctcgacgttcatgcgcagccagatcgccgctgtattcggcgtggcgatcgccaccatgatcccggcgatccagttctccgggctgatccacccggtgtcctcgctggagggtgcggcggcctggatcggcaagctctatccgacctcgcatttcctggtggtcagccgcggcgccttttccaaatcgctgggcctgtccgatctctgggcctactacctgccgcttgccgcttccatcgtggtgctgaccctgctcagcgtggcctgcctgaagaagcaggaggactgagcgatgcgcagcctggccaacatcttcaacctgggcatcaaggagttccgcagtctcggccgcgactacgcgatgctggcactgatcgtctgggccttcaccctgggcgtctacagttccgccaccggtattccggaaaccttgcatcacgcgccgatcgcggtggtcgacgaggaccgctcgcagctctcgtcgcgtatcgtcaatgccttccagcccccatacttccggccgccggaaatgatcggtcatgccgagatggatcgcggcatggacgtcggcctgtataccttcaccctcgatatcccgccggacttccagcgcgacgtgctcgccgggcgcaagccctcgatccaggtcaacgtcgacgcgacccagaccgggcaggccttctctggcgcgggctacatccagaacatcgtcgccaccgaggtgcgcgaattcgtcagccgctaccgcgcggagccgagcatgccggcgcagatcgaggtgcgcatggaattcaacccgaacctgacccaggcctggttcggtggggtgatggaagtgatcaaccagatcactatgctgtcgatcatcctcaccggcgccgcgctgatccgcgagcgcgagcacggcaccgtcgagcacctgctggtgatgccgctgtcggccttcgagatcatgatggccaaggtctggtcgatggggttggtggtgctggtggcggcggggctctcgttgcagtgggtggtgcgtggctggctggacgtgccgatcagcggctcggtgggactgttcctgctcggcgccggattgcatctgttcgccaccacctccatgggcatattcctcggcacggtggcgcgttcgatgccgcagctcggactgttgaccatcctcgtgctgctgccgctgaacatcctttcgggcggcaccacgccacgggaaagcatgccggaactgctgcagaacatcatgctggcggcgccgaccacgcatttcgtcagcctggcccaggcgatcctgttccgcggcgccggtttcgacatcgtctggccgcagttcgccggtatcgtggtgatcggttcggcgttcttcttcggcgcgctctggcgtttccgccggaccatctcgcagatggcctgagcgatggcttcagcgtttcgccagcggcaggatcgcctgccattcctcggcgctga

SEQ ID NO: 6295 - DNA, 513 bp, Pseudomonas aeruginosa
gatcgtccccggtcggggccaatgccccggctgggccggcgcgccggcaaccggtcgcatggtcttgccggggcgggcggtgctaggataaccatcttcatttcacgtgtagcgccccaatggcgcccagccgtcagggtcccgagatgtccactcagaattccgcctacagcgccttttactcccttctcgccgaggcggccatgccggtctcgccggccgaactgcacggccatctgctgggtcgggtctgcgccggcgccggcttcgacgaggccgcctggcaacacgctgccgccgaactgctcggcggcgcgccgggcgaacgactcaaggccgcgttgtccggcctgctcggcatggtccggcaggacttttccgccggcgaggtcgccgtcgtcatgctcctgcccgacgacgaaaccccgctcgcccagcgcaccgaggcgctcggccaatggtgccagggtttcctcgccggtttcggcctcaccgcccgcgaaggcagcctga

SEQ ID NO: 6296 - DNA, 1221 bp, Pseudomonas aeruginosa
tggccgcggccaagagcgaggcagcctgaggtgacgatgagcaaggtcaacctggcgatcatcggcgggggcctggtcggcgcctcgctggcgctggccctgcaggccggcgctcgggagcgcggctggtcgatcgtgctgatcgaacccttcgcccccggcaatgcctaccagcccagctacgacgcccgctcttcggcgctgtcctacggcagccggcagatctacgagcgactcggcctgtggccggcgatcgccgagcgcgccgagccgatcctgcatatccatgtttccgaccgcggccgcttcggcgccacccgcctgaccgccatcgaggaaggcgtgccggcgctgggctacgtggtggagaacgcctggctcggccagtgcctgtggaaggcgctcgaccccgaggtggtgcgctggcactgcccggccgaagtgaagaccctggaagcccgggagggcggttaccggcttaccctcgacgacgagacgcaactcgattgcgagctggcgatcctcgccgatggcggtcgttccgggctgcgcgaacaacttggcatcgccgtggagcagacgccgtaccggcagactgcgctgatcgccaacgtatcgccctccgaggcgcacctcgggcaggccttcgagcgcttcacccccagcggtccgatggccctcctgccgttgccggataaccgttgcgcgctgatctggacccgcccaggcaaggacgccgaacgcctgcgtggcctcgatgacgcggccttcctcggcgagctgcaggctgccttcggctaccgcctcggcgccttccgccaggtcggcgcacggcactgctaccccttgcacctggtcgaggcccgcgagcaggtgcgtccgcacctggtggtgctgggcaacgctgcgcacagtctgcaccccatcgccggccagggcttcaacctgtcgttgcgcgacaccctggcgctggtcgacgccctgctccacgacgacgcgccgctgggcgagttcgccgtgctgcagcgctacctcgatgggcagcgcctggaccagcagatgaccgtcggcttctccgaccgggtgacccggctgttctccaacgaccgcgcgctgctcggcgccgggcgcaacctcggcctgctcgggctcgacctgctgccgccggccaagcgctggttcgcccgccaggccatgggcctcggcgcgcggccgctgtag

SEQ ID NO: 6297 - DNA, 957 bp, Pseudomonas aeruginosa
cgccatgccggtctggtcgagggcgcgcaaggcccgcctgctgcgcttcgccatgaatctctacccgcccttcctgggggcgggcatccgtgtgcggcacatcgctggcgatttccgcgaggttcgggtgcgcatgggcctgaaccggctcaatcgcaactatgtatgcacccagttcggcggcagcctctacgcgatgaccgacccgttcttcatgctgatgctgatggagaacctgggccgcgactacgtggtctgggacaaggcggccaacatcgagttcgtcagcccgggcaagggcccggtgcatgcgcatttcagcatcgaccagaagctgctcgacgaggtccgcgagcggaccgccggcggcgagaagtacctgccccggctgcacgccgaagtgcgcgacgacgccggcaccctggtggcgcgggttcagaaaaccctgtacgtgcggctcaagccgcgcctgcggaacgcggcctgaagagggcccacgagtggagaacgaggatatgcacgcggatctggtcatcgtcggcgccggcatggtcggtagcgccctggccctggccctggagggcagcggcctggaggtgctgctggtggacggcggctcgctcgacgtggcgccgttcaagccggaggcgccctacgagccgcgggtcagcgcgctgtccgaagccagccggcggattctccagcgcctgcatgcctgggacggcatcgtcgcgcgccgcgccgagccctatcgcgagatgcaggtgtgggatggctccggcaccgggcggatcggcttcagcgccgccagcgtgcacgccgaggtactcggccatatcgtccaaaaccgggtggtgcaggacgccctgctggaacgcctgcacgattccaccaccggcctgctggccaatgcgcgcctggaacagatgcgccactccggcgacgactggctgctga

SEQ ID NO: 6298 - DNA, 732 bp, Pseudomonas aeruginosa
ggaacgcagcgcaaccgcagagaaacagcgcgaggcgggggaaaccctgggacgaattcatggaacgctctgcctggacgagaaaccccctgttataggggcgctcccgacgggctggccaataccgattcaggaccgatcgataccgaggaaccgcatgctcgacctacgccgcctgcgctgcttcgcagccgttgccgaaaccctgcatttcggccgcgccgcccagcgcctgcacatggcgcagccgcccttgacccggcagatatccgcgctggaggaagagctgggctttcgcctgttcgaccgctccagccgggcggtgaccctcaccgccgagggcagcctgttcctgccttacgcacgcgccctgctggaccaactggagcgcaccgccggcttcgcccgcaagctggcgcaggggctggccggccacctgaccctcggctacgccagctccatcgccctgtcggacctgttcaccgaggcgatccgactgttccgcgagcgccatccggaggtgcaactggagctgctcgaaggcgcttcggcggcgcaatgggcgcagatcgccgaaggcggcatcgatgtggggctggggcgcctgccgccgccggaaggccaggtcggcatcgaggtgctggccctgggcggcgagccgctggtggtggccgtgcccaacggcgatccgctggcgcggcaagagcggatcgacctgtacgatctgcgtga

SEQ ID NO: 6299 - DNA, 1710 bp, Pseudomonas aeruginosa
tggaccgcgccggctggaactgaccgccggttatactcggcgccccggctcgtccgagcggggcgtcgttcgttccgcaccgaggatttcgtggcccatcccgctccccgccgctggtaccccatcaccttcaccgttgccgcgctggtgctgctgccgctcagcgtgctgctgctgagctggctggagatcgaccgggaaatctggagccacctgtgggatacccagttgccgcgcctgctcggcaacaccctgaccctggtgctcggcgtcggcatcggcgtgactctactcggggtcagcctggcctggctcaccagcctctgcgaattccccgggcggcgctggctggactgggcgctgatgttgccgttcgcgatcccggcctacgtcctggcgttcgtcttcgtcggcctgctggatttcgccggaccggtgcagagcctgctgcgcgagtggttcggcagcggcctgcggttgccgcgcgtacgctccaccggcggggtgatcctggtcctggtgctggtgttctatccctatgtctacctgctcgcgcgcagcgccttcatcgcccagggcaagggcctgatggaagccgcgcgggttctcggcctgtcgccctggcaggcgttcctgcgggtcgccctgccgatggcgcggccggcgatcggcgccggcctggcgctggcggtgatggaaaccctggccgacttcggcgcggtatcggtgttcaacttcgacaccttcaccaccgccatctacaaaacctggtacggcttctacagcctctccagcgccgcccagctggccagcctgttgttgctcggggtatgcctggtgctgctcggcgagcgccacacgcgaggccgagccaaggccgccagcgagcgtccgcgcggcgcgccgctgtatcgcctgcgcggcgccagggcgctggcggcgagcgcctggtgcgggctggtgttcctctgcgccttcgtgattcccgtggcgcaactggttgtctggttctggcgccagggccgtttcgacctcgacgagcgctactgggacctgatcggccataccctgacgctgggcggcatcgccgcgctggcgacggtcgccgtggccctgctgctggccttcgccgtgcgcctggcgccgactcgcgctatccgcggcgcggtgggcctgggcaacctcggttatgcgctgccgggctcggtcctggcggtttcgatcatgctggccttcagctggctggacaatcactgggtgatcccgctttccagcgccctcggcggcgccggcaagccgctgctgctgggcagtctgttcgccctgctgctggcctacctgatccgtttcatggcggtggcctacgggccgctggaaagcgggctggcgcggatccgcccgtcgctgccggaagcttcgcgcagcctcggcgtgggcggcccgctgctgttcctgcgggtctacctgccgctgttgctgccggcctcgctgagcgccgcgctgctggtcttcgtcgacgtgctcaaggagatgccggcgaccctgctgatgcgtcccttcggttgggacaccctggccgtacggatcttcgagatgaccagcgagggcgaatgggcgcgcgcctcgctgccggccctgaccctggtgctggtcggcctgctaccggtggtcgggttgattcgtcgttctgcccatcattcagatcgctga

SEQ ID NO: 6300 - DNA, 1209 bp, Pseudomonas aeruginosa
ggtctatgcacggatcgcggcacgcttccatggtgtcctgctccggggcttgcggctacaatgcgcgcgatttcgtgccggcggtccctgccgacggcacccgctacgcccggaaggagaatacccatgggattgcgcaccccgctttacgagctgcacgtcgcgctcggcgccaagatggtcgatttcggcggttgggacatgccgctgcactacggttcgcaggtcgaggagcaccatcaggtccggcgtgactgcggcgtcttcgacgtgtcccacatgaccgtggtcgacgtcgccggcgagcaggccacggcctatctgcagcatctcctggcgaacgacgtggcgcgtctcggcgaaaccggcaaggcgctctacagcgcgatgctcaacgaagagggcggggtggtcgacgacctgatcgtctacctgaccgagcacggctaccgggtggtggtcaatgcttccacccgcgacaaggacatcgcctggatgcaggcgcaggccgccggcttcaaggtcgacctgcaggaacgcggcgacctggcgatgctcgccatccagggccccaacgcccgcgtgcacagctccgaactggtatccccggcacgcgccgcgctgatacgcgaactcaagccgttccagggccgtgccgagggcgactggttcatcgctcgcactggctacaccggcgaggacggcctggaaatcatgctgccggccgccgaagcgccgggtttcctcaacgagctggttggcgccgggatctccccggcgggcctgggtgcgcgcgatacgctgcgcctggaggccgggctcaatctctacggccaggacatggacgaaagcgtttccccgcttgccgccaacatgggctggaccgtagcctgggagccggttgcgcgggacttcgtcggccgccgcgcgctggaagcgcagaaggccgccggcgaccagccgaagctggtcggcctggtactggaggagcgcggcgtgctgcgcgcccaccaggtggtgcgggtagctggcattggtgagggggagatcaccagcggcagcttttcgcctaccctgaacaagtccatcgcgctggcccgcgtgccggccgccaccggcgaccgcgccgaggtggaaatccgcggcaagtggtacccggtacgggtggtccagcccagtttcgtgcgtcacggcaagcccctgatctaa

SEQ ID NO: 6301 - DNA, 3486 bp, Pseudomonas aeruginosa
cctggcaatggcgaccgccgtcgcccccgacttcgaggaaaacaagatgagcaatattcccgccgaactgcgttacgcccagagccacgaatgggctcgcctggaagccgacggcagcgttaccgtgggcatttccgaccatgcccaggaagcccttggcgatgtggtcttcatcgagctgccggagctgggcaagaccctcgccgccgggcaggaagcgggcgtggtcgagtcggtgaaggccgcctccgacatctattcgccgatcggcggcgaagtcatcgccatcaacgaagccctggccgacaccccggaagacgtcaacaacgacccgtacgcgtcctggttcttcaagctcaagccgagcaatccggccgagctggacaagctgctcgatgccgctggctaccaggccgccgtcgacgcggaaggctgagccgccgcgtagtcgcgacaaaacccgctatccttggacaaggcctcgatcattcgaggctttgttctttttgcagcggcgaaatgcgttttcgccgtcgttgctttctcattcgatatccgttcggcgacgatcgctggcagggcgatgccgcccccaacgagaccgaagccatgtcgcagacgccgtccctcgcccagctccagcccgccgatgccttcctgcgccgccacctcggccccgatccggcggaacagcaggccatgctggatttcctcggagtttccactcgcgccgaactgatcgtgcagacggtgccgccggcgatccgcctcaaccggccgctggaactgcccgccgcgctcgacgaacaggccgccctggcgcgcctgcgcggctacgccgggctcaaccagcgctggaccagcctgatcggcatgggctactacggcaccgtgacgccgccggtgatcctccgcaacgtgctggagaatcccggctggtacaccgcctatacgccctaccagccggaaatcgcccagggccgcctggaagcgctgctgaatttccagcaactgaccatcgacctcaccgggctcgacctggccagcgcctcgctgctcgacgaagccaccgccgccgccgaggccatggccctggccaggcgggtggcgaaggccaggagcaaccggttcttcgtcgatgcgcattgccatccgcagaccgtttcggtgttgcgtacccgcgccgaggcgttcggtttcgagctggtcgtcgacgagccggacaatcttgccgcccacgcggtgttcggcgccttgctgcaatacccggacagtcgcggcgagatccgcgacctgcgcccgcttatcgaggcgttgcacggccaacaggcgctggcttgcgtcgccagcgacctgctcgccctgttgttgctgaccccgccgggggaactcggtgccgacgtggtgctcggcagcgcccagcgctttggcgtaccgatgggctacggcgggccgcacgcggcgttcttcgccacccgcgaagggtacaagcgggcaatgccggggcggatcatcggcgtttcccgcgacgcccgcggcaacccggcgttgcgcatggccctgcaaacccgcgagcagcacatccgtcgggaaaaggccaactcgaacatctgcaccgcccaggtgctgctggccaacattgcttcgctgtatgccgtctaccatgggccacaggagctgaaacgcatcgcccaacgcgtccagcgcctgaccgcgctgctggcggcgggcctggaaagcaagggactgcggcggctcaaccggcacttcttcgacaccctgacctacgaggtcggcgagcgtcaggcggcgatcctcgaacgggcgcgggcggcacgggtcaacctgcgcgtggtcgacgaccggcggctggccctgagcctcgacgaaacctgtgacgcggcgaccctggcgaccctgttcgagatcttcctcggcgccggccacgggctggatgtcgcgcacctggatggcggggcggtggccgacggcatcccggcggtcctgcaacgcacttcggcctacctgcagcatccggtgttcaacgcccaccacagcgagaccgagatgcttcgctacctgcgccagctggaaggcaaggacctggcgctgaaccaggcgatgatcccgctcggctcctgcaccatgaagctcaacgccagcagcgaaatgatccccatcacctggccggaattcgccgaactgcatccgttcgtgccgcgcgagcaggccgagggctatcgccggatgatcgacgaactggaagcctggctgcgggcgatcaccggcttcgacgccatctgcatgcagccgaactcgggagcacagggcgaatatgccgggttgctggcgatccgccgctaccaccagagccgcggcgatagccagcgcgacatctgcctgatccccgcatcggcgcatggcaccaacccggcctcggcgatcatggccagcatgcgggtggtgatcgtcgagtgcgatccctgcggcaacgtcgacctcgacgacctgcgcctcaaggcggccgaggcgggcgaccggctgtcctgcctgatgatcacctatccctcgacccacggcgtctacgaggaggggataggcgagatctgcgaagtggtccaccgccacggcggccaggtctacatggacggcgccaacctcaacgcccaggtcggcctggcgcgaccggcggacatcggcgcggacgtctcgcacatgaacctgcacaagaccttctgcatcccccatggtggtggcgggccgggcatggggccgatcggggtcaagcggcacctggcgccgttcgtcgccaaccatccggtgatccgcgtcgaagggccgaacccgctgaacgacgcggtcagcgcggcgccctggggcagcgccagcatcctgccgatcagttggatgtacatcgccatgatgggcccgcagctggccgacgccagcgaggtggcgatcctctccgccaactacctggcgaaccgcctggacggggcgttcccggtgctctaccgcgggcgcaacgagcgcgtcgcccacgaatgcatcctcgacctgcgaccgctcaaggcgcagaccgggataaccgaggaagacgtggccaagcgcctgatggactacggcttccacgccccgaccatgtccttcccggtgccgggcacgctgatggtggagccgaccgagagcgagtcgaaggcggagctggatcgcttcgtcgaggcgatgctgagcatcagggccgagatcggcaaggtggagagcggcgcctggccggcggaggacaacccgctgaaacgggcgccgcataccctggccgacgtcaccgggatctggcagagaccctacgagatcgccgaggcggtgaccccgagcgaacatgcgcgggcgttcaagtactggccggcggttaaccgggtggacaacgtctacggcgaccgcaacctgttctgcgcctgcgtgccgctggacgactaccgcgagtga

SEQ ID NO: 6302 - DNA, 306 bp, Pseudomonas aeruginosa
ggtacgcccagttcgagcaggcgggtgatcgccgtgggggagtcgttggtgtgcagggtggagagcaccaggtgcccggtgagcgccgcctggatcgccatctcggcggtctccaggtcgcggatctcgccgaccatgatgatgtccgggtcctgccgcagcagggcgcgtacgccgctggcgaaggtcaggtcgatgttgtgctggacctgcatctggttgaacgagggctcgatcatctcgatcgggtcctcgatggtgcagacgttcacctcatcggtggccagttgcttgagcgtggtgtaa

SEQ ID NO: 6303 - DNA, 1407 bp, Pseudomonas aeruginosa
tgttcctctaccagatcatcgaatggatcggcgatgtcgccgaccgcgcccagcgggtcggcaaccgcctggagcaattgctggcgcgttgagcgccaggtttctttccgccttctgcccgcatacggatccccgcccatgtccttgatcgccgaccacggcttcgccttccttgtactcgcctgcctgttcggtttcttcatggcctggggcgtcggcgccaacgacgtcgccaacgccatgggcacctcggtgggctcacgggcgctgaccatccgccaggcgatcctggtggcgatggtcttcgagttctgcggtgcctacttcgccggcggcgaggtcaccgaaacgatcaggagcggcatcgtcgatccgcagtacatgacccccgacctgctggtcttcggcatgctctcggccttgctggccgccggggtctggctgttgctggcgacgatcaagggctggccggtgtcgaccacccactccatcgtcggcgcgatcatcggcttcgcctcggtcggtgtctcggtgcacgcggtgcactggggcgcgatcggcccgatcgtcgccagttgggtggtgacgccggtgctgtccgggctgctcgccttcgccctgttcaggagcgtgcagtggttggtactgcatgccgaggacccgttccgcagcgcgcgccgctacgtgccgctgtacatgttcctggcgggcttcatggtcgcgctgatgaccgtcggcaagggcctgaagcatgtcggcctggagctttccggcctccagacgctgggtctggcgttgctcgccggtggcctggtgatgggcctgggcatcgtcctgctgttgcgcatccgacccactggcggagccgatccgcgtggcggcttcgccagcgtcgagcgggtcttcgcggtgctgatgatcttcaccgcctgctccatggctttcgcccatggcgccaacgacgtggccaacgccatcggcccggtggcggcggtcgtcgcggtggtccaggccggcggcgacctggaactggtgacccgctcaccggtgccgtcctgggtactgctgctgggcgcggtgggcatcgtcatcggcctggctacctatggctaccgggtgatcgcgaccatcggccgggagatcaccgagctgacccccagccgcggcttcgccgccgagctggcgaccgcctccacggtggttggcgcctcggccatcggcctgccggtgtccactacccataccctggtcggcgcggtgctcggcatcggcatggcgcgcggtatcggcgcgctcaacctgcgggtgatcggctcgatcttcctgtcctgggtagtgaccctgccggccggcgcggtgctggcgatcctgtgcttcctggtcctgcgcgcgctgttcggcgcctga

SEQ ID NO: 6304 - DNA, 1182 bp, Pseudomonas aeruginosa
tggggctcgatccgtgtggagagtcccatgccgttgccgtctctgaaagaccagttcggcgcgctgatcgccgcgtcttccgtcagttgcacccagcccgagctggaccagaccaaccgcccggtggtcgacctgctggcctcctggctgggcgatctaggcttccgctgcgagatccgggaagtctcgccgggcaagttcaacctgctggccagctacggcagcggttccggcgggctggtgctggccggccacaccgataccgtgccctacgacgaagcgctgtggagcagcgatccgctgcgcctggacgagcgcgacggccgctggtacggcctcggcagttgcgacatgaagggcttcttcccgctggccatcgaggccttgctgccgctgctcgaccagccgttccgccagccgctgatgatcctcgccacctgcgacgaggaaagctcgatggccggcgcccgtgccctcgccgaaagcgggcgaccgctgggtcgcgccacggtgatcggcgagccgaccaacctgcggccgatccgcctgcacaagggggtgatgatggagcgcatcgagattctcgggcagagcggccattcgtccgatccgaacctcggccgtagcgccctggaggccatgcacgcgaccatcggcgagctgatggcgctgcgcggggaatggcagcgggcctggaacaacccgcagttcagcgtgccccagccgaccctgaacttcggttgcatccacggcggcgacaatcccaaccgcatctgcggccagtgttcgctggaattcgacctgcgcccgctacccggcatgcagcctgagcagttgcgcgaggcgatccgccagcgcctgcggccgctggccgaacggcaccaggtgagcatcgactaccagccgctgttccctgccgtgccgccgttcgaacaggcgcaggacagcgaactggtacgcgtcgccgaacgcctgaccgggcatcgcgccgaggccgtggcgttcggtaccgaggcgccgtacttccagcgcctgggcagcgagaccctggtcctcggtgccggcgacatcgcctgtgcccaccagcccgacgagcacctcgaactggcgcgtatcgaaccgatggtcggcgtgctgcgccggctgatccagcattactgcctgacgcccgccgccgactga

SEQ ID NO: 6305 - DNA, 225 bp, Pseudomonas aeruginosa
agcgcggcgtggccggcgaccagctcgaagccgccgttgatgacgaactgcacgcccatcgccaccagcaggaagccgaccactcgcgagatggcgtcgatcccggattcgccgaggaacttcatgatgcgcccggagctttgcagggcgatccagaagatcagcgcggtgagcagggtgacggtgatcgccgcgaggtggatgaacagcggaatgcttccgtag

SEQ ID NO: 6306 - DNA, 1899 bp, Pseudomonas aeruginosa
gcggcgacgaaggtatcgaagtcgccatcctggtcgcgttccagctccgtctgttcggccagggagtcgctggccatcttctcgaagcgtgcctgctcttcggcggccagcggatgctggcggaaatactccgcgtgttcgcggctctggcgcagggagaacgcttcgaagctctcgccgcgctcgcgcatgaccttcagcacctgcgccgaaggcgtcagttcggcatcggcgaccttagcccgctggcgctgccagcgccgccgcgtgggcttcgccgccgcgtgcgcggtcgagcagcgccgcggtgtcggcgattcgttcgagcagctcgttcgcccagaccttcaattccaccggctggccgcgacgttgcaattgcaggcccggccgcctgccttccttgaccacggcgaggaagttgtcggtggcgtcgctgcactcgccattcagcagcgggctgtcgctgaacgcgcagaacagcaggaaggcgtcgaggaagcgcgcctcgtccaggtcgatgcccagcggcaggaacgggttgatgtccaggcagcgcacttccacgtactgcacgccgcgagcggccagggcctgcaccggacgctcgccggtgtaggtgacgcgctttggccggatgctcgagtagtactcgttttcgatctgcaggatgttggtgttcagctgcacccactcgccatcctgcttggtgccgaccttctcgtagggcgggtagggcgtgctgaccgcctggcgcaggctgtcgatgtagctctgcaggtcgttgtagcagggcgtcaggccggcctgggcgttgttctggtagcccaggtcgctcatccgcaggctggtggcgtagggcaggtagagcgtgtgttcgtcgaggcgctccaactggctcgggcggccacgcaggaagccggcgtcgagggccggcgaggcgccgaacaggtacatcagcagccagctgtagcggcggaaattgcgaatcagggcgatgtaggcggcggactggtagtcgcgttccgacagctcgctgccttcggcctggcgcagcagcggccagagcctctccggcagggagaagttgtagtggatgccggcgatgcactgcatggtcttgccgtagcgcagcgccaggcccttgcggtagacgtacttcaggcggccgatcatcgagctgccgtagcgggcgatcgggatgctctcctcgtccggcagctcgcagggcatcgatgggctccacaggtattcgccgtccagtttcgaactggcgaagcggtggatgcgctcgagatcgcccagagtgtcggcgacgtcggtttccgtgggcgtgatgaactccagcaaggcctcggagtagtcggtagtgatctgcggatgggtcagggtcgaacccagggcccgggggtggggggtgagcgccagcttgccgtcgctatcgactcgcaggcattcgcgctcgatgccatgcaggcactcggtcagcaggggcaggttggctgcggcgccgagcagagccaggcggcgggagagaagatcgctcaagtcgggattccttgtgatcgcgtcccagatcggtcgccccaatatgagggtggaccgagcggtctacaagagggaggacgtaaatgcgttttcgcttcgtcctggggccggtcgccgcgacttcggcgggagccgtcgaggcgggcgcccggcacggatcgggatcgccgttgcgcgccattctgccgcatggcggccgcgccggtttacaactgggcgaaggtaccttgtcctttcgcgaccagtttgtcgccttgccgcacctcggcttccacaaccaggctgcggcgcccggcatggaggacgcgggcgacgcagcgcacctcgccgtcggcgacggcgcggatgtag

SEQ ID NO: 6307 - DNA, 762 bp, Pseudomonas aeruginosa
ctcattctgggagtttctatgtcgaaccctgccgccctggccgaaggtgaaaagatcctcgtcgtcgacgacgacgcccgcctgcgccgcctgctcgaacgtttcctcgacgagcagggctaccgcgtccgcgcggtggagaacaccgagcagatggatcgccttctatcccgcgaactgttccagttggttgtgctcgacctgatgcttcccggcgaggacggcctcactgcctgccgccgcctgcgcgaacagaacaatcaggtgccgatcatcatgctcaccgccaagggcgacgagggcagccgcatccagggcctggaactgggcgccgacgactacctggccaagccgttcaacccgcgcgaactgctggcgcggatcaaggccgtgctgcgccgccaggcgccgctggtgcccggcgcgcctgccggtgccgacgaggtggtgaccttcggcgactaccagctgttcctcgccacccgcgaactgaagaagggcgacgaggtacacatgctgaccaccggcgagttcgccgtgctcaaggccctggtgcagcacgcccgcgaaccgctgacccgggacaagctgatgaacctcgcccgtggccgcgagtgggatgccctggagcgttccatcgacgtgcagatctcgcgcctgcgccggctgatcgagccggatccgtccaagccgcgctatatccagacggtctggggcgtcggctacgtgttcgtgccggacggcaacgcgcgcaaggcctga

SEQ ID NO: 6308 - DNA, 1443 bp, Pseudomonas aeruginosa
tccacgccgtgcacttccagttgccgcagggtcgcctccagcacgtcggtggcgatggccgaggctggcgcgatcagcgccacccggccgtcgatgggctgccaggtctggtcggaggagggacgagaggtcatgcggcgattccgtgaagcgtcaggaaaggattcgagtgccggaagagcacggggttcgacggggtttccggcatcggttgcggcggtgcttcattcaagcgtggcatggaccttctgtcgaggccgggatcgccggcgtaacgcggtgcgtccgatgcgccgggacaacgcatgcgttgtctggtccggctcacccctttcccttcgtcctggccaggtgggggccgccgttcttttccaggtactggatgatgatcccggcgatgtccttgccggtggtggattcgataccttccaggcccggcgaggagttcacctccattaccagcggaccatggttggagcgcaggatatccaccccggcgacgttcaggcccatcacgcgagcggcgcggatggcggtcatgcgttcttccggggtgatcttgatcaggctggcgctgccgccgcggtgcaggttggagcggaactcgccgggcgctgcctggcgcttcatcgaggcgatcaccttgtcgccgaccacgaagcagcggatgtcggcgccgccggcttcctttatgtactcctggaccatgatgttgtgcttgagccccatgaaagcctcgagcaccgattcggcggccttctcggtttcgcagaggaccacgccgatgccctgggtgccctccagcagcttgatcaccagcggtgcgccaccgaccatctcgatcaggtccgggacatcgtccggggagtgggcgaagccggtcaccggcaggccgatgcccttgcgcgagagcagttgcagcgagcgcagcttatcccgcgagcgagcgatggcgaccgactcgttgagcgggaacacgcccatcatctcgaactggcgcaataccgcgcagccgtagaaggtcaccgaggcgccgatgcgcgggatcaccgcgtcgaagccctccagcggttgtccccggtagtggatctgcggcttgtggctggcgatgttcatgtaggcgcgcagcgtatcgatgaccaccatttcatggccgcgctcccgcccggcctccaccaggcgacgggtcgagtagagccggggattgcgcgacagcacggcgattttcattcagcacctgtggatgggttggaccggctggcgggcagcggcggcgaggctgtgggttgtcgtcgcggcaggcattggaccggccgtttcgggaatggatggaggttggacaggtgctgccggcgaatggctcaaaccggactcccgtcgagcaggtcgatgctcgtcgccgcgggcagggcggccggcgactcgggacgatcctggacgtag

SEQ ID NO: 6309 - DNA, 594 bp, Pseudomonas aeruginosa
cagtcgcgagacagcggcggaacgaatacgggaaatgccagtgagcgagaaagacgacgacaaggtgcgcctggacaagtggctctgggcggcgcgcttcttcaagacccgggcgctggccaaggccgcgatagagggcggcaaggtgcattgccggggcgagcggtgcaagccgagcaaggaacccagggtaggggaggaattgaccattcgtacgggcttcgacgagcgaaccgtgacgattcgcgcgctttccgtagtccggcgtggcgcgccggaggcccaggctctctacgaggaaaccgcggacagcgtggcaagccgcgagcgcgcggcggccatgcgcaaggccggggcgctgggcgtacagaccgaggggcggccgagcaagaagcagcggcggcagatccaccagttgcgcggcggccaggactgagaagcgccggtctcccgcaggggagaccgggatggcctcaggccgagtcgcggaccacgccgaggcggccgatcagcggcaatttcgccagcaggcggaacagcggttcggtcacctgcaccagccagccgctggccttcgccgccagcggtgtgtag

SEQ ID NO: 6310 - DNA, 1062 bp, Pseudomonas aeruginosa
cagatggcgaacttgcgccattgccaggccgcttggaacggagaggcattatccataaaatcgtttccccctatcggcgccgggtcggcgtacgactgtcacgaagcgcgcttttataggcctttgtcactcacttgtcattccctcattcgtagcgttgtgtcccgcatgtcccattcagatcagagccagcgtttccttttcgacgataccgacgtgcgcggcgagatggtcgatctcgagcgcagctacagcgaagtgctggccaaacatccctatccggaaccggtcgcgcagctgctcggggagatgctcgcggcggcctcgctgctctgcggcacgctcaagttcgacggcctgctggtattgcaggcgcgctccagcggcgcggttccgctgttgatggtggagtgttccagcgaccgccaggtgcgtggcctggcccgctattcggcggagtccatcggcgccgacgccggcatgcaggaactgatgcccgaaggcgtgctgaccctcaccgtggacccggtcaagggccagcgctaccaggggatcgtcgccctggagggggtgaacctggcggaatgcctgtccaactacttcgccagctcggaacagctgccgacccgtttctggctcaacgccaacggccgccgtgcccgcggcctgctgctgcagcagcttcccgccgaccgcctgaaggaccccgaggcccgcgaggccagttggcagcacctgaccaccctggccgacacgctgaccgccgaagagctgctggcgctggacaacgagaccgtcctgcaccgcctctaccacgaggaaaccgtgcgcctgttcgagccgcaaccgctggtcttccattgcagttgctcgcgggaacgttcggccaacgccctggtcagtctcgggcaggccgactgcgagcggctgctcgaggaggaagaaggctcgatcagcatcgactgccagttctgcaaccagcgctacctgttcgacgcctccgacgtcgcccagttgttcgctggcgctggcagccaggggccttccgagacccgccactga

SEQ ID NO: 6311 - DNA, 186 bp, Pseudomonas aeruginosa
ccaatcccgagtctcctctcaataacaaccctgtgtccggtaaggttcggctacaattgcatggttcggttcaacctaacccccccttatcctgactcccaagctcgcaacaaaggttttaatgaataccgctttacgcccgtgccatactgggccgaagagcccgggtgttcaagaaatcccggc

SEQ ID NO: 6312 - DNA, 264 bp, Pseudomonas aeruginosa
ttcccccccttggtgccacctgggcggccttttggagatagaggaagactgacggaagcccgggtatggaacgctcgctcgctggccgaggccctgagcggcaccgagctgttcagcagcggcgaggcccagatcgagctgatcgagggggcggaagcgagtctctatgtgatcatgcgcgaatacggcgacctgccggtgttcgtcgcgccccagggcgagcagatctgcctctggcgcagcgcccgcgagtggttcggctga

SEQ ID NO: 6313 - DNA, 588 bp, Pseudomonas aeruginosa
aacgacccggcacgacggcgttcccgcctggggacgcctggcaagtccctatcatcgcaaggaaccccgcatggcccaccccaacgccgaactgatcgagcgcttctaccaggccttccagcgcctcgacggcgaggccatggcggcctgctacgctccccaggcgaccttccacgacccggccttcggcgaactgcgcgggcgcgaggtgggcgacatgtggcgcctgctgaccagccgggcgcgggacttccgcctggactacgcgaacgtccgcgccgacgagaacgaggggcgtgcgcaatgggtggcccactacctgttcacccagaccgggcgcagggtggagaatcgcatcgaggcccgtttccgcttcgccgacggtttgatcgtcgagcatcgcgaccagttcgacctgtggcgctggagccgccaggcgcttggcgccaagggcctgctgctgggctgggcgccgccggtgcagcgggcgatccgcgggcaggcgcgcaagggcctggccgcctaccaggctgcccatccggcggccggctgaggctgtcggtggccgaagcgcggataatctcctaa

SEQ ID NO: 6314 - DNA, 789 bp, Pseudomonas aeruginosa
gcaagcgcgccaaggagcgcctgttggtcggcgtaccggtgttgcgcgaggtcggcgagccggcaatctaggacgttcatctgcggtcatggggtattcgtgggttacctgaagaatcattggtggaaacgctggatccgccgccgcggctgcaagctggccggcggcccggccagtgtcggcaagcgcaccacgctggtgctcgaggagcgggtcgaactcggccacctgcgcatcgtcccgccgaggctggagatcggcgcctacagctatgtgcgcagcggcaccgacctgtccctggtggcgtccatcgggcgtttctgctcgatcggctcggactgcttcatcggccaggaaaagcacacccatcccagcgactgggtgagcagccaccccttccagcacaccggcaccgcgctgcgctacgagccggcgctgagctacgcggaaatcggccacgacgtctggatcgggcacagcgcgatggtgatggaaggtgtcaaggtcgggactggggcgatcatcgccacgcgcgccgtggtcactcgcgacgtgccgccctatgccatcgtcgccgggactccggcgcaggtgatccgctaccggcatccgccggagatcatcgagggcctgctcgcctcacgctggtgggagctggatagcgccttcctcaccggcctgccgctggaccgaccccgggagttcctcgccgccctggaggcgcgcgaggcgccgcgtgcggcgtaccggcggatgaccatcacccgccaggggtgccggctggattga

SEQ ID NO: 6315 - DNA, 990 bp, Pseudomonas aeruginosa
gcgtgttttcccagccgcgctaagctggtgcctcacatccgcccggaggcgcccatgtcagagctgatcctgcatcactatcccacttcgccctttgccgagaaggcgcgcctgctgctcggtttcaagcaactgtcctggcgttcggtgatgattccgccggtgatgcccaagccggacctggtggcgctgaccggcggctatcggaagaccccggtgttgcaggtcggcgccgatgtgtattgcgataccgcgttgatcgcccgtcgcctggagcaggaaaaggcggttccggcgctgtttcccgaaggccaggagatggtcgccgcgagcttcgcccagtgggccgatgcggtgctgttccagcacgcggtaagcctggcgttcgccccggagtccatcgccgtgcgtttcggcaagctgccgccggaattcctcaaggccttcatggccgatcgcagccagctattcagcggcggcagcgccggccgcctgccgctggaacaggcgcgccaccagtggccggcattcatggcgcgactggagcgccagttgtcgcgcgaggacggcgatttcctgttcggcgaagcgtccgtcgccgacttcgccgtggcgcactgcctgtggttcctcaagggcacgccggtcaccgcgccgctggtcgacgattacccgcaggtgcaggcctggttgggacgggtgctcggcttcggccatggcgcgccagccgagatgagtgcggaggaagccctggaggtggctcgcggcagccagcccgcggcattgccggacgaatccttcagcgaccccaacggtttcctgcccggccaggcggtcgccatcgccgccaccgactacggtgtcgacgcggtacagggcgaactgctcttcgccggcagcgaggaactcatcctgcgccgcgaagacccgcgggcgggtaccgtgcatgtgcatttcccgcgcctgggctttcgcatcgaggcgcgttga

SEQ ID NO: 6316 - DNA, 495 bp, Pseudomonas aeruginosa
ggcatgccggcggagaccccgccgctgcggccggacgccgatccgccgcagtgcgcgttgcccgaggcgaggccggaccgcgacgccggcaccaagctgcgcgccgcagtgctcggtgccaacgatggcctggtgtcgaacctgtgcctggtgatgggcgtggcgggtgcgagcatggcgcattcgtccatcgtcctcaccgggatggccggactggtgtccggggcctgttcgatggccctcggcgagtggctgtcggtgaccaacgcccgcgagatggcgagcaagcgcatcgccgaggaagaacgcctgctcaggctctgcccgaacaccgagacccaggaactgatcgatatcttcactgccaaggggctgagcgaggtgtccgcccggcgcgtggccctgcaactgatgaacgacggtcgtggcgcgctggacaccttgtcccgcgaggccctcggcatcgatccgacggagttgggcggcaacccgtga

SEQ ID NO: 6317 - DNA, 1260 bp, Pseudomonas aeruginosa
acgcggcgggcacgtcgttcctgctgttttcccttggcgccctggtgccggtggcgccgttcctgttcctcgacggtgccgcggcgctggtcgcaagcctgctgtccagcctgcttgcgctgctgttcagcggcgcggtcaccgcccgtttcaccgggcggccgctggcgttctcggcgttgcgccaggtgctggtcggtacccttgccgcggccttcacctatgggttgggcaccgcgctcggcgtgggcctgggctgaaagtccttcgcctgccggggactccgttttacactgcgacacccggccggcgtggccgggaacaggaaaaaccgaccagggagtggccatgaacgcctacgacatcgaaatcgtcaacgacgccgcgcacgccggcgaagccaaccacggctggtgcttcggcctgccgccgggcatccgtccggagcagtggccgctggatccggacaccggctatccgctgatgcacggcttcaccctgctgctgccggaggactaccgggtgcatggcccggagatcgtcgcgctgagcttcttctccctcgccccggaccagaacgacggtggaccgaccagcgtcgacggcattcgcgagatgctcatcgatccgcccgcgcaaccgccggccgaagcggaactgcggccgttctgggaggccgggcgcaatagccatccgcgtttgcatcggatggaggacatcctcggcggcgcctatgcgttgatcctgctcgacgccgctgaattcagcggcgcgccctgccagccgccggcgctgccggcgggcaacccgctgttggcgcagaccgagccgccgcagtggctggaggctggttcggcggccagcttcgtgccggactgggcggaggacgactactacctgctgcgcgccctcggtggccgcccggcggccggccaccagcagcgctacccgctgcgctggacggcgcgggcgcaagaccccaacgccggggtggtgcccagcgaatacggcgacggcggctaccagctgccgcactactggctggacggcaagatcgagcgcgacaactaccgcgagcatccctgggtggaagggcacctgccgaaccatatcggcggcaccatgcgtccggtgcagggcgtgccggagatgagtcccttctacgtagagttcgaggaatacctgggcggctacaacttcggcggcggcaacgcccagctcgatttccgcgacatgcgcttcgactgggcctgcggctga

SEQ ID NO: 6318 - DNA, 1248 bp, Pseudomonas aeruginosa
ggagggaaagggagcgccggcggcgctccggggcggcgcgggtcagtccttgcgccgcttgagctggtccttcaactgggtcggcaactggcggatgatcagcatgtcgcgctcttcgtcgtattccaccttggagcccagcaggtgcgcctcgaagctgatcgacaggccttcggcgcggccggtgaagcggcggaactggttgagggtgcgcttgtccgccgggatttccggcgacaggccgtagtccttgttacggatgtagtcgtagaacgcccgcggttgctggtcgtccatcagttccgaaagcgcgtcgagggtcatcggctcgccgatgcgcgcctgggaggtggcgtagtcgaccagcgtctcggtcttctcgcgggcctgttcctcggccatgtcctcgctttccacgaaatcgctgaaggctttcagcagggtgcgcgtctcgctcggcgaatccaccccttcctggcagccgatgaagtcgcggaaatagtcggagaccttcttcccgcccttgcccttgatgaacgagatgtactgcttcgactgcttgttgttgcgccattcggagatattgatccgcgcggccaggtgcaactggccgaggtccaggtggcgcgacggggtgacctccagcgactcgttcaccgccacgccttcgctgtggtgcagcagggcgatcgccaggtagtcggtcatgccttgctggtagtgggcgaacaggatgtggccgccggtggagagattggactcctccatcagcttctgcaggtgctcgaccgcttcgcggctgaagccgacgaagtcgcgatcgccctccaggtactcaccgagccagccgctgaacgggtaggccccggactcgccctggaagaagccccaggccttgttcttggcgttgtagctttcgttgaggtcggccagcaggttctcgatggcctgggagtcgcccagctcggcgtcgcgcgcgtggagcacggccggggtgccgtcgggcttcttctcgatcaggtggacgatggcgtgatggatcggcatgtcaggttcgacctttcaggtaatcggcggcgccgcgcaggtttccgcgacgctgcgggacacgccgctggcgcgcccgcggatcggccagtttacccgaggttgccggcttctgcctgcgtcgcctggcgttcctgcagaccgtgcaggcgcttgatcacgaagttcaggtgcaggtgcagctcgtacagctcgtggtag

SEQ ID NO: 6319 - DNA, 204 bp, Pseudomonas aeruginosa
aaccggccgttctcgctcaggcgcaggccgcgcccctcgcggacgaacagggccaggccgaggaggttttccagcagcttgatctgctggctgatcgctgagtgggtgacgtgcagctcgctggcggcctggctgatgctgccgagccgggcgaccgcttcgaagctgcgcagggcggtgaggggagggaggtcgctcatgtaa

SEQ ID NO: 6320 - DNA, 606 bp, Pseudomonas aeruginosa
accagaacacctgcgtggcgaacgcccggctttcctcggccatgccggccaggaaggccgcttcgccgccctcgcagtacagctcggcgccctggccgccaaagttcagtagcggcagggtacgggtcgggtcgagcttgccgaggttcttccacttgcgccggctgccgcgcgtggcttcgtccagcgaggcgtggaagggcgggttgcagagggtcatgtcgaagcgctcatcgacgccgatcaggccctggaatatctgcctgcgatcaggctgccggcgcaactcgatggcagcggcgaagcgtgggttggcggcgaggatcgcagcggccgaggccagcgattgcgggtcgatgtcggcgccgacgaagcgccagccgtattcgtggtggccgagcagcgggtagatgcagttggctccggttccgacgtccagcgcacgcaggccgggaccgcgtggaatcaggccatcgtggctggcgccgagcaggtcggccaggtagtgcaggtagtcggcgcgaccggggatgggcgggcacaggtaaccatcgggtatatcccactcgcgtacgtcgtagaactgttgcagcagcgcgcggttga

SEQ ID NO: 6321 - DNA, 438 bp, Pseudomonas aeruginosa
gcgccgtccatgtcgatgcaacggaacaggcccatcaacaggcagccgaccagtgccgcgaccacgttgggcaccaccccgctgaccatcagcgccaccatcacggccaggctgagcagggcgtgcggcgccttgctcagggccggcgccacctcgtcgatctccgccggcaggctgagcaccaggaaatcgcggttgcgtccctgcaactggcggatcgccttccaggcgccgatcaccagcagggtatcgcccaggcgcagcttctcttccagcatgccgtcggtgagcgcttcgtggtcgcgacgcaggccgaccacgttgagcccgtactgcgaacggaagcccagttccaggacgctcttgccgagcagggtggagtccggcggcagagtcacctcggccatgccgacctcccgcgactggtcgatgaagtag

SEQ ID NO: 6322 - DNA, 1002 bp, Pseudomonas aeruginosa
tctgctgcaggtcgacggcgcctccccgcttcgccgcggagaggcgccgcggccctgtcagccgaggaggagggcgtcgtcggcgagcttctcgccgcgcaccttctcgaacatcgccagcaggtccggtacgtcgaggcccttgcgttgctcgccggagacgtccagcaccacctggccctggtgcagcatcaccgtgcgctcgcccacgtccagcgcctggcgcatgctgtgggtgaccatcatggtggtgagtttcttctcggcgacgatccgtgcggtgagatgcaggacgaagtcggcggtgcgcgggtcgagcgccgcggtgtgttcgtcgagcaacaggatacgcgacggctgcagcgccgccatcagcaggctgacggcctggcgctggccgccggagagcaggccgatgcggtcgccgaggcggttctccaggccgaggccgagggtcgccaggctttcccggaaaccgtcgcgcatcgatgcctgcaccgccctgccgaggccgcgcccggcaccgcgacgttgcgccagggccatgttctcctcgatggtgaggtcctcgcaggtacccgccatggggtcctggaacacccgcgcgacgcggttggcgcgggcccagaccggcttgcgggtgacgtcttcgtcgtcgatcaggatctgtccgctgtcgatcggcaggtcgccggagactgcgttgaggaaggtcgacttgccggcgccgttggagccgatcacggtgacgaactggccggccgggatgtccagcgacaggccgcgcagggcgcgggtctcgatgggggtgccggggttgaaggtgatcttcaggttcttcgcgctgagcatggtcaggctcccttcttgccgagcaggcgtttcttcatcatcggaatcaccagggcgacggtgaccagcaccgcggtgaccaggttcaggtcctgggcctgcaagccgatgaaatcgctgttcagcgccagggcgatgaagaagcggtag

SEQ ID NO: 6323 - DNA, 585 bp, Pseudomonas aeruginosa
tggccttgtggtaaacgtctcccgagttgcaaggacgcgtaccgcaccgcctgcctgggagcggtgctttgcgcccggtctgcgtgcctgccatgggggtgggctctgggggatgcatggtggggcgttggagtgcgtggatcgtcgccgtggcgatctgtctcatggtcggggacgcgaccgccgctggctggcgttcggcaaacttccgtgtctatagcggcgcaggcctacaaccgttactcctatggctggaataatccgatcgccagtgtggatccgacagggtatgcgttggaggagatttctttgtccaaaagttggtactcgccagttattgataatagttggttgttcttgagcaacttgtggatggggaatggtccggaaagtggcttcgaatttagcctgggcattttaaaaggagggctatccttttctcagtctatgtcatgggtcaatccagttgccggaggtgttcaatatctttcgaataactgggcttctcaagctatttggggtgaagggtttagtgagttaatatcttataaaaatatcgatcagtgctggcggtggcttgtttga

SEQ ID NO: 6324 - DNA, 2430 bp, Pseudomonas aeruginosa
catcagcgccttgacccactcgatgtcgccttcggcggcggcgtcgatcctgccttcgtcggccaccggccagggttgcagcatcagggtcggaccttccttgccggcctggcccttgatgcgctgccagatttcctcggtgatgaacggcatgaacgggtgcgccaggcgcagggccgtctccagcacgcggatcagggtgcgacgagtgccgcgctggcgctcgatgggggcgttctcgtcccacagcaccggcttgaccagctccaggtaccaggcgcagtactcgtcccagatgaactcatagagggcctgggcggccaggtcgaagcggaaggcgtcgagctggcgggtgacttcctgctcggtgcgctgcaactgggagatgatccagcggtcgaccgaggacagctcgactggctcgccgttgaccccggtgtcctggccatcggtgttctcgatgacgaagttggcggcgttccagatcttgttgcagaagttgcggaagccttcgacgcggcccatgtcgaacttgatgtcgcggccggtggaggccagcgagcagaaggtgaagcgcagggcgtcggtgccgtagctggcgatgccttcggggaattcggcgcgggtctgcttggcgatcttctccgccagcttcggctgcatcatgccgctggtgcgcttttgcagcagggtatcgaggtcgatgccgtcgacgatgtccagcgggtcgagtacgttgcccttggacttggacatcttctggccctgaccgtcgcgcaccaggccgtggacatagacggtcttgaacgggatctgcggggtgccgtcggggttcttcaccaggtgcatggtgagcatgatcatccgcgcgacccagaagaagatgatgtcgaagccggtgaccagtacgtcggtggggtggaaggtcttgaggaactcggtctgctgcggccagccgagggtggagaaggtccacaggccggagctgaaccaggtgtcgagaacgtcttcgtcctggcgcaactcgacctcgttgccgagcttgtgcttggtgcgcacctcgacctcgtcgcggccgacgtagacgttgccggcctcgtcgtaccaggccgggatgcggtggccccaccagagctggcggctgatgcaccagtcctggatgtcgcgcatccaggagaagtacatgttctcgtactgcttgggcacgaactggatacggccgtcttccacggcggcgatggcgtcttcggccagcggcttggtgctgacgtaccactggtcggtcagccagggctcgatgacggtgccggagcggtcgcccttcggtactttcagcgcgtggtcgtcgaccttctcgagcaagcccatggcctcgaactcggcgacaatggccttgcgcgcggcgaagcggtccatgccggcgtagctctgcggcaggctggggtcaaggttcgggttgacactgccgtcaaggtggaacacctgggcctgggccagcaccgcggcgttcttgtcgaaaatgttgatcagcggcaggtcgtggcgcttgcccacttcgtagtcgttgaagtcgtgggccggggtgatcttcacgcagccggtgccgaattcgcggtcgacgtactcgtcggcgatgatcgggatgtgccggccgacgatcggcagttcggcgaactggccgatcagcttggcgtagcgctcgtcttccgggtgcaccgcgaccgcggcgtcgcccagcagggtttccggacgggtggtggcgaccaccaggtaatccaggccttcgctggtcttcgcgccgttcaccagcgggtagcgcaggtgccagaggtggtccttctcgtcgtggttttccacttccaggtcggaaatcgcggtgtgcagcttggtgtcccagttcaccaggcgtttgccgcggtagatcaggccgtgttcatgcaggcgcacgaaggcttccttgaccgcttcggagaggccgtcgtccatggtgaagcgctcgcgcgaccagtccaccgaggagcccaggcgacgaatctgccgggtgatgttgccgccggactgttccttccattcccagactttctccaggaacttctcccggccgaggtcgtggcggctcacgccctgggcgccgagctggcgctcgaccaccatctgggtggcgatgccggcgtgatcggtgcccggctgccacagggtgttgcggccctgcatgcggcggtagcggatcagcgcgtccatgatcgcgttgttgaagccatggcccatgtgcaggctgccggtcacgttcggcggcgggatcatgatggtgtagggctggccttcgccgctcggagcgaagtagtcgttggactcccaggtctcgtaccaggaagtctcgatggcgtgcggctggtaagtcttgtccatgcgaaaggggaccaaagctga

SEQ ID NO: 6325 - DNA, 1470 bp, Pseudomonas aeruginosa
tggtgccggccttcggcccgccgatgttggcgatgtcggcgaacgggctgtccagctgttcctggtattcgtcgaacagcgggcaattgccaggcgcggtcgtcggcgaactcccccggccttgagcaattgcctgaccagcgcttcgttgttgcccataaggcccgaggtgttgctgcccagggcgacgatgcaggcgccggtgagggtggcgatgtcgatcaccgactgcggcttgaagcgctcggcgtaggtcagtgcgtcgcacagcaccaggcgcccttcggcgtcggtgttgaggatctcgacggtctgcccgctcatggtggtgacgatgtcgcccggacgggtggctccgccgctgggcatgttctcggcgcaggccagcaggccgaccaggttgatcggcaactgcagttcgagcaccgcgcggaaggtgccgaagacgctggcggcgccgcacatgtcgaacttcatctcgtccatgcccaggcccggcttgaggctgatgccgccggtgtcgaaggtgatgcccttgccgaccagcacgtgcggggcctggtccttcttcgcgccgttgtattgcaggacgatcagccgcggcggctggtcgctgccctgggcgacggcgaggaacgagcccatgcccagctcgcgcagtttcttctcgtcgaggacctcgaccttcaggcccttgaactccttggccaggcccttggcctgctcgccgaggaacgtcggatggcagacgttcggcggcaggttgccgagatcgcgggtcagggccatgccattggcgatggcctgagcttccttgctgccttgctcgacggcggcgctgtcggccttgtcggcgagcagggtcagcttcttcagtttcagcggctcggctttctggctcttgtagcgatcgaacacgtacaggccatcggccagggtttccaccagcagacgcgccttcgcgtgggcatcgcggcctttcaccgcgagatcgccgagggccagcgcggcatcggcgccggccaggcccttgagggtcgacagcacggcggaggccagcttgcggtactggcggtcgcccagttcgcgctccttgccggcgccgaccagcagcacgcgctcggccttgagattgggcaggctctgcaggagcatggtctggccgaccttgccggccaggtcgccacgcttgagcactgcgctgatggcgccgccggtggcgtcgtcgaccgccttggcgctggcgccgagcttgcggccttcgcctacggcgagcaccagggtggcggttttcagggtttccgggcgtacgcttttaacaaggaattccatggaagaggtccccaatacagacagtcgggatggcgcaaggggcggcatccgttagcggtaagcgattgttccgagcacgattcgtcccgaggactgacggtcgccgccggggcggtgacgcaggcagcgacagcttag

SEQ ID NO: 6326 - DNA, 1011 bp, Pseudomonas aeruginosa
tcgttgcggcgggggtcgttccatgccgaggatggcaaccgaggttctacagcgccggagccgggttggcggtgcctcccggccgttgccgcacatggtcgcacaactgcggcgtgtctggcacgactgtgtacgcatgggaacccgcggccatgccgcgtccctataatgaacgtttcgttccgcaggagtcgcaccgtgcccgccagcaaaccagtcgcggatcccgcccggagtaccgacccacgcgattaccagcgagtcggccggccgctcggggtcatggccaagaccttcccggcggggttcgtggtcgccgagcaccggcacgagcgggcgcagttgatccatgccctgtcgggcgtgatcgaactgcatgtcggtcgcacgctatggctggtcccgccgcagcgcgcggtatggatgccggcggggatggcgcacgcgatgctggcgcgcggcgaggtccgcttgcacactgtctatgtccggccgcagtcctgcccgccggaattcccccgggtgccgcgcggagtgatggtcagcccattgttgcgcgagttgatcgtgcgcgccgccggcctgccgttgttgtacgacgagcgcggccgggaggggcggttgatggcggtgctgctggacgaactggagtggtcgcgggaacagcccctggccttgcccgaccccgcggaccgacgcctgggaagaatctgccaggcgctgctggagaacccggccgaccctcgcgggctggaggagtgggcgcgctgcgtgggggcgtcctcgcggaccctggcacggctgtttctctccgaactgggagtgaccttcgtccattggcgccaccaggtgcgcctggccgccgccctgccacgcctggcggctggcgaagcggtggcgcggatcgccgtggatctcggctaccagacgcccagcgcattcagtgccatgttccgacgcctgaccgggagcacgccgagccgctacttcgccttgtccgattcggcgtag

SEQ ID NO: 6327 - DNA, 471 bp, Pseudomonas aeruginosa
tcccggcgcgcctgttcggccagaaggaatccggcggcaagctggaagtcctggtcgagcgcgtgctcgaccagcaccgggtgcttgcccacatacgcgccagcaaggcgcccaagcccggcacgcggatcctcgtcgaaggcggtggcagcgcggagatgctgcaacgccacgacgccctgttcgaactcgcgttcgccgaacccgtgctgcctttgctggagcgggtcgggcacatgccgttgcctccctatatcgaccgaccggacgatgcggccgaccgcgagcgctaccagaccgtctacgcccagcgcgccggtgcggtggcggccccgaccgccggcctgcacttcgatgaggcgctgctcgaggcgatccgcgcgaagggggtggataccgccttcgttaccctgcatgtcggcgccggtaccttccagccggtgcgtgtcgagcgtatcgaggaccatgtga

SEQ ID NO: 6328 - DNA, 306 bp, Pseudomonas aeruginosa
tcgccgtcggcaccaccagcgtgcgctcgctggcaaagcgcggcacgcgacggtgagctgaagcccttcagcggcgacaccgacatcttcatctacccgggccggccgttccatgtggtcgatgccctggtcaccaacttccacctgcccgaatccaccctgctgatgctggtctcggccttcgccggctacccggagaccatggccgcctacgccgcggcggtggcgcagggctatcgcttcttcagttacggtgatgccatgttcatcacccgcaatcccgcgccccgcggacccgaggactga

SEQ ID NO: 6329 - DNA, 1131 bp, Pseudomonas aeruginosa
tccatgagcttcatgaacttcgagctgctggcgaccgacggcaaggcccgtcgcggccgcctgaccttcccccgcggcgtggtcgagaccccggccttcatgccggtgggcacctacggcacggtgaagggcatgttgccgcgcgacatcgaggacatcggcgcgcagatcatcctcggcaacaccttccatctctggttgcgcccgggcaccgaggtgatccagcgccacggcgacctgcacgacttcatgcagtggaaaggcccgatcctcaccgattccggcggtttccaggtgttcagcctgggagccatgcgcaagatcaaggaggagggcgtgaccttcgcctcgccggtggacggcgccaaggtcttcatggggccggaggagtccatggcggtgcaacgcgccctgggctcggacatcgtgatgatcttcgacgaatgcacgccgtacccggccgaccatgacgtcgccaagcgctccatggagctgtcgctgcgctgggccaagcgctcgaagatcgcccatggcgatagcccgtcggcgctgttcggcatcgtccagggcggtatgcacgaggacctgcgcctgcgctcgctggatggcttgcaggagatcggcttcgacggcctggccatcggtggtttgtcggtgggcgagccgaaggaagagatgatccgcgtgctcgatttcctgccgccgcagatgccggccgacaagccgcgctacctgatgggcgtgggcaagccggaagacctggtggaaggcgtgcgccgcggcgtggacatgttcgactgcgtgatgccgacgcgcaatgcgcgcaacggccacctgttcgtcgacagcggggtgatcaagatccgcaactcggtacacaagcacgacgactccacgctcgacccgacctgcgactgttacacctgcaaacatttttcccgcgcctatctgcaccacttggacaagtgcggggaaatgctcggtagcatgctcaataccatccacaacttgcggcattatcagcgggttatggctggtttgcgcgaggcaatccaacagggtacattggccgcctttgtcgatgccttatatgccaagcgcggccttcccacgccgccgctggatgcctga

SEQ ID NO: 6330 - DNA, 1890 bp, Pseudomonas aeruginosa
acacatgacggggcgcgcaaggcgccccgcgtcataacgggcggtgtcatgctcaacaagtatcctctgtggaaatatctgctgatcctggcggtcctcgccgtcgggttcatctattccgcacccaacctctacccggacgacccggcggtgcagatcagcggcgccagcacggcgctgcaggtcacccaggccgatgtcgaccgcgctgccaaggcgctgaccgacgccggtatcgcggtgaaggccgacagcctgtcgaagaagggcggcctgatccgcctggtcaagcaggacgaccagcttcccgccaaggaagtggtgcgccggaccctgggcgacgactacgtggtggcgctgaacctggcccagaccactcccgagtggctgcgcaagctgggcggcagcccgatgaagctcggcctggatctgtccggcggtgtgcacttcctgctggaagtggacatggacaaggcggtcgatgcccgcctgaaggtctatgaaagcgaagtgaagagcctgctgcgcaaggagcgcgtgcgctaccgcagcctgccgatccagcgatcgcgcgatccagctcggtttcaccgacagcgaatccctggacaaggcgcgcagcctgatcgccaaggacttccgcgatttcgaggtcgtgcccgaagagcgcaacggcctgcaggtcctgcgcgtcgccctgacccaggccaaactggcggaaatccgcgaatactccatcaagcagaacctcaccaccgtccgcaaccgggtcaacgagctgggcgtatccgagccgctggttcagcgccagggcgccaatcgcatcgtggtcgagctgccgggcgtgcaggacaccgcggaagccaagcggatcctcggcaagaccgccaacctagaattccgcctggccgccgagccggacgccctgaagtccgccaccgagaccttcgagttccgcgagccgcgccggccgccggtgccgctggagcgcggggtgatcatcaccggcgaccaggtcaccgacgccagcgccagtttcgacgagaacggccgcccgcaggtgaacatccgcctggatggccatggcggcgagctgatgaaccgcgccacccgcaacaacgtcggccgcagcatggcggtggtgttcatcgagcagaagccggtgacccgctacaccaagcagatggtcgatggcgtcgagaaggaggtcgcggttccggcgttcaaggaagagaagcagatcatcagcctggcgaccatccagtcgccgctgggcaaccagttccgtatcaccggcctcgatggccccggcgagtcctccgagctggccctgctgctgcgtgccggcggcctggctgcgccgatgtacttcgccgaagaacgcaccatcggcccgagcctgggggcggacaacatcgccaagggtatcgatgcgtcgctctggggcatgctcttcgtatcgctgttcatcatcgtcatctaccgtttcttcggcgtgatcgccaccgttgcgctggccttcaacatggtcatgctggtggcgctgatgtcgatcctcggcgcgaccctgaccctgccgggcatcgccggtatcgtgctgaccatgggcatggcggtggacgccaacgtgctgatcttctcgcggatacgcgaggaactggccaatggcatgtccgtccaaaaggcgatccacgaaggcttcaaccgtgccttcaccgcgatcctcgacgccaacctgacctcgctgctggtcggcggcatcctatacgccatgggcaccggcccggtgaaaggatttgccgtgaccatgtcgctcggcatcatcacctcgatgttcacggccatcatggtcacccgcgcaatggtcaacctgatcttcggcgggcgtga

SEQ ID NO: 6331 - DNA, 645 bp, Pseudomonas aeruginosa
tccggcggctcgcaacgcactcgaggtcctcacctgttatccgggcctgcacgccgtctggctgcatcggctggcccacggcttgtggacgtccggctggaagtggctggcgcgcctggtgtccaatttcggccgctggatgaccggcatcgagatccacccgggggccaggatcggccggcgcttcttcatcgaccacggcatgggcatcgtcatcggcgaaaccgccgagatcggcgacgacgtcaccctctatcagggcgttaccctgggcggcaccacctggaacaagggcaagcgccaccccaccctcggcaacaacgtagtggtcggtgccggtgccaaggtgctcggcccgttcaccgtcggcgagggcgccaaggtcggctccaacgccgtggtgaccaaggaagtcccgccgggtgccaccgtggtcggcattcccgggcggatcatcatgcgcgaggactccgagcagcaggccaagcgccaagcgatggcggagaagctcggcttcgatgcctatggggtcagccaggacatgccggacccggtggcgcgtgccattggtcagttgctcgatcacctgcaggccgtcgacggccggctcgagggcatgtgccaggcgctcaccgccctgggtag

SEQ ID NO: 6332 - DNA, 402 bp, Pseudomonas aeruginosa
gagcataatccgcgtcaaccccgaatgatcccgatgggaaaagcccatgcgtctgaccaccaaaggccgctacgccgtaaccgccatgctcgacctggcgctgcatgctcagcaaggtccggtctcgctggccgatatctccgaacgccaaggcatttccctgtcctatctcgaacagctgttcgccaagttgcgccgtggcaacctggtgaccagcgtgcgcggcccgggcggcggctaccagctgtcccgccatatgtcgggcatccatgtggcgcaggtgatcgacgcggtcaacgaatccgtcgacgcgacccgctgccaggggcagggcgattgccactccggcgatacctgtctgacccaccacctgtggtgcgacctcagtttgcagatccatga

SEQ ID NO: 6333 - DNA, 1263 bp, Pseudomonas aeruginosa
agcgtccgccatcgactgagcagggcgccagcctgtaggagttacctgatgaaattgccgatctacctcgattactccgcgaccactcccgtcgatccccgcgtcgcccagaaaatgagcgaatgcctgctgatggacggcaacttcggcaacccggcttcgcgttcccacgtgttcggctggaaagccgaagaagccgtggagaacgcccgtcgccaggtggccgaactggtcaacgccgatccccgcgagatcgtctggacctccggcgccaccgagtccgacaacctggcgatcaagggcgtcgcgcacttctactcgggcaagggcaagcacatcatcacctcgaagatcgagcacaaggcggtcctcgacacctgccgccagctggagcgcgaaggtttcgaagtgacctacctggagccgggcgaagatggcctgatcactccggctctggtcgaggcggcgctgcgtgacgacaccatcctggtctcggtcatgcacgtgaacaacgagatcggcaccgtcaacgacatcgccgccatcggcgagctgacccgctcccgcggcgtgctgttccacgtcgacgccgcacagtcgaccggcaaggtcgagatcgacctggacaagctcaaggtcgacctgatgtccttctccgcgcacaagacctacggcccgaaaggcattggcgcgctctacgtccggcgcaagccgcgcgtccgcatcgagggtcagatgcacggtggcggccatgagcgcggcatgcgttccggcaccctggccacccaccagatcgtcggcatgggcgaggcgttccgcatcgccaaggaagaaatggcccaggagaacgcccgcgtgctggcgctccgcgaccgcttcttcgcgcagatcgacggcctggaagagctctacatcaacggcagcatgacctcccgcgtcccgcacaacctcaacgtcagcttcaactacgtcgagggcgagtcgctgatcatggcgctcaaggacctcgcggtctcctccggttcggcctgtacctcggcgtccctggaaccgtcctacgtattgcgcgccctgggccgcaacgacgaactggcgcatagctccatccgcttcaccttcggtcgcttcaccaccgaggaagagatcgactatgccgcgaagaaggtggtcgaggccgtttccaagctgcgcgaactgtcgccgctgtgggatatgtacaaagagggcgtcgacctgtcccaggtcgaatggcaggcgcactga

SEQ ID NO: 6334 - DNA, 672 bp, Pseudomonas aeruginosa
aggtcatcatcgacccgaaaagcctggtctatctcgatggcaccgagctggacttcactcgcgaagggctcaacgaaggcttcaagttcaacaatcccaacgttcgtggcgaatgcggctgcggcgaaagcttcaacgtctgaggccggcgtgggtaaaccctgtcatttcgcccagttcgacctgcaaccggctttcctggtcgatctcgacgagctcggccagcgctatcgcgagttggtgcgcagcgtccatcctgaccgtttcgccgacgctcccgagcgcgagcagcgtctcgccctggaacgcgcggcgcaactgaacgaggcctaccagaccctgaagagcgctccgcgccgggccctgtacctgttgaccctgagtggtcacgagttgcccttggaggctacggtgcaggatccggagtttctcctgcagcagatgcagctgcgcgaggaactggaggagttgcaggacagcgccgacctggccggcgtggcgaccttcaagcgtcggctcaaggccgcccaggccgagctggagcgtgagttcgccgcgtgctgggatgatgcgcagcgccgcgaagaggccgaacgcctggtccgtcgcatgcagttcctcgacaagctcgcgcaggaagtgcgccagctggaagagcgactcgacgattaa

SEQ ID NO: 6335 - DNA, 1872 bp, Pseudomonas aeruginosa
ttaagacagagcatggccctactgcagatcgccgagcccggtcagagtcccaagccccatgagcgtcgcctggcggttgggatcgacctgggtaccaccaattcgctggtcgccgcggtgcgtagcggcgtcgccgagcccttgccggatgcgcagggacgcctgatcctgccttccgcggtgcgttatcacgccgagcgggcggaagtgggcgagagcgcccgcgcggccgccgcggaggatcccttcaataccgtcatttcggtcaagcgcctgatggggcgcggcctggaggacgtcaagcaactgggcgagcaattgccctaccgcttccgccagggtgagtcgcacatgcccttcatcgagaccgtacaggggttgaagagtcctgtggaagtctcggcggacatcctgcgtgagctgcgccagcgcgccgaaaccaccctcggtggcgagctggtgggtgcggtgatcactgtgccggcctatttcgacgacgcccagcgccaggctaccaaggatgccgcgcgcctggccggactgaacgtcctgcgcctgctcaacgagccgaccgccgccgccgtggcctacggcctggacaagggcgcggaaggcctggtggccatctatgacctgggtggcggaaccttcgacatttccatcctgcgcctgacccgcggtgtcttcgaagtcctggccaccggcggcgatacggccctgggtggcgacgacttcgaccatgccatcgctggctgggtgatcgagcaggctggcctctctgccgatctggacccgggcagccagcggcagttgctgcaaatcgcctgtgcggccaaggagcgtcttaccgacgaggcgtcggtccgggtcgcctatggcgactggagcggcgagctgagccgggcgacgctcgacgagttgatcgagccgttcgtcgctcgcagcctgaagtcctgccgccgagcggtgcgcgactccggtgtcgatctggaagaaatccgctcggtggtgatggtcggcggctcgacccgcgtgccccgtgtgcgcacggcggttggcgagttgttcggctgcgagccgctgaccgatatcgatccggaccaggtggtcgccatcggcgcggccatccaggccgatgccctggccggcaacaagcgcggcgaggaattgctgctgctggacgtcattccgctgtcgctcggcctggaaaccatgggcgggctgatggagaaggtgattccgcgcaataccaccatcccggtggcgcgcgcccaggagttcaccacctacaaggacggccagacggccatgatgatccacgtgctgcagggcgagcgcgagctggtgaaggattgtcgttcgctggcgcgcttcgagctgcgcggcattccgccgatggtggcgggcgcggcgaaaatccgggtgaccttccaggtcgacgccgacggcttgctcggcgtgtccgcacgcgaactgagttccggcgtcgaggccagcatccaggtcaagccgtcctatgggctgaccgacggcgagatcgcgcggatgctcaaggactccttcgactacgccggcgacgacaaggctgcccgcgccctgcgcgaacagcaggtcgaggcgcagcggctgctggaggccgtgcagtcggcgctggacgtcgacggcgagcggctcctggacgaagaggagcgcctggccatcgcggcgcagatggacaccttgcgtgaactggccggtggtagcgacaccgcggccatcgagaaccagatcaagcgcctgtcccaggtgaccgacgctttcgccgcacggcggatggacgcgaccgtcaaggccgcgctctccggccgccggctcaacgaaatcgaggaataa

SEQ ID NO: 6336 - DNA, 345 bp, Pseudomonas aeruginosa
gcgaagatgccgcagatcgtgattctgccccatgccgaccactgccccgagggggcggtattcgaggcgaagcccggcgaaaccatactggatgccgcgttgcgcaatggcatcgagatcgagcatgcctgtgagaaatcctgcgcctgcacgacctgccacgtaatcgtccgcgaaggcctcgactccatggagccgtccgacgaactcgaagacgacatgctggacaaggcctggggtctggagcccgattcgcggctatcctgccaggcagtggtggccgacgaagacctggtggtcgagattcccaagtacaccatcaaccaggtgtcggaaggccactga

SEQ ID NO: 6337 - DNA, 855 bp, Pseudomonas aeruginosa
agccatgacaacgaccaccgccggcaaggtgaacctgctgggcctgacccagccgcagctggaacagttcttcgagtccatcggcgagaagcgtttccgggccggccaggtcatgaagtggattcaccactttggcgtcgacgatttcgacgccatgaccaacgtcggcaaggccttgcgcgaaaagctcaaggcctcagccgagatacgcggtcccgagatcgtcagccaggatatttccgccgacggcacccgcaagtgggtggtccgggtggcgtccggcagttgcgtcgagaccgtgtacatcccccagggcggacgcggcaccctgtgcgtgtcctcccaggcgggctgcgccctggattgcagtttctgctccaccggcaagcagggtttcaacagcgacctcaccgccgccgaggtgatcggccaggtgtggatcgccaacaagtcgttcggtaccgttccggccaagatcgaccgcgccatcaccaatgtcgtgatgatgggcatgggcgagccgctgctgaacttcgacaacgtggtcgtcgccatgaacatcatgatggacgacctcggctacggtatttccaagcgcaaggtgaccctgtccacctccggcgtggtgccgatgatcgacaagcttggcgaggtgatcgacgtgtccctggccctgtcgctgcacgcaccgaacgacgagttgcgcaacaagctggtgccgatcaacaagaagtatccgctgggcatgctgctggatgcctgccgccggtatatttcccggctcggcgagaagcgcgtgctgaccgtcgaatacaccctgctcaaggatgtcaacgatcagcccgagcatgctga

SEQ ID NO: 6338 - DNA, 1008 bp, Pseudomonas aeruginosa
tccattcccgcactccggctacgagcgcccgagcaacaatgccatccggcgtttccaggacatgttgcacaagggcggcttcaacgtgaccgtgcgtaccacccgcggcgacgacatcgacgcggcctgtggccaactggttggtcaggtcatggatcgtacccgccggagcgaacgttatattgccgtgcgccaactggccgagtccgagtcggcggcgaatcgaaattgagtgagaggagggttccgatgactgtacgcgccgcgctggtgttcctgttggcagttgggctgacaggctgcgtgacgagcggagatcagaatcccctgaaaaccgacaagggccgtgacgaggcgcgcgacgcctatatccagcttggcctcggctatctccagcgggggaacaccgagcaggccaaggtgccgctgcgcaaggccctcgagatcgacccttccagcgccgacgcgcacgccgcgctggcggtggtgttccagaccgagatggagcccaagctggccgacgaggagtaccgcaaggcgctcgccagcgatagccgcaatgcccgggtactgaacaactacggcggtttcctctacgagcagaagcgctacgaggaggcctaccagcgtctcctggaggccagccaggacaccctctatcccgagcgctcgcgggtcttcgagaacctcggcctggtttcgctgcaaatgaagaaaccggcccaggccaaggagtacttcgagaaatccctgcgtctgaaccgtaaccagcccagcgtcgcgctggagatggccgacctgctctacaaggagcgcgagtacgtgccggctcgccagtactatgatctctttgcccagggcggcgggcagaacgcccgcagtctgttgctgggcattcgtctcgcgaaggtcttcgaagaccgcgacacggccgccagctatggcctgcagttgaaacgcctgtacccaggctctcccgaatatcaggaattccaggcggaaaaatga

SEQ ID NO: 6339 - DNA, 2088 bp, Pseudomonas aeruginosa
cgcttctccgatcattcgccgcaagtctcggaaaatctgggtcggcaacgtcccggtgggcggcgacgcgccgatcgccgtgcagagcatgaccaacaccgagacctgcgacgtcgctgccaccgtcgcgcagatccgccgcctggaagatgccggcgcggacatcgtgcgggtttccgtccccgacatggacgccgccgaggcattcggcaagatcaagcagcaggtcaacgtgccgctggtcgccgacatccacttcgactatcgcatcgccctgcgcgtcgccgagctgggagtggactgcctgcgcatcaatccgggcaacatcggtcgcgaggaccgggtcaaggccgtggtcgatgccgcgcgcgagcgcaacatcccgatccgtatcggcgtcaatgccggttcgctggaaaaggacctgcagaagaaatacggcgaaccgaccccggaagccctgctcgaatcggccatgcgccacgtcgatcatctcgacaagctggacttccagaacttcaaggtcagcgtcaaggcctccgacgtcttcatggccgtcgccgcctatcgcctgctggccaggcagatcgagcagcccctgcacctgggcatcaccgaggccggcggcctgcgctccggcacggtgaagtcggcggtggggctgggcatgctcctggccgagggaatcggcgacaccatccggatttccctggctgccgatccggtcgaggagatcaaggtcggtttcgacatcctcaagtccctgcacctgcgctcccgtggcatcaacttcatcgcctgcccgagctgttcgcggcagaacttcgacgtggtgaagaccatgaacgagctggaagggcgcctggaggacctgctggtgccgatggacgtggccgtgatcggttgcgtcgtcaacggtccgggcgaagccaaggaggcccatgtcggcctcaccggcggcactccgaacctggtgtatatcgacggcaagccgtcgcagaaactgaccaacgacaacctggtggacgagctggaacggctgatccgccagaaggcggccgagaaggccgaggccgatgcgagcctgatcgcccgcggctgacccgtttaaggaccctacgtgagcaagtccctgcaagccattcgtggcatgaacgacatcctgccggagcagactccggcctggcgctatctggaacgcaccttcgccggcctgctggacggctacggctacagcgagatccgcctgcccatcctcgagttcaccgaactcttcgcccgcggcatcggcgaaggcaccgacgtggtcgacaaggagatgtacaccttcctcgaccgcaacggcgaatccctgaccatgcgtccggaaggtaccgccggttgcgtgcgcgccgtgctggagcacggcctgagcggcggtggccaggtgcagaagctctggtacaccgggccgatgttccgttacgagaaaccgcagaaaggtcgctaccggcagttccaccagatcggcgtggaagtcttcaacctgcccggtccggacatcgacgccgagttgatcatcctcacctggcgcctgtggcagaagctcggcatggccgacgcggtgaccctgcagctcaacaccctcggctccagcgaggcccgcgcacgctatcgcgaggccctggtggcctatctgcaggagcgcttcgagcaactcgacgaagacagccagcggcgcatgaccaccaatccgctgcgaatcctcgacagcaaggtggagagcacccaggcgttgctggttggcgcgccgaccctgcacgactatctcgacgaagaatcgatcgcccacttcgagggtctcaaggcccgcctggatgctgtcggactgcgctacgaaatcaaccagaagctggtgcgcggcctggactattactgccgcacggctttcgaatgggtcaccgacaagcttggcgcccagggcaccgtttgcggcggtggccgctacgacgggctggtcagccagttcggcggcaagccgaccccgggcgtcggtttcgccatgggcgtggaacgcctggtgctgctgctggaaaccttggggggtga

SEQ ID NO: 6340 - DNA, 309 bp, Pseudomonas aeruginosa
accgtccggccgacctctacgtctgcgccttcggcgaaccagcccgagctggccgccctgaccctggccgaacagttgcgcagcgccattcccggcatacgcctgctggtcaacgccggcgccggtagcttcaagagccagttcaagaaggccgacaagagcggcgcgcgctttgccctgatcctcggggaggacgaggtggccaatcgcgtggtaggtttcaagcccctgcgtgacgagggcgagcaacaaagcattgcctgggatgctctgcccgagcacctggcagcctgtctggcacaggcttga

SEQ ID NO: 6341 - DNA, 1338 bp, Pseudomonas aeruginosa
agctgctcgatggcgatgccgacaaggcctacgtctcgacccgcgaggagctcaggggcgacctgctggtgcagctcaagcgcaccgacgaggcgcgcgcggcctacgagaaagccaagcagtcgctgcccgaagacggtgccggcgatgccctgcagatcaagctcgacgacctgtccaagggagaggcctgagatggtgcaatggaaacacgcggcgctgctcgccctggccctggcggtcgtgggttgcagcagcaacagcaagaaggaactcccgcccgccgaactgaccgacttcaaagaggaagtcgtgttgagcaagcagtggagccgctcggtcggtgatggccagggtgacctgtacaacctgctcgaaccggccgtcgatggttccaccatctacgccgcgtccgccgaagggcgggtgatggcgatccagcgcgagaccggcgacgtgctctggaagaaggacctggaacgtccggtttccggcggtgtcggcgttggctacggcctggtgctggtgggtaccctgcgcggtgacgtgatcgccctcgacgaagccaccggcaagaagaagtggaccaagcgagtcaacagcgaagtgctgtcggcgccggccaccaatggcgacgtggtggtggtgcagacccaggacgacaagctgatcggcctcgatgcggccagcggcgaccatcgctggatctacgaaagcaccgtgccggtgctgaccctgcgcggcaccggcgcgccgctgatcgccggcaacatggccctggccggcctggccagcggcaatgtggtggcggtcgacgtacagcgcggcctgccgatctgggagcagcgggtaccgattccccaggggcgttccgaactggatcgcgtggtggacatcgacggcggcctcctgctgtccggcgacaccctctacgtggtcagctaccagggccgtgccgcggcgctggacgtgaacagcggccgcctgctctggcagcgcgaagcgtcgagctacgtcggcgtcgccgaaggcttcggcaatatctacgtcagccaggccagcggttcggtggaaggcctggactcgcgcggtgcctcttcgctgtggaacaacgacgccctggcgcgtcgccaactgtcggctccggcggtgttctccagcaacgtggtggtcggcgacctggaaggctacgtgcatctgctgagccaggtggacggtcgcttcgtcggtcgcgagcgggtcgacagcgatggcgtgcgggttcgtccgctggtggtcgggagctggatgtacgtgttcggcaacggtggcaagctcgtcgcctacaccatccgctag

SEQ ID NO: 6342 - DNA, 1323 bp, Pseudomonas aeruginosa
tcgcgaggtggttattcgtcctgcgccatcgcctggcgcatattcccctctgacctgaagcggtcacggttttttctaaggcgtgcccctgcagcgtcgctcccggatcggctatcctgccctgccacccgtctggccgggctgtcgtccggcgagtctctgcaggaagtcccgatgattcagagcaagctgccgaatgtcggcaccaccatcttcacccgcatgtcgcaactggccgccgagtgtggcgcgatcaacctctcccagggctttcccgatttcgacggcccgccggagttgcgcgaggcggtaggcaggcatatcgccgccgggcacaaccagtacgcgccgatgaccggcttgccggccctgcgcgagcaggtggcgaagaagatcgagcagttctatggacgccgggtgagcgccgacagcgaggtgaccatcacgccgggggcgaccgaggcgatcttcagcgcgatccaggcgctggtccatccgggcgacgaagtggtggtactcgacccgtcctacgacagctacgaaccctccgtgcaactcgccggcgggcgttgcgtgcacgtgccgctggtgctgccggacttctccatcgactggcagcgcatggccgaggccatcgggccgcgtacccggctggtcatcatcaataccccgcacaaccccagcggcgcgctgatcagccgcgaggaactggaccgcctggccgcgctgatccgcgaccgggatatctatctgatcagcgacgaggtctacgagcacctggtgttcgacggtgtcgcccataccagcgtgctgtcccacgacgagttgtatccgcgttccttcgtggtcagttcgttcggcaagacctaccacgtcaccggctggaagaccggctacgtggtcgcgccgccggcgctcagcgcggagctgcgcaaggttcaccagtacgtcaacttctgtggcgtcacgccgctgcaatgggcattggcggactacatggccggccatccggagcacttgcggcaattgcccggcttctaccaggccaagcgcgacctgttctgcgacctgctgctggactctcgcttccgttttacccgtgcgccgggcacctacttccagtgcgtggactattcggccatccgtccggacctggacgacgtggccatggccgagtggctgacccgcgaacacggagtggcggcgatcccggtttcggtgttttatgaaaaggctccggacgccatgcggctggtccggttctgttacgccaaacgcgaggagacgctgcgtcaggcagcggaaaagctatgcgcgatctga

SEQ ID NO: 6343 - DNA, 480 bp, Pseudomonas aeruginosa
ggtcgcgccaggggcggtgcggcacagggcggtggcgatggcggtggtctgctcggttcgctgggcagcatccttggtggtgccggcggcggggccgcgagcggcgggctgggtggcgtcctcggcgatctgctcggtggcgccgcgggcggtgccgggcaggcggcgccgggcgtggaggccggctcactgggcggactcggcgggttgttccagatgctccagaacgcaggcctgggtgatgccctgaattcctggatcggcggtgggccgaaccagtcggtgtcggcggcggacatttcccgggtcttcggcgacggtcaattgcagcaactggcggactccgccggagtcagccagggcgaggcggccgaacacctgagcagcctgctgccggaactggtcaacaagctgacgccggacggccaggcgccgcagggcgacctggacatcggttcgctgctggcgcgcttcagctaa

SEQ ID NO: 6344 - DNA, 705 bp, Pseudomonas aeruginosa
ggctttcccgtcgatgcggagcggatagccgcgatacggttatccgctccactcaacggggcgaggccgccctcgacggcaggtcggtcaataggcgctggcgctgtccaggcggtggatcgcctgttcgtcgagcttcaggtgggtggcggcgatcaggtcgtcgagctgttccaggctggtggcgctggcgatcggcgcggtcaccgtcggacgagcgatgagccaggccagggcgacctgcgtcgggttggcgttgtactgctcggccacttcgtcgagcgccgcgaggatggccacgccgcgctcgttgagataacccttcaccttctctccccgggctcgcccggcggtgtcggcctggttgcggtacttgccgctgaggaagccgctggccagcgagtagtagctgatcaccccgataccgagttcttccaccgtcggctccaggttggtctcgtagtcggcgcgatcgtacaggttgtattcgggttgcaggctctggtagctcggcaggttaagccgggcgctgacctggcgtgcttcgaggaggcgccgggcgtcgtagttggaggcgccgatgacccgtaccttgcctttcttgatcagttcgccataggtggaaagggtttcctccaggtcggtgtggggatcgtcggtgtgcgactggtagaggtccaggtagtcggtctgcaggcgtcgtag

SEQ ID NO: 6345 - DNA, 477 bp, Pseudomonas aeruginosa
atatccgcagggagcacacgcatgaacagcgacaccgagaatccgttccgcccaccggaggcccgcctggacgagcctgacgccacccatggcgagccgctgtacaggctttccgcgatcggtctgggtaccttcatcggcacgcccctggccggtgccttcctcgcggcggtgaatctccgtcgcctgggacgggcgcaggaagtcgggaaaacctggctggtcggcctctgcctgtttgtcctgctgccagttctgggcgcgatactgccggagaacatcccctcgatcggcttcacggtggcgcagatattcggcatggtctactacgccaaatcagccttcggtccggccctggacagccacaaggcagcgggcggagcgttcatttccaactggcgggcggcggggatcggcctgctgttcatgttggtggtcctgtcggtagcgatcccggtggtaatgctggtggtgtga

SEQ ID NO: 6346 - DNA, 447 bp, Pseudomonas aeruginosa
tcgcggccgatgtcggccggatcgatcggcaggtacggcacttcccagatcgcgtcttccttctgctgggcgaagcccttgcgaatggcatcctggtgcgagccggagaaagcggtatggaccaggtcgccgacatatggatggcgcgggtggaccggcaactggttgcactcttcgaccaccttgcgcaccgcgtcgatgtcggagaagtccagttgcggatgcaggccctgggtgtacatgttcaaggccagggtcaccaggtcgacgttgccggtgcgctcgccgttgccgaacaggcaaccttcgacgcggtcggcgccggccatcaggcccagctcggtggcggccacgccggtgccacggtcgttgtgggtgtgcaggctgatgatcacgctgtcacgcttgtcgacgtggcggccgaaccattcgatctggtcggcgtag

SEQ ID NO: 6347 - DNA, 450 bp, Pseudomonas aeruginosa
acgtggacgatggccttcttcgccccgcgcagggattcgaaggtgcgggtgatcaggtcttcgcgggcctgggtcagcacctggatggtgacgtcgtccgggatgtggttgccttcgatcaactcgcggacgaagttgaagtcggtatcggaagccgacgggaaggccacttcgatctgcttcaggccgacctgcaccagggtcttgaagaatcgcatcttcttcgccgcgtccatcggttcgatcagcgactggttgccgtcgcgcaggtcggaactgcaccagatcggcacctcggtgatggtcttcgacggccaggtgcggtcgggcagattgatggccgggaatgggcggtatttctgcgaagggtctttcaacatgctcatggggctaatcctttggagtcggttcctgggccggcggggccaggcgaacgcagtgacgagatga

SEQ ID NO: 6348 - DNA, 1236 bp, Pseudomonas aeruginosa
cgacaggcgcattcttcttttcggcatgacccggcgcgagcggccatccggcccgctacgcggtggtcttcattcaagacggcgggagtcgcaggtggcgaccactctgaaacgacaaggcatcggtgcatggctggctctgttcgccatgctgatgatcttcgtcgggccgctgatctcccagtcgatgccgatggaccacccgatgccgatgggcgtggggatgggccacgaaggcatgtcccacgagaacatggaccatggcgacatggcccatgccggctgttccgatgcccagcgctccgtcgtccatgccggcatgccggggatgggcggcgaggaaggcaatcgcctggccagcgacgtgctctgggagaagtgcggttattgcagcctgttgttccacagcccgccgctcaccgaagacgcctgcctggcgctgttctccgttcccttcgcgacggcgcccgccgtcgctttcctgaacgaggcgttcgtcgcctcgccggtgtttcccggcgcccgtacccgtgcgccgccgttcctgatcgcctgacctctttcaatccgatagccgccgcttcctgggggcaccggcgcgtcttcgccgcgccggtgacgcgagcctggccgcgtgcctgctcgccgtgggggcggggcggaagtcacatagatcatggaaaaacgtatgtctactcaacaacgagcggccggcaacgcctgcccgaccgccgctttcagcttcgaccctgcccgtctcgcacaacgccgccgctgggcgggagccttcgccgctctgtgcggcctggccctgtctccgtcggcgctcctggccgaggaacactcacagcaccaggatcacgccgtggagctggcgccgagcgtggtcaccggagtcgcccagagttcgccgctgaccatcgtcaccaatcccaaggagccgcgccaaccggtgccggccagcgatggggccgactacctgaagaccattcccggcttcgcggtgatccgcaacggcggcagcaacggcgacccggtgctgcgcgggatgttcggttcgcgcctgaacatcctcaccaacggcggcatgatgctcggtgcctgtccgaaccggatggacgcgccgacctcctacatctcgccggaaacctacgacaagctcaccgtgatcaagggcccgcagacggtgctctgggggccgggcgcgtcggccgggacgatcctcttcgagcgtga

SEQ ID NO: 6349 - DNA, 456 bp, Pseudomonas aeruginosa
gccggagcgcttcggagaactcggctcgcgggtcaacgccagcctgctggccggctccaatggccgcttcgacaaggtgctggacgccgccgccggcaaccggctcggctacctgcgcttcaccggcaaccacgcgcagtccgacgattacgaggacggcgccgggaataccgtgccgtcgcgctggaagaagtggaacggcgacgtcgcggtcggctggacccccgacgaggacaccctgatcgaactcaccgccggcaagggcgacggcgaggcacgctacgccgggcgcggcatggacggctcgcagttcaagcgcgagagcctgggcctgcgcttcgtcaaatcgaacgtcagcgatgtgctggagaaggtcgaggcacaggtttactacaattaccccgaccacatcagggacaagttccgcctgggcactcccggacccatccggcatga

SEQ ID NO: 6350 - DNA, 1422 bp, Pseudomonas aeruginosa
tccatgcaatcgaacgaaaagaacggccgtgacttctacgcgctggcctggcgctggcatttctacgctggcctgttcgtcgcgcccttcatgatcctgctggcgctgaccggaatcgtctacctgttcaagccgcaactggatgcgctgctctatccgcaactgctgcgggtcgaggccggtgcgcagatgcgcagcgccgaccagttgctcgccggggtgcgccaggcgcacccgcaggccgccgtcagccagtacctgccgccgagcgaggcggggcgcagcgcgcaattcgtgattggcgaaagagggcagggccaatggaacctcttcgtcgatccctacagcggacgcgaactcggccgccaggatgcgcaactgaatctccaggcggtggcccgggcactgcatggcgagctgatggtcgggaccatcggcgaccggctgatcgagctggccgccggctggggcatcgtcctggtggtctccggtctctatctgtggtggccgcgcgggcgggcggcgagcgcgctgttctggccgcgcctgcacctgcgcggacgaccgctgtggcgcgatttacatgtggtcgccgggttctggggcagcctgctgttgctgttcatgctgctcagcgggatgacctggaccggctactggggcaagcagttcgccgatgtctggaaccgcttcccggcggcgatgtggaacgatgtgccgacctccgacatgcaggccggtagcctcaacagcgcgtcgcgccagcaggtgccctggccgctggagaacactccgctgccgcgctcgcagccgccggcggccgacgcccatgccgagcatcgcgggcattccgcccaggccgggcacgcgatgccgatggacatgccgatgccggcgggcatccctctgcaaagggtggtggatatcgcccgcgagcgcggcgtggcggcgggctacgggatcgccctgccgagcgggatggagggggtctacacgatttccgtgttccccgacgatccgcgccacgacgccaccctgcacatcgaacagtacagcggcaaggttctcgccgacgtgcgttggcaggactacaacgcggtggcgaggagcgtgcagatgggcgtcgtgctgcacgaaggcaagctcttcggcctcggcaaccagttgctgatgctcgcggtctgcctggcgatcctgctcagctcggcgagcggcctgtggatctggtggaagcgcaagccggccggacgccttggcgtgccgccgctgcgccacgagctgccgcgctggaagagcggcatcgccatcatgctggcgctgggcgtggccttcccgttggtgggggcctcgctcctgctggtctgggcgctggactggctggtgctgtcgcggctgccggcggttcgccgggtcctggcttga

SEQ ID NO: 6351 - DNA, 918 bp, Pseudomonas aeruginosa
tttcgatgcgcgccggctgcgcccgcgccggccgagagtctggcgctggcgcctggcggcggcgttcgcggccctggtggcgagcctgggcgtgctgctgtcgctggccggcacctcggccttgatcggccgccagccggctgtcggcatgctgcatatcgaacccgccgctggcggcgtcttgctggcccttggcctgctgtcgctctgcctcggcgtgttgttctggcgtttcagccgccgccgcagccgccgcaacagcgacctgagcctgtcgccgaacctgatgaaaaagcgcgactgagcgggctgccggcgtccggccgatccggtaaactgcgccgcttcgcggaggctcccatgcaagacgacgacttttccctgttcaagagcgagatgcgcggcgtcaagcgcatctcggtcgatcgagccgataccggcaaacctcgcaacgaccgccagcaactcaagcaacgccagctcaatgccagcgtgcgcaacgacgaaatccgcgtcgatggcctgtccgaccagttcgtcatcgacgtcggccccgaggacgagctgtcctgggcccgcgacggcgtccaggaaagccagttgcgcaagctcaagcagggcctggtgcccttcgacggtagcctcgacctgcacggcatgagcgtggagaaggcccggcagacgctatgggacttccttgccgaggccacccgcctggaaatccgctgcgtgcgcgtgacccatggcaaggccgcgcgcaaggacggacgcagcccgctggtgaaaagccacgtcaatacctggttgcgccagcacccgcaggtgctcggtttcacctcctgcctgccacgccacggcggcaccggctcggtctacgtgatgctgcgcaggaccatgctcgaaggccgcgacgagtag

SEQ ID NO: 6352 - DNA, 2445 bp, Pseudomonas aeruginosa
cgatcatccggctggccaggtcgccggcctggtgcccgcccatgccatcggcgaccgcccagagcccgcgatccgggcagtccaggaaggcatcctcgttgcgcgcgcggaccttgccgcgatccgtgcgtgccgcgctgcgccagggctcggtgcgttgcatcagagctgcaccggcatgcggaagctgcgcaggaccgcgagatcgaacggattcggcgtgcgctgggcgagcagcaggtagttggcgcgcaggccgcccaggtcggccttgagcaccatcacgtcacgcccgctgaggtactcggtctgcatcaggtcgaacagcctgaacagcgaccagggcccggtattgcgttcgattcctaccggtcgtccggccatcttctccagcaccaggctggtgcggccgccgtcggcgtcgctgggccacttgaacgacatcggcacgatcgggccgtggcggtactccatggactgaccgtcgaaacggaactcggcgcggctgacgccaggatcgagggtatagggctccaggcggaagcgcacctgtggctcggccgggttctcggcgaagaagctctggcggatcacctgggccgtgcccatctggtcgagatagaccttggacatcggcaggctgtaaccgtccacgctgcgcaggcggtaactgcccgggtcgccgctgacgaagggccgcatgtaggtttcgaagaagcgttcggcgacgccctgcgccttgaagaactcgcggaaatcgctgaccgcgacatcgctggcgctgtgcgcgttgaacgggtagcgcttgttgatcgccttgctgtagaaaccgtacagctcgctctggtagcgctggttgaggtacaggtaggcatcgccgaggaccagccgccaggcgtcttcggccagcacgctgaaccatccgccgagcggtcgcggcagtcgcgcggaggcgttgcgcaggttgctcagggcatcgcgctggccgcccatgcggctcttcgccatgtcgaaagccgcctgctccggctggctggcgcgcgccagtccggcgagttgcaactgcaactcgttgagcgcctgcaacagcggggtgaggtcggccgccgggccgttgttatcgtcgagcaggcgatgcaggggctcgaagcggcgttgcagggatttcttcgcggtatccggcaggttcttcgccaacgcgtccatggcattgccggccgccgcggcggccgcattgcccagcttgccgcccttttccgcggccttgtcgctggcctctgccagcgcctcggcgctctccgccaggaccgggaaacgggtgttctcacggacctccagcaacaactggaggatcggcgagttggcggcgagcagcccggaaacctggtcggcgccctcgccggcatcgttgaacggcagcaggcccaggcgtccgaccgcctcgctccagaagttcgcgtagtcgcggaaatacagctgctcgagttcgaccatcaggcgccgcaggtccatgtcgctaatcccgctgccctcgcccaggacccagttgtcgcgaaggatgtcgttgaccaggctggcgccctggaccacgaagtactgctggtagccctgctgggtgtagaaccccggaatcacgtagtcggtgccgacgaacagaccggcctgcggccccaggtgctggccgaagcgatactcgggcaggcttcgcgcctgttcgcgcagcacccggtagaccacgttggccagggactcgctgcgcagcacctggcgtgcctgggccaccagggtctcgttcagcggatagctgaacggttgctcgagcagacgggcgaaatgcgtgttcaggccattctgcacggtgccgttgccggcatagcgctgcgaccagtcggtagccacccagtccttgagccatccgttctcgcggcgctcgcgcagattcagcatcaggtaggcccgcaggctgttgagcaggcgttcgcgattctgcatgttgccgcggatctgcgcttcgagcatccgcgccacgcgcggcagcagttgcgtctccagctcgcggcgataggccgcggccagcggcgggttgacctcgttgccctggtacagcccggcgcgctcgtgcagcgagacttcccctttgggcggaaacacggtggtcgccgcatagctgctatccagcgtcttcagcgccgccatggcgtcatcgcgctcgccaagcgcctggcgctgctgggtccattgctgcgccagctcgcggacccgctccaggcgctcgtggttggccaaaaaaaccgccagcccagagcaggccgaatagcagaaggagcgccagcgaaccgacgtacagggcgcgctggccccagtggatgcgcgtgcgttcgcggcgatcgagacctgccaggttggcctcggggaagatcacctggctcagcaggtgatggatga

SEQ ID NO: 6353 - DNA, 276 bp, Pseudomonas aeruginosa
tcacctggctgttcaggcgtcgcagaaggtcctcgaacgcctggcgcaggaccgtcacatctgtgccgttctgctccttgccgaagctggtgcccagaacctggtcgctctcctcgcggctcaactggtcgaagaactcgtcgaagccgagcaactggtcggccttgctcagcaccaggtagaccggcagatcgaggtgcagggtctgctggatttcctgcaggcgcgcgcgcacctggcgagccagcgtatccagcgccatctcgtcgtcgctga

SEQ ID NO: 6354 - DNA, 1446 bp, Pseudomonas aeruginosa
tcatgttcagttcctgatggcccagaatttcagttcaagctcggagaactcgccggatacgtggaacgcgaaaccgccggagcgctccagctgggtcatgtcctcggcgttgggttcgagaatgaaataggtcttgttggagtggaacgggatctgccgcggcgccaccggcagcggcttgacccggatccccggcaggtgcaggttgaccaactggcgaatgtgctcgaccgcacccaccttgagatgcgcgggcaggcgctggcgcagttcctccgactcgcaattggcactggcggcgagcacgaacgaggcgctgccgagcagcttgtggtcgtgcaggggcgagaccaggatgccgtactggcgggcctggagaggcagttcgatggcatgctgctcgagcaccatcgacaggacctggcgaatcgcctccatcagcctgcggaagctggcgccctggtcgctgtgctggtaacggctgtccaggcgcggacgcttgctctcgctgccgaaggtggcgaggtcgccgagcatggtcagcagcacccggtacaactgctccggatgcacctgctccaatcccaggtagtggcgcagcagcaactcggtgcgattgatcagttgcagcatcatgaaatcgccgacctccgcgccgccgaccttgccattggaccggatacgctcggcgatggtgtcgccgcgatggccgagcatgctaatcacctccttcaggcaggacagcaggtaggcggatgcgtgggcatggaggtagctcggcacgaagtcggggtcgaggctgatcaccccgtccggcgtggtatccagcaccaccgccaccttcagtttgacgtaggcctggtcgttttgctgctcgccgagcagcaggcgaaaatccggccgcgcgcagctgacctgcaccatggaatcctcgccggcgttggagtccgccacctccagatcgtaggcggtatagcgcgccaggacctcggcctgctccggccggcgcgcctcgatgtggttaccggtgaccagcggcagggccaggtagatcggcacgttcgaggtattgggcggcacgtcgagggcgagcggctcggtgttgccgccgagttcgaacaggctgccgtcgggcagtacgccggaggcctggctgatcaccagcttgcccatgttgaggaactggcggtccagctccagggcgaggaagccccagttgtagctgcccagcaactgggtccgggccttcatctggttgtcgtagtagcggtcgttgtgttgcagatgctgcgggcgcagcagcatgccttcctgccagacgatcttgtgcacgttcatcgcgcgtcacccgccttgccgagcagttcgccggcattcaggatgcccttccggcccagcttcagctctacccgggtcagctctttcgccgtgaccggcaccacgtag

SEQ ID NO: 6355 - DNA, 426 bp, Pseudomonas aeruginosa
ccgggcggcgcgccgatcaggcgcgagacggtgtgcttctcctggaactcggacatgttgatggtggtgatgaaacgctcgccgccatacagcaggtcggccagcgccagcgcggtctcggtcttgcccaccccgctcgggcccaccagcagaaacacgccgaccggcgcatcgggcttgttcagcccggccgcggtggcgcgcatcgcgcggtccagggcgctgaccgcctgttcctggccacggatccgcgcccgcaggtcgtcagcgaaccccatcaccttggcgttgtgttcccgcgccagttgttccaccggtacgccggtccaggcgccgatcacctcggcaaccaggcgcgggcagacctcgaagctgaccagccgcccctgggcctgggcatcggcgagtgcctggcgggtttcgtga

SEQ ID NO: 6356 - DNA, 414 bp, Pseudomonas aeruginosa
agggccttttccagggcttcgacaccgccatgctcgtcggccgggaaagtctccgcgttcgcctcgccgccctgctcttcccggttcgcctcgcgggccctggccaattgctggcgcagggcgagcaggcgctcggcgagttcgcgctggcggctccactggtcctcctgtacgtgccgctcgctttccgcctgggccaggcgctcctccagcgcctgcagggcatcgtggtcgatcggcaggcctgcctcggcatcgcggcgcagggcctggcgctggcgctcgccttcggccagctcgccgcgcaggcgctcgagactctccggcgccgccgccaggctgatgcgcacccgcgcacaggcggtgtcgaggacgtcgacggccttgtccggcaactggcgacccgccaggtag

SEQ ID NO: 6357 - DNA, 492 bp, Pseudomonas aeruginosa
ccgcccgcgccgataagcgtatgggcctcgtcgatgaacaggatggtcggcctgagcgctgccttcacttcgtcgatgacgcctttcaggcgccgctcgaactcgcccttcacgctggcaccggcctgcaacaggcccatgtcgagggacaacagctcgacgtccctcagcgccggcggcacttcccctgcggcgatccgcgaggccaggccttcgacgatggcggtcttgccgacgccggcctcgccgaccacgatggggttgtttttccgccgacgggccaggatgtcgaccatctggcgaatagccccgtcgcgacagagcaccggatcgagcttgccgtcgcgcgcctgctgggtaaggttgtgggtgaaacgctgcaacagggactcgccgccgcccggcttgccgctgggcgcgccctccagcggctgcgagagcgcgaaatccttcaaccgctcgatgtcgagccgcgccagcagcggctggtag

SEQ ID NO: 6358 - DNA, 453 bp, Pseudomonas aeruginosa
gaattgagggcgcgaagccctattcgagcaccacctcgagatcgaggtggcacagcctgcgataaatgtcttccttgcgttctcgcacggcgtggttctgcggcaacagctcgcagcagctatgcagcaggtgcagtacatccagcgccagatcgggctcccaggcgtgcaatcccgattcgtgcaactgatggtcgaggctctccagctgggtcttggccagctcgtacttcttcgccaggaagcacagtcgcgcgaggctcagttgccagaagaaccgggcgcgtccgccgtgggcgcgcttcatgccctgcttcaacacctgtaccgccgccttcaggccgtccttgcgcaacaccggctggacctcgtccagggcgacgtcccattcggcctgcagggccacggtctcgaccttgcgcggcgcactgtcgttctggagatggggcatga

SEQ ID NO: 6359 - DNA, 2217 bp, Pseudomonas aeruginosa
cgccgtggtcaggaaagcccgcgccgggtcgatgccgctttgtttgttgtaggcagcttccgatcgagcctgcgcgcccttgtctcgcccgcgccaggcaggacaatcgaatcggtcgcctgcgccagtgagggacaacggatgttcgcagcagccaaccagacccacttcagcctcgccatcgacggcctcgccatcgacctgcaggtgctctccttcagcggccgcgaagccatcagccagccgttcgccttcgacctggagctggtcggcgaacgccccgtgccggacctcgaaagcctgctgcacaaacccgccttccttaccctcgggcccgccggcaacggtatccacggcctggtgcgcagcgccggacagggcgactcgggcaagcgcctgacccgctaccgcatcaccctcgtcccgcaactggcctacctcgcccagcgcaccaaccagcgcatcttccagcacctcacggtgccgcagatcgtcggccgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccggccggcggtcaagcgcttcggcgtacgcctggaaacccgcaccagccgcgtcacccgccgcgactacgacttcgagaaaccgcgcctgacgctggaaagcgccgcccgcggcgaagcccggccggacctcgaggactacgactatcccggtcgcttcgtcgaccgcgagcgcggaaagcacctggccaggcgcgccctcgaacggcagcgcagcgactaccgcctggccgagggccgcagcgaccaaccgttgctgctcagcggccacttcctgccgctggccgcccatccccaggcgggctggaacgacctctggctgctcaccgaggtgattcacgaggggcggcagcctcaggtgctggaggaaagcatcgtctccgatgcctcggcgagcccggacgacttccggcagggttaccgcaaccgcttccaggccacgccctgggaggcgttcttccgtcccccaccgacgccgccgaagccgcgcatcctcggcacgcagagcgcggtggtgaccggcccgaagggcgaggaaatccactgcgatcgctacggtcgggtgaaggtgcaattccactgggatcgcgagggccaggccgacgacagcagcagttgctggttacgcgttgcctccggctgggcgggaaggaactacggtgccatcgccatcccgcgggtcggcatggaggtgctggtgaccttcctcgaaggcgatcccgaccagccgctggtcaccggctgcctgtttcacagggaacatccggtgccctacgaactgccggggcacaagacccgcagcgtcttcaagagcctcagcagccctggcggcggtggctacaacgagctgcgcatcgaggaccgcaagggccaggagcagatcttcgtccatgcccagcgcgactgggacgaaaacatcgagcacgaccagaagatccgcgtcggtcaccaacgccacgacaccgtgcaggcgaacagctacagcgagttcaaggccgaggaacaccgcaccacccacgccgagcgcaaggtggaggtccgagccagcgaccacctcaccgtagccaacgaccagcacctgaagatcgccagcggccagttcgtcgaggccggccaggagatccacctgagcagcggtctgaaggtggtgctggaggccggcgccgaactgaccctcaagggcggcggcagcttcctcaagctcgacgccagcggcgtgaccctctccggggccaacgtccgggtcaactccggcggcagcccgggcaacggcagcggcgcggcgccgctgttgccggggccgccgctcgacgcggatgcggcgacagcgggccaggtactggacaacccggcgcgtagccgtcccgagcggaaggggccggaacaattgatcgtcgatgtctggggagacccggcgcaaggaagccaggtcgtactgttgccaccggagagcgaggcatga

SEQ ID NO: 6360 - DNA, 1053 bp, Pseudomonas aeruginosa
gacagggagatctgccgggcactgggcgcgacttcagcgctgtgccagcagttttctgccgcgggcgacggcggcacggacctggttcggcgcggtgccgccgatatggtcgcgggcgttgaccgagccttccagggtcagcacgtcgaagacgtcggcgtcgatctgctcgctgaagcggcgcagttcgtcgaggctcatctcggcgaggtccttgccgctgtctacgccgtacttcactgcgtggccgacgatctcgtggcagtcgcggaacggcaggcccttgcgcaccaggtagtcggccaggtcggtggcggtggagaaaccgcggcgtgccgcctcgcgcatgatctcgcgccggggccggatcgccgggaccatgtcggcgaaggcgcgcaggctgtcgcgcagggtgtcggcggcgtcgaacagcggttccttgtcttcctggttgtccttgttgtaggccagcggttggcccttcatcagggtcagcaagccggtgagggcgccgaacacccggccggacttgccgcgtaccagctccggcacgtcggggttcttcttctgcggcatgatcgaggagccggtgcagaagcggtcgggcaggtcgatgaactggaactgcgcgctggtccacagcaccagctcttccgagaagcgcgacaggtgcatcatcgccaggctggcggcggcgcagaattcgatggcgaagtcgcggtcggagacgccgtccagggagttgccgccaaccgcgtcgaagcccagcaactggcaggtgatctcgcgctggatcgggtaggtggtgccggccagggccgccgagccgagcggcatgcggttgacccgcttgcggcagtcgaccaggcgctcgtagtcgcggccgagcatctcgaaccaggccagcaggtggtggccgaaggtcaccggctgggcggtctgcaggtgggtgaaaccgggcatgatggtgtcggcttccgcttcggccaggcccagcaggccctcctgcaggcgggtgatctcggcgaggatggtgtcgatctcgtcgcgtag

SEQ ID NO: 6361 - DNA, 936 bp, Pseudomonas aeruginosa
gcaacccctacgacgaggcgctcgagtcgcccccgtcgaaaggcacgcgacaggcgttacacaatatcgatgcacgacttggggcacttttcgggcctaaagcgagtctcagcgtcgagcgccgtgacggacggcactacacctgtctacgctatccatgtgcgcgactcatgcaggaagcctgagcttatgaatgtcctgattgtcgatgacgaacctctggcgcgagagcgcctggcccgattggtagggcagctggacggctatcgcgtcctcgagccctcggccagcaatggcgaagaagcgctgacgctgatcgacagcctcaagcccgatatcgtcctgctggatatccgcatgcccggtctggacggcctccaggtcgcggccagactctgcgagcgggaagcgccgccggctgtgatcttctgcacggcccatgacgaattcgccctggaagccttccaggtcagcgccgtgggctacctggtcaagccggtgcgcagcgaagacctggccgaggcgttgaagaaagcctcgcgaccgaaccgcgtgcaactggccgcgctgaccaagcccccggcctccggcggcagcggtccgcgcagccacatcagtgcacggacccgcaaggggatcgagctgatcccgctggaagaggtgatcttcttcattgccgaccacaagtacgtgaccttgcgccatgcgcagggcgaggtgctgctggacgagccgttgaaggcgctggaagacgagttcggcgagcgcttcgtgcgcatccaccgcaacgcgctggtcgcccgcgaacggatcgaacgcctgcagcgtacgccgctggggcatttccagctctacctgaaaggcctcgacggcgatgcgctgaccgtcagccggcggcacgtggccggggtcaggcgtctgatgcatcagctctga

SEQ ID NO: 6362 - DNA, 1050 bp, Pseudomonas aeruginosa
cggcggtcggcggttcgccagcgacccgggtgcggctatcgggcccagcgtccgcgcactcgggttcgaactgttatcatgggcgcatccctgtgcacggaatatcccatgtcgtcccgcgaaatccgcatcgccactcgccagagcgccctcgccttgtggcaggccgaatacgtcaaggcgcgcctggaacaggcgcatcccggcttgaccgtcaccctgctgccgatgaccagtcgcggcgacaagctgctcgacgcaccgctggcgaagatcggcggcaagggcctgttcgtcaaggaactggaaaccgccctgctcgaaggcgccgccgacatcgcggtgcattcgatgaaggacgtgccgatggactttcccgaggggctcggcctctacaccatctgcgagcgcgaagacccgcgtgacgctttcgtctcgaacacctacgccagcctcgagcaactgccagccgggagcgtggtcggcacctccagcctgcgccgccaggcgcagctgctggcgcgccggccggacctgcagatccgtttcctgcggggcaacgtcaatacccgcctggccaagctggatgccggcgaatacgacgcgatcatcctcgccgccgccggcctgatccgcctcggcttcgagtcgcgcatccgctcctcgatcagtgtcgacgacagcctgcccgccggcggacaaggcgccgtcggcatcgaatgccgtacggccgacagcgacctgcatgccttgctggaacccttgcaccataccgacacggctctgcgggtcactgccgagcgcgcgctgaacaagcggctcaacggcggttgccaggtgccgatcgcctgctacgccatccgcgagggcgaccaactgtggctgcgcggcctggtcggccagcctgatggcacccagttgctgcgcgccgaggggcgggcgccactggcggacgccgaggcgctgggcgtgcgggtggccgaggacctgctggagcagggcgccgaagcgattctcgaagccgtctacggcgaggccggacatccgtga

SEQ ID NO: 6363 - DNA, 1344 bp, Pseudomonas aeruginosa
catcgcaccggccctgagcgccttgcagtcgtacgtgtcgcgccgcgaggccgccggcaacctggtgcccgaggcgcaggcggctccggccacggagggccgtccatgagacgcatctacctcctggttctggcggtggtgctggtcgccacgctggttgggctggcgatctccgagcaggccggctatgtgctgatcgcctacaagagcttccgttacgaatccagcctgtggtcgttcctcgccctgctggcggtggtctggctgctggtggtgctggtgcgcctggtcctgcgcctgctcggcagctcggggcgggtggtcaacccctggtcgcgctacaaccgccggcgtcgcgtgcagatggccgagcacagcggcctgcgcgatctcggcgaaggcaactggccgcaggcgctgcgtcatttgcggcgggctgcggagatgggcgagcggccgctgatgcattacctcggcgcggcgcgggccgccaacgaactcgagcgctacgacgaggccgacgacctgctgaaccgggctcgcgagcgcgagccggatgcccaattgctggtcggcctgacccgtgcgcaactgctgatcaatcgcggcgactacccgcaggcacgcaataccctcgaagagctgcacgggctccagccgcagcaccgcacggtattgcggctgatgcagcagctgtacgtcacccagcacgactggcaggccctttgcgtcctgctgccggagctgcgcaaggagcgtgtgctgaaggattccgaactgcgcgacctcgaacgccgtgcctgggtggcttccttgcaggaagccggcgagcgtggactgaacgagggcgaaacggcgttgcagccgctgacccagcgctggcagaacgtgccttcggcgctgcgtgcagacccggcgatcgtcgcgggctatgccgcccaactgcttcgcctgggcgccgaggaagaggctgaagaagtcctccgccatgcgctcaagcaaggcttcgacgcgaccctggtgcaactctacgggcaggtgcgcgggcgcgatccgggcaagcaattgcaggccgcggaaggttggctcaaggaacatccgaacgatcccggcctgctgctgaccctggggcgcctgtgcctgatcaacaagctctggggcaaggcccgggaatacctggaggccagcctgagcttccagcgcagtgccgagacctgcgccgagctgggacgcctgctggcgcagctcggcgaggtcgagcgcagcaaccagttgttccaggagggcctggtcctgctcgatcggcgtactccggggctgcccgtggtggtggcggggatttga

SEQ ID NO: 6364 - DNA, 462 bp, Pseudomonas aeruginosa
aggtcctgcggcaacagttgcacgaacgcttcgagctggaggactgcctcatcgaagtcctgcacaacgcccacagccagagcggcgcagagggttcggcagtaccggtctgattcaccggcgagtcgttacgaaacggcgcgtctccatgcgggagagcgccgtttttgcatttcagcggaagcccagcaggtcgatctcgaagaccagcggagcgtcgggcgggatcaggtcgccagcgccttcgtgaccataggcttgcgccgaaggaatcaccactcgccagcgcgcgccgacaggcatcgctcgcaacgctgtccgccatccctctatcacactgtccagggcgaaccactcggcgctttcgctctggtcgaacacttgaccgtcggcaagcaggccgcggtaacggacgtgtacctgggttgccgcgccgatgccgttaccttggccacgacgtaa

SEQ ID NO: 6365 - DNA, 450 bp, Pseudomonas aeruginosa
cggcgaagcctgcggccaagccggctgcgaagcctgctgcgaaaccggcggccaagcctgcggcgaaaaccgcggcagcgaagcccgcagccaagccgacggcgaagcctgctgcgaaaccggcggccaagcccgcggcgaaaaccgcagccgcgaagcccgcagccaagccggcggcgaagcctgtggcgaaaccggcggccaagcctgcggcgaaaaccgcagccgcgaagcccgccgccaagccggcagcgaagcctgtcgcgaaaccgacggccaagcccgcggcgaaaaccgcagccgcgaagcccgcagccaagccagctgcgaagcctgcggcgaaaccggcggccaagcctgtggcgaaatccgcggccgcgaagcctgcagccaagccggctgcgaagcctgcggcgaaaccggcggccaagcctgcggcgaaacccgtag

SEQ ID NO: 6366 - DNA, 423 bp, Pseudomonas aeruginosa
ccgcgaaacctgccgcaaccaagcccgccaccgctcctgctgcgaagcctgcggcgactcccagcgccccggcagccgcctccagcgctgcttcggcaacgcctgccgcgggcagcaacggcgccgccccgaccagcgcctcctaaggcgctgtctgcaaagccgccgagccaagcaccagcaaagcccggcgctctgcttccgtgcagatgtcccggctgcaggcttgcagccaggcatccgcactgcgattcgcttcctggccctccagccaggctgtggccaggtcggccaggcgttgcaggtgttcccgttccgctcgtagttcctgggccttcatttcctcgcggagttcggccaggcaggcgtcgtgggttgccgcttcgcgccaggcgcaacgcaatctgcgcaggggttcgatga

SEQ ID NO: 6367 - DNA, 582 bp, Pseudomonas aeruginosa
gtgatggaagacttgcaggtgttgacgcagacctggagcgggccgctggtggtggcgatgcagatcctgctcatcctgctggtcgcctggctgctacagcgcctggtccgacgcacggtgacccgtatcggcgagcgttatccggtgccgccggagctgctcctgccgctgcgtgggggcctgcgctggctgatcatggtcagcgcactgatcatggtgctggagcgcctgggcgtgtccgccgaagtgctgtggaccgcgctgaccggtttcgccgcggtggcggcggtagccttcttcgccatctggagcgtgctctccaacctgttctgtgcgttgctgatcttcaccgtcgggccgttccgcatcggcgaccgcgtggagctgatcgatagcgccgacaaaccgggcgtcaccggacgcgtggttgccatcaatctcttgtatacgacactggaagaaaccctcgaggatggctcgccgggcccgctgctgcagattcccaacagcctgttcttccagaaagccgtgcgtcgctggcgtgggccaggtttttcaactccaacaaaaaacgggaaataa

SEQ ID NO: 6368 - DNA, 765 bp, Pseudomonas aeruginosa
ccatctatggaatggctcgccagtcctgaaatctgggtcgcgttcctgaccctgaccgccctggaaatcgtcctcggcatcgacaacatcatcttcatctcgatcctggtcgggcgcctgccgccggcccagcaaccgaaggcgcgcttcttcggcctggccctggccatgggcacgcggatcctgctgttgctctcgatcacctgggtcatgcgcctgaccaccgacctgttccacctgttcggccagggcatctccgggcgtgacctgatcctcttcttcggcggcctgttcctgctgttcaagagcaccatggagatctaccacagcctggaaggcgcggaagaagagcagaagagcggcggcaaggtccacggcttcatgggcatcatcgtccagatcgcgatcatcgacatcatcttctccctggactcggtgatcaccgccgtcggtctggtgcagaacgtgccggtgatggtcgcggcgatcgtcatctcggtcggcgtgatgatgctggcggcaggcaccatcagcgacttcatcgagaaacacccctcgctgaagatgctcgccctgtcgttcctcatcgtggtcggcaccgtgctggtggccgagtccttcgaagtgcacgtgccgaaaggctacgtctacttcgccatggccttctccctggcggtggaggcgctgaacatccgcttgcgcggagccctggcgcgcaagcgcggcgaagagccggtgaagctgcgcaagggttcgccggactga

SEQ ID NO: 6369 - DNA, 1980 bp, Pseudomonas aeruginosa
ttgttacagagtatttcttgcatgggcgggaaggcgaagggacaatttaatctcttccattctcacttcgtcttcgccatgcaccctccgaaaatcctgctgtggctgctgccgctggtctgcgcgttcagccttggagctcttgccgacacggccgtcgacccctcccaagccttgcatctgttgagttacctggcggccgactatccgccgaccgtggctgacggcaagatcgtcgaccccagcgaataccaggaacaggtggagttcgtcggcaacctgcaggcattggtcctgaccctgccgatgcgccccgagcgcgccgagctggagaggggcgtcgccagcctgcgccaggccatcgagcagcgcttgccgggaagggacgtggccctccaggcgcgcaacctcgaggcacgggtggcggatatctaccaggtggtgcagacccccgcgatcacccccgacccgagccgcgcggcgccgatctatgcccagcagtgcgcgatctgccatggcgatgcgggcaagggcgacggccccgccggcatcggcctggaaccgccgccagcgaacctcaccgatcgccagcgcctcgaccacctgagcctctacgacctgcgtaacgtcatcggcctgggcgtggccggcaccgacatgccggcgttcgccgaccagctcgacgaacgccagcgctgggacctggccagctatgtggccggcctgagcgccggcagtgcgcagccggacaaggcccatgcctacccgctggcgaccctggccacgcagactccggccgaagtcgccgagcacgacggcgaggccgctgcggagagcttccgcgccctgcgtgcgcatccgccgctggagcagcgcggtcctgggcagttgatcgactataccgccgccaccctggacaagagcttcgcggtctatcgcgaaggcgaccgcgaccaggcctacgacctgtcggtggcggcctacctggagggcttcgagctggtggaaagctcgctggacaacgtcgacgccgatttgcgccgctccaccgagaagcagctgatggcctaccgccaggcgttgcgcgatggcctcccggaaacccaggtggcgcaacagctggagctggccaagggcaagctggcagaggccgccaagcagcttggcggcgactcgctgagtttctccatcagtttcgtttccgccttgttgatcctgttgcgcgaaggggtagaggcaatcctggtgcttgccgccatcctcgccttcctgcgcaataccgggcaggaaagtgccgtgcgtggcgtgcacgtcggctgggggctggccttcgtcgccggtttcgccacctgggcgttggccgcctatgtgatcgatatcggcggtgcccagcgcgagctgatggagggcttcacctctctgttcgcctgcgtgatggtgctctggctcggcgtctggatgcacgaccgccgccacgcggcagcctggcaggactacatccgcagcagcctggtgggcggtggcggacgcttcggcttcgcagtgctggcgttcttctcggtctaccgcgagttgttcgaggtcatcctgttctacgaaaccctctggttgcaggccggaccggccgggcacaatgccgtgatcggcggcgcggcgaccgccgtggtcctgctgatcggcctggcctgggtgatcctgcgtggttcggcgaaactgccgctggggttgttcttcagcatcaacgcggcgttgctctgtgcgctctcggtggtgttcgccggacatggcgtcatcgccttgcaggaagccggggtgatcggcacccgtccggtgccgttcttcgacttcgactggctggggatcaaggctgacgcctattcgctgtcggcccaggccatggcgctggtggccatcgcgctgctctacggacgtagccggatcgtcgagcgccggcgtgcggcggccaacgcggccgactga

SEQ ID NO: 6370 - DNA, 549 bp, Pseudomonas aeruginosa
gcgggttcgcgcaaccacgacggccagtgcgatactggccgtcgtcatttctacggaagtccgttcatgcgtatctggatcgatgccgacgcctgccccaaggcggccaaggaactggtctgcaagttcgctctcaagcgcaagctggaagtctggatggtcgccggccagccgcaggtcaagccgccgttcgcctgcgtgcgtctggtggtggtggaaagcgggatggatgcggctgacgattacctggtggagcaggccgagccgggcgacctggcgatctgcagcgacgtaccgctggccgatcggctgatcaagaaacaggttgccgccctcgatcctcgcggccgcgagttcgacgcgcggaacatgggcgataagctggccatgcgcaacctgatggccgacctgcgtgaccaggggcagatgggcggcggccaggcgccctacggtgagcgtgaccgccaggcgttcgccaacgccctggatcgcctgctcacccgcctgcagcgggaagccgatctacgcgcgagtcagccgcacagatag

SEQ ID NO: 6371 - DNA, 1017 bp, Pseudomonas aeruginosa
accgtgagcttcactcccgccaatcgcgcctatccctacacccgcctgcggcgcaatcgccgcgatgacttctcccgccgcctggtccgcgagaatgtcctcaccgtcgacgacctgatcctgccggtgttcgtcctcgatggggtcaaccagcgtgaaagcattccgtcgatgcccggcgtcgagcgcctgtccatcgaccagttgctgatcgaggcggaagagtgggtggccctgggcattccggcgctggcgctgttcccggtgaccccggtggagaagaagtccctggacgccgccgaggcatacaacccggaaggcatcgcccagcgcgccacccgcgccctgcgcgagcgctttccggagctgggcatcatcaccgacgtggcgctcgacccgttcaccacccatggccaggacggcatcctggatgacgatggctacgtcctcaacgacgtcagcatcgacgtgctggtacggcaggcgctgtcccacgccgaggcaggcgcccaggtggtagcgccctcggacatgatggacggtcgcatcggtgcgatccgcgaggccctggagtctgccggccacaccaatgtgcggatcatggcctactcggccaagtacgccagcgcctactacggtccgttccgcgatgcggtcggctcggcttcgaacctcggcaagggcaacaaggccacctaccagatggatccggcgaacagcgacgaggcacttcacgaagtggccgccgacctggccgaaggcgccgacatggtgatggtcaagccgggcatgccctacctcgacatcgtgcgtcgggtgaaggatgaattccgcgccccgacctttgtctaccaggtcagtggcgagtatgcgatgcacatgggcgccatccagaacggctggctggccgaatcggtgatcctcgagtcccttaccgccttcaaacgtgccggcgccgatggcattctgacctacttcgccaagcaggccgcagaacaattaagacgggggcgttga

SEQ ID NO: 6372 - DNA, 1743 bp, Pseudomonas aeruginosa
cgacagcatctgctggtcctggcgcgagaagccagccaggtcggagtgctcgatcaagtaggcgccgtgcttgtggtagtggtaatgggcgatgtccaggccgatctcgtggacccgtgcgccccagctcagcaggtcgcggtgcagttcgccgttcagctcccaggcgtcgccgacttcggcaagcaccttgagggccttggcctccacccgcgaagcctgctccggatcgacgtggtagcgctgcatcagcgagctgatggtgcgttcgcgcacgtcctcgtgctggtgacggccgaccaggtcgtagagaacgccttcgcgcagggcgccctcggagtgaaccatctgttccagttccagcgcgtcgaagatcgcttcgagaatggccagtccggccgggaagatggtccggcggtccggcttgatcccttccagatcgagcttctccacgtcgccgagcttgagcaccttgcgcttcagccaggccagtccgtccgggctgatctcgccgttgccgtggccgccggccttgatcgccagcgccactgcgcggatggtgccggaggcgccgaccgcctgttgccagccgaggcgccgcaggctgttctcgatgcccatcagttccaggcgtgcagcagtgtacgcctgggcgtagcgggccggggtgatcttgccgtcgcggaagtagcgttgggtgtagctgacgcaacccatctgcaggctttcccgcagctcggactcgaaaccctggccgatgatgaactcggtgctgccgccgccgatgtcgctgaccagccggcgaccgccgctgtcgggcatgctgttggcgacgccgaggtagatcaggcgggcttcctcgcggccggagatgacttccacgggatggccgagaacctcttccgcacgacggatgaaatcgctgcggttgcgcgcctcgcgcaaggcgttggtcgcgaccacgcgtacggaaccctggggcatgccgctgatgaactgggcgaagcggcgcaggcagtcgaggccgcgctgggtggcctcttcgctgagattgcgctcctcgtcgaggccggcggccagttggaccttctcgcccagccgttcgaggatgcggacttcgccgtggatattggccttggccagacagaggtggaaactgttggagcccaggtccagggcggcaatcagcgggaatgcctcggcaggtttttgcggcatgctttgcaagtccattggaaaactgcgccatcctgccacgatagggcgagggtcgccaatgcggcagccgatcaatcgggaatcagccgaccaacgatagagactctcaatcggctgcgccttccggcgagggtcaaggcgggatatgatggtcggcactttcgcgtttcaattcgcgtccgactacggagagatttcatgagcgaacatatcgtcaacgttactgatgccagcttcgagcaggacgtgctgaaggccgacggccctgtgctggtggactactgggccgagtggtgcggtccgtgcaagatgatcgcgccggtgctggacgaagtcgccagggactatcagggcaagctgaaggtctgcaagctgaacatcgacgagaaccaggataccccgccgaaatacggcgtgcgtggcatccctaccctgatgctgttcaaggacggcaatgtcgaggcgaccaaggtcggcgcactgtccaagtcgcagctggcggccttcctcgacgccaatatctga

SEQ ID NO: 6373 - DNA, 369 bp, Pseudomonas aeruginosa
ccgaggtgtgcgaccgcacgttgcgcgccaagggcccggcattgctgttcgaaaagccgaccggcttcgacatgccggtgctcggcaacctgttcggtacgccggagcgcgtggcgctgggcatgggcgccgaggacgtcggcgcgctgcgcgagatcggcaagctgctggcgcaactcaaggagcccgagccgccgaagggcctcaaggacgcctgggccaagctgccgatgtacaggaaggtcctgtccatggcgccgaaggtgctcaaggacgccccctgccaggaagtggtcgaggagggcgaggacgtcgacctcggccggctgccggtccagacctgctggccgggcgatgtcgggccgctga

SEQ ID NO: 6374 - DNA, 1275 bp, Pseudomonas aeruginosa
ccgacctgctgttcaacaacctcatcgtccagccctgaggtcaactatccgttctgtcccgcgctcccggatgcgaggcaccggggattctgctttcctgtgaagttcggtcgggcgcgtctgacgtgcatcaacacctgcgcgccgccctggagggacaatcgagccagtgaagtccgcggcggccgcgctttccagcgtgagcgccatcgccgcggcctggccgaacgtgcgaggagaagggatgaaacaggaaagcaaacggtggctgagccgtgccctggtcgtggcggcgctgctcggcgtaggcgtgctggtctggcaggtatcgcgaccgaccggcctgggcgagggattcgccagcggcaacggacgcatcgaggccaccgaggtggacgtggcggccaagcttcccgggcgggtcgccgagatcaaggtcgacgagggcgacttcgtcaaggccggcgaaatcgtcgcgcggatggatacccaggtgctcgaggcgcagttggcccaggcccaggcccaggtgcgccaggcggagaacgccaagctcaccgcgacctcgctggtggcccagcgcgagagcgagaagagcaccgcccaggccgtggtggcgcagcgccaggccgagctgacagcggcgcagaagcgcttcacccgtaccgaggcgctggtcaagcgcaatgccctgccgcaacagcaactcgacgacgatcgggcgaccctgcagagcgcccaggcggcgttgtccgcggcacgctcgcaagtgatttcggcgcaggcggcgatcgaggccgggcgttcccaggtaatcgaggcgcagtcggccatcgaggcggccaaggccagcgtcacccggctccaggcggatatcgacgacagcctgctcaaggcgccgcgcaacggccgcgtgcagtaccgcgtggcacagccgggggaagtgctgccggccggtggcaagctgctcaacatggtcgacctggccgacgtctacatgactttcttcctgccatccatgcaggccggcagggtcggactgggccaggaagtgcgcttggtgatcgacgcggtgccggactacgtgatcccggccaaggtttcctatgtcgccagcgtcgcccagttcaccccgaaaacggtggaaaccgccaacgagcgggagaagctgatgttccgggtcaaggcgcggctcgatccggcgctgctggaaaaatacatcacctacgtcaagaccggcgtgcccggaatggcctacctgcgactggaccctga

SEQ ID NO: 6375 - DNA, 2790 bp, Pseudomonas aeruginosa
  unsure (2073): Identity of nucleotide at the above locations are unknown.
ggtcgagtggccggccaacctgcagatcaaggttccgcaatgaccgctggcgggagcggcgtggcgagcctccggggcgtttcgctgcgctacggcgagacgcgcgcggtggacgacgtcagcctggagatcccggccaaccgcatggtcggcctgatcggtccggacggggtcggcaagtccagcctgctggcgctgctggccggcgcacggaagatgcaggatggcgagatccgcgtgctcgatggcgacatgcgcgaccgccgccaccgccgggcggtctgcccgcgcatcgcctacatgccccaggggctgggcaagaacctctacccgacgctctcggtgttcgagaacgtcgacttcttcggtcggctgttcggccacgacaaggccgagcgcgagcggcgcatcgccgacctgctgcagagcaccgggctggcgccgttcgccgagcgtcctgcgggcaagctgtccggcggcatgaagcagaagctcgggctgtgctgcgcgctgatccacgatcccgacctgctgatcctcgacgagccgaccaccggcgtcgacccgctgtcgcgcaaccagttctgggagctgatcggccgtatccgcgcgggccgcgaaggcatgagcgtgctggtcgccaccgcctacatggaggaagccgagcgcttcgactggctggtggcgatggacgacggaaaggtcctggccaccggtacgccgcaggagttgcgcgagcgtaccgggacgcagagcctcgagtcggcgttcatcgccctgctgccggaaagcaagcgcgccggccaccatcgattggtgatcccgccgcgaccgcagagcgaaggcgcgccgcggatcgccatcgaggccgagggcctgacctgtcgtttcggcgacttcgtcgcggtcgatcacgtcagcttccgtatcgagcgtggggaaatcttcggctttctcggctccaacggctgcggcaagtccaccaccatgaagatgctcaccggcctgctgccggccagcgaaggcacgtgcgcgctgttcggccagccggtggacgccagcgacatggcgacccgtcgccgggtcggctacatgtcccaggccttttccctgtatgccgagctgagcgtgcggcagaacctggtgttgcacgcccggctgttccacctgccggcggatggcatcccggcacgggtcggcgaaatgctccggcgcttcgacctggagaaggtggccgacgagctgcccaacgacctgccgctgggcattcgccagcgtctgtcgctggcggtggcggtgatccacaagccggaaatcctgatcctcgacgagcccacttcgggggtcgacccggtggctcgcgacggcttctgggagctgatggtcgagctgtcgcgccgcgacggggtgaccatcttcatttccacccacttcatgaacgaggctcagcgctgcgatcgcatctcgctgatgcatgccggcaaggtactggccagcgatactcccgatgagctggtgcgccagcgtggtctgccgaccctggaagcgaccttcatcgcttacctggaggaagccgcgggtgccgccgcgccagcgcaaccggccgaggcgccggccgtcgcggagcagcccggcgatggccaggagcgccaggcgcaacgcgaacgcttcagccccctgcggctgttcagctatgcgcgccgcgaagccatggagctgcgccgcgacccgatccgcctgaccctggccctgctcggcaccgcgctgctgatgttcatcatcggctatggcatcaacatggacgtcgaggacctctcctgggcggtcatcgaccgtgaccagaccaccaccagccaggcctacgcgctgaacatcgccggctcgcgctatttcgtcgaacatgcgccgatcaccgacccggacgacctcgaccggcgcctgcgcagcggcgagctgagcctggcggtggagattccgccgaacttcgggcgcgatctcaagcgtggctccgatccggccatcggcgtgtggatcgacggagcgatgccgacccgtgccaacaccgtgctcggntacgtgcaggccctgcacaccagtacctggcggcacttctcgcgccaggcgggtggggccgaggccagcgcggcggccagcaccgaggtgcgctatcgctacaaccccgacgtggaaagcctgaaggcgatggtgccggcggtgatcccgctgctgctgatcatgatcccggccatgctcaccgccctcggcgtggtgcgcgaaaaggaactgggttcgatcaccaacctctatgtcaccccggtgacgcgcctggagttcctggtcggcaagcagctgccctacgtcgccatgggcatgatcaacttcctgctgatgctggtcctggccatcgtggtatttcgcgtgccgctcaagggcagcttcctggcgttgaccatcggcgctttcctctatgtggtcaccagcactggcctcgggctgttcctctcgacgttcatgcgcagccagatcgccgctgtattcggcgtggcgatcgccaccatgatcccggcgatccagttctccgggctgatccacccggtgtcctcgctggagggtgcggcggcctggatcggcaagctctatccgacctcgcatttcctggtggtcagccgcggcgccttttccaaatcgctgggcctgtccgatctctgggcctactacctgccgcttgccgcttccatcgtggtgctgaccctgctcagcgtggcctgcctgaagaagcaggaggactga

SEQ ID NO: 6376 - DNA, 1128 bp, Pseudomonas aeruginosa
gcgatgcgcagcctggccaacatcttcaacctgggcatcaaggagttccgcagtctcggccgcgactacgcgatgctggcactgatcgtctgggccttcaccctgggcgtctacagttccgccaccggtattccggaaaccttgcatcacgcgccgatcgcggtggtcgacgaggaccgctcgcagctctcgtcgcgtatcgtcaatgccttccagcccccatacttccggccgccggaaatgatcggtcatgccgagatggatcgcggcatggacgtcggcctgtataccttcaccctcgatatcccgccggacttccagcgcgacgtgctcgccgggcgcaagccctcgatccaggtcaacgtcgacgcgacccagaccgggcaggccttctctggcgcgggctacatccagaacatcgtcgccaccgaggtgcgcgaattcgtcagccgctaccgcgcggagccgagcatgccggcgcagatcgaggtgcgcatggaattcaacccgaacctgacccaggcctggttcggtggggtgatggaagtgatcaaccagatcactatgctgtcgatcatcctcaccggcgccgcgctgatccgcgagcgcgagcacggcaccgtcgagcacctgctggtgatgccgctgtcggccttcgagatcatgatggccaaggtctggtcgatggggttggtggtgctggtggcggcggggctctcgttgcagtgggtggtgcgtggctggctggacgtgccgatcagcggctcggtgggactgttcctgctcggcgccggattgcatctgttcgccaccacctccatgggcatattcctcggcacggtggcgcgttcgatgccgcagctcggactgttgaccatcctcgtgctgctgccgctgaacatcctttcgggcggcaccacgccacgggaaagcatgccggaactgctgcagaacatcatgctggcggcgccgaccacgcatttcgtcagcctggcccaggcgatcctgttccgcggcgccggtttcgacatcgtctggccgcagttcgccggtatcgtggtgatcggttcggcgttcttcttcggcgcgctctggcgtttccgccggaccatctcgcagatggcctga

SEQ ID NO: 6377 - DNA, 822 bp, Pseudomonas aeruginosa
tcgcaaggaccggcctcgaaaattgcctggaagggggaggcaatcgatgaagcgcaagccagacttgctgtgggttttggtcatcatcttcggacttggggtcgtcaccaccggttatacccagagcctctgggaacgacaggccagcacgcccgcccaggtgacgcaacagccgtaagactcgccgggtatcgcatggaacgcggtacccagggttctccctccttcctagcgtttccctgccacgtaccagcccgcatcggtcaccgttcccgccaggggaatgtcccagctggccagcgccagtcgatccaccttctgacattcatgggccaggccgatcagcgtcggtttgtgaccatttttgcgcctcgccaggtaggccaggctgcggtcgtagaagccgccgcccatgcccaggcgcccgccctgttcgtcgaaccccaccagcggcagcagtaccaggtccagcgcccaggccttgcgctggcggccggcgtcggccagcggttcgctgatgcggaagcggttgcgggtccagcgttcgccgctgccgacccgctggaataccatgcgcgtctgcggccagggcgccagcaccggcaggtaggtggccttgcccgcggttctgcgccgcacgcagcagcggacgcgggtcgatctcgccgtcgttgggcaggtacagggcgatatggcgggcacggcggaaaaggggatgctgcgccagttgtcgatagagggcacgggcggcgaggcgttgctgcaggggggagagcgcgcggcgcgcctggcggagcttgcggcgcagggccgggcggctga

SEQ ID NO: 6378 - DNA, 855 bp, Pseudomonas aeruginosa
cgccccaatggcgcccagccgtcagggtcccgagatgtccactcagaattccgcctacagcgccttttactcccttctcgccgaggcggccatgccggtctcgccggccgaactgcacggccatctgctgggtcgggtctgcgccggcgccggcttcgacgaggccgcctggcaacacgctgccgccgaactgctcggcggcgcgccgggcgaacgactcaaggccgcgttgtccggcctgctcggcatggtccggcaggacttttccgccggcgaggtcgccgtcgtcatgctcctgcccgacgacgaaaccccgctcgcccagcgcaccgaggcgctcggccaatggtgccagggtttcctcgccggtttcggcctcaccgcccgcgaaggcagcctgaccggcgaagccgaggaagtgctgcaggacatggccgccatcgcccaggtccagggccagctggaagacagcgaggacggcgagacggactatatggaagtcatggaatacctgcgggtcgctccgctgctgctgttcgccgagtgcggcaagccgctggagcccgctcccaagccttcactgcactgaggtttctgcatgatccgtatccccaagtcggagtacgcccgtcggcgcaaggcgctgatggcgcagatggaacccaacagcatcgccatcctgccggcggcgccgatgtacatccgcaatcgcgacgtcgagcatgtctaccgccaggacagcgacttccagtacctcaccggcttccccgagccggaggcggtgatggcgctgattcccggccgtgctcacggcgaatacgtgctgttctgccgcgagcgggatccggagcgtga

SEQ ID NO: 6379 - DNA, 687 bp, Pseudomonas aeruginosa
actgtgggacggcctgcgcgccggccaggacggtgcgatcggccagtacggcgccgacgacgcctttcccatcggcgatatcgacgacatcctgcccggcctgatcgaaggccgcgaccgggtctactacgcccttggcgccaatcccgacttcgaccgccggctgatggactggatcaacgtgatccgctccaaggcccgccagggcgcgcagccgccgaacgagttcgttgccctcgaccacctgctgcacgaccagcggctgtacaagagcgccaacgaagtgaaggtcatgcgctacgccgccgaggtctccgcccgggcgcacatccgggcgatggaggtgtgccggccggggctgttcgagtaccacctggaagccgaactggaatacgagttccgcaagggcggggcgaagatgccggcctacggctcgatcgtcgccgccggacgcaacgcctgcatcctgcactaccgcgagaacgatgcggcgatcaaggacggcgacctgatcctgatcgatgccggctgcgagatcgactgctacgccagcgacatcacccgtaccttccccgccaatggccgcttcagtcccgagcagaaggcgatctacgaactggtgctggaagccaacatggcggcgttcgactacatcgcccccggtcgccactggaacgaggcccatga

SEQ ID NO: 6380 - DNA, 621 bp, Pseudomonas aeruginosa
cccggctgttctccaacgaccgcgcgctgctcggcgccgggcgcaacctcggcctgctcgggctcgacctgctgccgccggccaagcgctggttcgcccgccaggccatgggcctcggcgcgcggccgctgtagcgccatgccggtctggtcgagggcgcgcaaggcccgcctgctgcgcttcgccatgaatctctacccgcccttcctgggggcgggcatccgtgtgcggcacatcgctggcgatttccgcgaggttcgggtgcgcatgggcctgaaccggctcaatcgcaactatgtatgcacccagttcggcggcagcctctacgcgatgaccgacccgttcttcatgctgatgctgatggagaacctgggccgcgactacgtggtctgggacaaggcggccaacatcgagttcgtcagcccgggcaagggcccggtgcatgcgcatttcagcatcgaccagaagctgctcgacgaggtccgcgagcggaccgccggcggcgagaagtacctgccccggctgcacgccgaagtgcgcgacgacgccggcaccctggtggcgcgggttcagaaaaccctgtacgtgcggctcaagccgcgcctgcggaacgcggcctga

SEQ ID NO: 6381 - DNA, 1239 bp, Pseudomonas aeruginosa
cgccctggccctggccctggagggcagcggcctggaggtgctgctggtggacggcggctcgctcgacgtggcgccgttcaagccggaggcgccctacgagccgcgggtcagcgcgctgtccgaagccagccggcggattctccagcgcctgcatgcctgggacggcatcgtcgcgcgccgcgccgagccctatcgcgagatgcaggtgtgggatggctccggcaccgggcggatcggcttcagcgccgccagcgtgcacgccgaggtactcggccatatcgtccaaaaccgggtggtgcaggacgccctgctggaacgcctgcacgattccaccaccggcctgctggccaatgcgcgcctggaacagatgcgccactccggcgacgactggctgctgaccctggccgacggtcgccagctgcgtgcgccgctggtggtcgccgccgacggcgccaactcggcggtacgccgcctggccggctgcgccacccgcgaatgggattacctgcaccacgccatcgtcaccagcgtgcgctgcgagaacgcgcaccgcgcaaccgcctggcagcgcttcaccgacgacggtccgctggccttcctgcccctgccggaccgcggcgacgagcactggtgctcgatcgtctggtcgaccaccccggaacaggcagaacgcctgatggcgttggacgaggatggcttccgcgccgccctcggcgaagccttcgaacagcgcctgggcgccatcctgcatgccgaccggcgcctgtgcatcccgctgcgccagcggcaccccaagcgttacgtcgagccgggcctggcgctggtcggcgacgctgcgcacaccatccacccgctggccggacagggcgtgaacctgggcttcctcgatgcggcggtgctgtccgaggtcctgttgcacgccctggagcgcggcgaacggcttgccgacgaacgcgtgctgagtcgcttcgagcggcggcggatgccgcacaacctgggcatgatgacggcgatggaaggcttcgagcgcctgttccaggccgaccggttgccgctgcgctggctgcgcaacgccggcctgcgcctggtcgacggccatcacgaggcgaaggcgctgttcgtccgccaggcgcttggcctcagcggcgacctgccgtcgctggcacgagtctgagcggggcggcccccctgacgggagggccgccagtcctcagaacagcgccgcgcagtcacgcatga

SEQ ID NO: 6382 - DNA, 1602 bp, Pseudomonas aeruginosa
ggggcgtttcccgagtgcgggcgcgtgcctgccagaattggcagggagcagcgcacggatggcgacagcgatgagcagggtcagcccggcgaggatccggaaggcgacgcgccaatcccactcctcggtcagcaggccggtgaggaagcgtccggcgaagccgccgaggatggtcccggcgacatagaggctggtcagctcgatgaccgcgccgccgctccagcgctcgccgatgtaggccacgctgctggcgaacagcaggggaatcagcatcccttcggcgaagcgccagagcaggaaggcggcgaagctgccggcatgggcggccagcagcatgggcacgcagagcaggctggcggcgaaggcgatcacccggctgcgctcgcggccgccgctgagtcggccgacgaagggcgcggcgagagccaccgccagggtggtggcggtgatgctccagttcgattgatgggcgctgatgtggaagctcgccgccagttcgtcgaagatgccctgggtggtatagagattgaggaacgcagcgcaaccgcagagaaacagcgcgaggcgggggaaaccctgggacgaattcatggaacgctctgcctggacgagaaaccccctgttataggggcgctcccgacgggctggccaataccgattcaggaccgatcgataccgaggaaccgcatgctcgacctacgccgcctgcgctgcttcgcagccgttgccgaaaccctgcatttcggccgcgccgcccagcgcctgcacatggcgcagccgcccttgacccggcagatatccgcgctggaggaagagctgggctttcgcctgttcgaccgctccagccgggcggtgaccctcaccgccgagggcagcctgttcctgccttacgcacgcgccctgctggaccaactggagcgcaccgccggcttcgcccgcaagctggcgcaggggctggccggccacctgaccctcggctacgccagctccatcgccctgtcggacctgttcaccgaggcgatccgactgttccgcgagcgccatccggaggtgcaactggagctgctcgaaggcgcttcggcggcgcaatgggcgcagatcgccgaaggcggcatcgatgtggggctggggcgcctgccgccgccggaaggccaggtcggcatcgaggtgctggccctgggcggcgagccgctggtggtggccgtgcccaacggcgatccgctggcgcggcaagagcggatcgacctgtacgatctgcgtgatcggccgctgatcctgtttccactggactacggctccggcctcaacgaactgatcgagcgcctctaccggaaggccgggctggcgctgacgaggggaccggccggacgccagatcacctcgatcatcgccctggtcgcggccggccagggcgttgccctggtgccgcgttgcagcaccgcgctggcccgggccggagtcgtctatcgcccgctggccgagcccgaggcgctggccgatttcctcgtcttcacccgccgccatggccgcagcgccgcggtggaggcgttcctcgccatcctcggtggcttggacgcaggcgaaacaccccgacacatttag

SEQ ID NO: 6383 - DNA, 441 bp, Pseudomonas aeruginosa
tctaacctggcaatggcgaccgccgtcgcccccgacttcgaggaaaacaagatgagcaatattcccgccgaactgcgttacgcccagagccacgaatgggctcgcctggaagccgacggcagcgttaccgtgggcatttccgaccatgcccaggaagcccttggcgatgtggtcttcatcgagctgccggagctgggcaagaccctcgccgccgggcaggaagcgggcgtggtcgagtcggtgaaggccgcctccgacatctattcgccgatcggcggcgaagtcatcgccatcaacgaagccctggccgacaccccggaagacgtcaacaacgacccgtacgcgtcctggttcttcaagctcaagccgagcaatccggccgagctggacaagctgctcgatgccgctggctaccaggccgccgtcgacgcggaaggctga

SEQ ID NO: 6384 - DNA, 978 bp, Pseudomonas aeruginosa
ccccgagcgaacatgcgcgggcgttcaagtactggccggcggttaaccgggtggacaacgtctacggcgaccgcaacctgttctgcgcctgcgtgccgctggacgactaccgcgagtgacctcgcctccgggcggaggcgaggtcgccgtggcctactgctggacggcggactgctcgccgccggcgaggatcgcgctggccagttccatgtcgctggcctgcaggtccgggttgtcgttgcgcagcttttgcagggcggcttccaggtacggcccgcggatcgcgccgtcgctggcgatgtagctgccggcgtcgtcctgcgcggcgacgatcagcttgtggtcgtggcggaaggtcaggtaggtggaggccgtggtggcacccgaggaaatgatgttgcgccagaaggtatcggccatggccgagcccagcggcagggcggcgatgaccagggtggcggcggcgagtttgacggaacgcatgggggaactcctgatagggggctgcgtgttacatcagatcgcgtttgccgtcccggagttccagtggggatgaccgtccggtcgctttttccgctgccgtacagcccccgccggccgggagctacagcgattcaaggcgcagcaggctcgacgtgcagcagggcgccgtcctggccggtgacccggaccagggcgccgcgcggcaggtcgggaccgctgaccagccacgacgcgtcctcgacgcgcagctcgccgagcccgccgacgatcgcccggtgcaagggaaaggtgcggccgaacaggtcgtcgccgcgtcgctgcaaccctggcgtttcctcgacgctaccggccttgcggcgacggcgtcgatgcaaggcggcgaccagcccggagagcaggacgaacagccctacctgccaaggccaggccagtcccggcaggagcgcgccgagcgcaccgacacaagcggcggtgaggccgacccgcagcagatag

SEQ ID NO: 6385 - DNA, 348 bp, Pseudomonas aeruginosa
gatcctcgacctgctgcgcggcgaggaactccagcggatgctgctggttgcgcaccgcgctgcggcggatcgccaggcactgttcggcctgctcctgcccgacccggccctgggcgaccagctcgcggagcaggtcgccgaggtccagcaggcggtcctgggcggcggtggcgaacacggacatgcagactcccttcggatgatggcggtagcggcgaagcttatttcatcagcgccttccagggtttgagcgtcagcacagtatgggcctgcgtggcgcgggcagccaggcgctcgacatcgacaggttgccgcagcagctccagcaacttggccagttcgccgtag

SEQ ID NO: 6386 - DNA, 474 bp, Pseudomonas aeruginosa
ccgcgctcggccttgctgatgtcgcagggcatcagcggcaggtcggcggccagttccgcggccagctcgagcagcgcggcggcatcgccctggcgcagttccagctccagttcgcagatttcctcctggttgtcgccggcgaccaccttgcccaggtcgagcgccgcctccacgactaccctggccttgccgcggccccaggcgatctcggcgcgctggcggacgaagtcggtgctgaagatcggcttgagctgcttcttgtcgaggtccttgagggccgccggccagcacttgtcgtcgagtttctttaggtcgagcttgttcttttccaggtaccagtcccactcgttgcgttcggacaacccggccacgctctgcccgcggctcttcagcgtctggatgtactgctcgccgtcgcggcgcatgcgcagcgcgaccttggcccgggccagctcgcggccgggggtgtcgtag

SEQ ID NO: 6387 - DNA, 378 bp, Pseudomonas aeruginosa
cccgctggcgctgccagcgccgccgcgtgggcttcgccgccgcgtgcgcggtcgagcagcgccgcggtgtcggcgattcgttcgagcagctcgttcgcccagaccttcaattccaccggctggccgcgacgttgcaattgcaggcccggccgcctgccttccttgaccacggcgaggaagttgtcggtggcgtcgctgcactcgccattcagcagcgggctgtcgctgaacgcgcagaacagcaggaaggcgtcgaggaagcgcgcctcgtccaggtcgatgcccagcggcaggaacgggttgatgtccaggcagcgcacttccacgtactgcacgccgcgagcggccagggcctgcaccggacgctcgccggtgtag

SEQ ID NO: 6388 - DNA, 1269 bp, Pseudomonas aeruginosa
tcatctgctcgcgggcgggcatctcgctcatggacggctccgtcacttcttcttcagttgcttggcgttggcgaacagcgcggccatggcgttgttcgccggcggcgcgctctgtccgcgcggggcgccacgctcctggcgcggctggccgctgccggtgggacgcccgccgcgctggccttcgaccttctcgccgggggtgtcgctcatgcgcatggacaggccgacacggttgcgcgggatgtccacttccatgaccttgaccttgacgatgtcgccggccttgaccacttcgtacggatccttgacgaacttctcggacagcgccgagatatgcaccaggccgtcctggtggacgccgatgtcgacgaacgcgccgaagttggtgacgttggtcaccacgccctccaggaccatgcccggcttgaggtccttgaggctctcgacgccttcctggaattctgcggtcttgaactccggacgcgggtcgcggccgggcttgtcgagttccttgaggatgtcggtgacggtcggcaggccgaaggtctcgtcggtgaacttcttcgggtcgaggcgcttgaggaacgccgagtcgccgatcagcgagcggatgtcgcgctcggtgtcggcggcgatgcgctgcaccagcggataggtctccgggtgcaccgccgaggcgtccagcgggttgtcgccgttcatcacgcggaggaagccggcggcttgctcgaaggtcttttcgcccaggcggctgactttcttcagctcgtcgcgggtgcggaacgctccgttggcgtcgcggtgcgcgacgatgttctgcgccagcgtcgagttgaggccggagatgcgtgccagcagggcggcggaggcggtgttgacgtcgacgccgacggcgttcacgcaatcctcgaccaccgcgtccaggctacgcgccagcttcagctgggacacgtcgtgctggtactggccgacgccgatcgacttgggctcgatcttcaccagctccgccagcgggtcctgcaggcgacgggcgatggatacggcgccgcgcagggacacgtccagctcggggaactccttcgccgccagttcggaggcggaatacaccgatgcgccggcttcgctgaccatgatcttggtcagcttcatgcccggatatttcttgatcagttcgccggccagcttgtcggtttcgcggctggcggtgccgttgccgatggcgatcagctcgacctggtgcttggcgcacagcgcggcgagcacggctag

SEQ ID NO: 6389 - DNA, 1116 bp, Pseudomonas aeruginosa
ggtctggtcccactggttcttcggcgcatgtgggtagacggtggcggtgtccagcagcttgccggtggcgtcgaccaccgcgaccttgaccccggtgcgcaggcccgggtcgaggccgagggtggcgcgcgggccggccggggcggccagcagcaggtcgtgcaggttgcgcgcgaacacgctgatcgcctcgtcctcggcgccgtcgcggagctcgccgaacaggtcggtttccaggtgggtatagagcttgaccttccaggtccagcgcaccacctcggccagccacttgtcggcggcgcggccctggttggacaggccgaagcgctcggcgatcatgacctcgcatgggtgcagggtgcccggcgcttcctcgccgaccttcagcgaggcgctgaggatgccttcgttgcgtccgcggaagatcgccagggcgcggtgcgacggggcgcttttcagcggctcatcgtgttcgaagtagtcgctgaacttggcgccttcctgttccttgccggggaccacgcgggcggtcagggtcgcttcgttcttcatgaacacgcgcagcttgtcgagcagcgtggcgtcttcggcgaagcgctccatgaggatgtacttggcgccttccagcaccgccttgacgtcggcgaagcctttctcggcgtcgacgaaacgcgcggcctcgctttccgggaccagggtcgggtcgtcgaacagtgcgtcggccagctcgccgaggccggcttccagggcgatctggcccttggtgcggcgcttctgcttataaggcaggtagaggtcttcgagacgggtcttggtgtcggcgagcttgatgtcgcgggccagttcgggggtcagcttgccctgttcctcgatgctggcgaggatcgcgccgcggcgttcttccagttcgcgcaggtagcgcaggcgctcttccagcatgcgcaactgggtatcgtcgaggctgccggtgacctctttgcggtaacgggcgatgaagggaacggtggagccttcgtcgagcagggcgacggcagcggcgacttgctgcggttgaacgcggccggagggcagtgcggagagctcttcggcgatacgggtgttgatgctgtccattga

SEQ ID NO: 6390 - DNA, 1506 bp, Pseudomonas aeruginosa
tcgagccggatccgtccaagccgcgctatatccagacggtctggggcgtcggctacgtgttcgtgccggacggcaacgcgcgcaaggcctgagtctccgcgcggccggtgcagcgatgcaccggccgcgtcgtcttacccgcaacaggcgtcggccccgtccgccggcgcgcaaccggtccgatcgatgaaaacgccgctctggttcccgcaaagcttcttcgcccgcaccctctggctggtgctgatcgtcgtgctgtcctccaaggcgctgaccctggtctacctgctgatgaacgaggacgtgatcgtcgaccgccagtacagccacggcgcggcgctgaccatccgcgcgttctgggctgccgacgaggagtcgcgcgcggccatcgccaaggcttccggcctgcgctgggtgccgagcagcgccgaccagcccggcgagcagcactggccgtacacggaaatcttccagcggcagatgcagatggagctggggccggacaccgagacccgcctgcgtatccaccagccgtcgcagctctgggtgcgcgcaccgagcctcggcgaaggctggctggcggtgccgctgtatccgcatcccttgcgtggccaacggatctggagcgtgctcggctggttcctcggcatcggcctgctctccaccgccgccgcctggatcttcgtccgccagctcagccagccgctcaagcgcctggtggtcgccgcccgccagttcggccaggggcgcagcgtgcgcctaccgctgggaccggagacgccgagtgaaatggccgaggtgtatcgcgccttcaaccagatggccgaggacatcgagcagggcgggcgcgaacgcgaattgatgttggccggtgtctcccacgacctgcgcaccccgctgacgcgcctgcgcctgtcgctggagttgctgccggagagcgaacgggagatggtcgaggacatgatccgcgacatcgaggacatggacgcgatcctcgaccagttcctcgccttcatccgcgacggccgcgacgagccggtggaggagggcgacctgaccgacctggtgcgcgaggtcgtggcgccgttcaaccagactcgcgagcaggtgcgcatggccttgcaaccggtaccggcgatgccgttgcggcgtgtgtcgatgaagcgtctgctgggcaacctgatcgacaatgccctgaaccacggcggcggttcggtggaggtggccagctacgtggccggcgaaagcgcggcgccctacgtggtgctgagcgtgctcgatcgcggccagggcatcgatcccgcggaagtggacagcatcttcaatcccttcatccgtggcgacaaggcgcgtggcggcaagggcaccggcctcggcctggcgatcgtcaagcgcatcgccgcccagcacggcggcagcgtcgaactgcgcaaccgcgatggcggcggcctggaagcgcgggtctgcctgccgctggggttgctgctgccgcgcggcgcggcctga

SEQ ID NO: 6391 - DNA, 1119 bp, Pseudomonas aeruginosa
tgtccggcatgtcgaaggcgttgtgcaggtcttccaggcgctgctcgacggtcccggcgaggtagcggtagcgggcttcgacgtggcggccgagatggtagtccacgccgtgcacttccagttgccgcagggtcgcctccagcacgtcggtggcgatggccgaggctggcgcgatcagcgccacccggccgtcgatgggctgccaggtctggtcggaggagggacgagaggtcatgcggcgattccgtgaagcgtcaggaaaggattcgagtgccggaagagcacggggttcgacggggtttccggcatcggttgcggcggtgcttcattcaagcgtggcatggaccttctgtcgaggccgggatcgccggcgtaacgcggtgcgtccgatgcgccgggacaacgcatgcgttgtctggtccggctcacccctttcccttcgtcctggccaggtgggggccgccgttcttttccaggtactggatgatgatcccggcgatgtccttgccggtggtggattcgataccttccaggcccggcgaggagttcacctccattaccagcggaccatggttggagcgcaggatatccaccccggcgacgttcaggcccatcacgcgagcggcgcggatggcggtcatgcgttcttccggggtgatcttgatcaggctggcgctgccgccgcggtgcaggttggagcggaactcgccgggcgctgcctggcgcttcatcgaggcgatcaccttgtcgccgaccacgaagcagcggatgtcggcgccgccggcttcctttatgtactcctggaccatgatgttgtgcttgagccccatgaaagcctcgagcaccgattcggcggccttctcggtttcgcagaggaccacgccgatgccctgggtgccctccagcagcttgatcaccagcggtgcgccaccgaccatctcgatcaggtccgggacatcgtccggggagtgggcgaagccggtcaccggcaggccgatgcccttgcgcgagagcagttgcagcgagcgcagcttatcccgcgagcgagcgatggcgaccgactcgttgagcgggaacacgcccatcatctcgaactggcgcaataccgcgcagccgtag

SEQ ID NO: 6392 - DNA, 504 bp, Pseudomonas aeruginosa
cagggctatgggcggccgccagacggctgcccgaggatgccgaagacgaacctagcggctgtcgatgacagtcgcgagacagcggcggaacgaatacgggaaatgccagtgagcgagaaagacgacgacaaggtgcgcctggacaagtggctctgggcggcgcgcttcttcaagacccgggcgctggccaaggccgcgatagagggcggcaaggtgcattgccggggcgagcggtgcaagccgagcaaggaacccagggtaggggaggaattgaccattcgtacgggcttcgacgagcgaaccgtgacgattcgcgcgctttccgtagtccggcgtggcgcgccggaggcccaggctctctacgaggaaaccgcggacagcgtggcaagccgcgagcgcgcggcggccatgcgcaaggccggggcgctgggcgtacagaccgaggggcggccgagcaagaagcagcggcggcagatccaccagttgcgcggcggccaggactga

SEQ ID NO: 6393 - DNA, 1590 bp, Pseudomonas aeruginosa
agcgctacgaagtttggaggactcggcctctggccgacggggaaccacatgacgcaagccaacaacgccgtgtacaccgatatcagcgccgcccaactggtagaagaagccattcgccgcggtgagggcgaactggccgccaacggctcgctggtcgtacgcaccggccatcgcaccggccgttcgccggtcgaccgtttcatcgtcgaagagccgagcaccaaggacgcgatcgcctggggcaacatcaaccgtccgttcccggccgacaagttcgatgcgctgtgggcccgcgtggaagcgttcaacaacgcccaggaccatttcgtttcccatgttcatgtaggttccgccgaggcttactacctgccggtgaagatgaccaccgctaccgcctggcagaatctgttcggccgttgcctgttcatcgagccggagcagtacaacccggccggcaaggacgagtggcaggtcctcaatgtcgccaacttcgaatgcgtgcccgagcgcgacggcaccaactccgacggttgcgtgatcctcaatttcgcccagaagaaagtgctgatcgcaggcatgcgctatgccggcgagatgaagaaagccatgttctccgtgcagaacttcctgctgcccgagcgcgacgtgctgccgatgcactgcgctgccaacatcggcgaagcgggcgatgtgaccctgttcttcggcctgtccggcaccggcaagaccaccctgtccgccgatgaaagccgttacctgatcggtgacgacgagcacggctggggcgagggcgtggtgttcaacgtcgaaggcggttgctatgccaagtgcatcgacctgtccgagaagaacgagccggtcatctggaaagccatcaagttcggcgccgtgctggagaacgtggttctcgacgaagagcgcgtgcccaactacgccgatgacagcctgacccagaacagccgcgccgcctacccgctggagcacgtcgagaagcgttcggagaagaacctcggcggcgagcccaacgcggtgatcttcctgacctgcgacctgaccggcgtactgccgccggtatcgatcctgaacaatgagcaggcggcctaccacttcctgtccggctacaccgcgctggtcggctccaccgagatgggttccggcggcggtatcaagtcgaccttctccacctgcttcggtgctcctttcttcccgcgtccggccggcgtctatgccgagctgctgatcaagcgcatcaaggccttcggctccaaggtctacctggtcaacactggctggaccggtggtggctacggcgtcggcaagcgcttcaacatcccgaccacccgtggcgtgatcgcggcgatccagagcggcgcgctgatcggcgcggaaaccgagcacctggacatcatcaacctggacgtgccgaaggccgttccgggcgtcgagaccaatctgctcaacccgcgcaacacctgggctgacaaggctgcctacgacgaggcggcgaagggcctggccaagcagttcatcgaaaacttcaagaaattcgaggtttccgatgcgatcaaggccgccggcccgcagctgtaa

SEQ ID NO: 6394 - DNA, 666 bp, Pseudomonas aeruginosa
agtctggtttatcttctcgccaatgccctagagtgggcgcccctttgttccctcgcagtggatttccccatgcatatcgaagacgccgttcgtagtcgccgtgccatcaagggctacgactcatccttcagcctgactcgcgaagagaaggaccatctcctggacctggcgctgcatgcgccttccgccttcaacctgcaacacgtgcggctggtcgaggtcagcgatccgcaattgcgcgtgcagttgcgtgaagtggcctgggaccaggcgcaggtcaccgacgcggcgatgctggtggtggtgtgcgcccagctcgacagttgggagcgcaacgcgcagcgggtctgggacggtgctcccgaggcggtacaggcgttcatggcaggcgccatcgacacctactaccgcggcaagccccaggtacagcgcgacgaagccatgcgcagctgcggcctgctggcgcagaccctgatgctggtcgcccgcggccagggcctggattcgtgtccgatggatggtttcgacttcgatgccgtggcccggctgatcaacctgccggacaaccatgtgatcggcctgatggtcgcggtcgggaaaaaggccgttgaaccctggccgcgcagcggcaagctgccgcgggaagaactggtccagactgtgtaa

SEQ ID NO: 6395 - DNA, 645 bp, Pseudomonas aeruginosa
tcatgcgcgaatacggcgacctgccggtgttcgtcgcgccccagggcgagcagatctgcctctggcgcagcgcccgcgagtggttcggctgaaacgacccggcacgacggcgttcccgcctggggacgcctggcaagtccctatcatcgcaaggaaccccgcatggcccaccccaacgccgaactgatcgagcgcttctaccaggccttccagcgcctcgacggcgaggccatggcggcctgctacgctccccaggcgaccttccacgacccggccttcggcgaactgcgcgggcgcgaggtgggcgacatgtggcgcctgctgaccagccgggcgcgggacttccgcctggactacgcgaacgtccgcgccgacgagaacgaggggcgtgcgcaatgggtggcccactacctgttcacccagaccgggcgcagggtggagaatcgcatcgaggcccgtttccgcttcgccgacggtttgatcgtcgagcatcgcgaccagttcgacctgtggcgctggagccgccaggcgcttggcgccaagggcctgctgctgggctgggcgccgccggtgcagcgggcgatccgcgggcaggcgcgcaagggcctggccgcctaccaggctgcccatccggcggccggctga

SEQ ID NO: 6396 - DNA, 741 bp, Pseudomonas aeruginosa
tctcctaagctcgccgcggacaacccgcaggacgccgcgatgatcacgctcttccagttccccgccgcattcaacgtacccaatgccagtccctactgcctgaaactggaaacctggttgcgcctggccggcctggagtatcaggtgaaggtcgtcagcgacccgcgcaaggcgcccaagggcaagctgccctacgtgcgtatcgagggcgaggcgatcggtgacagcgagatcgtcatccgtaccctcggcgagcgctacggggtcacactcgacgccggcctggatgcccggggcaagggctgggcacgggcgatcacgcgcctgtgcgacgaacacctgtactacctgatgctgtatttccgctggttcgacgaggacagctggcgcgtgctcaagccggtgttcttcggctcgctgccattcggcgtgcgcgacgcggtggcctgggccatgcgccgcaaggtccgcgctaccctcagggcgcaggggctcggggtccacggcagggacgaactgctggccttcgcccgcgacgacctcgatgccctcgacggcctgcttggccaggtcccgtactacggcggcgaacatccgtgcagcgccgatgccgccgcttacggtatcctcgccaacctcatcgaggcgaccctggataccccactcagccatgtggcgcgaggctatccgcgcctggtggcgtattgcgagcggatgcgggagcgggtctggagtgagtga

SEQ ID NO: 6397 - DNA, 411 bp, Pseudomonas aeruginosa
tcctgctcgacgccgctgaattcagcggcgcgccctgccagccgccggcgctgccggcgggcaacccgctgttggcgcagaccgagccgccgcagtggctggaggctggttcggcggccagcttcgtgccggactgggcggaggacgactactacctgctgcgcgccctcggtggccgcccggcggccggccaccagcagcgctacccgctgcgctggacggcgcgggcgcaagaccccaacgccggggtggtgcccagcgaatacggcgacggcggctaccagctgccgcactactggctggacggcaagatcgagcgcgacaactaccgcgagcatccctgggtggaagggcacctgccgaaccatatcggcggcaccatgcgtccggtgcagggcgtgccggagatga

SEQ ID NO: 6398 - DNA, 630 bp, Pseudomonas aeruginosa
ggttgtgggaggacgcgctgtccatggcgcccgtgccgtgcaagcctaagccagacgaaccgagacgtcgaaccgaaggaggacgccatgctgatccgcgccgcaacctcgaccctgctggtggtcgatatccaggaacgcctgctgccggccatcgacgacggtccggcgctggtcgagtacagccagtggttgttgcgcgtggcccgcgcactggacgtgccggtgctggccagcgagcagtacagcaagggcctggggccgacggtggcggccctgcgcgatgagctggagcccacgcagatcctcgagaagctggacttctcggccgccgccgacggcgccctgctgcgcgcgcccggcggcgaccgccggcagttcgtggtttgcggcagcgaggcgcacgtctgcgtgctgcagaccgtgctcgacctgcttggccgtggtcgcgaagtgttcgtcgtggaggaggcgatcggctcgcggcggccgagcgacaaggcgctggccgtggagcggatgcgccaggccggggcgatgatcgtgtcgcgggagatggtcgccttcgaatggatggaacgcgccggcagcgaccgcttccgcgagatcagccgcaacttcattcgctga

SEQ ID NO: 6399 - DNA, 1029 bp, Pseudomonas aeruginosa
cggcgcttaatcatcgacaaaggatgccgcgatgcaactgatcggtatgctggattcgccttttgtgcgccgggtcgccatcgccctgcgcctgctggacctgccctacgagcaccggccgctgtcggtgttccgcaatttccaggcgttcagcctgttcaacccgatggtcaaggcgcccacgctggtgctggacgatggcaccgtgctgatggactccagcctgatcctcgattacctggagtgcctggccggccgcgaacgcagtctgctgccgcaacggccgcaggcccgtgcacgggcgttgagtctgatcggcgcggcgctggtggcctgcgagaaatccgtgcagatctactacgaactgaacctgcgtcccgaggaacgccgccacggcccctggctggagcgggtggaggggcagttgctggcggcctacgactggctggaggcagcgctgcgccaggagccgctggcacgcgacggtggcatcgagctggtcggggtgaccgtcgcggtggcctggcgcttcagccaactggtggtcgcggagcgggtcgccgccagcgaatacccggaactggcaagctattcggattatgcggaggggttgccggtgttcctcgagacgccgtcggtctgagcccgcgaggcgccaggctggcgcccctcgaacggctcgattccgcctgcgcccggcctcggttcgctgtaggtcgctgccgtcgtcacggcccggaccggttgttgcgaactgctgttcggcgccggcatggaggcggcccggccctggctcagcctggtcctgagcgcggccctcggcttgctcttcggcatgctgctgggcgggctctggttcggctactggatccgccaggagggattgcaactgacccacctgctgctggtggtctgggtgctggcgaacttcttcgtgctcaacgtccgctggaactgatggggactgccggtacgaggagcaggacgcgaggacggcgacagtggagcgagccggacgcccgtcgatag

SEQ ID NO: 6400 - DNA, 636 bp, Pseudomonas aeruginosa
ggggctgctcgctcgcctgggcgcggcgctcgtgcgtcccttcgtggcgatcatggactggctgggcaaactgttgggctcccacgcccgcaccgggccgcagcccagtcaggacgcgcagcctgcggtcatgtcctcggccgtcgtgttcaagcagatggtgctgcagcaggcattgcccatgaccttgaagggactcgacaaggcgagcgagctggcgaccctgacaccggaaggactggcccgggagcactcccgcctggccagcggagatggggcgctgcgttcgctgagcaccgccttggccggcattcgtgccggcagccaggtcgaggagtcccgtatccaggctggccgcctgctcgaacggagcatcggcgggatcgcgctgcagcagtggggcaccaccggcggtgccgcgagtcaactggtgctcgacgcaagcccggaactgcggcgcgaaatcaccgaccagttgcatcaggtaatgagcgaggtcgcactgttgcgccaagcggtagagagcgaggtcagcagagtatcggccgacaaggcgctggcggatggcctggtgaagcggttcggggcggatgcggaaaagtacctgggcagacagcctggtggcatccacagtga

SEQ ID NO: 6401 - DNA, 420 bp, Pseudomonas aeruginosa
tctggcctgaccgggcgtaaaagaaagacgtcacgaacggacaccttggggtgtccgattcttggctcggcagcggatctggatggagaggcgtgctggctattcgcccagtggttccaggagggctgctgtccaacgctccttgcgccaggcccggcgctgcttcttgtcgaggtaggtccaggcgacgaagcggctctgcttctgtccctgggccatgtccaccacgcggatatcgctggcgcccaacgtcttcaggcgctcctggaggttcggcaggttgctcgccttggataccagggtggtgaaccagaacacctgcgtggcgaacgcccggctttcctcggccatgccggccaggaaggccgcttcgccgccctcgcagtacagctcggcgccctggccgccaaagttcagtag

SEQ ID NO: 6402 - DNA, 840 bp, Pseudomonas aeruginosa
cggcagggtacgggtcgggtcgagcttgccgaggttcttccacttgcgccggctgccgcgcgtggcttcgtccagcgaggcgtggaagggcgggttgcagagggtcatgtcgaagcgctcatcgacgccgatcaggccctggaatatctgcctgcgatcaggctgccggcgcaactcgatggcagcggcgaagcgtgggttggcggcgaggatcgcagcggccgaggccagcgattgcgggtcgatgtcggcgccgacgaagcgccagccgtattcgtggtggccgagcagcgggtagatgcagttggctccggttccgacgtccagcgcacgcaggccgggaccgcgtggaatcaggccatcgtggctggcgccgagcaggtcggccaggtagtgcaggtagtcggcgcgaccggggatgggcgggcacaggtaaccatcgggtatatcccactcgcgtacgtcgtagaactgttgcagcagcgcgcggttgaaggctttcaccgccgccggatcggcgaagtcgatgctctgcctgccgtacggattgaggatgacgaagcgctccagttccgggctgccggcgatcaggcgcggaaagtcgtagcgtcccaggtggcgattgcgcgggtgcagcgggctggcgctcttgcgctcggcgtcgggatgcgggctggtcgggcggggcatgttctcggtttccgtgacggcgaggcgggcattattcacatccgccggaggctggccagtgtttctgccgagcggcgcgctcctggcccggtcacaatggaaacagccacggaatcaccagcacgcagacgaacatcaccagcagggtaa

SEQ ID NO: 6403 - DNA, 1032 bp, Pseudomonas aeruginosa
agagggcgacggtggtggcgagcaggccgaccacccagagcagttcgaggttcatgcgggcatctgagcgggaggatgcctgcgagtgtggcagacggacgcggatcgcgccttgatctgctgcaggtcgacggcgcctccccgcttcgccgcggagaggcgccgcggccctgtcagccgaggaggagggcgtcgtcggcgagcttctcgccgcgcaccttctcgaacatcgccagcaggtccggtacgtcgaggcccttgcgttgctcgccggagacgtccagcaccacctggccctggtgcagcatcaccgtgcgctcgcccacgtccagcgcctggcgcatgctgtgggtgaccatcatggtggtgagtttcttctcggcgacgatccgtgcggtgagatgcaggacgaagtcggcggtgcgcgggtcgagcgccgcggtgtgttcgtcgagcaacaggatacgcgacggctgcagcgccgccatcagcaggctgacggcctggcgctggccgccggagagcaggccgatgcggtcgccgaggcggttctccaggccgaggccgagggtcgccaggctttcccggaaaccgtcgcgcatcgatgcctgcaccgccctgccgaggccgcgcccggcaccgcgacgttgcgccagggccatgttctcctcgatggtgaggtcctcgcaggtacccgccatggggtcctggaacacccgcgcgacgcggttggcgcgggcccagaccggcttgcgggtgacgtcttcgtcgtcgatcaggatctgtccgctgtcgatcggcaggtcgccggagactgcgttgaggaaggtcgacttgccggcgccgttggagccgatcacggtgacgaactggccggccgggatgtccagcgacaggccgcgcagggcgcgggtctcgatgggggtgccggggttgaaggtgatcttcaggttcttcgcgctgagcatggtcaggctcccttcttgccgagcaggcgtttcttcatcatcggaatcaccagggcgacggtga

SEQ ID NO: 6404 - DNA, 573 bp, Pseudomonas aeruginosa
tatcttataaaaatatcgatcagtgctggcggtggcttgtttgatgttggcagtgtctttcttcctgtcgggcgcgcaatagtttctgtaggttttgactttatgttcggggccgtctcgggagcggagcgcggtctaggagggcgtggtggccataaatatgctgctggtatactttctgggggtaatgggaaagcgttcgcagggcacggtaaatatgttttcggtagcggggatttttgggtgcctgatgggacgtacataactcttccaaggcctggaattaatattctggatgaaaccggtcgatttattgaattgggtgattgggctggtttggcgcaggctgcaaaaattaatccgagacttgcaggtgatattgaaggcatggctacttatttgccgcgtgctgagattcctaactatactctaagtgctccagctgctagaggtccagcattgcatatcgatggaaactcaacgactgttgagttcagtacccccttggaaaaactattacagcttggggtgggatgcgtgcagtgggctgcttgtacaacatttgcgaggtag

SEQ ID NO: 6405 - DNA, 747 bp, Pseudomonas aeruginosa
agcgcggcgatcttctgccgttgctcggccagcttggccagggcctgttcggcctcggctagcttggcgcgttccttctcgatcacgtcggccggggccttggcgacgaagccttcgttggacagcttgccgccgacgcgcttgacctcgccttccaggcgctggatctccttgtccaggcgccccagttcggcgctcttgtcgatcaggccggccatcggcaccaatacttccatgtcgccgaccagggcggtggcggacatcggcgcttcctcgccggcttccagcacgcggatgctttccagcttggccagtttcatcagcagcggctcgttgtcggccaggcggcggtggtcgctgggcgaggcgttcctgaggatgatgtcgatgcgcttggccatggagatgttcatctcgccgcggatctgccgcacgcctagcatcagcgccttgacccactcgatgtcgccttcggcggcggcgtcgatcctgccttcgtcggccaccggccagggttgcagcatcagggtcggaccttccttgccggcctggcccttgatgcgctgccagatttcctcggtgatgaacggcatgaacgggtgcgccaggcgcagggccgtctccagcacgcggatcagggtgcgacgagtgccgcgctggcgctcgatgggggcgttctcgtcccacagcaccggcttgaccagctccaggtaccaggcgcagtactcgtcccagatgaactcatag

SEQ ID NO: 6406 - DNA, 585 bp, Pseudomonas aeruginosa
aggcctcgccgcggaagctccacaggcggccgtccaactcgctgcgctgcgcctcgtcggcgcaatgcaggtagacctgcatgccctgccgccaggccttctcggccaggcggcaggcgacctgcaggcgcgccgacggatcggcgctggggatcacgtagaaatcgacccgggtcacttggcccgttccagcaggtactgggtcaacaacggaaccgggcggccggtggcgcctttgtccttgccgccgctgatccaggcggtgccggcgatgtccaggtgcgcccagtggtatttcttggcgaagcgcgagaggaagcagccggcggtgatggtgccggccttcggcccgccgatgttggcgatgtcggcgaacgggctgtccagctgttcctggtattcgtcgaacagcgggcaattgccaggcgcggtcgtcggcgaactcccccggccttgagcaattgcctgaccagcgcttcgttgttgcccataaggcccgaggtgttgctgcccagggcgacgatgcaggcgccggtgagggtggcgatgtcgatcaccgactgcggcttgaagcgctcggcgtag

SEQ ID NO: 6407 - DNA, 555 bp, Pseudomonas aeruginosa
gtcagtgcgtcgcacagcaccaggcgcccttcggcgtcggtgttgaggatctcgacggtctgcccgctcatggtggtgacgatgtcgcccggacgggtggctccgccgctgggcatgttctcggcgcaggccagcaggccgaccaggttgatcggcaactgcagttcgagcaccgcgcggaaggtgccgaagacgctggcggcgccgcacatgtcgaacttcatctcgtccatgcccaggcccggcttgaggctgatgccgccggtgtcgaaggtgatgcccttgccgaccagcacgtgcggggcctggtccttcttcgcgccgttgtattgcaggacgatcagccgcggcggctggtcgctgccctgggcgacggcgaggaacgagcccatgcccagctcgcgcagtttcttctcgtcgaggacctcgaccttcaggcccttgaactccttggccaggcccttggcctgctcgccgaggaacgtcggatggcagacgttcggcggcaggttgccgagatcgcgggtcagggccatgccattggcgatggcctga

SEQ ID NO: 6408 - DNA, 1167 bp, Pseudomonas aeruginosa
cggggccgacgggccccgtcagagcctggcaacccaggagtgtccggattgatcgttttccgttatttgtcccgtgaagtgctggtcaccatgagcgccgtcagcgccgtgctgctggtgatcatcatgagtggccgtttcatcaagtacctggcgcaagcggcgcaggggttgctcgaccccggttcgctgttcctgatcatggcgttccggattcccggcttcctgcagctgatcctgccgcttggcctgttcctcggcatcctgctggcctacgggcgactctatctggaaagcgagatgaccgtgctctcggcgaccggcatgagccagaagcgcctgctcggctataccatggccccggcgctgctggtggcgatcctggtggcctggctgagcctgttcctggcgccccagggcatcaaccagttcgccctgctgttgaacaagcaggataccctgaccgagttcgacaccctggtcccgggccgtttccaggcaatgcgcgacggtacccgggtgacctataccgaggaactgtcgaaggatcgcggcgaactggccggcatcttcatttcgcagaaggacctcaacagcagcaaccaggaacgcggcatctccatcctggtggcggagaagggcacccagaacatccaggcggatggcagccgttacctgatcctgcacaacggctaccgctacgacggcaatcccgggcaggccaactaccgggcgatccagtacgacacctatggcgtgatgctgcccaagcccgaggccagcagcgaggtgagcgagcgtgacgcggtgcccaccgccgacctgttcggcagcgacaacccacgctaccaggccgaattgcagtggcgcctgtcgacaccgctgctggtattcgtggtgaccctgctggcggtgccgctgtcgcgggtcaacccacgccaggggcgcttcctcaagctgctgccggcgatcctcctttatatgggctacctggccctgctgatcgctgtccgtggccaactggacaaaggcaagatccccatggccatcggcctgtggtgggtccacggactattcctggcgatcggtcttcttctgttctattgggaacccttgcgcctgaagctggcgtcctcccgtgccggtcgcgacgtggcgcatggttaa

SEQ ID NO: 6409 - DNA, 1083 bp, Pseudomonas aeruginosa
gctcgatcgttacatcggtgtcaccgtcttcgtcgcgatcctcgcggtgctcggggtgatccttggcctggcgctgctgttcgccttcatcgacgaactcaacgacatcagcgccagctacggcatcggcgacgccctgcgcttcatcttcctcaccgcgccacggcgcgcctacgacatgctgccgatggcggcgctgatcggctgcctggtcggcctcggcaccctggccagcaacagcgaactgaccatcatgcgcgcggccggggtatccctgtcgcggatcgtctgggcggtgatgaaaccgatgctggtgctgatgctggccggcatcctggttggcgagtacgtcgcgccctggaccgagaacatcgcccagagcggccgcgccctggcccagggcggcggcgattcgcaaagctccaagcgcggtctgtggcatcgccaggggcgcgagtacatccacatcaacgcggtgcagcccaatggcgtgctgtacggcgtgacccgctaccgcttcgacgagcagcgtggcctggaatcggccagtttcgccaagcgcgcgcgcttcgagaccgatcactggcaactggaagaggtcaccaccaccttgctgcatccgagggaaaagcgttccgaggtggtcaagctaccgaccgaacgctgggatgcccagctcagcccgcaactgctgaacactgtggtgatggagcccgaggcgctgtctatcagcggtctctggcagtacatccactatctcgccgaccagggcctgaacaacaaccgctactggctggcgttctggaccaaggtcctgcaaccgctggtgaccgccgcgctggtgctgatggcgatttccttcatcttcggtccgttgcgctcggtgaccctgggccagcggatcttcaccggcgtgctggtgggcttcgtcttccgcatcgcccaggacctgctcggaccctccagcctggtgttcgacttcccgccgctgctggcggtggtgatccccgcctcgatctgcgcactggcgggtgtctggctgctacgccgggcgggctgacaggcccggcaggccgggtatga

SEQ ID NO: 6410 - DNA, 1617 bp, Pseudomonas aeruginosa
tctttgcgcagaccccaatcattacgagtcttttctatgccgattccggtgaagcgagctaggagaaaggcgctccggctgtcgttgtccgtgctggtcggggtgatgccgatcgtcctggggctgctcatcctctactggcaggccgagcgaagcctccaggagacgtccgagcaggcagccgggaatgcggtgcggcagttcgaacggatgctcgacaacgctgcgttggcggcgcgcaaggtcatgccggtggcggggcgcccctgtcccgaggccgaactggcgctgcgcgagcaagtggcgatcatgccgttcgtacgctcggtcaatttgacgcgcgacaatacgatctattgcacgtcgttgttcggcggcttcgacgagccggtgcggatcgagaactatgtcgacggacgcctcttgctgatgcccggcaaccaagtcacgccggacgccgcgctgctggtcctgcgggacttcgacggcaagcgcggggtattggcggcgatcgacgggcgctacttgagctacgtgctggacctcgtcgaccgacgtagccgacaggtgctggtggtcggtcccaattggctggatgccgagggccgcactcaccgcgacgcgccgcccacctatgaggtcgccgccgtatcgctcgcttcgcagcgttatccgttgcgggtgctgtcgggcttccccgagggcgaggaatggcgatcgatccgctcgcagaacccggcgatgttcggcctgctactgttcttcggactgctggccggcactctgtgctactggctatccaggcgggtcgcctcgcccagcagcgaactgcgccgggccctggaggccaacgagttcattccctactaccagccgctgagtcccggccagggcggacgctggataggcgtcgaggtgctcatgcgctggcgtcatccgcgtgagggactgatccggcccgacctgttcatacctttcgccgagcgctcgggactgatcgtaccgatgacgcgcgcgctgatgcgccaggtcgcggaagacctgggcgggcatgccgggaagctggagccaggcttccacatcggtttcaacatcagtgccacccattgccacgaactggccttggtggacgactgtcgcgagctgttggcggcgtttccgcccgggcacatcaccctggtcctggaactgaccgagcgcgagctgatcgagtcgagcgaagtcaccgaccgtctgttcgacgaattgcatgccctgggagtgaagatcgctatcgacgatttcggcactggacattccagcctggcctacctgcgcaagttccaggtggactgcctgaagatcgaccagagcttcgtcgcccgcatcggcatcgatactctttccgggcatattctcgacagcatcgtcgagctgtccgccaagctcgacctggatatcgtcgccgaaggcgtggagacccccgagcagcgtgactacctggccgcccgcggggtggattacctgcagggctacctgatcggccggccgatgccgctggagagtctgctttccagcctgactgtgcaggaagggcagggggcttccgtcgtcgcacttccggcggaccgaggctag

SEQ ID NO: 6411 - DNA, 483 bp, Pseudomonas aeruginosa
acgccgcgcaagccgcctgttggcgctggatggcccgacgggaaccctcgcccacagacaattcgccgatctcctggactacctgcgtccgggcgacctgatggtgttcaacaatacccgggtgatcccggcgcgcctgttcggccagaaggaatccggcggcaagctggaagtcctggtcgagcgcgtgctcgaccagcaccgggtgcttgcccacatacgcgccagcaaggcgcccaagcccggcacgcggatcctcgtcgaaggcggtggcagcgcggagatgctgcaacgccacgacgccctgttcgaactcgcgttcgccgaacccgtgctgcctttgctggagcgggtcgggcacatgccgttgcctccctatatcgaccgaccggacgatgcggccgaccgcgagcgctaccagaccgtctacgcccagcgcgccggtgcggtggcggccccgaccgccggcctgcacttcgatga

SEQ ID NO: 6412 - DNA, 351 bp, Pseudomonas aeruginosa
caggagtgctacatgagctttctaattcccgctgcccacgccgacgcagccgctccggcagccgctggcccggccggcaccggtttcgagtgggtcttcctggttggtttcctggtcatcttctacctgatgatctggcgtccccaggccaagcgcgccaaggaacacaagaacctgctgggcaacctgcaaaaaggtgacgaagtcgtcacttccggcggtatcgccggcaaggtgaccaaggtcgccgacgatttcgtcgtcgtcgaggtttccgacaacgtcgagctgaagttccagaaggccgcgattgccgcgaccctgccgaaaggcaccctgaaagcgatctga

SEQ ID NO: 6413 - DNA, 1398 bp, Pseudomonas aeruginosa
agagcctgctgcgcaaggagcgcgtgcgctaccgcagcctgccgatccagcgatcgcgcgatccagctcggtttcaccgacagcgaatccctggacaaggcgcgcagcctgatcgccaaggacttccgcgatttcgaggtcgtgcccgaagagcgcaacggcctgcaggtcctgcgcgtcgccctgacccaggccaaactggcggaaatccgcgaatactccatcaagcagaacctcaccaccgtccgcaaccgggtcaacgagctgggcgtatccgagccgctggttcagcgccagggcgccaatcgcatcgtggtcgagctgccgggcgtgcaggacaccgcggaagccaagcggatcctcggcaagaccgccaacctagaattccgcctggccgccgagccggacgccctgaagtccgccaccgagaccttcgagttccgcgagccgcgccggccgccggtgccgctggagcgcggggtgatcatcaccggcgaccaggtcaccgacgccagcgccagtttcgacgagaacggccgcccgcaggtgaacatccgcctggatggccatggcggcgagctgatgaaccgcgccacccgcaacaacgtcggccgcagcatggcggtggtgttcatcgagcagaagccggtgacccgctacaccaagcagatggtcgatggcgtcgagaaggaggtcgcggttccggcgttcaaggaagagaagcagatcatcagcctggcgaccatccagtcgccgctgggcaaccagttccgtatcaccggcctcgatggccccggcgagtcctccgagctggccctgctgctgcgtgccggcggcctggctgcgccgatgtacttcgccgaagaacgcaccatcggcccgagcctgggggcggacaacatcgccaagggtatcgatgcgtcgctctggggcatgctcttcgtatcgctgttcatcatcgtcatctaccgtttcttcggcgtgatcgccaccgttgcgctggccttcaacatggtcatgctggtggcgctgatgtcgatcctcggcgcgaccctgaccctgccgggcatcgccggtatcgtgctgaccatgggcatggcggtggacgccaacgtgctgatcttctcgcggatacgcgaggaactggccaatggcatgtccgtccaaaaggcgatccacgaaggcttcaaccgtgccttcaccgcgatcctcgacgccaacctgacctcgctgctggtcggcggcatcctatacgccatgggcaccggcccggtgaaaggatttgccgtgaccatgtcgctcggcatcatcacctcgatgttcacggccatcatggtcacccgcgcaatggtcaacctgatcttcggcgggcgtgacttcaagaagctgtggatctaa

SEQ ID NO: 6414 - DNA, 897 bp, Pseudomonas aeruginosa
aaaacccggcgccaggccgggttcttcgtcagcggcggatcagcgcttcagcgacggcggcaggtgcggctggatggtggtcagcagtgccttgaagcatttggtgttgccggcgacgatgtgacccttctcgaggaattcgtggctgccggtgaagtcgctcaccaggccgccggcttcctgtaccagcagggcgcctgccgccatgtcccattcggacaggccgaattcccagaaggcgtcgtagcgtccggcggcgacgtaggccaggtccagactggcggcgccggcgcggcggatgccggcggtctggccgaccaggctgcggaacatgttcaggtagttgtcgagattgtcgatctggttgtcgcggaacgggaacccggtgccgagcagggcgccttccaggctcttgcggccgctgacgcgcaggcggcgaccgttgagggcggcgccgcgaccgcggctggcggtgaattcttcctggcgtaccgggtcgaggaccacggcgtgctccaggcggcccttgtacttgcaggcgatgctcacggcgaagtgcggtacgccatggatgaagttggtggtgccgtccagcggatcgatcacccagaggtaatcggcgccctcgccgctgccttcgatgaagccgccttcctcgcccatgatcgcgtgagtcggataggccttgcgcagcgcggcgacgatggtctgctcggcggcgcgatcgacttcggtcacgtagtccttggcatccttctcgttgaccgagatgacatccaggcgttcgatggagcggaaaatcagttcaccggcgctgcgagcggcgcgcagggcgatattcagcataggctgcatggagaggtcacctgggtcgttaaagaaagccggccattctag

SEQ ID NO: 6415 - DNA, 783 bp, Pseudomonas aeruginosa
cgactgatgttcgaacgtgtgcgtgaagatatccaaagcgtattccaccgtgatccggcggctcgcaacgcactcgaggtcctcacctgttatccgggcctgcacgccgtctggctgcatcggctggcccacggcttgtggacgtccggctggaagtggctggcgcgcctggtgtccaatttcggccgctggatgaccggcatcgagatccacccgggggccaggatcggccggcgcttcttcatcgaccacggcatgggcatcgtcatcggcgaaaccgccgagatcggcgacgacgtcaccctctatcagggcgttaccctgggcggcaccacctggaacaagggcaagcgccaccccaccctcggcaacaacgtagtggtcggtgccggtgccaaggtgctcggcccgttcaccgtcggcgagggcgccaaggtcggctccaacgccgtggtgaccaaggaagtcccgccgggtgccaccgtggtcggcattcccgggcggatcatcatgcgcgaggactccgagcagcaggccaagcgccaagcgatggcggagaagctcggcttcgatgcctatggggtcagccaggacatgccggacccggtggcgcgtgccattggtcagttgctcgatcacctgcaggccgtcgacggccggctcgagggcatgtgccaggcgctcaccgccctgggtagcgactactgcgcgaaggacctgccggtattgcgcgaggaagatttcgccggagtcaaggacgaggacggcaatccggccgcgtaa

SEQ ID NO: 6416 - DNA, 510 bp, Pseudomonas aeruginosa
tcccgatgggaaaagcccatgcgtctgaccaccaaaggccgctacgccgtaaccgccatgctcgacctggcgctgcatgctcagcaaggtccggtctcgctggccgatatctccgaacgccaaggcatttccctgtcctatctcgaacagctgttcgccaagttgcgccgtggcaacctggtgaccagcgtgcgcggcccgggcggcggctaccagctgtcccgccatatgtcgggcatccatgtggcgcaggtgatcgacgcggtcaacgaatccgtcgacgcgacccgctgccaggggcagggcgattgccactccggcgatacctgtctgacccaccacctgtggtgcgacctcagtttgcagatccatgagttcctcagcggcatcagcctggccgatctggtcagccgccaggaggtccaggaggtcgcgctgcgccaggacgaacgccgttgctcaggcaagacgcctcgtctcgacaagattgaagcgtccgccatcgactga

SEQ ID NO: 6417 - DNA, 405 bp, Pseudomonas aeruginosa
tcgtccgcgaaggcctcgactccatggagccgtccgacgaactcgaagacgacatgctggacaaggcctggggtctggagcccgattcgcggctatcctgccaggcagtggtggccgacgaagacctggtggtcgagattcccaagtacaccatcaaccaggtgtcggaaggccactgagcccggcggtagagaggagcgtgcaatgagcctgaaatggaccgatgtgctggaaatcgccatccagctcgacgaaagcaagccggaggtcgatccgcgatacgtcaacttcgtcgatctgcggcgctgggtggtggaacttccagagttctccgacgatcctcagcgtagcggggagaaagtcctggaggccatccaggccgcctggatcgaggaacgggactag

SEQ ID NO: 6418 - DNA, 603 bp, Pseudomonas aeruginosa
aatcgcccgcgggcgcattccaggctaggcgcgccgggcccgatgccaggcgcagccacgctgattccggccctttcgggccgttttcgtcagcgtcctgaacgaatcacggcgtcccgccccgctggcggggccgcccatgctagacaaccttgtttcggagttttaccaatggcactgcaacgcaccctgtccatcatcaagccggacgccgtttccaagaacgtgatcggcgaaatcctgacccgcttcgagaaagccggcctgcgcgtcgtcgccgctaaaatggttcagctgtccgagcgtgaagccggcggcttctatgccgagcacaaagagcgtccgttcttcaaggacctggtttccttcatgacttccggtccggttgtagtccaggtcctggaaggcgaggacgccatcgccaagaaccgcgagctgatgggcgccaccgatccgaagaaagccgacgccggtaccatccgcgccgacttcgccgtctccatcgacgagaacgccgtccacggttccgattccgaagcttccgccgctcgcgagatcgcctacttcttcgcggctaccgaagtctgcgagcgcattcgctga

SEQ ID NO: 6419 - DNA, 1164 bp, Pseudomonas aeruginosa
tcgagcgtgggtgagggtgaagccatgacaacgaccaccgccggcaaggtgaacctgctgggcctgacccagccgcagctggaacagttcttcgagtccatcggcgagaagcgtttccgggccggccaggtcatgaagtggattcaccactttggcgtcgacgatttcgacgccatgaccaacgtcggcaaggccttgcgcgaaaagctcaaggcctcagccgagatacgcggtcccgagatcgtcagccaggatatttccgccgacggcacccgcaagtgggtggtccgggtggcgtccggcagttgcgtcgagaccgtgtacatcccccagggcggacgcggcaccctgtgcgtgtcctcccaggcgggctgcgccctggattgcagtttctgctccaccggcaagcagggtttcaacagcgacctcaccgccgccgaggtgatcggccaggtgtggatcgccaacaagtcgttcggtaccgttccggccaagatcgaccgcgccatcaccaatgtcgtgatgatgggcatgggcgagccgctgctgaacttcgacaacgtggtcgtcgccatgaacatcatgatggacgacctcggctacggtatttccaagcgcaaggtgaccctgtccacctccggcgtggtgccgatgatcgacaagcttggcgaggtgatcgacgtgtccctggccctgtcgctgcacgcaccgaacgacgagttgcgcaacaagctggtgccgatcaacaagaagtatccgctgggcatgctgctggatgcctgccgccggtatatttcccggctcggcgagaagcgcgtgctgaccgtcgaatacaccctgctcaaggatgtcaacgatcagcccgagcatgctgagcagatgatcgcattgctgaaagacacgccttgcaagatcaacctgattccgtttaatccattcccgcactccggctacgagcgcccgagcaacaatgccatccggcgtttccaggacatgttgcacaagggcggcttcaacgtgaccgtgcgtaccacccgcggcgacgacatcgacgcggcctgtggccaactggttggtcaggtcatggatcgtacccgccggagcgaacgttatattgccgtgcgccaactggccgagtccgagtcggcggcgaatcgaaattga

SEQ ID NO: 6420 - DNA, 1644 bp, Pseudomonas aeruginosa
agaccaggcggtgatcgaagcgcagaaggaaggcgagcaagcgcccgccgaggtttctccggaagtcgctgcccaggccgagggagcgccgccggtggcgagcgagggcgcgcaggttcccgccgctccggcccagggcacccccgccgcaccccagcagcccgttaccgccgcgcctgccggcacggctcccgctcccggtactgctccagccgttccagcgacggccagtccggccgccccgccagcgccgagcgaacctgccgccgcgcccgtggtggccggcgagggccagggggtggtcaaggtacagttcgtcgccgattgctggacccaggtcaccgacgccaacggcaaggtcctggtcagcgcgctgaagcgcaagggcgacagcctggaactggccggcaaggccccgctggagctgcgcctcggtttcgctcgcggcgcccaggtcagctacaacggccagccggtggacgtgacccccttcgtccgcggcgaaacggcccgtctgaaggtaggacaatgagcattcatagcgcttctccgatcattcgccgcaagtctcggaaaatctgggtcggcaacgtcccggtgggcggcgacgcgccgatcgccgtgcagagcatgaccaacaccgagacctgcgacgtcgctgccaccgtcgcgcagatccgccgcctggaagatgccggcgcggacatcgtgcgggtttccgtccccgacatggacgccgccgaggcattcggcaagatcaagcagcaggtcaacgtgccgctggtcgccgacatccacttcgactatcgcatcgccctgcgcgtcgccgagctgggagtggactgcctgcgcatcaatccgggcaacatcggtcgcgaggaccgggtcaaggccgtggtcgatgccgcgcgcgagcgcaacatcccgatccgtatcggcgtcaatgccggttcgctggaaaaggacctgcagaagaaatacggcgaaccgaccccggaagccctgctcgaatcggccatgcgccacgtcgatcatctcgacaagctggacttccagaacttcaaggtcagcgtcaaggcctccgacgtcttcatggccgtcgccgcctatcgcctgctggccaggcagatcgagcagcccctgcacctgggcatcaccgaggccggcggcctgcgctccggcacggtgaagtcggcggtggggctgggcatgctcctggccgagggaatcggcgacaccatccggatttccctggctgccgatccggtcgaggagatcaaggtcggtttcgacatcctcaagtccctgcacctgcgctcccgtggcatcaacttcatcgcctgcccgagctgttcgcggcagaacttcgacgtggtgaagaccatgaacgagctggaagggcgcctggaggacctgctggtgccgatggacgtggccgtgatcggttgcgtcgtcaacggtccgggcgaagccaaggaggcccatgtcggcctcaccggcggcactccgaacctggtgtatatcgacggcaagccgtcgcagaaactgaccaacgacaacctggtggacgagctggaacggctgatccgccagaaggcggccgagaaggccgaggccgatgcgagcctgatcgcccgcggctga

SEQ ID NO: 6421 - DNA, 1053 bp, Pseudomonas aeruginosa
ggaccctacgtgagcaagtccctgcaagccattcgtggcatgaacgacatcctgccggagcagactccggcctggcgctatctggaacgcaccttcgccggcctgctggacggctacggctacagcgagatccgcctgcccatcctcgagttcaccgaactcttcgcccgcggcatcggcgaaggcaccgacgtggtcgacaaggagatgtacaccttcctcgaccgcaacggcgaatccctgaccatgcgtccggaaggtaccgccggttgcgtgcgcgccgtgctggagcacggcctgagcggcggtggccaggtgcagaagctctggtacaccgggccgatgttccgttacgagaaaccgcagaaaggtcgctaccggcagttccaccagatcggcgtggaagtcttcaacctgcccggtccggacatcgacgccgagttgatcatcctcacctggcgcctgtggcagaagctcggcatggccgacgcggtgaccctgcagctcaacaccctcggctccagcgaggcccgcgcacgctatcgcgaggccctggtggcctatctgcaggagcgcttcgagcaactcgacgaagacagccagcggcgcatgaccaccaatccgctgcgaatcctcgacagcaaggtggagagcacccaggcgttgctggttggcgcgccgaccctgcacgactatctcgacgaagaatcgatcgcccacttcgagggtctcaaggcccgcctggatgctgtcggactgcgctacgaaatcaaccagaagctggtgcgcggcctggactattactgccgcacggctttcgaatgggtcaccgacaagcttggcgcccagggcaccgtttgcggcggtggccgctacgacgggctggtcagccagttcggcggcaagccgaccccgggcgtcggtttcgccatgggcgtggaacgcctggtgctgctgctggaaaccttggggggtgatccccgccgaactgaaccgtccggccgacctctacgtctgcgccttcggcgaaccagcccgagctggccgccctga

SEQ ID NO: 6422 - DNA, 777 bp, Pseudomonas aeruginosa
tgcgaaaatggccgagcaatcgttgcaggccatcgaggaggcggatgccgtcctgttcctggtcgattcgcgcgccggcatgaccgccgccgaccagatgatcgccgagcacctgcgcaagcggaacaagcgcagcttcctgatcgccaacaaggtcgacaccatcgatcccgatctcgctcgcgccgagttcagcccgctgggcctgggcgatgcgctgccgatcgccgccgcccacggtcgcggcatcaaccatatgctgcaggaagccctggggatcttccccaaggacaacgcggaggaagagggcgagggcgagccggcgagcgaagaggtcgccgaaggcgaggaaccgacccggattcccggtcccagcgagaaggacgggatcaagattgccatcatcggccggcccaacgtgggcaagtcgaccctggtcaaccgcatgctcggcgaagagcgggtgatcgtctacgaccaggccggcaccacccgcgacagcatctacatcccgttcgagcgcaacgaggagaagtacaccctgatcgacaccgctggcgtgcggcgtcgcggcaagatcttcgaggcggtggaaaagttctcggtggtgaagaccctccaggcgatccaggacgccaacgtggtgatcttcgtcatggacgcccgcgaaggggtggtcgagcacgacctcaacctgctcggcttcgtcctcgagaccggccgtgccctggtcatcgccctgaacaaatgggatggcatggaggcggccgagcgtga

SEQ ID NO: 6423 - DNA, 429 bp, Pseudomonas aeruginosa
tcagcgacgaggtctacgagcacctggtgttcgacggtgtcgcccataccagcgtgctgtcccacgacgagttgtatccgcgttccttcgtggtcagttcgttcggcaagacctaccacgtcaccggctggaagaccggctacgtggtcgcgccgccggcgctcagcgcggagctgcgcaaggttcaccagtacgtcaacttctgtggcgtcacgccgctgcaatgggcattggcggactacatggccggccatccggagcacttgcggcaattgcccggcttctaccaggccaagcgcgacctgttctgcgacctgctgctggactctcgcttccgttttacccgtgcgccgggcacctacttccagtgcgtggactattcggccatccgtccggacctggacgacgtggccatggccgagtggctga

SEQ ID NO: 6424 - DNA, 408 bp, Pseudomonas aeruginosa
cccggatcaccgcttcgtagtcgcggccgatgtcggccggatcgatcggcaggtacggcacttcccagatcgcgtcttccttctgctgggcgaagcccttgcgaatggcatcctggtgcgagccggagaaagcggtatggaccaggtcgccgacatatggatggcgcgggtggaccggcaactggttgcactcttcgaccaccttgcgcaccgcgtcgatgtcggagaagtccagttgcggatgcaggccctgggtgtacatgttcaaggccagggtcaccaggtcgacgttgccggtgcgctcgccgttgccgaacaggcaaccttcgacgcggtcggcgccggccatcaggcccagctcggtggcggccacgccggtgccacggtcgttgtgggtgtgcaggctga

SEQ ID NO: 6425 - DNA, 678 bp, Pseudomonas aeruginosa
aagcttgtcctcgattgcgccgccggcacgctctccgcaacggaaaattctgcggccccatgccgcagaagagccagccgcccttgtgcgatcatttcgttccccgtgcctggggcgtataacgacaggcgcattcttcttttcggcatgacccggcgcgagcggccatccggcccgctacgcggtggtcttcattcaagacggcgggagtcgcaggtggcgaccactctgaaacgacaaggcatcggtgcatggctggctctgttcgccatgctgatgatcttcgtcgggccgctgatctcccagtcgatgccgatggaccacccgatgccgatgggcgtggggatgggccacgaaggcatgtcccacgagaacatggaccatggcgacatggcccatgccggctgttccgatgcccagcgctccgtcgtccatgccggcatgccggggatgggcggcgaggaaggcaatcgcctggccagcgacgtgctctgggagaagtgcggttattgcagcctgttgttccacagcccgccgctcaccgaagacgcctgcctggcgctgttctccgttcccttcgcgacggcgcccgccgtcgctttcctgaacgaggcgttcgtcgcctcgccggtgtttcccggcgcccgtacccgtgcgccgccgttcctgatcgcctga

SEQ ID NO: 6426 - DNA, 2049 bp, Pseudomonas aeruginosa
  unsure (1174),(1177): Identity of nucleotide at the above locations are unknown.
atcatggaaaaacgtatgtctactcaacaacgagcggccggcaacgcctgcccgaccgccgctttcagcttcgaccctgcccgtctcgcacaacgccgccgctgggcgggagccttcgccgctctgtgcggcctggccctgtctccgtcggcgctcctggccgaggaacactcacagcaccaggatcacgccgtggagctggcgccgagcgtggtcaccggagtcgcccagagttcgccgctgaccatcgtcaccaatcccaaggagccgcgccaaccggtgccggccagcgatggggccgactacctgaagaccattcccggcttcgcggtgatccgcaacggcggcagcaacggcgacccggtgctgcgcgggatgttcggttcgcgcctgaacatcctcaccaacggcggcatgatgctcggtgcctgtccgaaccggatggacgcgccgacctcctacatctcgccggaaacctacgacaagctcaccgtgatcaagggcccgcagacggtgctctgggggccgggcgcgtcggccgggacgatcctcttcgagcgtgagccggagcgcttcggagaactcggctcgcgggtcaacgccagcctgctggccggctccaatggccgcttcgacaaggtgctggacgccgccgccggcaaccggctcggctacctgcgcttcaccggcaaccacgcgcagtccgacgattacgaggacggcgccgggaataccgtgccgtcgcgctggaagaagtggaacggcgacgtcgcggtcggctggacccccgacgaggacaccctgatcgaactcaccgccggcaagggcgacggcgaggcacgctacgccgggcgcggcatggacggctcgcagttcaagcgcgagagcctgggcctgcgcttcgtcaaatcgaacgtcagcgatgtgctggagaaggtcgaggcacaggtttactacaattaccccgaccacatcagggacaagttccgcctgggcactcccggacccatccggcatgatgcccatgccgatggcgtcccaggtggacagaggcaccctcggcggtggcctggcggccacttggcgctgggacgacttcaagctggtcaccggggtggacgccatgcgcaacgagcaccgcgcgcgcggctccaagtacgacatgatgaccgantantacaccgacgccgaccagttcccctggagcaaggacgcggtgttccacaactacggggccttcggcgaactgacctggttcgccgccgagcgcgaccggctgatcggcgggttgcgcctggaccgcgcctcggtcaaggactaccggcagaccctgaagtccgggcacatgggccacgccatggccaacccgacggccaacgacacccgcgccgataccctgcccagcggcttcgtgcgctacgagcacgacctcgccgactcgccgaccaccctatacgccggcctcggccatgccgagcgcttccccgactactgggagctgttctcgcccaagcgcgggccgaacgggtcggtcaacgccttcgacaagatcaagccggaaaagaccacccagctcgacttcggcctccagtacaacggcgacaagctgcaggcctgggcctccggctacgtcggggtggtccaggacttcatcctgttcagctatcgcgagggcatgatgggttcctcgacccaggcgaccaacgtcgacgcgcggatcatgggcggcgagctgggcgcttcctaccagctcaccggcaactggaagaccgacgccagcctggcctatgcctggggcaagaacagctcggacgaccgcgcgctgccgcagatcccgccgctggaagcgcgcttcggcctgacctacgaggaaggcgactggagtgccggcagcctgtggcgggtggtcgcgccgcagaatcgcatcgccagggaccagggcaacgtggtcggcaaggacttcgacaagagcgccggcttcggcgtcttctcgctcaacggcgcctaccgggtgactcgcaacgtcaagctgagcgccggtgtcgataa

SEQ ID NO: 6427 - DNA, 534 bp, Pseudomonas aeruginosa
tgctcgcggtctgcctggcgatcctgctcagctcggcgagcggcctgtggatctggtggaagcgcaagccggccggacgccttggcgtgccgccgctgcgccacgagctgccgcgctggaagagcggcatcgccatcatgctggcgctgggcgtggccttcccgttggtgggggcctcgctcctgctggtctgggcgctggactggctggtgctgtcgcggctgccggcggttcgccgggtcctggcttgagacctgctgcccggcgctcagtcgaggtcgagctggcgggtcttccagagtgccgccagcaacagcacgcagagcagcgcctcggcgccgagccagaggaaggtggttagcgccggcgaggcgtcgatcagcacaccgtagagacgcgccgcgccgccgctggcgatcaccgccagggcggcgagcaggccgagcaccaggtagcgggggcgcagggcggcatagccgagcagcaggccgatgccgaagctggtgccgccgtagctggcgcgcaggtcggtga

SEQ ID NO: 6428 - DNA, 510 bp, Pseudomonas aeruginosa; identical to SEQ ID NO: 4421

SEQ ID NO: 6429 - DNA, 471 bp, Pseudomonas aeruginosa
cctcttgacgcttcacaactagtctgcctgcagggccatggcttgcggcgagaagacgagtggcgcacggtttgcccacggctcccgggaatccgggaacccggccggaaggttccggtcctagccccgatgacacacgaggaagtcgggatgaagttgtccgatagtttcgatgcgcgccggctgcgcccgcgccggccgagagtctggcgctggcgcctggcggcggcgttcgcggccctggtggcgagcctgggcgtgctgctgtcgctggccggcacctcggccttgatcggccgccagccggctgtcggcatgctgcatatcgaacccgccgctggcggcgtcttgctggcccttggcctgctgtcgctctgcctcggcgtgttgttctggcgtttcagccgccgccgcagccgccgcaacagcgacctgagcctgtcgccgaacctgatgaaaaagcgcgactga

SEQ ID NO: 6430 - DNA, 810 bp, Pseudomonas aeruginosa
ccgcgaaggtctgctggacacgcccaagcgtgccgccaaggccatgaagtacctgtgccgcggctaccaacagagcctggaagaagtcgtcaacggtgccctgttcagctccgacaacagcgaaatggtattggtcaaggacatcgagctgtactcgctctgcgagcaccacctgctgcccttcatcggcaaggcccacgtggcctatatcccgaacggcaaggtgctcggcctgtcgaaggtcgcgcggatcgtcgacatgtacgcccgccgcctgcagatccaggagaacatgagccggcagatcgccgaggcggtccagcaggtcaccggcgccctcggcgtcgcggtggtgatccaggcccagcacatgtgcatgatgatgcgcggcgtggaaaagcagaactcgtccatggtcacttcggtgatgctcggcgaattccgcgacaacgccgccacccgcagcgaattcctcagcctgatccgctgaggccaggtccgctggcgaaagaaccggccccactgggccggttttgcgtttccttccccggcgatcagccgaagaagcgcttcatcgagcgcgacaaccaaccgccctcgctcttgtccttgaccagttcggacatgctgtggcgtaccgcatccacatatccggcgtcgtcgttgcggatgtggttgaacagccagcgcgagagcaagcccttgagttcgtcgccgacatcctcgccggcctggaagcgcacccggtattcggagacccggcggatgaacagctcgtggatcttcttgtgcgcccgggaaaactggtag

SEQ ID NO: 6431 - DNA, 600 bp, Pseudomonas aeruginosa
cggtgccagcggcgcactcgccgagggcgacgtctacgtgcctacgctacatggggcgatcatctacctgaatgtcgcggacctggatgccgtcattgcccgggccctcggcgaaggcagcgaaatcctcttcccgaagacgccgcttggcgacggcgtgttcatcgccgagatcagggacagcgaaggcaatcgtatcgccctgcagagcgcttgcggagagcggccgtagaggtcctgcaaaccgagcgccgccggctcaacgggcaagaacgccggccagccaggaacgccgcgcgcccagcgcttcctgcaattcgcggacgccgatgcagcgccgttcggggtcgaggctcagggcggtacgcagcgccggccagcagcgccgaggcaggtgtccgggcgcgcgcagctggcgctccagcccctgctcccgggcctggttcgagggcaggcggcggaacggatggcgaccgtcggccagttcgtagaggacgcaggccagcgcatacaggtcggccgccggcgacaatggcgcgccctcgagcagttcgggagcggcgtagcccggagtccaggcgtcgatgcggccccggctga

SEQ ID NO: 6432 - DNA, 1068 bp, Pseudomonas aeruginosa
gcagcttcagcgctaccagcggcgccgggtcgccgaactgctcatggagcaggtcccgggcacggtagaccgtccccatgccgccggcgccgagcatccgctccagacggtagcgcccggaaagaacgtccggcagcggaccgggcaacaccgccggcaggtccggcgccgaggcggtcggggcggcgaaggcgaaataggtcaggttcgcgccgccctcctcctccggcagcagctccagcgacgacagcggttcgttcattggcggatcaccacggccgtcaggttgtcccgtgcggcgccgctcagggcaccgtcgaacagccgctccaccgccacctgcggcgatgccaggctcaacgcgcgacccagcgcatcggcgctcagctcttcgtagagcccgtcgctgcagagcaggaagacatcaccgggatgcacctccagttccaacacgtccagcaccagttgttcgctagcgccgacggcacgggtcagcgcgcgcgccgagggataggcgcgggcctgctcgatatccatccgccgttcgtcgaccagtcgctgcaacagcgagtggtcgcgggacagctggtacagccgctggccgcgccacaggtagcagcggctgtcgccgacccacacgcaggccgcccgcgaaccctccacgaccagcgccaccaccgtactgccgatgatcctgtcgccgcgttcggcgctgagggtgagttcctcgcccaggcgccggttgagccagtgcaggcactggcgcatcgcgttcaggcgctcgtcgaatcccgcccgggccggcagttccgccaggctggtgacgatcatccggctggccaggtcgccggcctggtgcccgcccatgccatcggcgaccgcccagagcccgcgatccgggcagtccaggaaggcatcctcgttgcgcgcgcggaccttgccgcgatccgtgcgtgccgcgctgcgccagggctcggtgcgttgcatcagagctgcaccggcatgcggaagctgcgcaggaccgcgagatcgaacggattcggcgtgcgctgggcgagcagcaggtag

SEQ ID NO: 6433 - DNA, 1704 bp, Pseudomonas aeruginosa
cagaaggagcgccagcgaaccgacgtacagggcgcgctggccccagtggatgcgcgtgcgttcgcggcgatcgagacctgccaggttggcctcggggaagatcacctggctcagcaggtgatggatgaagcgcgagcgcccgttgcgcagggtcggcaacaggccgctggcgatccccaggttggcgccgatgccggcggtgtcttcatccagctgctgggccaggtgcggcgcgctggtcaggtagaagccgcgcaggcggctggcgcgctggtagcggttgccggtgaaggcgagttcgacgaacaggcacaaccgctcgccgatctggccaagctggtgcgggaagtcgaggatgcgaccgcgacgcagggtatcgcgctcctggtggatgcgcatgatcacctggctgttcaggcgtcgcagaaggtcctcgaacgcctggcgcaggaccgtcacatctgtgccgttctgctccttgccgaagctggtgcccagaacctggtcgctctcctcgcggctcaactggtcgaagaactcgtcgaagccgagcaactggtcggccttgctcagcaccaggtagaccggcagatcgaggtgcagggtctgctggatttcctgcaggcgcgcgcgcacctggcgagccagcgtatccagcgccatctcgtcgtcgctgagcaacgtttccaccggaatcgacaccatcacgccattcagcggccgtgcgcggcggcgcttgcgcaacaggccgagcagagtcgcccaggcgcccccgtcgacctcgccgtcggcttgggtcaggtagcgcccggcggtgtcgatcaggacgccgtggtcggcgaagtaccagtcgcagtagcgcgtgccggcggtatcgcgggtcagcttgcggtcgatccggttgatcgggaactccagtccggaaaagtccagcaggctggtcttgccgcttccctgcgggccgatcagcaggtaccagggcagctcgttgcgccagcgctcgctacgaccgcggtacaggctggaggtcttcagggtgcgcaaggcgtccttgaagcggctgcgcaattccttctgttcgtcttcgatcagaccgtcacggcgcaggcgctcctggccctcgtcgctgtcctcgacggccttgcgccgcactccggcgcgccagctgacgaagaccatcgccagcccccagaccaggaacatcagactgatgctcagcaaccgcgaggtcgggctttcccagaacttgtagtcggcgaccgccagcagcggcccgacgaaccacaccagcaatgccgccaggagtaccagcagcagcgtccagacccacgtcttgcgcaggaaggcgccgactttcttgaagaagtttttcatttcgcgtccctgtgtttacgaaccgggctgtcctgccgccgcatcgagcgactggtaaggctgcagcaccgtgtcgcgttgctcgccgagaacccaggcgaatcccgaatacatcaccaccaggcagaccagggtgaacagcgccaccatccaccagggcacgatccgcaccaggccgcgacgctggtcgctgagcccctgccagtgcggcgacagttcgcgcggcacgtcgccgcgcaactggcggatctgccggtagagcgcatcggaaataccgtccaggtcgagcacgccgcgggccatcacccggtacttgccctcgaagcctag

SEQ ID NO: 6434 - DNA, 1878 bp, Pseudomonas aeruginosa
cgaacaggcatcagggagtctccatggaagggccgcggacgccgcgctccaggcgcgcgcccggctgggctggttggaaggaaatctcgatcatgggcttcaggtccggggatcgccgaaatgaatgttcaggcgtcccatgcgatagatcagggttcgtcgcggcagacccagttcgcgcgcggcgagggtctggttgccagcgttcctgcgcaggcaggcgagcagcaggtcccgttcgatctgctccagatgctcgcgcagcttgagcggcgcctccgcttccgggggcgcgcgcagggaaaagtgttcggccagcagcatctcgccttcgcagagcagtaccgcgcattccaccagtcccttcagctcccgaacgttgccgggaaagccatagccgtcgagcagttccagcgcttccgcggaccagcccagcggcgcgcggcgcaggaacacgcaggcgcgctcggcgaaatgccgggccagttcgagggcgtcgccctcgcgctggcgcaacggcggcaactcgatgggaaactgcgccagccggtagtagaggtcttcgcggaacttgccatcgcgtaccagcagggcgaggtcacggtgggtagcggcgatgatgcgtacatcgaccttgtgcgtgtcgttgccgccgagcgggcgaatctcgccttcctgcaacacgcgcaacagcttggcctggagcgagaggggcatgtcgccgatttcgtcgagcagcagggttccgccatccgcggcatcgaacaacccgggacgatcgcgctcggcaccggtaaaggcgcccttgcggtagccgaacagctcgctttccagcaggttttccggaaacgccgcgcagttctgcaccacgaacgcctgtgcacgccgcgggccgtactcgtggatcgcccgtgcgaccacctccttgccggtgccggtctcgccctgcagcaacacggtataggggttgtgcaggaccttgctgatcaggcggcaggtctcacgcatcgccgcgctcctgccgatcagcccgtatccgctgaccaccggtgcgctggacggtccctgcggctcgccggagggttgcgagaggcgttgcagcagatgcagctgggccagcacgaacgagcccagctggcccagtggatgggcgaatccctgcaggtccagtgggcgccgggtagcgcagaccaccatgccctcgaccgttttctccgggctcaccagcggaacgcagagcagggacagccagggctgctcccctgccggcaggaagccggtctcgtgcagccgcgacggcaggtcgacgagactgaccacgcggttctggcacagggcgaactgcagcaactgctcgccggtgtagtccgccggcaggctcgacggctccagcgcctgcaacaggccgtcccggcattcggcgttgagggtgagcgcggtatgggtctggtcgagcagatacaactggctcagctcgcagccgctgagttcgccgactgcgcgtgcgaaaccgcccagcagggccgtgatgtcggtttcccgcgacagcgcgccgaactgagcgagcagggcttcggcgaaggccaggggttgcggtacgcggctgaacatcgcacccacctcaggcgaactcgcagagcacgcggccgtgctcgcccagcgtcgcatggacccgctcgagacgctcgtcgcgcgccatcgcttccagcaaacggtcggccaccagcggcagcaggtgcgtgtccagcaggtggtcgatcaaccgtgcgccgctgtcgctctgggtgcaacgctcggccaggtggcccaccagcgcctggctgtagtcgaaagccagttgacggcgcgccaggcgctcgccgaggcgttgcagcttga

SEQ ID NO: 6435 - DNA, 393 bp, Pseudomonas aeruginosa
ccagccgcccctgggcctgggcatcggcgagtgcctggcgggtttcgtgaagggccttttccagggcttcgacaccgccatgctcgtcggccgggaaagtctccgcgttcgcctcgccgccctgctcttcccggttcgcctcgcgggccctggccaattgctggcgcagggcgagcaggcgctcggcgagttcgcgctggcggctccactggtcctcctgtacgtgccgctcgctttccgcctgggccaggcgctcctccagcgcctgcagggcatcgtggtcgatcggcaggcctgcctcggcatcgcggcgcagggcctggcgctggcgctcgccttcggccagctcgccgcgcaggcgctcgagactctccggcgccgccgccaggctga

SEQ ID NO: 6436 - DNA, 1923 bp, Pseudomonas aeruginosa
ccagcaggaccgcctggaacagcgagtactcgcgaatgccccgggccagcgcgcttacagcaggggctgcaaacccatgcgcggtttccattggtacacgtctccctgtgtgctcctcacccgcaactcgtggtaggagttgatgctggcgtaaagcgcgaaaaattcgttcagaaccgaagcgaacacgaacaggtcgccctcgccgatgtagccttccggatcgatcgtcagctcggtacgcaagccgcgcagcggcaggccccgatgcaggcggtcgacatgctcgtggcggaccgccttgagcccgcccagcaggcgcttgctgaccttcgccgcatgctggtcgtagtagcgcggcaggtcgtaggtttcgaggatcaccttgagtgcgtcgacgttggccagcgacaggtagttgagcgacatgttgctgatcagtttccagaggaaatcgcggttcagcggcggcgcgtagctcggcgtcgccggggtgatattgcggaaaccgaggaactccggcgtaccttcgcaagcgacgcagatatcgcccaggcgcagccgttggggcaggttctggttggtgcaggtcagttccaccgacagcgtctcgatctgctcgggatggcggatgccgaagctcaggtaggtgtccaggccatcgtgcagcaacgaggtccgttgccggacgctgtagtggggccgtgcttccgggacgtcgaagctgggatcgtgctcgaaggactcgaacggcacataggcctggtagccgagcccgcccggccgccagccggtgacgccctctaccgagaacaccccgcagtcctccaggctgtattcggccggcatcagcaggtactcgtcctgcttgccgtcgaggcggatcggcagcgcatcgtggcggaacaggttggccaccggcgtacagtacagcttgacgttctccagcgtcgggtgcaggcgctggatgccgctcttgcggatatcgaagcgcaactcgaggccgcggacctgcttgagggtttcctcgggcagagcgccgagcaggtcaaggccatccacgtcgacgaacaggaacttgtcctggaacgcgaagtattcctgcaggtagcgatagccacggaaggtattcagcggatagggaatcaacgcctcgtcttcggcgaaccccaccggctgcacccgctcgcccgtcaggcggaacgacatcggcttgccggccacgccatccagcggccgcccatgggcatccagcggaatcagctggatgctctccaggttgcgcagcaggcacaggtagagcatctggctgatgtagcgctcgccggccaggtgcaggcgcagccgactcaggcccagctcgccgagatgcccgtcgcagttcatcgccaggcgcaggccgagcagcgcaccctcgccggtcaccgaatagttgagcgcctccagcaccagcggcaggacttcggtggcgtagcaggtacggaagcgacaggcgacctcgcccaccggccggctctcgaccggcgtatcgcgctccacgcgcagcgccccgcccgggcgggtcagggggtcgaactggagaatgctgaaagccggcagcgggcgcatatagttcggccacagcaggtgcatcatcgagtggctgagttccggcaactcgtcgtccagcttctgccgcaaccgcccggtcaggaaggcaaagccctcgagcaggcgctcgacatccggatcgcgtccgacctgcccgagaaacggggccagggccgggctacgctcggcgaaacggcgccccagctggcgcagtgcggtgagttcgctctggtagtaatgattgaaggacacggcttacctgctggatatcgtttcactgatggcagtcgtctgaccgctgccgccaaaaccgcaatgacatttctggcctga

SEQ ID NO: 6437 - DNA, 2307 bp, Pseudomonas aeruginosa
agatcggaaacccacggtgtccgttgtctttccgtaatcgacccgattcgcgcccatctcagaagacctcatggacgaaccaggcatcgagcggtacagcgccaggccgaggcgtcaccctggcgggccgccgcgaggccgtcgaagaacacgtcggcggaaccgacgccgatgggattgctgccgtgcccggggagcggacaagcggtgggatcggaaacgcgggctgcgggtttgccggacatcgaaacctccttagctgaccttcacctggccgctgccatccaggcatgcggaaaaactcacctggcgcttgaaacctcccacctccagcaagccttcgatgctgaaggccaggcggagctggtcgttgtcgcgtggcagggaaacgacacgcacgtcgctcaagcgcggttcgtaagcctcgatgaaaccttcgatggccgagcgggcctggctcagggagtcgtgcaggctcaggcgcatgtcgttgagatcgggcaacccgtagtcggacagcgtctgcacgctgcccgcccgggtgctgagcatcttgcccagatgggcagccaccgacgccatggcggaaacctcgcggctccagccgacgcgcttatccgcgtcgccgttcaggcgctcgaacaggctgccgtatccggtcatggaaagctccgcttactctttgtccagcttgccgaccagcgacagggtgaagtccgcccccatgtacttgaagtgcgggcgcacgttcaggctgacgcggtaccagcccggctcgccctcgacgtcactgacgatgatctgtgcagcgcgcagcgggcgacggccgcgcacttcggcgctggggttttcctggtcggcgacgtactggcggatccacttgttcagctccagctcgaggtcggtacgctccttccacgaccccagctgttcgcgttgcaggaccttcaggtaatgggccaggcggttgacgatcatcatgtacggcaactgggtgccgagcttgtagttcagctccgcggccttgccttcggcgctgatgccgaagaacttcggcttctgcaccgagctggcggagaagaacgcggcgttgtcgctgcccttgcgcatggtcagggaaatgaagccttcctcggccagttcgtactcgcggcgatcggacaccagcacctcggtggggatcttggtctcgatctcgcccatgctctcgaagtggtgcaacggcaggtcctctaccgcaccgccgctctgcggcccgatgatgttcgggcaccagcgatacttggcgaagctgtcggtcagcttggtgccgaaggcataggcggtgttgccccacaggtaatgctcgtggctgttggccacggtctccttgtaggcgaacgacttgaccggattctcttccggatcgtagggcgtgcgcagcaggaagcgcggtacggtcagcgccacgtagcgggaatcctcggactggcggaagctctgccacttggcgaactgcgggccttcgaaatgatccttcaggtccttcaggtccggcaggccggtgaagctttccaggccgaagaacttcggaccggcggccgccacgaatggcgcatgggccatgcaggccacgctggagacgtattgcatcagcttgacgtcgggcgaactgggcgacatgtagtagttggcgatgatggcgccgaccggctggccaccgaactggccgtattcggcggtgtagatgtgcttgtacaggccggactgcatcacctcgggcgagtcctcgaaatcgtccagcaggtcctgcttggaaacgctgagaatctcgatcttgatgttctcgcggaagttggtgcggtcgaccagcagttgcaggccgcgccaggccgactccagcgcctggaaatcgggatgatggagaatctcgtccatctgcgtgctgagcttggcgtcgatctcggcgatcatccggtcgaccatcgccttcttcaccggctcgccgtcgttctgcggcttgagcaattcctcgatgaaggcggagacgccgcgcttggcgatgtcgtaggcctcgtcgtccgggctcaggcgggtctcggcgatgatgctgtcgagaatgttgtattcgccgttctggttccggccttgctgtgcggcactggtgctcatgtatctgcttccttggctagggggtggctcaggcgtcctgggagggggcggcgctcagccccagctcgcccagcacacggctacgggactcgtcgtcggcgagtacgctttcgatggccttgcggaacgccggggcgttgcccagcgggcccttga

SEQ ID NO: 6438 - DNA, 447 bp, Pseudomonas aeruginosa
cccgctaccgcatcaccctcgtcccgcaactggcctacctcgcccagcgcaccaaccagcgcatcttccagcacctcacggtgccgcagatcgtcggccgggtgctggaggaacacggcatcctcgccgacgcctaccgcttccagctcggcacccgctaccccgagcgcgaatactgcgtgcagtacgacgagagcgacctgcagttcgtccagcgcctgtgctgcgaggagggcatccattttcatttccagcacagcgccacggcgcacctgctggtgttcggcgacgaccagacggtgttcccgcggctcgcgccggtggcctaccagcaggactccggcctggtcgccgaccggccggcggtcaagcgcttcggcgtacgcctggaaacccgcaccagccgcgtcacccgccgcgactacgacttcgagaaaccgcgcctga

SEQ ID NO: 6439 - DNA, 363 bp, Pseudomonas aeruginosa
ccttcctcgaaggcgatcccgaccagccgctggtcaccggctgcctgtttcacagggaacatccggtgccctacgaactgccggggcacaagacccgcagcgtcttcaagagcctcagcagccctggcggcggtggctacaacgagctgcgcatcgaggaccgcaagggccaggagcagatcttcgtccatgcccagcgcgactgggacgaaaacatcgagcacgaccagaagatccgcgtcggtcaccaacgccacgacaccgtgcaggcgaacagctacagcgagttcaaggccgaggaacaccgcaccacccacgccgagcgcaaggtggaggtccgagccagcgaccacctcaccgtag

SEQ ID NO: 6440 - DNA, 1215 bp, Pseudomonas aeruginosa
gttcaacgtatgactgtacacatggatgccacgtactcagccagtgcttatcgcagtgaagtcaacgactctttaccgccgccaaggtggaaggaggagtctaaccgtaatggtatttttgacacccatcttgcctttgggaactatgccaatctagatccggaaatggagattgtagggcagctttcgatcggggctgaggataagtcagaggttggaggtgctgaggcatattgcaactctatgcgttggcagttccagaactctagcagaattccttatataatattcacgcttaggatgctgtgctatttttttgtatggattgctttgggaattggcataatgggagaagccaccggagagtggaggagggacatacagcaactctacaccttggtttgctcattctttgtggtggctgtttcagtaatatccatggtggcctttctttcgaataaaaaatatcttcacgttattcagatgtcgggttttttattttcaatcccattggctttgtaccagtatggaacaatatttggaaccaatggtttgcaaatagcaatttggataggcgtagctacttattttatgggtgcagtcggcttcagcgccatcctttggctctacagcaaagtcttcaagcaagatggcagtgaattcaatcgcctggacggcatgctccgcttcaagcgtcgcttccgccgcctgttcgtcgctcccttcgacgagttcgatccggtgctgcaattgctgcccagtggctacggcagccacgactatgcgctctggttgcatcaccgctataccgacaacaaggtctgtctggccacccgcgtccactccctcggtctcgacaaggtcaatgccctggccttctgggactgcctgcaacgctacatggacgtgacccagccgttgcccgacctgccggtcctggagccgagccgccccttagatccggtcaccgccgagcatgatcggcataccggacgcgatccccattactggcgccagcgcacctaccagggctggccagccaaggagcgcaaggagctggaccgacgcctgcatgagtatccctggcaacagcagccctgcatcgtcagggcgcgcatcgatcccgggctaagcatcgaagcctattaccggcgccaggaagccaagggcatttttgccacgcccagggccgatgatttcaatgatgagcactga

SEQ ID NO: 6441 - DNA, 873 bp, Pseudomonas aeruginosa
cgggcaaagtgcgacgatgatagcaggccgggaggaaaaaccggcggctcgtcgacgaagccggaacgagcgctgtttcgcggttttttgcggcagatggcatttcggtgctttatttcgcccgtacgcccgcggctgtcttgcgggcgccacgggccttgcggaaactctgtcgatgcctatccgattcaagcccggccgctcgacccggccggccgtccaagacgacttcttcattcccgagctctgcgaagccgaagccctgttcaccctggtgctgctggcggagctgctggtgctcgtgctggtgctggcggagccgatgacgccgagcttcaactgggtgcgcctggccctggcgtcgctgttcgtgcagtggatcgtactgctctcggcggcgctgttctgccgcctgcggccattgctcgcacgcctgccggtggcgctggcggggagtgcctgctgcctgttggtggtggccctcaccctgggctgcacggcggtcgccgagcactatcagctgggcggagaactgacgcgtgccggcgaggtcaatctgtatctgcggcacgcgctgatcgcgctgatcatgtccgccctggtgctgcgctacttttacctgcagagccagtggcgccggcagcagcaggccgagttgcaggcgcgcctggaatcgctgcaggcgcggattcgcccgcacttcctgttcaacagcctgaacagcatcgccagcctgatcgagctggacccgctgaaggccgagcatgcggtgctggacctgtccgacctgttccgggccagcctggcgaagcccggcactttagtttcctgggaggaggaactggcgctggcaaggcgctatctttccattga

SEQ ID NO: 6442 - DNA, 321 bp, Pseudomonas aeruginosa
acaagcggctcaacggcggttgccaggtgccgatcgcctgctacgccatccgcgagggcgaccaactgtggctgcgcggcctggtcggccagcctgatggcacccagttgctgcgcgccgaggggcgggcgccactggcggacgccgaggcgctgggcgtgcgggtggccgaggacctgctggagcagggcgccgaagcgattctcgaagccgtctacggcgaggccggacatccgtgagcggctggcggctcctgctgacgcgccccgacgaggagtgcgcggccctggccgccagcctcggcgaggcgggcgtccatag

SEQ ID NO: 6443 - DNA, 1146 bp, Pseudomonas aeruginosa
ccaaaggatggacctgtgagcgaagcagtcactccccaagacgacgcaagaacttccacttccaccccttctcccgttgcacccgatgcatccaggcgttccggtaccgccaccggcctggcgttgctcgccctgctggttggcgtggcgggactcggcgcgggtggctggagcttctggcaggtccagcagttgcagggcaccgagcgcgaccagctggcgcagctggaagatgcccgtggcaagaccgaatccctggcccagcgcaaccagcaactggctgcccgcctggacgctttgcctaccgcggacgaactggaggcccggcgacgccttgtggtggagctgcagggcgaccagcagcatctcagcgagcaactgaagaagctcctcggccagagccgccagcaatggcgactggccgaggccgaacacctgctgcgcctggccagcctgcgcctgtccgccttgcaggacgtgggtagcgccaccgagctggtgcagggcgccgatgacatcctgcgcgcgcagaacgatcccggcgcctatgccgcccgtgccaagctggcggccagcctcgaggccctgcgtgcgttgccggagccggaccgtaccgggctgttcgtgcaactggcggcgttgcgcgagcaggtcaaccagttgcaaccgctcacgccgaccttcaaggaaggcgaaagcggtgccagcaatgtcgcctggggcgacggcaacagcacctgggagctgtggtgggagaagatctcgcgctacatccgcatcgacttcaatgccggccaggacattcgtccgctgctggccggcgagcaattggcgcaggtgcgcctgaccatcggcctggccctggagcaagcccagtgggcggcgctgaatggcaagcaggaagtctacgagcaggcgctgaagcaggcccaggacgtgttggacggctatttcaacgtagagctggccgacagccgtgcgttgaagttgcgtatcgatgagttggcgaagcagccggtcaccgtgcaggtccctgacatcgcaccggccctgagcgccttgcagtcgtacgtgtcgcgccgcgaggccgccggcaacctggtgcccgaggcgcaggcggctccggccacggagggccgtccatga

SEQ ID NO: 6444 - DNA, 654 bp, Pseudomonas aeruginosa
aacggccggaggctttccactaccgtaggcggcctttcccctgtgtacctgtggatccgccatgcccctggccagcccccgtcagcttttccttctcgcgttcctggcctgcgtcgccatcatgggcggggcgctgtacctggaacatgtggttggcctggaggcctgcccgctgtgcgtcgtgcagcggatcttcttcatcctgatcggcctgacctgccttgctggcgcgatccaggggcccggcctgcgtgggcggcgtatctactccgtgctggtgttcctgctcgctctcggcggcggggccacggccgcccgccaggtatggttgcagaccgttccgctggaccaactgccggcctgcctgcccagcctcgactacatgatgcaggcgcttcccttccaggaagtgatccgcctggtcctgcatggcaccgcggattgtgcccaggtgagctggacgctattcaccctgagcattccggaatggagcctgctggcgttcgttgcctatctcggcttctccatcgtgcagttcctccgacgtgcctgatgcgggctgtcgcgtggtctttcgtcagctctcgagcgtcggccgtatcgatttggcgaaaaccagagcggatgcgggataccgatcaaacatccgtatga

SEQ ID NO: 6445 - DNA, 915 bp, Pseudomonas aeruginosa
cgtacaggaaagcctcaagctggcgcagggtgtcggcaaggtgaaggaagctgctggcaaggctctggagagccgcaaggcgaaacccgcgaccaaacctgctgcgaaggcggcagccaagcctgcggtgaaaaccgtagcggcgaagcctgcggccaagccggctgcgaagcctgctgcgaaaccggcggccaagcctgcggcgaaaaccgcggcagcgaagcccgcagccaagccgacggcgaagcctgctgcgaaaccggcggccaagcccgcggcgaaaaccgcagccgcgaagcccgcagccaagccggcggcgaagcctgtggcgaaaccggcggccaagcctgcggcgaaaaccgcagccgcgaagcccgccgccaagccggcagcgaagcctgtcgcgaaaccgacggccaagcccgcggcgaaaaccgcagccgcgaagcccgcagccaagccagctgcgaagcctgcggcgaaaccggcggccaagcctgtggcgaaatccgcggccgcgaagcctgcagccaagccggctgcgaagcctgcggcgaaaccggcggccaagcctgcggcgaaacccgtagccgcgaaacctgccgcaaccaagcccgccaccgctcctgctgcgaagcctgcggcgactcccagcgccccggcagccgcctccagcgctgcttcggcaacgcctgccgcgggcagcaacggcgccgccccgaccagcgcctcctaaggcgctgtctgcaaagccgccgagccaagcaccagcaaagcccggcgctctgcttccgtgcagatgtcccggctgcaggcttgcagccaggcatccgcactgcgattcgcttcctggccctccagccaggctgtggccaggtcggccaggcgttgcaggtgttcccgttccgctcgtag

SEQ ID NO: 6446 - DNA, 2259 bp, Pseudomonas aeruginosa
ttcctgggccttcatttcctcgcggagttcggccaggcaggcgtcgtgggttgccgcttcgcgccaggcgcaacgcaatctgcgcaggggttcgatgaccgtttcgcgccagggacgcgcggcgttctccaggatctgggcgcgttctttcgagcagctcacaccgcgcctgccaagccaggcggcgaccagcaacaggcagacgtccgcaccttgctcctgaagcgcgaggcaagccgtttccacgcccggccgggcatagacgtccaccgcgaatttccagacatttccagtcatacagcctcacgctccgcaagggcgaaactgataaactccgccgccatgatccgactcctcaatcttacgctacagcgcgggccgcagcgcctcctggaagctgctgaactgaccctgcacgccggccagaaagccggtctcatcggggccaatggcgctggcaagtccagcttgttcgcgctgttgcgcggccagctcgggcaggatgccggcgactgcctgttgcccgccgactggcgcatcgcgcacatgcgccaggaggtcgataccctggatcgcctggcggtggattacgtgctcgacggcgacagtcgcctgcgcgagatccaggcggcgctggccgtcgccgaagcggcgcacgacggttctgccctggcgcgcctgcataccgagctggacaacgccgacggttataccgccgatgcacgggcgcgcaagctgctggccgggctcggcttcagcagcgagcagatggagcgccgggtcggtgatttctccggtggttggaggatgcgcctgaacctggcgcaggcgctgatgtgcccgtccgacctgctgttgctcgacgaaccgaccaaccacctcgacctggacgccatcctctggctggaagagtggctcaagggttatcccggcactctggtgctgatctcccacgaccgcgacttcctcgatgcggtggtggaccacgtggtgcatctggaaaaccgcaagctgaccctctaccgcggcggctattccgctttcgagcggacccgcgccgagcggctggctcagcaacagcaggcctacgagaaacagcaggcgcagcgtgcgcacatggaaagcttcatcgcccgcttcaaggccaaggccaccaaggcgcgccaggcgcagagccggatcaaggcgctggagcgtctagaggaactggcgccggcacatgtcgattcgccgttcaatttcagtttccgcgagtcggacaagatctcccggccgttgctggatctcggcgaaggccgtctcggctatggcgacaaggcggtgctggagaaggtcaagctgcaactggtgcccggtgcgcggatcggcctgctcggtcccaacggcgccggcaagtcgacgctgatcaagaccctggccggggacctgcccgagctgggcggccgcctgctgcgcggcgagaacctggccatcgggtacttcgcccagcaccagctcgattcgctggatccacaggccagcccgttgctacatctgcagcgtatcgcccccggcgagcgcgaacagaccctcaaggacttcctcggcggcttcgacttccgcggcgttcgggtggacgagccggtattgaacttctccggtggcgagaaagcgcgcctggccctggcgctgatcgcctggcagaagcccaacctgctgctgctcgacgagccgaccaaccacctcgacctggaaatgcgcctggccttgaccatggctctacaggagttttccggggcggtcctggtggtttcccacgaccggcacctgctcaaaagcaccaccgatgaattcctcctggtcgccgatgggcgcgtggtgccgttcgatggcgatctcgacgattacgcccgttggctggtcgactatcgcgcgcgcaaggcgccgcaggccgagaccgcgccgggtgcgccgaccgaacgcaccgacaagcgcgcccagcgccaggcagcggccgcgctgcgccagcagctggcgccgcacaagcgcgaggccgacaagctggagcgcgaactcggcggcctgcacgaaaagctagccgctatcgaggcgcggctgggcgacagcgccctgtacgacgtatcgcgaaaggacgaattgcgcgagttgctgtccgaacaatcgagcctgaaggttcgcgaaggcgagctggaggaacgttggctggaggccctggaaaccctcgaagccctgcagaaagaactagaggccagtgagtga

SEQ ID NO: 6447 - DNA, 834 bp, Pseudomonas aeruginosa
ccgcatcgcggtggtctgcccaacatggctgagcacgtatcctcgggaaagcccggcatctgccgggttttttctgtccgccaggttgcgcccgcaaaggttgggcgaggcgcgtggtcggaaaacctgtgcggctgctccgccttggtgcacactggctttttcgttcccgccgccagccgcgttcgctttccgaggtgtgcaatgctcgtcagtacctggttcgccttcttcctcgcctgctgggccatcagcctgtcgccgggcgccggagccatcgcctcgatgtcctgcgggttgcagtacggctttgcgcgaggctactggaacgcgctgggcctgcagatcggcctggccctgcagatcgccattgtcgccgccggcgtcggtgcgttgctggcgacctcggcactggctttcagcctgatcaagtggttcggcgtggcctacctggtgtacctggcggtgcgccagtggcaggcgccgccacaggccttgagcaccgatggcgaacggcctctggggcgaccgttgaccctggtgctgcgtggtttcctggtcaacgccagcaatcccaaggcggtgatcttcatgctcgcggtgctgccgcagttcatcgacccgcaccagccgctgctggcgcaatacctgatcatgggcggcaccatgatcgtcgtcgacctgatcgtcatggccggctacaccgggctggctgcgcgcgtgctacgcgtactgcgttcgccgcgccagcagaagctggtgaaccgtaccttcgccagcctgttcgtcggtgccgcggggctgctggcgacggtacgccgagcgccgctctga

SEQ ID NO: 6448 - DNA, 792 bp, Pseudomonas aeruginosa
cggcacggatttgaaaagggcggcggcgcgaccgccctcgtgcttggccgatcaggccttgtcctggtccaccagttcgagcacccggtcgaccagcttgttgatcccggaagcggcttcggctatcgactgggcgagcatgtaggccggggtggtcaccagcttgcgcgcgctgtcttcgacgatctcgtccaccggcgcgtcgatgtgctcggcacccatctgcttcagcgcgtcggcggtgtcggcgtcgttgccgatggtgcattggacgccggcgccgtagatcttcgccgccatcgccggagcgatgcagatcagcccgactggcttgccggcttcggcgaaagccttggccagcgccagcacgtccggctgcacctggcattgcgcgccgttgatggcaaagtcgctgaggttcttcgcagcgccgaagccaccgggcacgatcagcgcgtcgtagtcctcggcgcgggcttcgcgcaggtccttgacttcgccgcgggcgatacgcgcggactcgaccaggacattgcggctttccggcatttcctcgccggtcaggtggttgaccacatggtgctgggcgatgttcggcgcgaagcattgtgcctcggcgccacgctggctgaggcggagcagggtgatcacgctttcgtggatttccgcgccatcgtagacgccacaaccggagaggatgacggcaactttcttgtgcatgaggcttactccttgggaacgcaggatccggaccggacgggcctggccggggtcggtatcgcgcaagcatag

SEQ ID NO: 6449 - DNA, 474 bp, Pseudomonas aeruginosa
atcaggcgggcttcctcgcggccggagatgacttccacgggatggccgagaacctcttccgcacgacggatgaaatcgctgcggttgcgcgcctcgcgcaaggcgttggtcgcgaccacgcgtacggaaccctggggcatgccgctgatgaactgggcgaagcggcgcaggcagtcgaggccgcgctgggtggcctcttcgctgagattgcgctcctcgtcgaggccggcggccagttggaccttctcgcccagccgttcgaggatgcggacttcgccgtggatattggccttggccagacagaggtggaaactgttggagcccaggtccagggcggcaatcagcgggaatgcctcggcaggtttttgcggcatgctttgcaagtccattggaaaactgcgccatcctgccacgatagggcgagggtcgccaatgcggcagccgatcaatcgggaatcagccgaccaacgatag

SEQ ID NO: 6450 - DNA, 1344 bp, Pseudomonas aeruginosa
cgctcctgtcgcccccttgcgacacggctttcccaagctcgacgctttctccaattcctctttctgcgtacctatctctttcctatgaatctgaccgaactcaagcaaaagccgattgccgaactgctggaaatgtccgatgccatgggcctggaaaacatggcccgttcgcgcaagcaggacatcatcttcgccctgctgaagaagcacgcgaaaagtggtgaagagatctccggcgatggcgtgctggagattcttcaggacggcttcggcttcctgcgctccgccgactcttcctacctggccggccccgacgacatctatgtctcgccgagccagatccggcgcttcaacctgcgcacgggcgacaccatcatcggcaagatccggccgccgaaagagggcgagcgttacttcgccctgctcaaggtcgactcgatcaacttcgatcgtccggagaatgcgaagaacaagattctcttcgagaacctgacgccgctgttccccaacgagcggatgaagatggaagccggcaacggctccaccgaagacctgaccggccgcgtcatcgatctctgcgcgccgatcggcaagggccagcgcggcctgatcgtggcgccgccgaaggcgggcaagaccatcatgctgcagaacatcgccagcaacatcacccgcaacaaccccgaatgccacctgatcgtactgctgatcgacgagcgccctgaggaagtgaccgaaatgcagcgcaccgtgcgcggcgaagtggtcgcctcgacctttgacgaaccgccgacccgtcacgtacaggtcgccgagatggtgatcgagaaggccaagcgcctggtcgagcacaagaaggacgtggtcatcctgctcgactccatcacccgtctggcgcgggcctacaacaccgtgatccccagctccggcaaggtgctcaccggcggtgtcgacgcccatgccctggagaagccgaagcgcttcttcggcgccgcgcggaacatcgaagagggcggttctcttacgattctcgccacggcgttggtggaaaccggctcgaagatggacgaggtgatctacgaggaattcaagggtaccggcaacatggaactcccattggatcgcaagatcgccgagaagcgcgtgttcccggccatcaacatcaaccgttcgggtacccgccgcgaagagctgctgaccagcgaggacgagctccagcgcatgtggatcctgcgcaagatcctgcacccgatggacgagatctccgcgatcgaattcctcatcgacaagctcaagcagaccaagaccaacgatgagttcttcgattcgatgaaacggaagtag

SEQ ID NO: 6451 - DNA, 1206 bp, Pseudomonas aeruginosa
gctaatgacgttcaaggatctccgcgatttcatcgcccagttggagcagcgcggtgcgttgaagcgcatccaggtgccgatttcccccgtgctcgagatgaccgaggtgtgcgaccgcacgttgcgcgccaagggcccggcattgctgttcgaaaagccgaccggcttcgacatgccggtgctcggcaacctgttcggtacgccggagcgcgtggcgctgggcatgggcgccgaggacgtcggcgcgctgcgcgagatcggcaagctgctggcgcaactcaaggagcccgagccgccgaagggcctcaaggacgcctgggccaagctgccgatgtacaggaaggtcctgtccatggcgccgaaggtgctcaaggacgccccctgccaggaagtggtcgaggagggcgaggacgtcgacctcggccggctgccggtccagacctgctggccgggcgatgtcgggccgctgatcacctggggcctgaccgttacccgcgggccgaacaaggaacggcagaacctgggcatctaccgccagcaggtgatcggccgcaacaaggtgatcatgcgctggctcagccatcgcggcggcgcactggactaccgcgagtggtgccagaagcatccgggccagccctatccggtagccgtggcgctgggcgccgatccggcgaccatcctcggtgcggtgacgccggtgccggacaccctttccgaatacgctttcgccggcctgttgcgcgggcatcgtaccgagctggtcaagtgtcgcgggagcgacttgcaggtgccggccagcgccgagatcgtcctcgaaggggtgatccaccccggcgagatggccgacgaaggtccctatggcgatcacaccggctactacaacgaggtcgatcgcttcccggtgttcaccgtcgagcgcgtcacccgccggcagaaaccgatctaccacagcacctacaccgggcgtccgccggacgagccggcgatcctcggggtggcgctgaacgaagtgttcgtgccgatcctgcagaagcagttcccggaaatcgtcgatttctacctgccgccggaaggttgttcctaccggatggcggtggtgaccatgaagaagcagtacccagggcacgccaagcgcgtgatgctcggggtctggtcgttcctgcggcagttcatgtacaccaagttcgtcatcgtcaccgacgatga

SEQ ID NO: 6452 - DNA, 1083 bp, Pseudomonas aeruginosa
tgccacccacaagtggccgggcgagaccagccgcgaatgggggcgcgccatcgtcaaggacgaagcggtgacacggcgcatcgacgcgctctggtcgagcctcgggatcgactgatgcgtatcgtcctgcaaccgtccggcgcctgcctcgagctgctgccgggggaacgcatcctcgatggcgcccggcggctcggctacgactgtccgcagagctgccgcaacggcaactgccatatctgcgcggcgctgctggtggaggggcgggtacgccagaacggagaggtacgcgatcatggcgaactcttcacctgcctcgccgagccgctggaagactgcgtgctgcattgggacggggtgctggcgccgggtgaactgcctctgcgcaagctgacctgccagttgagcttctgcgaagaggtcggcggcgacgtctaccgggtcggcctgcgcgcgccggccggcaagccgccacgctatcacgccgggcagtacctgttgctggagcgtgacggcggcgacagcgcggcgttttccctggcctccgcgccgcatgcgggacgcgaccttgagttgcacatcctggccaaggaagacagtgccgtcgcgctgatcgcgcaattgcagcgcgagcgcctggcacggatccagctgccgttcggcgacgcgcatctggcggaactgcccgacggtccgctggtgctgatcgctgcgggaaccggcatgtcgcagatgcacagcctgatcgagcactgccgcgccgccggcttcgcccatcctgtacatctctactggggcgttcggcgtccggaggatttctaccgactgccgcactggacggagtgggaaggcctgccgaacctgttcctgcaccgggtggtcagcgacctctgtggctgggaggggcgctgcggcttgctgcacgaggcggtgcgcgaggatttcgccgacctgtcgagcctgcatgtgtatgccagcggctcgccggcgatggtctacgcgaccctggatgccctggtcgaagcagggatggacgcgcaccagatgcgcgccgacgtgttcgcctacgcgccgcgggactga

SEQ ID NO: 6453 - DNA, 1452 bp, Pseudomonas aeruginosa
acgcggctccggcctggcgccggagccgccgcgtcatcagccggcttgctgcggcgcggcctggaccgcgggtttgcgcagggtcaggcagaggaacaggatggccagcaggcaggcgccgatcagcagcttgaagccaccgtcccagccgaagtgatccaccgtgtagccgaccagggcgttggccgccaccgagccgccgaggtagccgaacagaccggtgaagccggcggcggtgccggccgctttcttcggcgccagctccagggcctgcaagccgatcagcatcaccgggccgtagatcaggaagccgatcatgatcagcgcggccatgtcgatcgccgggttgccggccgggttcagccagtagatcagggtgccgacggtcaccaggatcatgaacaccacgccggtggcgccgcgattgcccttgaacagcttgtccgacagccagccgcagagcagggtgccgggaatccccgcccattcgtagaagaagtacgcccaggacgacttgtcgacgttgaagtgcttggcctccttgaggtaggtcggcgcccagtcgagcacaccgtagcgcagcaggtagacgaacacgttggccagggcgatgtaccagagcagcttgttgcgcagcacgtaggtgacgaagatctccttggtcgacagctcgcgctcgtggtgttcgtcgtagccttcggggtagtcgtccttgtgcttctcgatcggcggcaggccgcaggattgcggggtgtcgcgcatggcgaaataggcgaatacggctacgcccacggcgacgatggccggcacgtagaaggccgagcgccagtcgccgaacagcgccaggccgagcaggaacagcgggccgatcaggccgccgccgacgttgtgggcgacgttccacaccgagaccacgctgccgcgctccttctgcgaccaccagtggaccatggtccgtccgctcggcggccagcccatgccctgggcccagccgttgatgaagagcaggacgaacatgatggcgacgctggaggtagcccagtgcgcgaatccgaaaatgaacatcaccgccgccgacaccaacaggccgaacggcaggaagacccgtgggttggaacgatccgagaccaggcccatgatgaatttcgacaggccgtaggcgatggcgatggccgacatcgcgacgcccagttgaccgcggctgtagccgtcctcgatgaggtagggcatggccagggagaagttcttgcgcagcaggtagtaacccgcgtagccgatgaagataccggcgaagatctgccagcgcaggcgccggtaggtgctgtccacctcggcatcgggcagtggcgcctggtgtggcgcgggacgaaagattccgaacatcgcgagctccgcttgttgttgtgtcgcgcctttttacgcggttgcgaacactacatttttcgtaaatga

SEQ ID NO: 6454 - DNA, 1206 bp, Pseudomonas aeruginosa
gtgcattggtcggaaataagaaagccccggtcggaaaccggggccttcataggggaaaaacatctgacagcgtgggcctcggccggtgtatcgctccggcccgccatgcctttctccgcacgggcgggaggcaatactcgccgccttcgtggctcagcgaacctccaccaccaccttgccgaccgccctgcgctggccgagggcgtcgatagcgtcgccggcccgttccagcgggaagcgctgcgacaccagtggcttcagtttgccttcggcgtgccaggcgaacagctggcggaagttgtcagcgttgtcctgcggctggcgttgggcgaacgatccccagaacacgccgaccagcgaggcgcccttgagcagggtcaggttggccggcagcgaagggatgctgccgctggcgaagccgaccaccagcatccgtccgttccaggcgatgctgcggaaggcctcctcgaacagttcgccgcccaccggatcgtagatcacatcgacgccctggccgccggtcaaggccttgagctgctcgcgcaggctaccttcgctgtagttgatcagttcgtcggcgccggcggccttggccacggcgagcttgtcgggggtactggcggcagcgatcacccgcgcgcccatggccttgccgatctccacggcagccagcccgaccccgccggaagcgccgagcaccagcagggtctcgccgggttgcagattggcgcgctgtttcagggcgtgcatcgaggtgccgtaggtcatgccgaaggcggcggcgctggcgaagtccatgccttcgggaatcggcatcacgttatagccgggcaccttgacctgctcggcgaagctgccccagccggtcagggccatgacccggtcgccgggcctgacgtgggcgaccttttcgccgaccgcggcgaccaccccggccgcctcgccgcccggggagaaggggaagggcggcttgaactggtacttgccctcgatgatcagggtgtctgggaagttgaccccggcggcgtgcacatcgaggaggatttcgttcttcgccgggctcgggctggcgatttcttccaggaccaggctgctggccgggccgaaggctttgcagaggacggctttcatcggggacgctccagtttgcggtccggccagtgtaggagggagacgccgggggtcaatcagcatcgccgcaactga

SEQ ID NO: 6455 - DNA, 564 bp, Pseudomonas aeruginosa
tggttgtccataaaccccgggcttgggcccggccgagagtctggctatgcttgccggcattcgtcgaggagatgcgcccgtgagaacccccattgccctgtcgctggccctgtgcctgagtctgttcccgtcgttcgcctcggccgaggaggccgcgccggaaggcgagggcgcgaacaagccggtctacgtcgacctgaccccggcgctggtcggcaactacggcagcgggccgcgcctgcagtactacaaggccgacatcgccctgcaggtggccgacaaggacgcggcgaccaaggtcgagcatcacgagcccttgatccgcaaccagttgatcatgctgttcgcccagcagaccgaccagagcctgggtacggtcgaggccaaggaaagcctgcgccaggaggcgctgaagcaggtccagcagaccctcgagcaggaagagggcaagccgctggtgaccgacctgctgttcaacaacctcatcgtccagccctgaggtcaactatccgttctgtcccgcgctcccggatgcgaggcaccggggattctgctttcctgtga

SEQ ID NO: 6456 - DNA, 1194 bp, Pseudomonas aeruginosa
cgtgcatcaacacctgcgcgccgccctggagggacaatcgagccagtgaagtccgcggcggccgcgctttccagcgtgagcgccatcgccgcggcctggccgaacgtgcgaggagaagggatgaaacaggaaagcaaacggtggctgagccgtgccctggtcgtggcggcgctgctcggcgtaggcgtgctggtctggcaggtatcgcgaccgaccggcctgggcgagggattcgccagcggcaacggacgcatcgaggccaccgaggtggacgtggcggccaagcttcccgggcgggtcgccgagatcaaggtcgacgagggcgacttcgtcaaggccggcgaaatcgtcgcgcggatggatacccaggtgctcgaggcgcagttggcccaggcccaggcccaggtgcgccaggcggagaacgccaagctcaccgcgacctcgctggtggcccagcgcgagagcgagaagagcaccgcccaggccgtggtggcgcagcgccaggccgagctgacagcggcgcagaagcgcttcacccgtaccgaggcgctggtcaagcgcaatgccctgccgcaacagcaactcgacgacgatcgggcgaccctgcagagcgcccaggcggcgttgtccgcggcacgctcgcaagtgatttcggcgcaggcggcgatcgaggccgggcgttcccaggtaatcgaggcgcagtcggccatcgaggcggccaaggccagcgtcacccggctccaggcggatatcgacgacagcctgctcaaggcgccgcgcaacggccgcgtgcagtaccgcgtggcacagccgggggaagtgctgccggccggtggcaagctgctcaacatggtcgacctggccgacgtctacatgactttcttcctgccatccatgcaggccggcagggtcggactgggccaggaagtgcgcttggtgatcgacgcggtgccggactacgtgatcccggccaaggtttcctatgtcgccagcgtcgcccagttcaccccgaaaacggtggaaaccgccaacgagcgggagaagctgatgttccgggtcaaggcgcggctcgatccggcgctgctggaaaaatacatcacctacgtcaagaccggcgtgcccggaatggcctacctgcgactggaccctgaggtcgagtggccggccaacctgcagatcaaggttccgcaatga

SEQ ID NO: 6457 - DNA, 327 bp, Pseudomonas aeruginosa
tcggtccggacggggtcggcaagtccagcctgctggcgctgctggccggcgcacggaagatgcaggatggcgagatccgcgtgctcgatggcgacatgcgcgaccgccgccaccgccgggcggtctgcccgcgcatcgcctacatgccccaggggctgggcaagaacctctacccgacgctctcggtgttcgagaacgtcgacttcttcggtcggctgttcggccacgacaaggccgagcgcgagcggcgcatcgccgacctgctgcagagcaccgggctggcgccgttcgccgagcgtcctgcgggcaagctgtccggcggcatga

SEQ ID NO: 6458 - DNA, 615 bp, Pseudomonas aeruginosa
gataaccatcttcatttcacgtgtagcgccccaatggcgcccagccgtcagggtcccgagatgtccactcagaattccgcctacagcgccttttactcccttctcgccgaggcggccatgccggtctcgccggccgaactgcacggccatctgctgggtcgggtctgcgccggcgccggcttcgacgaggccgcctggcaacacgctgccgccgaactgctcggcggcgcgccgggcgaacgactcaaggccgcgttgtccggcctgctcggcatggtccggcaggacttttccgccggcgaggtcgccgtcgtcatgctcctgcccgacgacgaaaccccgctcgcccagcgcaccgaggcgctcggccaatggtgccagggtttcctcgccggtttcggcctcaccgcccgcgaaggcagcctgaccggcgaagccgaggaagtgctgcaggacatggccgccatcgcccaggtccagggccagctggaagacagcgaggacggcgagacggactatatggaagtcatggaatacctgcgggtcgctccgctgctgctgttcgccgagtgcggcaagccgctggagcccgctcccaagccttcactgcactga

SEQ ID NO: 6459 - DNA, 1344 bp, Pseudomonas aeruginosa
ggtttctgcatgatccgtatccccaagtcggagtacgcccgtcggcgcaaggcgctgatggcgcagatggaacccaacagcatcgccatcctgccggcggcgccgatgtacatccgcaatcgcgacgtcgagcatgtctaccgccaggacagcgacttccagtacctcaccggcttccccgagccggaggcggtgatggcgctgattcccggccgtgctcacggcgaatacgtgctgttctgccgcgagcgggatccggagcgtgaactgtgggacggcctgcgcgccggccaggacggtgcgatcggccagtacggcgccgacgacgcctttcccatcggcgatatcgacgacatcctgcccggcctgatcgaaggccgcgaccgggtctactacgcccttggcgccaatcccgacttcgaccgccggctgatggactggatcaacgtgatccgctccaaggcccgccagggcgcgcagccgccgaacgagttcgttgccctcgaccacctgctgcacgaccagcggctgtacaagagcgccaacgaagtgaaggtcatgcgctacgccgccgaggtctccgcccgggcgcacatccgggcgatggaggtgtgccggccggggctgttcgagtaccacctggaagccgaactggaatacgagttccgcaagggcggggcgaagatgccggcctacggctcgatcgtcgccgccggacgcaacgcctgcatcctgcactaccgcgagaacgatgcggcgatcaaggacggcgacctgatcctgatcgatgccggctgcgagatcgactgctacgccagcgacatcacccgtaccttccccgccaatggccgcttcagtcccgagcagaaggcgatctacgaactggtgctggaagccaacatggcggcgttcgactacatcgcccccggtcgccactggaacgaggcccatgaggccaccgtacgggtcatcaccgccgggctggtgcgcctgggcctgctggagggcgacgtcgacgagctgatcgcccacgaggcctacaaggctttctacatgcaccgcgccggccactggctggggatggacgtgcacgacgtcggcgagtaccgcgtcggcggcgaatggcgggtgctcgaaccgggcatggcgatgaccgtcgagccgggcatctacatcgccccggacaatacctcggtggcgaagaagtggcgcggtatcggcgtacgcatcgaggacgacgtggtggtcacccgcaatggctgcgaagtgctgaccaacggcgtgccgaagaccgtcgccgagatcgaggcgctgatggccgcggccaagagcgaggcagcctga

SEQ ID NO: 6460 - DNA, 669 bp, Pseudomonas aeruginosa
ggtgacgatgagcaaggtcaacctggcgatcatcggcgggggcctggtcggcgcctcgctggcgctggccctgcaggccggcgctcgggagcgcggctggtcgatcgtgctgatcgaacccttcgcccccggcaatgcctaccagcccagctacgacgcccgctcttcggcgctgtcctacggcagccggcagatctacgagcgactcggcctgtggccggcgatcgccgagcgcgccgagccgatcctgcatatccatgtttccgaccgcggccgcttcggcgccacccgcctgaccgccatcgaggaaggcgtgccggcgctgggctacgtggtggagaacgcctggctcggccagtgcctgtggaaggcgctcgaccccgaggtggtgcgctggcactgcccggccgaagtgaagaccctggaagcccgggagggcggttaccggcttaccctcgacgacgagacgcaactcgattgcgagctggcgatcctcgccgatggcggtcgttccgggctgcgcgaacaacttggcatcgccgtggagcagacgccgtaccggcagactgcgctgatcgccaacgtatcgccctccgaggcgcacctcgggcaggccttcgagcgcttcacccccagcggtccgatggccctcctgccgttgccggataa

SEQ ID NO: 6461 - DNA, 516 bp, Pseudomonas aeruginosa
cgcggccttcctcggcgagctgcaggctgccttcggctaccgcctcggcgccttccgccaggtcggcgcacggcactgctaccccttgcacctggtcgaggcccgcgagcaggtgcgtccgcacctggtggtgctgggcaacgctgcgcacagtctgcaccccatcgccggccagggcttcaacctgtcgttgcgcgacaccctggcgctggtcgacgccctgctccacgacgacgcgccgctgggcgagttcgccgtgctgcagcgctacctcgatgggcagcgcctggaccagcagatgaccgtcggcttctccgaccgggtgacccggctgttctccaacgaccgcgcgctgctcggcgccgggcgcaacctcggcctgctcgggctcgacctgctgccgccggccaagcgctggttcgcccgccaggccatgggcctcggcgcgcggccgctgtagcgccatgccggtctggtcgagggcgcgcaaggcccgcctgctgcgcttcgccatga

SEQ ID NO: 6462 - DNA, 1506 bp, Pseudomonas aeruginosa
tggagaacctgggccgcgactacgtggtctgggacaaggcggccaacatcgagttcgtcagcccgggcaagggcccggtgcatgcgcatttcagcatcgaccagaagctgctcgacgaggtccgcgagcggaccgccggcggcgagaagtacctgccccggctgcacgccgaagtgcgcgacgacgccggcaccctggtggcgcgggttcagaaaaccctgtacgtgcggctcaagccgcgcctgcggaacgcggcctgaagagggcccacgagtggagaacgaggatatgcacgcggatctggtcatcgtcggcgccggcatggtcggtagcgccctggccctggccctggagggcagcggcctggaggtgctgctggtggacggcggctcgctcgacgtggcgccgttcaagccggaggcgccctacgagccgcgggtcagcgcgctgtccgaagccagccggcggattctccagcgcctgcatgcctgggacggcatcgtcgcgcgccgcgccgagccctatcgcgagatgcaggtgtgggatggctccggcaccgggcggatcggcttcagcgccgccagcgtgcacgccgaggtactcggccatatcgtccaaaaccgggtggtgcaggacgccctgctggaacgcctgcacgattccaccaccggcctgctggccaatgcgcgcctggaacagatgcgccactccggcgacgactggctgctgaccctggccgacggtcgccagctgcgtgcgccgctggtggtcgccgccgacggcgccaactcggcggtacgccgcctggccggctgcgccacccgcgaatgggattacctgcaccacgccatcgtcaccagcgtgcgctgcgagaacgcgcaccgcgcaaccgcctggcagcgcttcaccgacgacggtccgctggccttcctgcccctgccggaccgcggcgacgagcactggtgctcgatcgtctggtcgaccaccccggaacaggcagaacgcctgatggcgttggacgaggatggcttccgcgccgccctcggcgaagccttcgaacagcgcctgggcgccatcctgcatgccgaccggcgcctgtgcatcccgctgcgccagcggcaccccaagcgttacgtcgagccgggcctggcgctggtcggcgacgctgcgcacaccatccacccgctggccggacagggcgtgaacctgggcttcctcgatgcggcggtgctgtccgaggtcctgttgcacgccctggagcgcggcgaacggcttgccgacgaacgcgtgctgagtcgcttcgagcggcggcggatgccgcacaacctgggcatgatgacggcgatggaaggcttcgagcgcctgttccaggccgaccggttgccgctgcgctggctgcgcaacgccggcctgcgcctggtcgacggccatcacgaggcgaaggcgctgttcgtccgccaggcgcttggcctcagcggcgacctgccgtcgctggcacgagtctga

SEQ ID NO: 6463 - DNA, 1317 bp, Pseudomonas aeruginosa
cgaggggaccggccggacgccagatcacctcgatcatcgccctggtcgcggccggccagggcgttgccctggtgccgcgttgcagcaccgcgctggcccgggccggagtcgtctatcgcccgctggccgagcccgaggcgctggccgatttcctcgtcttcacccgccgccatggccgcagcgccgcggtggaggcgttcctcgccatcctcggtggcttggacgcaggcgaaacaccccgacacatttagtcgcgcgggttcgcaagcgagatttcttatcattcgtgcctacgttccgctgacgaggctgttcttcatgcaggcaagcaaagctctactcgccgccctggccctgggcatcaccggcctggcccaggccgccgacgaagtggtggtgtattcctcgcgcatcgacgagctgatcaagccggtgttcgatgcctacaccagcaagaccggcgtgaaggtcaagttcatcaccgacaaggaagcgccgctgatggcgcggatcaaggccgaaggcgctaacaccccggccgacctgctgctcaccgtggacgccggcaacctctggcaggccgagcagatgggcctgctgcaaccgttcaagtcggccaccatcgaacggaacattccctcgcagtatcgttccagcaccgatagctggaccggactgtcgctgcgcgcgcggaccatcgtctactccaccgagcgggtcaagccggaagagctgagcacctacgaagccctggccgacaagcaatgggaaggccgcctgtgcctgcgcacggcgaagaaggtctacaaccagtcgctgaccgggaccctgatcgagacccacggggcgcagaagaccgaggaaatcctccagggctgggtgaacaacctggccaccgacgtattcgccgacgacaacgcggtgatccaggcggtggacgccggccagtgcgacgtcggcatcgtcaatacctactactacgggcgcctgcacaagcagaacccgaacctgcgggtcaagctgttctggccgaaccaggccgaccgcggcgtccacgtcaacctgtcgggcatcggcctgactcgccacgcgccgcatcccgaggcagccaaggcgctggtggaatggatgaccgggcccgacgcccaggcgctgttcgccgggatcaaccaggaattcccggccaacccgcaggtcgcgccgtcagccgaagtcgccagctggggcagcttcaaggccgacagcatcccggtggaagttgccggcaagcgccaggccgaggcgattcgcctgatggaccgcgccggctggaactga

SEQ ID NO: 6464 - DNA, 1965 bp, Pseudomonas aeruginosa
ccgccggttatactcggcgccccggctcgtccgagcggggcgtcgttcgttccgcaccgaggatttcgtggcccatcccgctccccgccgctggtaccccatcaccttcaccgttgccgcgctggtgctgctgccgctcagcgtgctgctgctgagctggctggagatcgaccgggaaatctggagccacctgtgggatacccagttgccgcgcctgctcggcaacaccctgaccctggtgctcggcgtcggcatcggcgtgactctactcggggtcagcctggcctggctcaccagcctctgcgaattccccgggcggcgctggctggactgggcgctgatgttgccgttcgcgatcccggcctacgtcctggcgttcgtcttcgtcggcctgctggatttcgccggaccggtgcagagcctgctgcgcgagtggttcggcagcggcctgcggttgccgcgcgtacgctccaccggcggggtgatcctggtcctggtgctggtgttctatccctatgtctacctgctcgcgcgcagcgccttcatcgcccagggcaagggcctgatggaagccgcgcgggttctcggcctgtcgccctggcaggcgttcctgcgggtcgccctgccgatggcgcggccggcgatcggcgccggcctggcgctggcggtgatggaaaccctggccgacttcggcgcggtatcggtgttcaacttcgacaccttcaccaccgccatctacaaaacctggtacggcttctacagcctctccagcgccgcccagctggccagcctgttgttgctcggggtatgcctggtgctgctcggcgagcgccacacgcgaggccgagccaaggccgccagcgagcgtccgcgcggcgcgccgctgtatcgcctgcgcggcgccagggcgctggcggcgagcgcctggtgcgggctggtgttcctctgcgccttcgtgattcccgtggcgcaactggttgtctggttctggcgccagggccgtttcgacctcgacgagcgctactgggacctgatcggccataccctgacgctgggcggcatcgccgcgctggcgacggtcgccgtggccctgctgctggccttcgccgtgcgcctggcgccgactcgcgctatccgcggcgcggtgggcctgggcaacctcggttatgcgctgccgggctcggtcctggcggtttcgatcatgctggccttcagctggctggacaatcactgggtgatcccgctttccagcgccctcggcggcgccggcaagccgctgctgctgggcagtctgttcgccctgctgctggcctacctgatccgtttcatggcggtggcctacgggccgctggaaagcgggctggcgcggatccgcccgtcgctgccggaagcttcgcgcagcctcggcgtgggcggcccgctgctgttcctgcgggtctacctgccgctgttgctgccggcctcgctgagcgccgcgctgctggtcttcgtcgacgtgctcaaggagatgccggcgaccctgctgatgcgtcccttcggttgggacaccctggccgtacggatcttcgagatgaccagcgagggcgaatgggcgcgcgcctcgctgccggccctgaccctggtgctggtcggcctgctaccggtggtcgggttgattcgtcgttctgcccatcattcagatcgctgagcccagtatccatgcaggtcgtagggtctatgcacggatcgcggcacgcttccatggtgtcctgctccggggcttgcggctacaatgcgcgcgatttcgtgccggcggtccctgccgacggcacccgctacgcccggaaggagaatacccatgggattgcgcaccccgctttacgagctgcacgtcgcgctcggcgccaagatggtcgatttcggcggttgggacatgccgctgcactacggttcgcaggtcgaggagcaccatcaggtccggcgtga

SEQ ID NO: 6465 - DNA, 1659 bp, Pseudomonas aeruginosa
aggccgcctccgacatctattcgccgatcggcggcgaagtcatcgccatcaacgaagccctggccgacaccccggaagacgtcaacaacgacccgtacgcgtcctggttcttcaagctcaagccgagcaatccggccgagctggacaagctgctcgatgccgctggctaccaggccgccgtcgacgcggaaggctgagccgccgcgtagtcgcgacaaaacccgctatccttggacaaggcctcgatcattcgaggctttgttctttttgcagcggcgaaatgcgttttcgccgtcgttgctttctcattcgatatccgttcggcgacgatcgctggcagggcgatgccgcccccaacgagaccgaagccatgtcgcagacgccgtccctcgcccagctccagcccgccgatgccttcctgcgccgccacctcggccccgatccggcggaacagcaggccatgctggatttcctcggagtttccactcgcgccgaactgatcgtgcagacggtgccgccggcgatccgcctcaaccggccgctggaactgcccgccgcgctcgacgaacaggccgccctggcgcgcctgcgcggctacgccgggctcaaccagcgctggaccagcctgatcggcatgggctactacggcaccgtgacgccgccggtgatcctccgcaacgtgctggagaatcccggctggtacaccgcctatacgccctaccagccggaaatcgcccagggccgcctggaagcgctgctgaatttccagcaactgaccatcgacctcaccgggctcgacctggccagcgcctcgctgctcgacgaagccaccgccgccgccgaggccatggccctggccaggcgggtggcgaaggccaggagcaaccggttcttcgtcgatgcgcattgccatccgcagaccgtttcggtgttgcgtacccgcgccgaggcgttcggtttcgagctggtcgtcgacgagccggacaatcttgccgcccacgcggtgttcggcgccttgctgcaatacccggacagtcgcggcgagatccgcgacctgcgcccgcttatcgaggcgttgcacggccaacaggcgctggcttgcgtcgccagcgacctgctcgccctgttgttgctgaccccgccgggggaactcggtgccgacgtggtgctcggcagcgcccagcgctttggcgtaccgatgggctacggcgggccgcacgcggcgttcttcgccacccgcgaagggtacaagcgggcaatgccggggcggatcatcggcgtttcccgcgacgcccgcggcaacccggcgttgcgcatggccctgcaaacccgcgagcagcacatccgtcgggaaaaggccaactcgaacatctgcaccgcccaggtgctgctggccaacattgcttcgctgtatgccgtctaccatgggccacaggagctgaaacgcatcgcccaacgcgtccagcgcctgaccgcgctgctggcggcgggcctggaaagcaagggactgcggcggctcaaccggcacttcttcgacaccctgacctacgaggtcggcgagcgtcaggcggcgatcctcgaacgggcgcgggcggcacgggtcaacctgcgcgtggtcgacgaccggcggctggccctgagcctcgacgaaacctgtga

SEQ ID NO: 6466 - DNA, 486 bp, Pseudomonas aeruginosa
cgcggcgaccctggcgaccctgttcgagatcttcctcggcgccggccacgggctggatgtcgcgcacctggatggcggggcggtggccgacggcatcccggcggtcctgcaacgcacttcggcctacctgcagcatccggtgttcaacgcccaccacagcgagaccgagatgcttcgctacctgcgccagctggaaggcaaggacctggcgctgaaccaggcgatgatcccgctcggctcctgcaccatgaagctcaacgccagcagcgaaatgatccccatcacctggccggaattcgccgaactgcatccgttcgtgccgcgcgagcaggccgagggctatcgccggatgatcgacgaactggaagcctggctgcgggcgatcaccggcttcgacgccatctgcatgcagccgaactcgggagcacagggcgaatatgccgggttgctggcgatccgccgctaccaccagagccgcggcgatag

SEQ ID NO: 6467 - DNA, 1029 bp, Pseudomonas aeruginosa
ccagcgcgacatctgcctgatccccgcatcggcgcatggcaccaacccggcctcggcgatcatggccagcatgcgggtggtgatcgtcgagtgcgatccctgcggcaacgtcgacctcgacgacctgcgcctcaaggcggccgaggcgggcgaccggctgtcctgcctgatgatcacctatccctcgacccacggcgtctacgaggaggggataggcgagatctgcgaagtggtccaccgccacggcggccaggtctacatggacggcgccaacctcaacgcccaggtcggcctggcgcgaccggcggacatcggcgcggacgtctcgcacatgaacctgcacaagaccttctgcatcccccatggtggtggcgggccgggcatggggccgatcggggtcaagcggcacctggcgccgttcgtcgccaaccatccggtgatccgcgtcgaagggccgaacccgctgaacgacgcggtcagcgcggcgccctggggcagcgccagcatcctgccgatcagttggatgtacatcgccatgatgggcccgcagctggccgacgccagcgaggtggcgatcctctccgccaactacctggcgaaccgcctggacggggcgttcccggtgctctaccgcgggcgcaacgagcgcgtcgcccacgaatgcatcctcgacctgcgaccgctcaaggcgcagaccgggataaccgaggaagacgtggccaagcgcctgatggactacggcttccacgccccgaccatgtccttcccggtgccgggcacgctgatggtggagccgaccgagagcgagtcgaaggcggagctggatcgcttcgtcgaggcgatgctgagcatcagggccgagatcggcaaggtggagagcggcgcctggccggcggaggacaacccgctgaaacgggcgccgcataccctggccgacgtcaccgggatctggcagagaccctacgagatcgccgaggcggtgaccccgagcgaacatgcgcgggcgttcaagtactggccggcggttaa

SEQ ID NO: 6468 - DNA, 615 bp, Pseudomonas aeruginosa
caccgtggcgcggatcaggtagtagggtacgcccagttcgagcaggcgggtgatcgccgtgggggagtcgttggtgtgcagggtggagagcaccaggtgcccggtgagcgccgcctggatcgccatctcggcggtctccaggtcgcggatctcgccgaccatgatgatgtccgggtcctgccgcagcagggcgcgtacgccgctggcgaaggtcaggtcgatgttgtgctggacctgcatctggttgaacgagggctcgatcatctcgatcgggtcctcgatggtgcagacgttcacctcatcggtggccagttgcttgagcgtggtgtaaagcgtggtggtcttgcccgagccggtggggccggtgaccaggatgatgccgttgggctggctggtcatgctctgccagcggcgcaggtcgtcggcggagaatccgagctggtcgaagctcttgagcagcacctcggggtcgaagatgcgcatcaccatcttctcgccgaaggcggtgggcagggtcgacaggcgcagctccacctcggcgccgtccggggtcttggtcttgacccggccgtcctgcggcttgcgtttctccgccacgttcatccgtcccagtga

SEQ ID NO: 6469 - DNA, 441 bp, Pseudomonas aeruginosa
gcatgcgctgcaggcgcggcgcttggtcggggagcagctcgggatgctggtgggcgcgcgccagcggcgtggcctgggcttcttcggcaaggctgcgcagcagccatttgcccagcgcggcggcgccctggcggttgccgcgctcgttgcgcgactcggtccaggccttggccagcagccagcgcgaggcattcagggagaacagaccccagcgggtctcgtcgagttcgccgcggaacagttgcggcgcctgctggcgtagcgtctcgtcgtcacggccgcgctcgatgcgcggcgcccagtcggcgaggagagcgtccagcgcttcgcgcagctcgcgactgctggcgcgtggcaccgcctggccgaggctgccgagcagggtacgcaggtcctgcaggtgttgcagccagtcctccagcaggcgccagtggccgttga

SEQ ID NO: 6470 - DNA, 750 bp, Pseudomonas aeruginosa
aggtgttccagatcaaaggcgcgcggggtgggtggcctatacttttcggcatttccaccagggaggcgttccatgccgaccaatccgttcatcagcctgttcggccgttcgccgatcgggccgatgcagcagcacatcgccaaggcccacgaatgcgcggccggcctgttgccgttcttccgcgcggtgatcgccgaggactgggcgcaggtcgaacaggttcagcaggacatggtgcgactggagcaggaagccgatcggctgaagaagaacgtccggatgcacctgcccaagagcctgttccttccggtgccgcgctccgatctgttggagctgctcagtgtacaggacaaagtcgccaatcgcgccaaggacatcgccgggctgatgctgggccggcgcatgcgcatcccgctgccgctgcagggccagatgctcgcctacgtgcagcgctcggtggacgccagcgcccaggcgttgcgggtggtcaacgaactcaacgaactgctcgagaccggcttcggcgggcgcgagaccagtctggtggagagcatggtggaggaactcgaggcgatcgagaacgataccgaccgcatccaggtcgaggtacgccgcgagctgttccgtctggaaagcgagctgccgccggtggacgtgatgttcctctaccagatcatcgaatggatcggcgatgtcgccgaccgcgcccagcgggtcggcaaccgcctggagcaattgctggcgcgttga

SEQ ID NO: 6471 - DNA, 1380 bp, Pseudomonas aeruginosa
gcgccaggtttctttccgccttctgcccgcatacggatccccgcccatgtccttgatcgccgaccacggcttcgccttccttgtactcgcctgcctgttcggtttcttcatggcctggggcgtcggcgccaacgacgtcgccaacgccatgggcacctcggtgggctcacgggcgctgaccatccgccaggcgatcctggtggcgatggtcttcgagttctgcggtgcctacttcgccggcggcgaggtcaccgaaacgatcaggagcggcatcgtcgatccgcagtacatgacccccgacctgctggtcttcggcatgctctcggccttgctggccgccggggtctggctgttgctggcgacgatcaagggctggccggtgtcgaccacccactccatcgtcggcgcgatcatcggcttcgcctcggtcggtgtctcggtgcacgcggtgcactggggcgcgatcggcccgatcgtcgccagttgggtggtgacgccggtgctgtccgggctgctcgccttcgccctgttcaggagcgtgcagtggttggtactgcatgccgaggacccgttccgcagcgcgcgccgctacgtgccgctgtacatgttcctggcgggcttcatggtcgcgctgatgaccgtcggcaagggcctgaagcatgtcggcctggagctttccggcctccagacgctgggtctggcgttgctcgccggtggcctggtgatgggcctgggcatcgtcctgctgttgcgcatccgacccactggcggagccgatccgcgtggcggcttcgccagcgtcgagcgggtcttcgcggtgctgatgatcttcaccgcctgctccatggctttcgcccatggcgccaacgacgtggccaacgccatcggcccggtggcggcggtcgtcgcggtggtccaggccggcggcgacctggaactggtgacccgctcaccggtgccgtcctgggtactgctgctgggcgcggtgggcatcgtcatcggcctggctacctatggctaccgggtgatcgcgaccatcggccgggagatcaccgagctgacccccagccgcggcttcgccgccgagctggcgaccgcctccacggtggttggcgcctcggccatcggcctgccggtgtccactacccataccctggtcggcgcggtgctcggcatcggcatggcgcgcggtatcggcgcgctcaacctgcgggtgatcggctcgatcttcctgtcctgggtagtgaccctgccggccggcgcggtgctggcgatcctgtgcttcctggtcctgcgcgcgctgttcggcgcctgagcgcggtcttcgtcggctggcgcaggcggaaccggaacggacggttttatccaccgccgcgatag

SEQ ID NO: 6472 - DNA, 633 bp, Pseudomonas aeruginosa
gccatgatggggctcgatccgtgtggagagtcccatgccgttgccgtctctgaaagaccagttcggcgcgctgatcgccgcgtcttccgtcagttgcacccagcccgagctggaccagaccaaccgcccggtggtcgacctgctggcctcctggctgggcgatctaggcttccgctgcgagatccgggaagtctcgccgggcaagttcaacctgctggccagctacggcagcggttccggcgggctggtgctggccggccacaccgataccgtgccctacgacgaagcgctgtggagcagcgatccgctgcgcctggacgagcgcgacggccgctggtacggcctcggcagttgcgacatgaagggcttcttcccgctggccatcgaggccttgctgccgctgctcgaccagccgttccgccagccgctgatgatcctcgccacctgcgacgaggaaagctcgatggccggcgcccgtgccctcgccgaaagcgggcgaccgctgggtcgcgccacggtgatcggcgagccgaccaacctgcggccgatccgcctgcacaagggggtgatgatggagcgcatcgagattctcgggcagagcggccattcgtccgatccgaacctcggccgtag

SEQ ID NO: 6473 - DNA, 1107 bp, Pseudomonas aeruginosa
gcagttgcgcgaggcgatccgccagcgcctgcggccgctggccgaacggcaccaggtgagcatcgactaccagccgctgttccctgccgtgccgccgttcgaacaggcgcaggacagcgaactggtacgcgtcgccgaacgcctgaccgggcatcgcgccgaggccgtggcgttcggtaccgaggcgccgtacttccagcgcctgggcagcgagaccctggtcctcggtgccggcgacatcgcctgtgcccaccagcccgacgagcacctcgaactggcgcgtatcgaaccgatggtcggcgtgctgcgccggctgatccagcattactgcctgacgcccgccgccgactgaagcgcggcgtggccggcgaccagctcgaagccgccgttgatgacgaactgcacgcccatcgccaccagcaggaagccgaccactcgcgagatggcgtcgatcccggattcgccgaggaacttcatgatgcgcccggagctttgcagggcgatccagaagatcagcgcggtgagcagggtgacggtgatcgccgcgaggtggatgaacagcggaatgcttccgtaggtggattgcagcgtcgacgccgagctgaccaccagggcgatggtccccggccccgcggtacccggcagggccagcggaacgaaggacaggtcgcggaagtgcggggtgatcttttcctcgtccgacagcaggtcgtgctggacttcggtctcgtccggcgtggtggcggggaacagcatggtgaagccgatataggcgacgatcagcccgccggcgatgcgcaggccgggaatggagatgccgaacacctgcatcaccaggctgccgccgtagaagctgaccagcatgatcagcgccacgtagaggctggccttgaatatctgccggttgcgctccgccggcggcaggctgccgccgaggccgagcagcagcgagacgctggtcagcgggttggctaccgggagcacggcgagcaggccgaccaggacgtgatggaagtattcgctcatggattttcctcgttcgcgtgggtgcgcgccggacggcacggcgaacgaggcagcctagcgaaaaagcgctgcgcgagttaa

SEQ ID NO: 6474 - DNA, 1404 bp, Pseudomonas aeruginosa
ggagaagcctgtcgatgttgctgcgacgacgataacggcgcccttcgggccgtcccggccgctcacgctttgctctcgctcacgaaacgacaggctttccccaccatgcccgactacgtcaactggttacgtcacgcttcgccctacatcaactcgcaccgggaccgcaccttcgtggtcatgctccccggcgaaggggtggagcatcccaatttcggcaatatcgtccacgacctggtccttctccacagcctcggcgcgcgcctggtgctggtgcacggttcgcgcccgcagatcgaggcgcgcctggccgcgcgcggcctggctccgcgctatcaccgcgacctgcgagtgaccgatgcgccgaccctggaatgcgtcatcgacgccgtgggtagtctgcgcatcgccatcgaggcgcggctgtcgatggacatggccgcctcgccgatgcagggcgcgcgcctgcgggtcgctggcggcaacctggtcaccgcgcggccgatcggcgtggtcgagggtgtcgactaccaccataccggcgaggtccgtcgcatcgaccgcaagggcattggccgccttctcgacgagcgcagcatcgtcctgctctcgccgctgggctactcgccgaccggggaaatcttcaacctggcctgcgaagacgtggccatgcgcgccgccatcgacctggaagcggaaaagctgattctctacggcgccgaacagggcctgctggacgcatccggcaagctggtccgcgaactgcgcccgcagcaggtgcccgcgcacctgcaacggctgggcaacagctaccaggccgagctgctggacgccgcggcgcaggcctgccgggccggggtcaagcgcagccatatcgtcagctacaccgaggacggcgcgctgctcagcgagctgttcacccgcaccggcaacggcaccctggtcgcccaggagcagttcgaacagttgcgcgaggcgggcattgaggacgttggcgggctgatcgagctgatccgcccgctggaagagcagggcatcctggtacgccgttcccgcgaggtgctggaacgcgagattgaacagttcagcatcgtcgagcgcgaagggctgatcatcgcctgcgccgcgctctacccgatcgccgattccgaggcgggcgagctggcctgtctggcggtcaacccggagtaccgccacggcgggcgtggcgacgaactgttggagcggatcgaggagcgcgcgcgcggactcggcctgaagaccctgttcgtgctcaccacgcggaccgcgcactggttccgcgagcgcggcttccagcccagcagcgtagagcggctaccggcggcgcgggcctcgctgtacaacttccagcgcaattcgcaggtattcgagaagagcctgtga

SEQ ID NO: 6475 - DNA, 591 bp, Pseudomonas aeruginosa
ccgcctggcgcaggctgtcgatgtagctctgcaggtcgttgtagcagggcgtcaggccggcctgggcgttgttctggtagcccaggtcgctcatccgcaggctggtggcgtagggcaggtagagcgtgtgttcgtcgaggcgctccaactggctcgggcggccacgcaggaagccggcgtcgagggccggcgaggcgccgaacaggtacatcagcagccagctgtagcggcggaaattgcgaatcagggcgatgtaggcggcggactggtagtcgcgttccgacagctcgctgccttcggcctggcgcagcagcggccagagcctctccggcagggagaagttgtagtggatgccggcgatgcactgcatggtcttgccgtagcgcagcgccaggcccttgcggtagacgtacttcaggcggccgatcatcgagctgccgtagcgggcgatcgggatgctctcctcgtccggcagctcgcagggcatcgatgggctccacaggtattcgccgtccagtttcgaactggcgaagcggtggatgcgctcgagatcgcccagagtgtcggcgacgtcggtttccgtgggcgtga

SEQ ID NO: 6476 - DNA, 1137 bp, Pseudomonas aeruginosa
atgcgttttcgcttcgtcctggggccggtcgccgcgacttcggcgggagccgtcgaggcgggcgcccggcacggatcgggatcgccgttgcgcgccattctgccgcatggcggccgcgccggtttacaactgggcgaaggtaccttgtcctttcgcgaccagtttgtcgccttgccgcacctcggcttccacaaccaggctgcggcgcccggcatggaggacgcgggcgacgcagcgcacctcgccgtcggcgacggcgcggatgtagttgatcttgcattccagggtgacgctctggcggtcgaaaccatgggaactggagcaggccagccccatggtcacgtccatcagcgagaacagcgcgccgccgtgcatgaccccgccgcggttgcgcaggtgcgcggccatcggcaggcgtacctcggcgacgccgtcgccgaggctgaccgggtccaggccgaccagttcgctgtaggcgctgatcatctgctcgcgggcgggcatctcgctcatggacggctccgtcacttcttcttcagttgcttggcgttggcgaacagcgcggccatggcgttgttcgccggcggcgcgctctgtccgcgcggggcgccacgctcctggcgcggctggccgctgccggtgggacgcccgccgcgctggccttcgaccttctcgccgggggtgtcgctcatgcgcatggacaggccgacacggttgcgcgggatgtccacttccatgaccttgaccttgacgatgtcgccggccttgaccacttcgtacggatccttgacgaacttctcggacagcgccgagatatgcaccaggccgtcctggtggacgccgatgtcgacgaacgcgccgaagttggtgacgttggtcaccacgccctccaggaccatgcccggcttgaggtccttgaggctctcgacgccttcctggaattctgcggtcttgaactccggacgcgggtcgcggccgggcttgtcgagttccttgaggatgtcggtgacggtcggcaggccgaaggtctcgtcggtgaacttcttcgggtcgaggcgcttgaggaacgccgagtcgccgatcagcgagcggatgtcgcgctcggtgtcggcggcgatgcgctgcaccagcggatag

SEQ ID NO: 6477 - DNA, 651 bp, Pseudomonas aeruginosa
gtctccgggtgcaccgccgaggcgtccagcgggttgtcgccgttcatcacgcggaggaagccggcggcttgctcgaaggtcttttcgcccaggcggctgactttcttcagctcgtcgcgggtgcggaacgctccgttggcgtcgcggtgcgcgacgatgttctgcgccagcgtcgagttgaggccggagatgcgtgccagcagggcggcggaggcggtgttgacgtcgacgccgacggcgttcacgcaatcctcgaccaccgcgtccaggctacgcgccagcttcagctgggacacgtcgtgctggtactggccgacgccgatcgacttgggctcgatcttcaccagctccgccagcgggtcctgcaggcgacgggcgatggatacggcgccgcgcagggacacgtccagctcggggaactccttcgccgccagttcggaggcggaatacaccgatgcgccggcttcgctgaccatgatcttggtcagcttcatgcccggatatttcttgatcagttcgccggccagcttgtcggtttcgcggctggcggtgccgttgccgatggcgatcagctcgacctggtgcttggcgcacagcgcggcgagcacggctagggtctggtcccactggttcttcggcgcatgtgggtag

SEQ ID NO: 6478 - DNA, 234 bp, Pseudomonas aeruginosa
agcttgaccttccaggtccagcgcaccacctcggccagccacttgtcggcggcgcggccctggttggacaggccgaagcgctcggcgatcatgacctcgcatgggtgcagggtgcccggcgcttcctcgccgaccttcagcgaggcgctgaggatgccttcgttgcgtccgcggaagatcgccagggcgcggtgcgacggggcgcttttcagcggctcatcgtgttcgaagtag

SEQ ID NO: 6479 - DNA, 519 bp, Pseudomonas aeruginosa
ccatccgcgcgttctgggctgccgacgaggagtcgcgcgcggccatcgccaaggcttccggcctgcgctgggtgccgagcagcgccgaccagcccggcgagcagcactggccgtacacggaaatcttccagcggcagatgcagatggagctggggccggacaccgagacccgcctgcgtatccaccagccgtcgcagctctgggtgcgcgcaccgagcctcggcgaaggctggctggcggtgccgctgtatccgcatcccttgcgtggccaacggatctggagcgtgctcggctggttcctcggcatcggcctgctctccaccgccgccgcctggatcttcgtccgccagctcagccagccgctcaagcgcctggtggtcgccgcccgccagttcggccaggggcgcagcgtgcgcctaccgctgggaccggagacgccgagtgaaatggccgaggtgtatcgcgccttcaaccagatggccgaggacatcgagcagggcgggcgcgaacgcgaattga

SEQ ID NO: 6480 - DNA, 1080 bp, Pseudomonas aeruginosa
tccggcgtggcgcgccggaggcccaggctctctacgaggaaaccgcggacagcgtggcaagccgcgagcgcgcggcggccatgcgcaaggccggggcgctgggcgtacagaccgaggggcggccgagcaagaagcagcggcggcagatccaccagttgcgcggcggccaggactgagaagcgccggtctcccgcaggggagaccgggatggcctcaggccgagtcgcggaccacgccgaggcggccgatcagcggcaatttcgccagcaggcggaacagcggttcggtcacctgcaccagccagccgctggccttcgccgccagcggtgtgtagcagccccaggcgagggccagcagggccatctgcaggccgccgatgtagtcgtcctggccccagtgcgcgccggctaccaggcgcggcatcatgaacagcacggccagggtccagatcagcaggaactgcccggcgcggcgagcgaacagcgacatgaacagcgcccagaccagcagcaccgaggcgtggtcgccggggaagctgcgcttggagcggtccttgatttcccacacgcgttcccagtccgggaagtggtcgctgaggtggatggccttgtccatcagcatcgacaggctggcgtgctgccagtgcaggtggtgggcgatcttcgcgtagagcacgcggatcaccaccaggatcagcagggtcacgatgaagccgaaggtcagccgccgtacctggttcgccggcagcagccagtcgccgcgaatcagcaggcagagcaggatcaccccgaccaccgcgtcgaacggtcgggtactgagcaggccccagagtttcagccaggtttcgttgagggcgagggagccgttgagcttgtcgaagagccagaagtcgaagccgttcatcagctcgcgggtggggccccagagccacaggatcagcagcaggagcgccagaagatgacagatggcgaacttgcgccattgccaggccgcttggaacggagaggcattatccataaaatcgtttccccctatcggcgccgggtcggcgtacgactgtcacgaagcgcgcttttatag

SEQ ID NO: 6481 - DNA, 1026 bp, Pseudomonas aeruginosa
cgttgtgtcccgcatgtcccattcagatcagagccagcgtttccttttcgacgataccgacgtgcgcggcgagatggtcgatctcgagcgcagctacagcgaagtgctggccaaacatccctatccggaaccggtcgcgcagctgctcggggagatgctcgcggcggcctcgctgctctgcggcacgctcaagttcgacggcctgctggtattgcaggcgcgctccagcggcgcggttccgctgttgatggtggagtgttccagcgaccgccaggtgcgtggcctggcccgctattcggcggagtccatcggcgccgacgccggcatgcaggaactgatgcccgaaggcgtgctgaccctcaccgtggacccggtcaagggccagcgctaccaggggatcgtcgccctggagggggtgaacctggcggaatgcctgtccaactacttcgccagctcggaacagctgccgacccgtttctggctcaacgccaacggccgccgtgcccgcggcctgctgctgcagcagcttcccgccgaccgcctgaaggaccccgaggcccgcgaggccagttggcagcacctgaccaccctggccgacacgctgaccgccgaagagctgctggcgctggacaacgagaccgtcctgcaccgcctctaccacgaggaaaccgtgcgcctgttcgagccgcaaccgctggtcttccattgcagttgctcgcgggaacgttcggccaacgccctggtcagtctcgggcaggccgactgcgagcggctgctcgaggaggaagaaggctcgatcagcatcgactgccagttctgcaaccagcgctacctgttcgacgcctccgacgtcgcccagttgttcgctggcgctggcagccaggggccttccgagacccgccactgacgatttttcatccagcgggcttttctggcataatcccgccacttttttcctgtagtgagttttttgaagcgctacgaagtttggaggactcggcctctggccgacggggaaccacatga

SEQ ID NO: 6482 - DNA, 705 bp, Pseudomonas aeruginosa
tcgattcaaatcagcggggggacgtcaatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaatgctatccgcggtgtctgtcggcagttcctggtgctgtgccatcagcttgggctgttctctgaaacgctgggtgggcctcgacggcttcaagttcctaggggtcaagcaccgctaccgccatttcaccattgcctagcttcatcggggaatggaggaaatccactccggcatccatcgcttcctaagcgccctggattcccgcggatcgtccggaaccggcgctggcgcacgtctaacgccaacgcctccacgaacagatcggcaaccccaaatcgaagctgccggaatctcatggaattccaggtccacctctgcgaaatatcgcgataa

SEQ ID NO: 6483 - DNA, 231 bp, Pseudomonas aeruginosa
aggaaccggataagtacttcgtcgagcatgaccacccgttcgagatcggcgtctgcgccggcaagttcgaccagcgtaccggtctctcccagtccaccgtatcggttacacctcgccaccctgcaacgcgccggtctggtgaccagccgccgggtcggccagtggaacttcttcaagcgcaacgaggagaccatccaggccttcctcgaccaactcggcgacgagctgtaa

SEQ ID NO: 6484 - DNA, 540 bp, Pseudomonas aeruginosa
  unsure (504): Identity of nucleotide at the above locations are unknown.
gcagcactcgcttccaccccaccacctcgcagtccaggagctcgaccgatgccggcgtctcttctcgtcctcgctttatccgcctttgccatcggtaccaccgaattcgtcatcatgggcctgctgccgcaggtcgccggcgacctgcgggtatccattcccagcgccggctggctgatcagcggctacgccttcgccgtggccttcggcgccccgctgatggccatggccaccgcccgcctggagcgcaagaaagccctgctcgcgctgatgggcatcttcatcgtcggcaacctgctctgcgcggtggccgccaactacggcctgctgatgctggcgcggatcgtcaccgcgctctgccatggcgccttcttcggcatcggctcggtggtcgccgccagcctggtggcgccgaaccgcagcgcttccgccgtggccctgatgttcaccggcctgaccctggccaacgtgctcggcgtgccgctgggtaccgcgctcggccanaaaacccggctggcgcgcgaccttctgggtgggtga

SEQ ID NO: 6485 - DNA, 390 bp, Pseudomonas aeruginosa
gtgttgcccccccctgtgtttgaagactcggcggggatcgccggcgtccttctggtggtcctgctggtgatcggcctggcggtggccaacgcgatgctgcggccgttgcaccagatccgccagaacctcgatgacatcgccgccggcgaaggcgacctgacccgtcgcctaccggtgaccagccacgacgagctgggcgagctggccggttccttcaaccgcttcgtcgagaagatccacggtctggtgcggcagatcgccgggatgaccggcgacctcaagcaactggtggagcagatgtcggcccaggccgagcgttccgagcaggccatggagcgccagcgccacgagaccgaccaggtcgatcatcgtcatcagccctgtcgatag

SEQ ID NO: 6486 - DNA, 1059 bp, Pseudomonas aeruginosa
  unsure (1018): Identity of nucleotide at the above locations are unknown.
ccggcgacctcaagcaactggtggagcagatgtcggcccaggccgagcgttccgagcaggccatggagcgccagcgccacgagaccgaccaggtcgatcatcgtcatcagccctgtcgatagcgactatcgtcgcaatcgatccccatatcgtcccacaccgatatatagttcgtcccaacccgatatggacggccaacggaccaccgccatgccactggacatcgacgaaatcatcaaggctctctcccacccggtgcgacgcgacatgctgcgctggctgaaggaaccggataagtacttcgtcgagcatgaccacccgttcgagatcggcgtctgcgccggcaagttcgaccagcgtaccggtctctcccagtccaccgtatcggttacacctcgccaccctgcaacgcgccggtctggtgaccagccgccgggtcggccagtggaacttcttcaagcgcaacgaggagaccatccaggccttcctcgaccaactcggcgacgagctgtaagcagcactcgcttccaccccaccacctcgcagtccaggagctcgaccgatgccggcgtctcttctcgtcctcgctttatccgcctttgccatcggtaccaccgaattcgtcatcatgggcctgctgccgcaggtcgccggcgacctgcgggtatccattcccagcgccggctggctgatcagcggctacgccttcgccgtggccttcggcgccccgctgatggccatggccaccgcccgcctggagcgcaagaaagccctgctcgcgctgatgggcatcttcatcgtcggcaacctgctctgcgcggtggccgccaactacggcctgctgatgctggcgcggatcgtcaccgcgctctgccatggcgccttcttcggcatcggctcggtggtcgccgccagcctggtggcgccgaaccgcagcgcttccgccgtggccctgatgttcaccggcctgaccctggccaacgtgctcggcgtgccgctgggtaccgcgctcggccanaaaacccggctggcgcgcgaccttctgggtgggtgacctga

SEQ ID NO: 6487 - DNA, 507 bp, Pseudomonas aeruginosa
  unsure (79): Identity of nucleotide at the above locations are unknown.
agcacattgcccaggccgacgaaggcgaccacgccgatcaggtcacccacccagaaggtcgcgcgccagccgggttttntggccgagcgcggtacccagcggcacgccgagcacgttggccagggtcaggccggtgaacatcagggccacggcggaagcgctgcggttcggcgccaccaggctggcggcgaccaccgagccgatgccgaagaaggcgccatggcagagcgcggtgacgatccgcgccagcatcagcaggccgtagttggcggccaccgcgcagagcaggttgccgacgatgaagatgcccatcagcgcgagcagggctttcttgcgctccaggcgggcggtggccatggccatcagcggggcgccgaaggccacggcgaaggcgtagccgctgatcagccagccggcgctgggaatggatacccgcaggtcgccggcgacctgcggcagcaggcccatgatgacgaattcggtggtaccgatggcaaaggcggataa

SEQ ID NO: 6488 - DNA, 1038 bp, Pseudomonas aeruginosa
gacactgatccctctcgacccactgcatcgcgcccaggcgctggaactggccctgctggtggcctgcgacatccatccgctgaacaacgtgcgggtgctcaagtacctgacccaggtcctcggcatagacgccgaggaccgccagcgctggtacgcgcactgggtcgccgagggcctggcggcggcggagaccctgctgaaccgacaccgtcgcggcgccttcttcgccggcgccgcagcgggcatcgtcgagtgctgcctggtaccgcaactggccaacgcccggcgcatgggctgtgtcctggcgccctacccggcgttgctcgaactggaggggcgctgcctggcgctctgatctccctgtacatctgggccggcccgcaccacctgcactacaccgcgctgccggactgggcgcagtcgctgggcatggtgatgtcgctgatcctcctggcaccgagctggggcggcatgatcaacggcatgatgaccctctccggcgcctggcataagctgcgcagcgacccgatcctgcgcttcctggtggtgtccctggccttctacggcatgtccaccttcgaaggcccgatgatggcgatcaagaccgtcaacgccctctcccactacaccgactggaccatcggccacgtacacgccggcgccctcggctgggtcgcgatggtttccatcggctcgctctaccacctgatcccgaaggtcttcggccgcgagaagatgtacagcctgggcctgatcaacgcgcacttctggctggccaccatcggtaccgtgctttacatcgcctcgatgtgggtcaacggcatcacccagggcctgatgtggcgcgcggtcaacgaggacggcaccctgacctactccttcgtcgaagcgatggccgccggccaccccggcttcatcgtgcgcatgctcggcggtttcatcttcctgctcggcatgttcctgatggcctacaacacttggcgcaccgtcagtgccgccaagccggccgaatacgaagccgccgcacagatcgcctga

SEQ ID NO: 6489 - DNA, 1617 bp, Pseudomonas aeruginosa
cttcaccggccgaacccactcgtccggatagcgccagaaagccatacggccgccttggaaagcgctctgaagcaggcatcaaactggcgtcgcccctggcctggcgcgttgcaatgcccacccgctttctccatacttgccgccgattttttgtccctaaaaaagtccattaaccgtggaacccctagcatgagcacagcaatcagtcagactgcttataactataaggtggtccgccagttcgccgttatgacggtggtctggggggtcattggaatgggtctcggtgtcctgatcgccgcccaactggtatggcccgaattgaacttcgacctgccgtggacgagcttcggccgccttcgccccctgcacaccaacgcggtgatcttcgccttcggtgggtgcgccctcttcgccacctcgtactacgtggtgcaacgtacctcgcaagcccgactgatttcagacacgctggcggccttcaccttctggggttggcaggccgtgatcgtgggcgccgtgctgaccctgccgcagggtttcaccacctccaaggaatacgccgaactggaatggccgctggccatcctcctggcgatcgtctggatcacctacgcgatcgtgttcttcggcaccatcgtcaagcgcaaggtcaagcacatctatgtgggcaactggttctacggtgccttcatcctggtgacggcgatgctgcatatcgtcaaccacatgtcgctgccggtgagctggttcaagtcctactccgcctactccggcgccaccgatgcgatggtccagtggtggtacgggcacaacgccgtgggcttcttcctgaccaccggcttcctcggcatgatgtactacttcgtgcccaagcaggccgagcgtccggtctattcctatcgcctgtccatcgtccacttctgggcgctgatctccctgtacatctgggccggcccgcaccacctgcactacaccgcgctgccggactgggcgcagtcgctgggcatggtgatgtcgctgatcctcctggcaccgagctggggcggcatgatcaacggcatgatgaccctctccggcgcctggcataagctgcgcaccgacccgatcctgcgcttcctggtggtgtccctggccttctacggcatgtccaccttcgaaggcccgatgatggcgatcaagaccgtcaacgccctctcccactacaccgactggaccatcggccacgtgcacgccggcgccctcggctgggtggcgatgatctccatcggctcgctctaccacctgatcccgaaagtcttcggtcgcccgcagatgcacagcatcggcctgatcaacgcgcacttctggctggccaccatcggcaccgtgctgtacatcgcctcgatgtgggtcaacggcatcacccagggcctgatgtggcgcgcggtcaacgaggacggcaccctgacctactccttcgttgaagcactggtcgcaagccacccgggcttcatcgtgcgcatgatcggcggtggtttcttcctcaccggcatgctgctgatggcctacaacacctggcgcaccgtgcgtgctgccaagccggccgaatacgaagccgccgcgcagatcgcctga

SEQ ID NO: 6490 - DNA, 963 bp, Pseudomonas aeruginosa
caaagaatgacgaccttctggagtctgtacattacagctctcaccctcggcaccctgctggcgctgacctggctgatcttcgccacccgcaagggccagcgcagcagcaccaccgacgagaccgtgggccactcctacgacggcatcgaggagtacgacaacccgctgccgaagtggtggttcatgctgttcgtcggcaccctggtgttcgccgtgggctacctggccctgtacccgggcctgggcacctggaaaggcctgatgccgggctaccagtccgccgacgaattcgccgacaaggaaaaaggctggaccggcgtccaccagtgggaaaaggaaatggccaaggccgacgagaaatacggcccgatcttcgccaagttcgccgcgatgcccatcgaggaagtcgccaaggatccgcaggcggtgaaaatgggcggtcgcctgttcgcctccaactgctcgatctgccacggctccgacgccaagggcgcctacggcttccccaacctgaccgacgccgactggcgctggggcggcgagccggaaaccatcaagaccaccatcatggctggccgccacgccgccatgccggcctggggtgaagtgatcggcgaggaaggcgtgaagaacgtcgccgctttcgtcctcacccagatggatggccgtaagctgccggaaggcgccaaggcagacatcgaggccggcaagcaggtcttcgctaccacctgcgtcgcctgccacggtccggaaggcaagggcaccccggcgatgggcgctcccgatctgacccaccccggcgcgttcatctacggctccagcttcgcgcaactgcagcagaccatccgctacggtcgccagggtgtgatgccggcgcaacaggaacacctgggcaacgacaaggtgcacctgctggccgcctacgtatacagcctgtcgcacggcgagaagagcgccgaataa

SEQ ID NO: 6491 - DNA, 639 bp, Pseudomonas aeruginosa
tccgcgtcgtggcgagaagcgcggcccgcgcaagaagtccctcgactacaaggcccagggcctgggcgactgcatcgactgcacgatgtgcgtgcaggtctgcccgaccggcatcgacatccgcgacggcctgcagatcgagtgcatcggctgcgcggcgtgcatcgacgcctgcgacagcatcatggagaagatgaactacccgaaagggctgatcagctacaccaccgagcacaacctcaacggccagaagacccacctggcccggccgcgcctgatcggctacgccatcgccctggtgctgatgatctccgccctgatcaccgcggtggtcctgcgtccgctggtcggcttcgacgtcagcaaggaccgcgtgctctaccgcgagaacgaactcggccgcatcgagaacgtgtacagcctgaagatcatgaacaaggatcagcaggaccacacctacatcctcggcgccaagggcctcgaaggcctgaccctggaaggccggcgcgagctgaaggtggcggcgggcgacatcctcaacctgccgatggaactgtccatcgagccggagaagctgccttcgaccaccaacgagatcgtcttcaccatcgagtcggccgacgacccgagcatccataa

SEQ ID NO: 6492 - DNA, 591 bp, Pseudomonas aeruginosa
agaagcgaagagtcgcttcattggcccacgcacccgttgagtaacttgagcatgcagtccgagacccaccctcaaccctggtacaaacacttctgggcctggttcatcgtggccctcctggcgacctcggtggtgctcgggctgagcctggtcaccatcgcagtgcgcaaccaggacaccctggtcaccgacaactactacgaggccggcaagggcatcaaccgctccctggaacgcgagaacctggccgtacgcctgcaggtgcacgccaaggtcaaggtcgacgacctgaccggcgaagtcgaagtgcgcctgaccggcaacagccgtccggatcggctcaccctcaacctgatctcgccgacccagccggagaaggaccgccgcgtggagctgctgcgcagcaactccgaccgcgagcgctacgtcgggcaactgaccgacgccgtcgagggccgtcgcttcgtcgaactgctcggccaggaaggcagcggccagtggcgtcttttcgaggaagaggtggtatcgccgaccgtggtcatggagctgggtgacgaaccgctccagggagcagaagcgaagcgcccatga

SEQ ID NO: 6493 - DNA, 315 bp, Pseudomonas aeruginosa
ccatggacgtctcggtgtcgctggcgatcggcggcgcctacgtcgccggcatctggtcgacgatcaccggccagggcgagctgtatttcgacgcggtcggcatgttcgccctgttcctcctcgccggccgctacctcgaacgccgcgcgcgggagcgcaccgccgcctccaccgcgcaactggtcaacctgctgccggcgtcctgcctgcgcctggacgccgccaaccagggcgagcgcatcctgctcagcgaactgcgcgtcggcgaccgcgtactggtaccgccaggcgccgtgctgccggccgacggagtga

SEQ ID NO: 6494 - DNA, 456 bp, Pseudomonas aeruginosa
cgctcaagcaggtgctacccctgcgcgatctcgacgcggatcgctgcctggccctcgccgccgccctcgagaaccgttccgaacaccccatcgcccgcgccttcggccgtgcgccggaggccgccgacagcgtcgcaagccatccgggactgggcctcgaaggcctggtggaaggccgccgcctgcgcatcggccaggccgccttcgtcagcaacctgggcggcagcgccacgcccgcgatgcccggcgactccggacagtggctgctgctcggcgacgagcagggaccgctggcctggttcggtctcgacgaccgcctgcgcagcgacgcccccgccctgctcgccgcctgcaaggcgcgcggctggcgcaccctcctgctatccggtgacgcctcgccgatggtcgccagcgtcgctgccgaactgggcatcgacgaagcccgcggcggcctga

SEQ ID NO: 6495 - DNA, 1521 bp, Pseudomonas aeruginosa
tggggcattgacggacgcccgtcccaacatcgggcgacacatcctgtatacattcacccgcttgatacaaatcaacaggccttcccggcgcaatccctagacttcccgactaaagctcgccaactggggatctctggcatgctcgacaccattcgctgggacgctgacctgattcggcgctacgacctttccggcccgcgttacacctcctatccgaccgccgtgcagttccacgaaggcatcggcccgttcgaccagttgcacgccctgcgcgacagccggaaggccggacaccccctgtcgctctacgtgcacatcccgttctgcgccaacatctgctactactgcgcctgcaacaaggtgatcaccaaggatcgcgggcgcagcgcgccgtaccttgcgcgcctggtccgcgagatcgagatcgtcagccgccacctctcccgcgagcaggtggtcgagcaactgcacttcggtggcggaaccccgaccttcctcagtcccggccaattgcgcgaactcatgtcgcaattgcgcacccacctcaacctgctggacgacgattcgggcgactacggcatcgagatcgacccgcgcgaggccgactggtcgaccatgggcctgctccgcgaactcggtttcaaccgcgtcagcctcggcgtacaggacttcgacatggaggtgcagaaggcggtcaaccgcatgcagaccccggaggagacccgtaccatcgtcgaggccgcgcgcaccctgcaataccgctcgatcaacctcgacctgatctacggactgccgaaacagacgccggacagcttcgcccgcacggtcgacgaagtgatcgcgctacagccggatcgcctctcggtgttcaactacgcccacctgcccgagcgtttcatgccgcagcggcggatcaacgccgacgacctgccgagcccgggccagaagctggaaatgctccagcgcaccaccgagcaactcgccgcggcgggctaccgctatatcggcatggatcacttcgccctgcccgacgacgagctggccagcgcccaggaagacggcaccctgcaacgcaatttccagggctacaccacgcacgggcactgtgacctggtaggtctcggggtctcggcgatcagccagatcggcgacctctacagccagaacagcagcgacatcaacgactaccagaccagcctcgacaacggccagttggcgatccgtcgcggcctgcactgcaacagcgacgaccgggtgcggcgcgcggtgatccagcaactgatctgccacttcgaactggccttcgaggatatcgagacagagttcggcatcgacttccgcagttacttcgccgagctgtggcccgatctcgaacgcttcgccgccgacggcctgatccgcctggacgccaagggcatcgacatcacgtcttccggacgtctgctggtgcgttcgatctgcatgctgttcgaccgctacctgcccagcctcaaccggcagcgcttctcccgggtgatctga

SEQ ID NO: 6496 - DNA, 714 bp, Pseudomonas aeruginosa
tcagcgcggaaggcaaggaagtgcacatcctcgactccatcgagctgtgcgccctcgccggcggccagctggaaggctgaagcgcctgcgaaccgccaacgggcccgcctcagcgcgggcccgttgtatgatgggccccgaaaaacgcccagcccaggatcttccatgattttcgacgagttcaccctcaagtcgcagatccgcgccgtgccggactttcccaagcccggcgtggtgttccgcgacatcaccccgctgttccagtcgccacgcgcgctgcgcatgaccgtggacagcttcgtccagcgctacatcgaggccgatttcagccacatcggcgccatggatgcccgcggcttcctcatcggctcggcggtggcctatgcgctgaacaagccgctggtcctgttccgcaagcagggcaagctacccgccgacgtactcgccgagggctaccagaccgaatacggcgaggccttcctcgaagtacatgccgacagcctctgcgaaggcgacagcgtactgatcttcgacgacctcatcgccaccggcgggaccctgctggcggccgcgagcctggtacgacgcctcggggccagggtcttcgaggccgcggcgatcatcgacctgccggaactcggcggctccactcgcctgcaggacgccggcatctccaccttcagtctcaccgcgttcgctctcgacgagcgttga

SEQ ID NO: 6497 - DNA, 1617 bp, Pseudomonas aeruginosa
agtatacagatgtctacattcgcaggtagacgagtgtatacgccagcaaacaatcataataggagcttggccatgagtacccaacccacccctgccgccgcccggcactgcaaggtcgccatcatcggcaccggtttctccgggctggggatggcgatccgtctccgccaggaaggcgaggacgacttcctgatcttcgaaaaggacgccggcgtcggcggcacctggagagtcaacaactaccctggctgcgcctgcgacgtgcaatcccacgtctattccttctccttcgaagcgaacccggagtggacgcggatgttcgcccgccagccggaaatccgcgcctatctggagaagtgctgggaaaaataccgcttgcaggaaaagaccctgctgaacaccgagatcggcaaactggcctgggacgagcggcaaagcctctggcacctgcatgacgcccagggcaaccattacaccgcgaacgccgtggtttccggcatgggcggcctgtccaccccggcctatccacgcctcgatggcctggagaacttccagggcaaggtcttccattcccagcagtgggaccatgactacgacctcaagggcaagcgcgtggcggtgatcggcaccggcgcctcggcgatccagttcgtcccggagatccagccgctggtggccgcgctcgatctctaccagcgcactccgccatggatcctgcccaaacccgaccgggcaatcagcgaaaccgagcgccggcgcttccggcgcttcccgctggtgcagaagctctggcgcggcggcctctacagcctgctcgaagggcgggtgctgggcttcaccttcgccccgcaggtaatgaagctggtgcagcgcctggcgatccgccacatccacaagcagatcaaggatccggaactgcgccgcaaggtcacgccggactacaccatcggctgcaagcgcatcctcatgtcgcacaactactaccctgccctggctgccgccaactccacggtgatcaccgaaggcatccgcgccgtcaccgccaatggaatcgtcgacggcaacggccgggaacgcgaggtcgacgcgatcatcttcggtaccggcttcaccgccaacgatcctatcccccgcggagtggtcttcggtcgcgacggccgcgacctgctggacagctggaccaagggcccggaagcctacaagggcactaccaccgccggcttccccaacctgttcttcctgatgggaccgaacaccggcctcggccacaactcgatggtctacatgatcgagtcgcagatcgcctacgtcctcgatgcgctgaagctgatgaagcgccgcgaactgctcagtctcgaggtcaaggccccggtgcaggaacgctacaacgaatacctccagcgcaagctggaccgcagcgtctggagcgtgggcggttgcaagagctggtacctgcatccggtcagcggccgcaactgcaccctgtggccgggattcacctggcgcttccgtgccctgacccggcagttcgacgcctccgcctaccacctcaccacgacaccgctcgccgccctgagcaacgaagcctgccaacaggccgaaggggtacccgcatga

SEQ ID NO: 6498 - DNA, 717 bp, Pseudomonas aeruginosa
tgctgcgcctggcaccagtgctctaccagcgcctggtcaccgccagcatgcgcctggcagcgcgcttcgcgccgcgcccgaagagcccccagggcgcccagtgaacaggcccgccgggtagccgctaggctgcccggcacgtcatactcgacggccagtctccagggtacggccgtcatgaaccctccccttcctcacttccgctaccatcccgaaccgctcgccagcggcagcatcgaggcttccgccaccacctgccagtgctgtggcaaggctcgtggctacgtctacaccggttcgccctattcccgccacgagttgccgcccggcagcctttgcccctggtgcatagccgacggcagcgcggccgcgcgctacgaagcgagcttttccgacgactatccgctgctcgacgccggcgtcgccgcggatatcgtcaccgaagtctgcgagcgcacgcccggctacacctcctggcagcaggagcgctggctggtttgctgcgaggatgcctgcgcctttcgcggcgacgcggggcgtgaggaaatcgggcaactgggagccgagggcctggcgcagcgcttcgccgatttcgcctggccggctatcacctggcaacgcctcgtcgacgcctatacgcccggcggcaatccggccatctaccgcttcgactgcctgcactgtggccaggcgcattacgacctggacttcacctga

SEQ ID NO: 6499 - DNA, 1419 bp, Pseudomonas aeruginosa
aacgcggccctacaaccccatctgcttgccgatgatctcgttcatgatttcccgcgaaccgccgccgatggagagaatccggttgtcgcgatacagccgctccaccaggctttcgcgcatgtagcccatgccgccgagcacctgcacggcatcataggtcaggcgatcggcgacatcggtggcgaagttcttggccatcgatatctccttgatcacgctcttgccggcggccatcttcgctgcctggcgataggtgaactcccgggaaacctccagttgcgtggccatttccgcgagacgatggcgcagcacctggaacttgccgatcggcttgccgaacgcttctcgctcgcgcgcccagcgcagcgactcctccagagccagttgcgcggtcatgttggccatcaccgccagggccaggcgctcgctctggaaattggccatgatgcaggcgaagccggcattctccacgccgatgaggttttccgcaggcacccggcagtcgtcgaagaacagttcggcggtatccgacgcccaccagcccatcttcttcagcttgcggccgacactgaacccggcagtgcccttctccaccagcagcaggctgatgccggcgaaaccctcgccgccggtacgcaccgccaccgtgtagtagtccgcgcgcacgccgctggtgatgaaggtcttgctgccgctgacgcgatagtgatcgccatcgcgcaccgcacgggtcttcaggttggccacgtcggagccgccagagggctcggtgaccgccagggccatgatcttctcgccgcgcagcaccgccggcactacccgctcgcgcacctcgggacgggcccacttgaccaccggaggcaagccgatatccagcgatcccaacccggcgaccaagccgccggaaccgcagcgcatgagctcttcgctggccgccaccttggcgaacagatcgccttcgcaactgccgccgtaggcttccgggtagccgatgccgaggatcccggccgcgccggccttgagatagagttcgcggggaaattcctcggcctcctcccattcatcgatgtacggcaacacctcgcgctcgacgaaacggcgaaccgaatcccggatcagttgatgggactcgtcgaagtactgctggaagtcagtcatggccgggctcctgatgggagcctcagaacttacctagcgcttgcttggttttcaatacgggaaactggccatcggcgagggcgtataggccgcccgtcctacggatacgggaggcacagagctcaggagatcggccgccgtccggccagggcgtgggccaaggtgccgccatcgaccagctccagctcgccgcccagcggcacgccatgggcgatacgcgacaaggtcaggccgcggccggccagtagctgggcgatatag

SEQ ID NO: 6500 - DNA, 591 bp, Pseudomonas aeruginosa
tcgtcctgctcgtcctgctcgtcaggtgataccggcaacgcagccggcagggcttccagaacggtttccaccaccgcctcgaccgccactgccggagggatcgagggagcttccacggctagcggctcgggctcgggctcgggctcgggctcgggctcgggctcgggctcgggctcgggctcgggctcgggctcggcagcgaggctcggcgccggctcttcccagggcaagtcgacgacctctgccgcggcggcgggctcttcgacaaccgcttccgtgacgcgcgcctcgaccgccgccggcggcgcggatggcgctgccggcggggcagccggggcttcgacgggcgcagccacgacaggcgcgggagcaacggtagcgaccggcgcaggcgaggccgcgccggccacgggggagttggcgggatcagtcgtggccttgctgatccccaggtcctttagcggcgtcctcggcacgccgtcggcgtccgccgggcggaacgcgagcatccgcagcaacaccatctcgaagccgctacgcggatcgggcgccagcggcaggtcgcggcggccgatcaggcccatctggtaa

SEQ ID NO: 6501 - DNA, 1884 bp, Pseudomonas aeruginosa
  unsure (3): Identity of nucleotide at the above locations are unknown.
tanaactgtacgtcttccgccggcaacgcctgggccagggccagcacccgctcgcggtcgccctggccattgtcgatcgcttccggcagggcctgggcgatcgcgacgcggtgcagcacgttgagtatttcggcaagcacgccgccccagtccgggccctgctcggccaggtggcgcaccgcttcgagcagggcgcgcgcatcgccctccagcaaggcctgtgagcacgccatagacctggccgtgatcgagggtaccgagcatcgcccgcacgtctgcggccagcaccttgccctcgccgaaggcgatggcctggtcggtcaggctcatggcgtcacgcatcgagccgtcggcggcgcgcccgagcaaccacagggcgtcatcctcgaagggcacgttctcggctccgagcacgtgggtcaggtgctcgaccacccgctccggcggcatgttcttcagggagaactgcagacagcgcgagaggatggtcaccggcaacttctgcgggtcggtggtggccagcaggaacttgacgtgcggcggcggctcctcgagggtcttgagcagcgcattgaaactgtgcgacgagagcatgtgcacttcgtcgatcaggtagaccttgtagcgtccgcgggtcggcgagtactgcacgttgtcgagcagctcgcgggtatcctcgaccttggtccggctcgcggcgtccacttcgatcaggtcgacgaagcggccttcgtcgatttcgcgacagaccgagcattcgccgcacggcgtggagctgaccccggtctcgcagttcaggcacttggccaggatccgcgcgatggtggtcttgccgaccccgcgggtaccggtgaacaggtaggcatggtgcagccgctggttgtccagggcgttgatcagagccttgagcacatgggtctggccgaccatttcacggaaggaacggggacgccatttacgcgcaagaacttgataactcatcgaaaaccgtcgcagaagggaagcacaagtcggccaatgctagcgcaatttaccccttctgcgctcgccgacttggcaaactgcgtgctaagaattcccctggcccttcagcagccctcgtcggtggcaatgactctaccttccctgacatcgttcatgcctcatttcggcgcacctgcgctgctcctgctgcagttgctcgcggccctgccagcgacggccgcggagaccgacgcgacgccattgcgcttctcggtgatggaaagctggagcatgccgttggtccgcctgcaacggggccagccgatcgacggcatcgtctacgacatcacccgctcccttgcccggcaggtcggccgcaaggcgctctaccacccctacccgcgcgggcgcatcgagcaggcgatgaacgctggcgaaatcgatgtccgctgctacatcagccccgcctggctcagccacgacttccccggctatcgctggagcgtcgcgctgctggtgcaacgcgacatcctggtcgcccgcgaaggcttcgcgccgattcccgaggcgctgccggcccagcgtatcggtaccgtccttggctacagttatccccgcttgcaagcgctgttcgacatcggccgactgcgccgcgacgatgcgcgcacccaggatctggtgctggaaaagctgcgcgccggccgctaccgctacgcggtcagccatcaactgtcgctgcactggagcaaccgccaggcgccggggcagccgccactccaggaagccgcgcagctcgaagagacggcggtgagctgcatggtgcgggactccgcagaggttccggtggaagcgatactgaagacgttcgaggaaatgaagcgcagcggagagatcgaggagatactgcagcgctaccgataa

SEQ ID NO: 6502 - DNA, 477 bp, Pseudomonas aeruginosa
ccccggccgccttggcaaaaacgccaatggtcaggttttccaaattcttttccataccacttgactccgtacatgactacggaagtaaggttacgctatccaattcaaattcgaaaggacaagcgcatgtctgaaccacaaaacgggcgcggcgcgctcttcgctggcgggctagctgccatcctcgcctcgacctgctgcctcgggccgctggttctggttgccttgggcttcagcggggcatggatcggcaacctgaccgtgctggagccgtatcgcccgattttcatcggcgcagcgctggtggcgttgttcttcgcctggcggcgcatctaccgccctacgcaagcctgcaaaccgggtgaggtctgcgcgattccccaaatgcgagcgacttacaagctcattttctgggtcgtggccgtgctggtcctggtcgcactcggatttccctacgtcatgccatttttctactga

SEQ ID NO: 6503 - DNA, 336 bp, Pseudomonas aeruginosa
  unsure (192): Identity of nucleotide at the above locations are unknown.
tcggagttcaccatgaaaacgcaagtttcggcgcaagccaaaaaactgtttgcctccctcgccctcgccgccattgttgcccccgtgtgggccgccactcagaccgtcacgctgtccgtaccgggcatgacctgctccgcctgcccgatcaccgtcaagaaggcgatttccaaggtcgaaggcgtcagcaanggtgacgtgaccttcgagacccgcgaagcggttgtcactttcgatgatgccaagaccagcgtccagaagctcaccaaagcaaccacccgatgcgggctatccctccaccgtcaaagcagtgaaacactgaaacccgaaaccggg

SEQ ID NO: 6504 - DNA, 369 bp, Pseudomonas aeruginosa
tgccccgttggtgagacactgatccctctcgacccactgcatcgcgcccaggcgctggaactggccctgctggtggcctgcgacatccatccgctgaacaacgtgcgggtgctcaagtacctgacccaggtcctcggcatagacgccgaggaccgccagcgctggtacgcgcactgggtcgccgagggcctggcggcggcggagaccctgctgaaccgacaccgtcgcggcgccttcttcgccggcgccgcagcgggcatcgtcgagtgctgcctggtaccgcaactggccaacgcccggcgcatgggctgtgtcctggcgccctacccggcgttgctcgaactggaggggcgctgcctggcgctctga

SEQ ID NO: 6505 - DNA, 693 bp, Pseudomonas aeruginosa
tggcctacaacacttggcgcaccgtcagtgccgccaagccggccgaatacgaagccgccgcacagatcgcctgaggagccgagcatgaaacacgaaatactcgagaaggacgtcggcctgctggcgctatgcatggccgtggccgtgagcatcggcggcctgacccagatcgtgccgctgttttttcaggacgtgaccaacaccccggtcgaaggcatgaagccctataccgcgctgcaactggaaggccgcgacatctatatccgcgaaggctgcgtcggctgccactcgcagatgatccgtccgttccgcgccgaaaccgaacgctacggccactactcggtggccggcgagagcgtctgggaccaccccttcctgtggggttccaagcgtaccggtccagacctggcccgcgtcggtagccgctactccgacgactggcaccgcgcacacctgttcaatccgcgcaacgtggtgcccgagtcgaagatgccggcctacccgtggctggtggagaacaagctcgacggcaaggacatcgagaagaagctcgaagtgatgcgcaccctcggcgtgccctataccgacgaagacatcaagggcgccaaggactcgctgaaaggcaagaccgaaatggatgccgtggtcgcctacctgcaggtgctcggcacctcgatcaagaacaaacggtga

SEQ ID NO: 6506 - DNA, 477 bp, Pseudomonas aeruginosa
cccgcagagcatcgagaccaccatcctcggcggtcgccacgcgatcatggcggcctggggcgacatcctcggcgaagacggggtgaagaacgtcgccgcctacgtccgcaccgaactcgccgggctgaagctgccggaaggcaccaaggccgacgtcgaggccggcaagcagatcttctcggtcaactgcgtcgcctgccacggcccggaaggcaagggtaccgccctggtcggcgcgccgaacctgaccaaccccggcgcgttcatctacggctccagctacgcccagctccaacaaaccatccgccatggccgccagggccagatgccggcccaggagccatacctgggcaaggaaaaggtgcacatcctggccgcctacatctacaacctgtcgcacaaccagggcagcaactgacccctccccccacccgcgccctcccgggcgcgggtccttcccccggtctcagaccttag

SEQ ID NO: 6507 - DNA, 273 bp, Pseudomonas aeruginosa
agccgtgaagggcaagaccgagatggacgccctggtggcgttccttcaaggcctgggaacctctatcaagagcaaacggtgagtgtgatggatatcgggactctgcgtggactgggcaccgtggtgatcatggtcgccttcatcggcctggtgatctgggcctacagcggcaagcgcaagaagagcttcgacgaagcgacgatgctgcccttcgcagacgatcccgaagccaaaaagcacgtcgagcaagcttctaggagtaacaaagaatga

SEQ ID NO: 6508 - DNA, 1467 bp, Pseudomonas aeruginosa
ccctgtcggcatgtaccggccgggcgccccccactgccgtggtacgcactgatgagcaaacagattcccgttcaagacgtcaccccgcctgccaagggcgacaccaataacaacgatctctacgccaagcgcgagaagatctacacccgggccttcaccggtatcttccgccgactgcgcatggtgggcggtgcggcgctcttcctcctctacttcggtaccgtctggctcaactggagcggccgccaggccgtctggtgggacctacccgagcgcaagttctacatcttcggcgccaccttctggccgcaggacttcatgctgctgtcctggctgctgatcgtctgcgccttcggcctgttcttcatcaccgtgttcgccggtcgcgtctggtgtggctatacctgcccgcaaagcgtgtggacctggatctacatgtggtgcgagaaggtcaccgaaggcgaccgcaaccagcgcatcaagctggacaaggccccgatgagcggcaacaagctgctgcgcaagaccgccaagcacagcctgtggctgctgatcggcctggtcaccggcctgaccttcgtcggctacttctcgccgatccgcgagctgattcccgagctgctcaccggccaggccgacggctgggcctacttctgggtcggcttcttcaccctggccacctacggcaacgccggctggctgcgcgagcaggtgtgcatctacatgtgcccctacgcgcgcttccagagcgtgatgttcgacaaggacaccctgatcgtctcctatgatccgcgtcgtggcgagaagcgcggcccgcgcaagaagtccctcgactacaaggcccagggcctgggcgactgcatcgactgcacgatgtgcgtgcaggtctgcccgaccggcatcgacatccgcgacggcctgcagatcgagtgcatcggctgcgcggcgtgcatcgacgcctgcgacagcatcatggagaagatgaactacccgaaagggctgatcagctacaccaccgagcacaacctcaacggccagaagacccacctggcccggccgcgcctgatcggctacgccatcgccctggtgctgatgatctccgccctgatcaccgcggtggtcctgcgtccgctggtcggcttcgacgtcagcaaggaccgcgtgctctaccgcgagaacgaactcggccgcatcgagaacgtgtacagcctgaagatcatgaacaaggatcagcaggaccacacctacatcctcggcgccaagggcctcgaaggcctgaccctggaaggccggcgcgagctgaaggtggcggcgggcgacatcctcaacctgccgatggaactgtccatcgagccggagaagctgccttcgaccaccaacgagatcgtcttcaccatcgagtcggccgacgacccgagcatccataaagaagcgaagagtcgcttcattggcccacgcacccgttga

SEQ ID NO: 6509 - DNA, 1686 bp, Pseudomonas aeruginosa
gggcgagctggcggaaaccagcctgatgatcgaaggcatcagttgcgccgcctgcggctggctgatcgagaagcacctgcgccagttgcctggcgtggccgaggcgcggctcaacctgtccaaccatcgcctgcacgtgcgctggcaggacagccagttgccgctcagccagttgcttggcgaactgcgccagatcggctatgccggccatccctaccaacccgaccgcgccaccgagcgcctggccatggagaaccgtcacgccctgcgccagctcggtgtcgccgggctgctgtggatccaggtgatgatggcggtaatggcgacctggccggaattcaacctcgacctttccgccggcatggaccgcatcctgcgctgggtcagcctgatcctcaccacgccgatcgtcttctactgctgcggccagttcttccgtggcgccctgcgcgacctgcgcacccgccacctgaccatggacgtctcggtgtcgctggcgatcggcggcgcctacgtcgccggcatctggtcgacgatcaccggccagggcgagctgtatttcgacgcggtcggcatgttcgccctgttcctcctcgccggccgctacctcgaacgccgcgcgcgggagcgcaccgccgcctccaccgcgcaactggtcaacctgctgccggcgtcctgcctgcgcctggacgccgccaaccagggcgagcgcatcctgctcagcgaactgcgcgtcggcgaccgcgtactggtaccgccaggcgccgtgctgccggccgacggagtgatcctcgacggccagtccagcgtcgacgagtcgctgctcaccggcgagtacctgccccatccacgccaggccggcgacgccgtcaccggcggcaccctgaacgtcgaggggccgctgaccgtcgaggtcggcgcccttggcgacgacagccgcctgtcggccatcgtccgcctgctggaacgcgcccaggcggacaagccgcgcctggcggaactggccgacaaggtggcgcagtggttcctgctcatcgtcctgctggtcgccgcagcggtcggcgcgctgtggtggcaggtcgaccaccagcgcgccttctgggtggtgctgtcgctgctggtcgccacctgcccctgcgccctgtcgctggccacgcccaccgcgctcaccgcggccaccggcagcctgcacaagctcggcctgctgatcacgcgcgggcacgtgctggaagggctgaaccacatcgacacggtaatcttcgacaagaccggcaccctcaccgaaggccgcctgacgctcaagcaggtgctacccctgcgcgatctcgacgcggatcgctgcctggccctcgccgccgccctcgagaaccgttccgaacaccccatcgcccgcgccttcggccgtgcgccggaggccgccgacagcgtcgcaagccatccgggactgggcctcgaaggcctggtggaaggccgccgcctgcgcatcggccaggccgccttcgtcagcaacctgggcggcagcgccacgcccgcgatgcccggcgactccggacagtggctgctgctcggcgacgagcagggaccgctggcctggttcggtctcgacgaccgcctgcgcagcgacgcccccgccctgctcgccgcctgcaaggcgcgcggctggcgcaccctcctgctatccggtga

SEQ ID NO: 6510 - DNA, 672 bp, Pseudomonas aeruginosa
cgcctcgccgatggtcgccagcgtcgctgccgaactgggcatcgacgaagcccgcggcggcctgaccccggacgacaagctggccatgctcgaacgcctgcacggcgagggccgccgggtgctgatgctcggcgacggagtcaacgacgtaccggtgctcgccggtgccgacatcagcgtcgccatgggcagcgccaccgacctggccaagaccagcgccgacgcggtgctcctgtccaaccgcctggacagcctggtgcaggctttccggctggcgcgccgcacccgccatatcatcatcgagaacctggcctgggccagcctgtacaatggcctggtcctgcccttcgccgcgctcggctggatcaccccgggctgggcggcgatcggcatgtcggtcagttcgctgctggtggtggtcaacgccctgcggctgacccgaatcccttcgccgaggtccgtatggccgcgctctacatcctgatccccgtcgcgatcgtcatcgtcgccatcgccatctacgtgttcttctgggcggtggacagcggccagtacgacgatctcgacggccccgcccacagcattctcttcgacgacgaagacccgaagcaccaggccggcgtcgacgaagcggagaagccgtcgaaacccgaggaccgaccgcgtggctga

SEQ ID NO: 6511 - DNA, 765 bp, Pseudomonas aeruginosa
actggcgccgctgctggtttccgcgctgatcctcggcctgctcgggggaggccactgcctgggcatgtgcggcggcctgatgggcgccctgaccctggccattcccgccgaacagcgcggccgtcgtctgcgcctgctgctggcctacaacctcggccgcatcctcagctacgcctgcgccggcctgctgctcggcctggccggctgggcggtggcgcgcaccccgttggccggcgcgctgcgggtggtcgccgggctgctgctgatcgccatgggactctacctggccggctggtggagcggcctgacccgcgtcgaggcgctcggtcgcggcctctggcgccacctggaacccttcgcccggcgcctgctgccggtctccagcctgccacgggccctgctgctcggagcgatctggggctggctgccctgcgggctggtctacagcaccctactctgggccaccagccagggatcggcactggacagcgcgctgctgatgctggcgttcggcctcggcacctggccggttctgctggccaccggcatggccgccgaacgggtgaccgccctgctgcgccgtcgcggcgtacgcatcgtgggcggcctgatggtcatcctcttcggcctctggaccctcccaggaccgcaccaggcctggctgatggggcattgacggacgcccgtcccaacatcgggcgacacatcctgtatacattcacccgcttgatacaaatcaacaggccttcccggcgcaatccctag

SEQ ID NO: 6512 - DNA, 417 bp, Pseudomonas aeruginosa
tcaccaaggatcgcgggcgcagcgcgccgtaccttgcgcgcctggtccgcgagatcgagatcgtcagccgccacctctcccgcgagcaggtggtcgagcaactgcacttcggtggcggaaccccgaccttcctcagtcccggccaattgcgcgaactcatgtcgcaattgcgcacccacctcaacctgctggacgacgattcgggcgactacggcatcgagatcgacccgcgcgaggccgactggtcgaccatgggcctgctccgcgaactcggtttcaaccgcgtcagcctcggcgtacaggacttcgacatggaggtgcagaaggcggtcaaccgcatgcagaccccggaggagacccgtaccatcgtcgaggccgcgcgcaccctgcaataccgctcgatcaacctcgacctga

SEQ ID NO: 6513 - DNA, 891 bp, Pseudomonas aeruginosa
acaccaaggcattacctctccccacttcccgtctggtctcccgcgagcgtcactggaccggcgacctctagctccctccctcgacacctgctgtcggtggcgaccgcccctgcgcttcgcggtctttcccgcccctcgccaccgctcttcgtcatctttggccgcggcctccattccgcggtgcccatgggagggcaacatgcgttcctggatctatctgttactggctatcggcgccgaagtgatcggcaccacctcgatgaaactggccgccacccacgcccctgtcgcaggcatgctgctgatgtacgggatgatcggcctgtcctatttcttcctcgccctggcggtcaagcgtgtccccgtcggagtcgcctacgccctttgggaaggcattggcatcgtcctgatcacggcggtcagcgtcgcctggctgggcgaaagcatcggcctgtacaaggccgtcggcctcggcgtgatgatcgccggcatcctgctgatcaagtccggcacccgcaacgccagcggcacgccggcgcagccccgtggggaggccgtcacatgctgaccctgaactggattcccttcgcctggctcggcctggcgatcgcccttgaggtcgtcgccaacctgctgttgaaatactccgacggtttccgcaggcgcggcctcgggatcgcctcgatcctctgcgtgatggccgccttcaccgcgctggcgcaggcggtgaaggacatcgagctgtcactcgcctatgcgatctggggcggcttcggcatcctcgccaccgtcgccatgggctgggcgctgttcggccagcgcctggcctggcgcggctggctcggcctgttgctgctgctggccggcatgagcctgctcaagctggcctga

SEQ ID NO: 6514 - DNA, 546 bp, Pseudomonas aeruginosa
acagcgcgctctggcccggatcgagatgcagatgccagtggtcgccgtcggcagctaccagcgtacagttggcaccgatgctggcggtcaggccgccgaggccgagccgcgggaacagctccagccactccgcggccaggccggtggccggcttcgccgccggcagcggctcctccaccacgaccacgtcaggctcgggcgcggcatccaagtaggccagggtatccatgtcgacttcgtagtagtcgtctgcgggcggtggctagtcgtcctgctcgtcctgctcgtcaggtgataccggcaacgcagccggcagggcttccagaacggtttccaccaccgcctcgaccgccactgccggagggatcgagggagcttccacggctagcggctcgggctcgggctcgggctcgggctcgggctcgggctcgggctcgggctcgggctcgggctcgggctcggcagcgaggctcggcgccggctcttcccagggcaagtcgacgacctctgccgcggcggcgggctcttcgacaaccgcttccgtga

SEQ ID NO: 6515 - DNA, 822 bp, Pseudomonas aeruginosa
agaaggagaatgcaaatgagtcaagctacaccctgcaccaccactcccaccaacaacaccaataccaccgccctactcactcccgctgaattcgaagcaatccggctttacagcgaggaaggcctgtccatcgaaaacgtcaggaagaccactggcctgccaaatcatcacgtgagagccctcctcaaaggcaaacctcgggcactgaatacgcccctcagcaagtccgtagcccgagtctatgagttagcgatccgccccctaggcatcaaggactatgagctacgtgacattctgcacgaagaatacggcagcaattgggatgagcagaaaggctgctaccacgccaagaccacccctgacaccatcaagcaggtgaaagagaaggtgcgagaccgagcacgccgtgaaggtcaatccgtcatattcgtaatggactgggtgtgcgacagcttggcaaccgaaagtcgagttttccttgagagtgccgccttgagcctcatggcacgtgtagatgagtgcgtcaatgagttcatggagcgcttcgcggcccacgcaacggaagacagcgaagaagctgatcttgcccattgcaagcaggcatacgcagcacgcagacatttgctgaagcttgtgagcggcttacacccggaaccgaattcatcgctgctggagagaacgacagcagttacagacgcgcttgatgggataagcgatctgccagcaccgccagtgccccgacaagagcctgcggggctaataccagagccatcgaacagtaatgccttcctcgactatatcgaagctcaaggctggctctag

SEQ ID NO: 6516 - DNA, 402 bp, Pseudomonas aeruginosa
  unsure (211): Identity of nucleotide at the above locations are unknown.
cgacgcaatcagcgggcacgaaacattcccctttcgggcatggcaggcgcacacaagattagacaggacggcctccatgcgcgccaggtcggccatcttttcgcgcacgtcttggagcttgtgctcagccaagctgctggcttcctcgcagtgggtgccatcgtcgagccgcaacagctcggcaatctcatccaggctgaagcccagccgntgggccgactttacaaagcgcacccgcgttacatccgccgcgccatagcggcgaatgctgccgtaaggcttgtccggttccggcaacaagcccttgcgctggtagaaccggatggtctttacattgaccccggccgccttggcaaaaacgccaatggtcaggttttccaaattcttttccataccacttga

SEQ ID NO: 6517 - DNA, 933 bp, Pseudomonas aeruginosa
caaagaatgaccaccttctggagtctgtacatcacagctcttaccgtcggtaccttgatcgccctgctctggctggtcttcgccacccgcaagggcgaggccaagggtactaccgaaaagaccatgggccactcctacgacggcatcgaggagtacgacaacccgctgccgaagtggtggttcatgctgtacatcggcaccatcgtcttctccgtcggctacctggtcctgtacccgggcctgggtaactggaaaggcgtactgccgggctacgagggcggctggacccaggacaagcagtgggaacgcgaaatgaacatcgcccaggagaagtacgggccgatcttcgccaagtacgccgccatgcccatcgaggaagtggccaaggacgagcacgccatgaagatgggcagccgcatgttcgccacctactgctcgatctgccacggttccgacgccaagggcgccctcggcttccccaacctggccgacaacgagtggcgctggggcggtgacccgcagagcatcgagaccaccatcctcggcggtcgccacgcgatcatggcggcctggggcgacatcctcggcgaagacggggtgaagaacgtcgccgcctacgtccgcaccgaactcgccgggctgaagctgccggaaggcaccaaggccgacgtcgaggccggcaagcagatcttctcggtcaactgcgtcgcctgccacggcccggaaggcaagggtaccgccctggtcggcgcgccgaacctgaccaaccccggcgcgttcatctacggctccagctacgcccagctccaacaaaccatccgccatggccgccagggccagatgccggcccaggagccatacctgggcaaggaaaaggtgcacatcctggccgcctacatctacaacctgtcgcacaaccagggcagcaactga

SEQ ID NO: 6518 - DNA, 612 bp, Pseudomonas aeruginosa
atgaagaaccacgaaatactcgagaagaacgtcggcctgctggccatcttcatggtgatcgccgtcagcatcggcggcctgacccagatcgttccgctgttcttccaggacgtgaccaataccccggtcgaaggcatgaagccgcgtaccgccctggaactggaaggtcgcgacatctacatccgcgaaggctgcgtcggctgccactcgcagatggtccgtccgttccgtgccgagaccgaacgctacggccattactcggtcgccggtgaaagcgtctgggaccacccgttcctgtggggttccaagcgtaccggcccggacctggcccgcgtcggcggccgttactccgacgactggcaccgcgcgcacctgtacaacccgcgcaacgtggtgcccgagtcgaagatgcctgcctacccgtggctggtagagaacaagcttgatggcaaggacaccgccaccaagatggaagtcctgcgcaagctgggcgtgccttacaccgacgaggacatcgccggtgcacgtgaagccgtgaagggcaagaccgagatggacgccctggtggcgttccttcaaggcctgggaacctctatcaagagcaaacggtga

SEQ ID NO: 6519 - DNA, 2469 bp, Pseudomonas aeruginosa
cgaaccgctccagggagcagaagcgaagcgcccatgagcgcccccctgccctgctaccactgcggcttgccggtccccgccggcagccgcttcgaggcccgcgtgctcggcgagacgcgggccatgtgctgtccgggctgccaggcggtggccgaggccatcgtcgccggcggcctggaaagctactaccggcaccgcagcgaaaacgccgccaatcccgaagccttgcccaaggcgctcagcgaagagttgcagctctacgaccgcccggacgtacagcgcggcttcgtccgccatgagggcgagctggcggaaaccagcctgatgatcgaaggcatcagttgcgccgcctgcggctggctgatcgagaagcacctgcgccagttgcctggcgtggccgaggcgcggctcaacctgtccaaccatcgcctgcacgtgcgctggcaggacagccagttgccgctcagccagttgcttggcgaactgcgccagatcggctatgccggccatccctaccaacccgaccgcgccaccgagcgcctggccatggagaaccgtcacgccctgcgccagctcggtgtcgccgggctgctgtggatccaggtgatgatggcggtaatggcgacctggccggaattcaacctcgacctttccgccggcatggaccgcatcctgcgctgggtcagcctgatcctcaccacgccgatcgtcttctactgctgcggccagttcttccgtggcgccctgcgcgacctgcgcacccgccacctgaccatggacgtctcggtgtcgctggcgatcggcggcgcctacgtcgccggcatctggtcgacgatcaccggccagggcgagctgtatttcgacgcggtcggcatgttcgccctgttcctcctcgccggccgctacctcgaacgccgcgcgcgggagcgcaccgccgcctccaccgcgcaactggtcaacctgctgccggcgtcctgcctgcgcctggacgccgccaaccagggcgagcgcatcctgctcagcgaactgcgcgtcggcgaccgcgtactggtaccgccaggcgccgtgctgccggccgacggagtgatcctcgacggccagtccagcgtcgacgagtcgctgctcaccggcgagtacctgccccatccacgccaggccggcgacgccgtcaccggcggcaccctgaacgtcgaggggccgctgaccgtcgaggtcggcgcccttggcgacgacagccgcctgtcggccatcgtccgcctgctggaacgcgcccaggcggacaagccgcgcctggcggaactggccgacaaggtggcgcagtggttcctgctcatcgtcctgctggtcgccgcagcggtcggcgcgctgtggtggcaggtcgaccaccagcgcgccttctgggtggtgctgtcgctgctggtcgccacctgcccctgcgccctgtcgctggccacgcccaccgcgctcaccgcggccaccggcagcctgcacaagctcggcctgctgatcacgcgcgggcacgtgctggaagggctgaaccacatcgacacggtaatcttcgacaagaccggcaccctcaccgaaggccgcctgacgctcaagcaggtgctacccctgcgcgatctcgacgcggatcgctgcctggccctcgccgccgccctcgagaaccgttccgaacaccccatcgcccgcgccttcggccgtgcgccggaggccgccgacagcgtcgcaagccatccgggactgggcctcgaaggcctggtggaaggccgccgcctgcgcatcggccaggccgccttcgtcagcaacctgggcggcagcgccacgcccgcgatgcccggcgactccggacagtggctgctgctcggcgacgagcagggaccgctggcctggttcggtctcgacgaccgcctgcgcagcgacgcccccgccctgctcgccgcctgcaaggcgcgcggctggcgcaccctcctgctatccggtgacgcctcgccgatggtcgccagcgtcgctgccgaactgggcatcgacgaagcccgcggcggcctgaccccggacgacaagctggccatgctcgaacgcctgcacggcgagggccgccgggtgctgatgctcggcgacggagtcaacgacgtaccggtgctcgccggtgccgacatcagcgtcgccatgggcagcgccaccgacctggccaagaccagcgccgacgcggtgctcctgtccaaccgcctggacagcctggtgcaggctttccggctggcgcgccgcacccgccatatcatcatcgagaacctggcctgggccagcctgtacaatggcctggtcctgcccttcgccgcgctcggctggatcaccccgggctgggcggcgatcggcatgtcggtcagttcgctgctggtggtggtcaacgccctgcggctgacccgaatcccttcgccgaggtccgtatggccgcgctctacatcctga

SEQ ID NO: 6520 - DNA, 864 bp, Pseudomonas aeruginosa
tccccgtcgcgatcgtcatcgtcgccatcgccatctacgtgttcttctgggcggtggacagcggccagtacgacgatctcgacggccccgcccacagcattctcttcgacgacgaagacccgaagcaccaggccggcgtcgacgaagcggagaagccgtcgaaacccgaggaccgaccgcgtggctgaactggcgccgctgctggtttccgcgctgatcctcggcctgctcgggggaggccactgcctgggcatgtgcggcggcctgatgggcgccctgaccctggccattcccgccgaacagcgcggccgtcgtctgcgcctgctgctggcctacaacctcggccgcatcctcagctacgcctgcgccggcctgctgctcggcctggccggctgggcggtggcgcgcaccccgttggccggcgcgctgcgggtggtcgccgggctgctgctgatcgccatgggactctacctggccggctggtggagcggcctgacccgcgtcgaggcgctcggtcgcggcctctggcgccacctggaacccttcgcccggcgcctgctgccggtctccagcctgccacgggccctgctgctcggagcgatctggggctggctgccctgcgggctggtctacagcaccctactctgggccaccagccagggatcggcactggacagcgcgctgctgatgctggcgttcggcctcggcacctggccggttctgctggccaccggcatggccgccgaacgggtgaccgccctgctgcgccgtcgcggcgtacgcatcgtgggcggcctgatggtcatcctcttcggcctctggaccctcccaggaccgcaccaggcctggctgatggggcattga

SEQ ID NO: 6521 - DNA, 753 bp, Pseudomonas aeruginosa
cctagcaaggacccctcaatggccgaaaccatcaaggtgcgcgcactgccccaagcacactgcaaggattgcagtctggccccgctgtgcctccccctgtcgctgaccgtggaagacatggattcgctggacgagatcgtcaagcgcggtcgtcccctgaagaaaggcgaattcctgttccgccagggcgatcctttcggctcggtctttgccgtgcgctccggcgccctgaaaaccttcagcatcaccgatgccggcgaagagcagatcaccggcttccacctgcccagcgagctggtcggcctgtccgggatggataccgagacctatccggtatccgcccaggccctggaaaccacctcggtctgcgagattcccttcgagcgcctggacgaactgtccgagcagctgccgcagctgcgccgtcaactgatgcgcctgatgagccgggaaatccgcgatgaccagcagatgatgctgctgctgtcgaagaagactgccgacgagcgcatcgccaccttcctggtcaacctgtcggcgcgcttccgtgcccgtggcttctccgcccagcagttccgcctggccatgtcgcgtaacgagatcggcaactatctcggcctggccgtggaaaccgtgtcgcgggtcttcacccgcttccagcagaacggcctgatcagcgcggaaggcaaggaagtgcacatcctcgactccatcgagctgtgcgccctcgccggcggccagctggaaggctga

SEQ ID NO: 6522 - DNA, 927 bp, Pseudomonas aeruginosa
cacattcagaggtgttatagcgaactcgccatagggaacccgaggaaacctgtgcgtttcccctccccagaacaacaaaaggagttagccatgactgccactggcaccgcctccccggttcgcgccaatttccccgtgcggcggatggatttcagcttcagcgaaaccccgaagtactggtgggacggccaacccttcatgacccagttcatgaacaacctgtcctcgcttttcccctacggcgaaaaattcttcgtcgatagcgtgcgcgcggtgcgcgaccgcctggaggatccgcaactgaagaaggacgtcagcgccttcatcggccaggaggcgatgcactccaaggagcatgccgcctacaacgaatatgccgaggagcacggggtcgacctggagtgcctcgaactgcggatcaaggtcctgctggaaaacgtcagcaaggtcaccaccaggaaacaccagttggcgatcacctgcgccctcgagcatttcaccgcgaccatggccgcgcagctgctcaagcgcgaagacctgaccatccagatgcagtcgccgaagatgtacaagctgtggatgtggcatgccatcgaggagaacgaacacaagaatgtcgcctacgatgtgtaccagaaagcctacggcggctacttcacccgggttctggtgatgatgctgaccaccctgatgttcttcggcgtcatcggctggttccagctcgacctgctacgcaaggacggccaattgttcaactggcgctcctggaagcatggcctgggcaccctgttcggcctgcgcaagggcttcttcacccgcctgctgctgccctacctggactactaccggccgggcttccaccccagcgaccacgacaccgcgaaactggagaaatactggaaggacaaactggccttcgccgattga

SEQ ID NO: 6523 - DNA, 588 bp, Pseudomonas aeruginosa
tatcatgttcattatgttgaacaccaaggcattacctctccccacttcccgtctggtctcccgcgagcgtcactggaccggcgacctctagctccctccctcgacacctgctgtcggtggcgaccgcccctgcgcttcgcggtctttcccgcccctcgccaccgctcttcgtcatctttggccgcggcctccattccgcggtgcccatgggagggcaacatgcgttcctggatctatctgttactggctatcggcgccgaagtgatcggcaccacctcgatgaaactggccgccacccacgcccctgtcgcaggcatgctgctgatgtacgggatgatcggcctgtcctatttcttcctcgccctggcggtcaagcgtgtccccgtcggagtcgcctacgccctttgggaaggcattggcatcgtcctgatcacggcggtcagcgtcgcctggctgggcgaaagcatcggcctgtacaaggccgtcggcctcggcgtgatgatcgccggcatcctgctgatcaagtccggcacccgcaacgccagcggcacgccggcgcagccccgtggggaggccgtcacatgctga

SEQ ID NO: 6524 - DNA, 267 bp, Pseudomonas aeruginosa
aaggtgttcggattcaggcccgcctcgcgcgccagctcgcgcaagccgatggcccccaggctgcggctgctgctgcccaggcgcaaggccgcctccagcaaggcgcgtttgccgggagcgtcggcaaccctgtccttcgtttcgttcatatcgctcatgttccacctggttgtttccatgcgccacaagttcggccgttgcgccgcgacgaccctacctaaggttggcttgaccctgaagtatacagatgtctacattcgcaggtag

SEQ ID NO: 6525 - DNA, 1899 bp, Pseudomonas aeruginosa
ctacgacctcaagggcaagcgcgtggcggtgatcggcaccggcgcctcggcgatccagttcgtcccggagatccagccgctggtggccgcgctcgatctctaccagcgcactccgccatggatcctgcccaaacccgaccgggcaatcagcgaaaccgagcgccggcgcttccggcgcttcccgctggtgcagaagctctggcgcggcggcctctacagcctgctcgaagggcgggtgctgggcttcaccttcgccccgcaggtaatgaagctggtgcagcgcctggcgatccgccacatccacaagcagatcaaggatccggaactgcgccgcaaggtcacgccggactacaccatcggctgcaagcgcatcctcatgtcgcacaactactaccctgccctggctgccgccaactccacggtgatcaccgaaggcatccgcgccgtcaccgccaatggaatcgtcgacggcaacggccgggaacgcgaggtcgacgcgatcatcttcggtaccggcttcaccgccaacgatcctatcccccgcggagtggtcttcggtcgcgacggccgcgacctgctggacagctggaccaagggcccggaagcctacaagggcactaccaccgccggcttccccaacctgttcttcctgatgggaccgaacaccggcctcggccacaactcgatggtctacatgatcgagtcgcagatcgcctacgtcctcgatgcgctgaagctgatgaagcgccgcgaactgctcagtctcgaggtcaaggccccggtgcaggaacgctacaacgaatacctccagcgcaagctggaccgcagcgtctggagcgtgggcggttgcaagagctggtacctgcatccggtcagcggccgcaactgcaccctgtggccgggattcacctggcgcttccgtgccctgacccggcagttcgacgcctccgcctaccacctcaccacgacaccgctcgccgccctgagcaacgaagcctgccaacaggccgaaggggtacccgcatgaagtcgttcgaaaacaaagtcgccgccatcaccggcgcaggctcgggcatcggtcgcgccctggccgtggagctgggcaggcagggttgtcacctggccctggccgacgtcaatgccgcagctctcgaggaaacccgccaattgctcgccagcagcggggtacgcgtctccaccgcggtcgtcgacgtggccgaccgcgagcaggtgcaggcctgggccgacaaggcggccagcgaacatggccgggtgaacctgattttcaacaacgcgggcgtcgcccacgccggtaccgtggaaggcagcgactactcggaatacgagtggatcatgaacatcaacttctggggcgtggtgaacggcaccaaggcgttccttccgcacctgaaggcctccggcaacggccacgtggtcaatgtctccagcgtcttcgggctgttcgcccagcccggcatgagcgcctacaacgccaccaagtacgcggtgcgcggcttcaccgagtcgttgcgccaggaactggacatggaggactccggcgtctccgccagttgcgtgcatcccggcgggatcaagaccaacatcgccaagaccgcgcgaatgaacgagagcatggccaaggtcaccggccaggctccggacaaggctcgcgagcaattcaacgaccagttgctgcggaccaccccggagaaggccgcccaggtcatcctgcgcggcgtgcagcgcgacagccggcgcatcctgatcggcaccgacgcccacgcgatcgacgtgatgctgcgcctggcaccagtgctctaccagcgcctggtcaccgccagcatgcgcctggcagcgcgcttcgcgccgcgcccgaagagcccccagggcgcccagtga

SEQ ID NO: 6526 - DNA, 489 bp, Pseudomonas aeruginosa
ctgggcgatatagtgggcggtggcctcgccttcgacggtggggttggtggcgaggatcacctcgctgaaggctccgtccctgatccgcgcttccagttcgggaatgccgatcgcctccggccccaggccgtcgagcggcgacaggtgtcccttgagcacgaaatagcggccgcggtagccggtctgctccaccgcgaatacgtccagcgggccttccaccacgcagagcagcgagtcgtcgcgtcgcgggtcggcgcactgcgggcacaactcctcctcgctgagggtacggcactgccggcaatgaccgaccccttccatcgcggcggtcaacgcctgggccagcttcaggccgccgctgcgatcgcgctccagcagcatcagcgccatgcgctgggccgacttctgcccgacaccgggaagaatgcgcagggactcgatcagttggcggatcagcgggctgaaactcatgcaggactcgtcggatag

SEQ ID NO: 6527 - DNA, 978 bp, Pseudomonas aeruginosa
agggaggggaatggctgccgggcgccgtccgaagaaggcggacccggcacgaacgcgggatcagaagggcatcttgaagccgggcggcagttgcatgcccgaggtgaagccggacatcttttcctggttgttctgctcgatcttgcgcaccgcatcgttgaccgcggccgcgatcaggtcttcgaggatttccttgtcttcctgcatcaggctgtcgtccaggctgacgcgcttgacgtcgtggcgcccggtcatcaccacgctgaccagaccggcgccggattgcccggtcacttcggcgttggccagttcttcctgcatcttctgcatcttttcctgcatctgctgcgcctgcttcatcaggccggccatgccacctttcatcatgttcttcacctcgaatgtcgtcttgttgcgtgcgccaagcgccggtcaggccttggcttccaaaggttcgatggtaccgtcacggaccaccgcggcgaactgctcgcgcaactgccggaccaacgggtcggcatcgatcgatgcctcggccgcccgctggcgctcggcacgccggcgtgccgctgcctgagccggggtctcctgctcaggcttctgcagggtcacctccagtttgagggtgcgccccaggtgctggttcagcgcatcgttcagccgccgctgctgggtggcgttgaacagcgcgctctggcccggatcgagatgcagatgccagtggtcgccgtcggcagctaccagcgtacagttggcaccgatgctggcggtcaggccgccgaggccgagccgcgggaacagctccagccactccgcggccaggccggtggccggcttcgccgccggcagcggctcctccaccacgaccacgtcaggctcgggcgcggcatccaagtaggccagggtatccatgtcgacttcgtagtagtcgtctgcgggcggtggctagtcgtcctgctcgtcctgctcgtcaggtga

SEQ ID NO: 6528 - DNA, 1398 bp, Pseudomonas aeruginosa
cagtgttccactctgctgtaccacttcggtgtcacactcatgacttacgtaatccgtcgcggagccatctactacctgaatctccggctgcccaagcatctctttccgcaccgtcacactcttcgcttgagccttgatgtgcgggacaggaagaacgctgtgtttctcgccagcgccctcacccagcgggttcatctgcacatcactgataagccactcactactctggagcagcttcgtgccctctgcatccagtggcgtgaaggagcgccagcacctatcccgttgcccatacatcgtagccagcaaacaccctcaactaccctaaccactgcggcaggaaactctccgctgcttagcacactgtcgaagatctatataaaggaaggacaacgcggcggtacatggcgagaagtcagcagcctcgacgtacagcgggcgcttcgggatttcttcgagctgatgggcgacatgccagccgaccactttacagctgaggtagcacggacactcaaggctcgactcagccggtgcccgcaatactttgcccaacgaccggagttcaaaggtatgtcgctgcgacaggtagtcgagtcagcgaaggattatcaaaccatcaccgcagtgacgatcaacaaccgtttacggaagctcaccgccttcttcaactggtgcaaatccaacggatatatcgagcagaacccattagccgggatgaaggtcatggctggcgctgcgaaagatgcgcgtctctccttcgaccgatctgaccttctggtgttgctgaacctcgacactcttcgccaagaggcccgcaagcatccttggagattctggcttcccctgctcgcccgtttcactggtgcgcgactggaggagctttgccagcttcacacgacaaacgtcatcgaagtacagggagttccgtgcattcagatcgacgacagtcatgatggacagaagttgaagaatcagagcagccgtagaactctccccatccatcctgcactgatcaccatcgggctgcgggagtatgtcgaatcgattggggcgaacggtgccacgagactatttcccgatctggaacccacacgaggcaaatacggacatgctccatcgaagtggttcagcaggtacaagaccaagatgggcataaccgatcctcggaagaccttccatagcttccggcatacgttcatcgacgatctccgagaggcaggtgtgcaggattcattaatcaagcagatggttggccatgaggatggttcggtaactttcggagtctatggaagtcgcttgcaagttaccgccatgcggcaagcactcaacgccatcgaaatagatcaagccatacggaaaatgcaagtagatattgacagccggccgaaatataggtaa

SEQ ID NO: 6529 - DNA, 297 bp, Pseudomonas aeruginosa
  unsure (249): Identity of nucleotide at the above locations are unknown.
ggcgtctccgaccttgccaagcttgtttcgccctgtagcgacgcaatcagcgggcacgaaacattcccctttcgggcatggcaggcgcacacaagattagacaggacggcctccatgcgcgccaggtcggccatcttttcgcgcacgtcttggagcttgtgctcagccaagctgctggcttcctcgcagtgggtgccatcgtcgagccgcaacagctcggcaatctcatccaggctgaagcccagccgntgggccgactttacaaagcgcacccgcgttacatccgccgcgccatag

SEQ ID NO: 6530 - DNA, 594 bp, Pseudomonas aeruginosa
  unsure (97): Identity of nucleotide at the above locations are unknown.
cccgcatcgggtggttgctttggtgagcttctggacgctggtcttggcatcatcgaaagtgacaaccgcttcgcgggtctcgaaggtcacgtcaccnttgctgacgccttcgaccttggaaatcgccttcttgacggtgatcgggcaggcggagcaggtcatgcccggtacggacagcgtgacggtctgagtggcggcccacacgggggcaacaatggcggcgagggcgagggaggcaaacagttttttggcttgcgccgaaacttgcgttttcatggtgaactccgatcagtagaaaaatggcatgacgtagggaaatccgagtgcgaccaggaccagcacggccacgacccagaaaatgagcttgtaagtcgctcgcatttggggaatcgcgcagacctcacccggtttgcaggcttgcgtagggcggtagatgcgccgccaggcgaagaacaacgccaccagcgctgcgccgatgaaaatcgggcgatacggctccagcacggtcaggttgccgatccatgccccgctgaagcccaaggcaaccagaaccagcggcccgaggcagcaggtcgaggcgaggatggcagctag

SEQ ID NO: 6531 - DNA, 1077 bp, Pseudomonas aeruginosa
  unsure (1018): Identity of nucleotide at the above locations are unknown.
cattggccgacttgtgcttcccttctgcgacggttttcgatgagttatcaagttcttgcgcgtaaatggcgtccccgttccttccgtgaaatggtcggccagacccatgtgctcaaggctctgatcaacgccctggacaaccagcggctgcaccatgcctacctgttcaccggtacccgcggggtcggcaagaccaccatcgcgcggatcctggccaagtgcctgaactgcgagaccggggtcagctccacgccgtgcggcgaatgctcggtctgtcgcgaaatcgacgaaggccgcttcgtcgacctgatcgaagtggacgccgcgagccggaccaaggtcgaggatacccgcgagctgctcgacaacgtgcagtactcgccgacccgcggacgctacaaggtctacctgatcgacgaagtgcacatgctctcgtcgcacagtttcaatgcgctgctcaagaccctcgaggagccgccgccgcacgtcaagttcctgctggccaccaccgacccgcagaagttgccggtgaccatcctctcgcgctgtctgcagttctccctgaagaacatgccgccggagcgggtggtcgagcacctgacccacgtgctcggagccgagaacgtgcccttcgaggatgacgccctgtggttgctcgggcgcgccgccgacggctcgatgcgtgacgccatgagcctgaccgaccaggccatcgccttcggcgagggcaaggtgctggccgcagacgtgcgggcgatgctcggtaccctcgatcacggccaggtctatggcgtgctcacaggccttgctggagggcgatgcgcgcgccctgctcgaagcggtgcgccacctggccgagcagggcccggactggggcggcgtgcttgccgaaatactcaacgtgctgcaccgcgtcgcgatcgcccaggccctgccggaagcgatcgacaatggccagggcgaccgcgagcgggtgctggccctggcccaggcgttgccggcggaagacgtacagttntattaccagatgggcctgatcggccgccgcgacctgccgctggcgcccgatccgcgtag

SEQ ID NO: 6532 - DNA, 405 bp, Pseudomonas aeruginosa
tcccgccaactcccccgtggccggcgcggcctcgcctgcgccggtcgctaccgttgctcccgcgcctgtcgtggctgcgcccgtcgaagccccggctgccccgccggcagcgccatccgcgccgccggcggcggtcgaggcgcgcgtcacggaagcggttgtcgaagagcccgccgccgcggcagaggtcgtcgacttgccctgggaagagccggcgccgagcctcgctgccgagcccgagcccgagcccgagcccgagcccgagcccgagcccgagcccgagcccgagcccgagcccgagccgctagccgtggaagctccctcgatccctccggcagtggcggtcgaggcggtggtggaaaccgttctggaagccctgccggctgcgttgccggtatcacctga

SEQ ID NO: 6533 - DNA, 1152 bp, Pseudomonas aeruginosa
cggtaccatcgaacctttggaagccaaggcctgaccggcgcttggcgcacgcaacaagacgacattcgaggtgaagaacatgatgaaaggtggcatggccggcctgatgaagcaggcgcagcagatgcaggaaaagatgcagaagatgcaggaagaactggccaacgccgaagtgaccgggcaatccggcgccggtctggtcagcgtggtgatgaccgggcgccacgacgtcaagcgcgtcagcctggacgacagcctgatgcaggaagacaaggaaatcctcgaagacctgatcgcggccgcggtcaacgatgcggtgcgcaagatcgagcagaacaaccaggaaaagatgtccggcttcacctcgggcatgcaactgccgcccggcttcaagatgcccttctgatcccgcgttcgtgccgggtccgccttcttcggacggcgcccggcagccattcccctccctctatccgacgagtcctgcatgagtttcagcccgctgatccgccaactgatcgagtccctgcgcattcttcccggtgtcgggcagaagtcggcccagcgcatggcgctgatgctgctggagcgcgatcgcagcggcggcctgaagctggcccaggcgttgaccgccgcgatggaaggggtcggtcattgccggcagtgccgtaccctcagcgaggaggagttgtgcccgcagtgcgccgacccgcgacgcgacgactcgctgctctgcgtggtggaaggcccgctggacgtattcgcggtggagcagaccggctaccgcggccgctatttcgtgctcaagggacacctgtcgccgctcgacggcctggggccggaggcgatcggcattcccgaactggaagcgcggatcagggacggagccttcagcgaggtgatcctcgccaccaaccccaccgtcgaaggcgaggccaccgcccactatatcgcccagctactggccggccgcggcctgaccttgtcgcgtatcgcccatggcgtgccgctgggcggcgagctggagctggtcgatggcggcaccttggcccacgccctggccggacggcggccgatctcctgagctctgtgcctcccgtatccgtaggacgggcggcctatacgccctcgccgatggccagtttcccgtattga

SEQ ID NO: 6534 - DNA, 1182 bp, Pseudomonas aeruginosa
gtaagttctgaggctcccatcaggagcccggccatgactgacttccagcagtacttcgacgagtcccatcaactgatccgggattcggttcgccgtttcgtcgagcgcgaggtgttgccgtacatcgatgaatgggaggaggccgaggaatttccccgcgaactctatctcaaggccggcgcggccgggatcctcggcatcggctacccggaagcctacggcggcagttgcgaaggcgatctgttcgccaaggtggcggccagcgaagagctcatgcgctgcggttccggcggcttggtcgccgggttgggatcgctggatatcggcttgcctccggtggtcaagtgggcccgtcccgaggtgcgcgagcgggtagtgccggcggtgctgcgcggcgagaagatcatggccctggcggtcaccgagccctctggcggctccgacgtggccaacctgaagacccgtgcggtgcgcgatggcgatcactatcgcgtcagcggcagcaagaccttcatcaccagcggcgtgcgcgcggactactacacggtggcggtgcgtaccggcggcgagggtttcgccggcatcagcctgctgctggtggagaagggcactgccgggttcagtgtcggccgcaagctgaagaagatgggctggtgggcgtcggataccgccgaactgttcttcgacgactgccgggtgcctgcggaaaacctcatcggcgtggagaatgccggcttcgcctgcatcatggccaatttccagagcgagcgcctggccctggcggtgatggccaacatgaccgcgcaactggctctggaggagtcgctgcgctgggcgcgcgagcgagaagcgttcggcaagccgatcggcaagttccaggtgctgcgccatcgtctcgcggaaatggccacgcaactggaggtttcccgggagttcacctatcgccaggcagcgaagatggccgccggcaagagcgtgatcaaggagatatcgatggccaagaacttcgccaccgatgtcgccgatcgcctgacctatgatgccgtgcaggtgctcggcggcatgggctacatgcgcgaaagcctggtggagcggctgtatcgcgacaaccggattctctccatcggcggcggttcgcgggaaatcatgaacgagatcatcggcaagcagatggggttgtag

SEQ ID NO: 6535 - DNA, 1665 bp, Pseudomonas aeruginosa
tggcggcgactttgttttcgaacgacttcatgcgggtaccccttcggcctgttggcaggcttcgttgctcagggcggcgagcggtgtcgtggtgaggtggtaggcggaggcgtcgaactgccgggtcagggcacggaagcgccaggtgaatcccggccacagggtgcagttgcggccgctgaccggatgcaggtaccagctcttgcaaccgcccacgctccagacgctgcggtccagcttgcgctggaggtattcgttgtagcgttcctgcaccggggccttgacctcgagactgagcagttcgcggcgcttcatcagcttcagcgcatcgaggacgtaggcgatctgcgactcgatcatgtagaccatcgagttgtggccgaggccggtgttcggtcccatcaggaagaacaggttggggaagccggcggtggtagtgcccttgtaggcttccgggcccttggtccagctgtccagcaggtcgcggccgtcgcgaccgaagaccactccgcgggggataggatcgttggcggtgaagccggtaccgaagatgatcgcgtcgacctcgcgttcccggccgttgccgtcgacgattccattggcggtgacggcgcggatgccttcggtgatcaccgtggagttggcggcagccagggcagggtagtagttgtgcgacatgaggatgcgcttgcagccgatggtgtagtccggcgtgaccttgcggcgcagttccggatccttgatctgcttgtggatgtggcggatcgccaggcgctgcaccagcttcattacctgcggggcgaaggtgaagcccagcacccgcccttcgagcaggctgtagaggccgccgcgccagagcttctgcaccagcgggaagcgccggaagcgccggcgctcggtttcgctgattgcccggtcgggtttgggcaggatccatggcggagtgcgctggtagagatcgagcgcggccaccagcggctggatctccgggacgaactggatcgccgaggcgccggtgccgatcaccgccacgcgcttgcccttgaggtcgtagtcatggtcccactgctgggaatggaagaccttgccctggaagttctccaggccatcgaggcgtggataggccggggtggacaggccgcccatgccggaaaccacggcgttcgcggtgtaatggttgccctgggcgtcatgcaggtgccagaggctttgccgctcgtcccaggccagtttgccgatctcggtgttcagcagggtcttttcctgcaagcggtatttttcccagcacttctccagataggcgcggatttccggctggcgggcgaacatccgcgtccactccgggttcgcttcgaaggagaaggaatagacgtgggattgcacgtcgcaggcgcagccagggtagttgttgactctccaggtgccgccgacgccggcgtccttttcgaagatcaggaagtcgtcctcgccttcctggcggagacggatcgccatccccagcccggagaaaccggtgccgatgatggcgaccttgcagtgccgggcggcggcaggggtgggttgggtactcatggccaagctcctattatgattgtttgctggcgtatacactcgtctacctgcgaatgtagacatctgtatacttcagggtcaagccaaccttag

SEQ ID NO: 6536 - DNA, 426 bp, Pseudomonas aeruginosa
tgtaattattgcaggattgtccaacagcgggaggtcattcctggccatttcgaagtcattaatggccaggtcggctcgaccagacggaagatggggtgcaaggagcgagcgcggggcgccagggcgccccccggcgtatcaacgctcgtcgagagcgaacgcggtgagactgaaggtggagatgccggcgtcctgcaggcgagtggagccgccgagttccggcaggtcgatgatcgccgcggcctcgaagaccctggccccgaggcgtcgtaccaggctcgcggccgccagcagggtcccgccggtggcgatgaggtcgtcgaagatcagtacgctgtcgccttcgcagaggctgtcggcatgtacttcgaggaaggcctcgccgtattcggtctggtagccctcggcgagtacgtcggcgggtag

SEQ ID NO: 6537 - DNA, 639 bp, Pseudomonas aeruginosa
gtctggcaacgaccatttctgacaggccgatggcgtttccaatcagtgacttgcgtcaaacaactgcgactacctgtcgcaccctgtcaaggggcgacgaaaagggggctcaagttcgcgacgcgtgggccgatccaatggaagaattccatttttcccggagtgactggaatgttgaccctcagtggctggatcaccacccaggtgccaccctcgtcgcgcgccgccgcggacgccaaggccgcgcggaccggcaccgccgagcaggcggaagacccggccgccggcaccgacgccgccgatcagcatgtacggctttcccaggcagggcgcgagctggccgccaccatgggggtgccggtggaggaggaggacgaggatatcccgcaggagttgcggccgatggtgaagatgatccgccagttgaagaagaagatcgaagagaagctcagggagctgcaggaggccatgaggtcgtccgatccgggggcgaaggaggctcgcgtgcctgagttgcagaaggagctgcaacaactcaactccgtcctgcagacggcgacggcagcgatggcatcggccatcaaggagatgggcatcagcgacccggcgctgatcatgaaggtcatgggcagccggtag

SEQ ID NO: 6538 - DNA, 726 bp, Pseudomonas aeruginosa
aaggggcggggattcaccgccctgtcgtgcgggcagggcggtgcgctttcagatcacccgggagaagcgctgccggttgaggctgggcaggtagcggtcgaacagcatgcagatcgaacgcaccagcagacgtccggaagacgtgatgtcgatgcccttggcgtccaggcggatcaggccgtcggcggcgaagcgttcgagatcgggccacagctcggcgaagtaactgcggaagtcgatgccgaactctgtctcgatatcctcgaaggccagttcgaagtggcagatcagttgctggatcaccgcgcgccgcacccggtcgtcgctgttgcagtgcaggccgcgacggatcgccaactggccgttgtcgaggctggtctggtagtcgttgatgtcgctgctgttctggctgtagaggtcgccgatctggctgatcgccgagaccccgagacctaccaggtcacagtgcccgtgcgtggtgtagccctggaaattgcgttgcagggtgccgtcttcctgggcgctggccagctcgtcgtcgggcagggcgaagtgatccatgccgatatagcggtagcccgccgcggcgagttgctcggtggtgcgctggagcatttccagcttctggcccgggctcggcaggtcgtcggcgttgatccgccgctgcggcatgaaacgctcgggcaggtgggcgtagttgaacaccgagaggcgatccggctgtag

SEQ ID NO: 6539 - DNA, 747 bp, Pseudomonas aeruginosa
cgcgatcacttcgtcgaccgtgcgggcgaagctgtccggcgtctgtttcggcagtccgtagatcaggtcgaggttgatcgagcggtattgcagggtgcgcgcggcctcgacgatggtacgggtctcctccggggtctgcatgcggttgaccgccttctgcacctccatgtcgaagtcctgtacgccgaggctgacgcggttgaaaccgagttcgcggagcaggcccatggtcgaccagtcggcctcgcgcgggtcgatctcgatgccgtagtcgcccgaatcgtcgtccagcaggttgaggtgggtgcgcaattgcgacatgagttcgcgcaattggccgggactgaggaaggtcggggttccgccaccgaagtgcagttgctcgaccacctgctcgcgggagaggtggcggctgacgatctcgatctcgcggaccaggcgcgcaaggtacggcgcgctgcgcccgcgatccttggtgatcaccttgttgcaggcgcagtagtagcagatgttggcgcagaacgggatgtgcacgtagagcgacagggggtgtccggccttccggctgtcgcgcagggcgtgcaactggtcgaacgggccgatgccttcgtggaactgcacggcggtcggataggaggtgtaacgcgggccggaaaggtcgtagcgccgaatcaggtcagcgtcccagcgaatggtgtcgagcatgccagagatccccagttggcgagctttagtcgggaagtctag

SEQ ID NO: 6540 - DNA, 450 bp, Pseudomonas aeruginosa
ccatcaggccgcccacgatgcgtacgccgcgacggcgcagcagggcggtcacccgttcggcggccatgccggtggccagcagaaccggccaggtgccgaggccgaacgccagcatcagcagcgcgctgtccagtgccgatccctggctggtggcccagagtagggtgctgtagaccagcccgcagggcagccagccccagatcgctccgagcagcagggcccgtggcaggctggagaccggcagcaggcgccgggcgaagggttccaggtggcgccagaggccgcgaccgagcgcctcgacgcgggtcaggccgctccaccagccggccaggtagagtcccatggcgatcagcagcagcccggcgaccacccgcagcgcgccggccaacggggtgcgcgccaccgcccagccggccaggccgagcagcaggccggcgcaggcgtagctga

SEQ ID NO: 6541 - DNA, 1302 bp, Pseudomonas aeruginosa
acgggaatctgtttgctcatcagtgcgtaccacggcagtggggggcgcccggccggtacatgccgacagggtcagaaaatagttgcacgcctactgattatacgcctgatctatcaggctttttgcggtaactgtgcgacttttggtcgcgtattgtcccattcgcgcttttcttttgcacaaaataaaacggcgccggggttgccggcgccgtctgggtcgtgggggagggagcgcttattcggcgctcttctcgccgtgcgacaggctgtatacgtaggcggccagcaggtgcaccttgtcgttgcccaggtgttcctgttgcgccggcatcacaccctggcgaccgtagcggatggtctgctgcagttgcgcgaagctggagccgtagatgaacgcgccggggtgggtcagatcgggagcgcccatcgccggggtgcccttgccttccggaccgtggcaggcgacgcaggtggtagcgaagacctgcttgccggcctcgatgtctgccttggcgccttccggcagcttacggccatccatctgggtgaggacgaaagcggcgacgttcttcacgccttcctcgccgatcacttcaccccaggccggcatggcggcgtggcggccagccatgatggtggtcttgatggtttccggctcgccgccccagcgccagtcggcgtcggtcaggttggggaagccgtaggcgcccttggcgtcggagccgtggcagatcgagcagttggaggcgaacaggcgaccgcccattttcaccgcctgcggatccttggcgacttcctcgatgggcatcgcggcgaacttggcgaagatcgggccgtatttctcgtcggccttggccatttccttttcccactggtggacgccggtccagcctttttccttgtcggcgaattcgtcggcggactggtagcccggcatcaggcctttccaggtgcccaggcccgggtacagggccaggtagcccacggcgaacaccagggtgccgacgaacagcatgaaccaccacttcggcagcgggttgtcgtactcctcgatgccgtcgtaggagtggcccacggtctcgtcggtggtgctgctgcgctggcccttgcgggtggcgaagatcagccaggtcagcgccagcagggtgccgagggtgagagctgtaatgtacagactccagaaggtcgtcattctttgttactcctagaagcttgctcgacgtgctttttggcttcgggatcgtctgcgaagggcagcatcgtcgcttcgtcgaagctcttcttgcgcttgccgctgtag

SEQ ID NO: 6542 - DNA, 528 bp, Pseudomonas aeruginosa
aggttcccaggccttgaaggaacgccaccagggcgtccatctcggtcttgcccttcacggcttcacgtgcaccggcgatgtcctcgtcggtgtaaggcacgcccagcttgcgcaggacttccatcttggtggcggtgtccttgccatcaagcttgttctctaccagccacgggtaggcaggcatcttcgactcgggcaccacgttgcgcgggttgtacaggtgcgcgcggtgccagtcgtcggagtaacggccgccgacgcgggccaggtccgggccggtacgcttggaaccccacaggaacgggtggtcccagacgctttcaccggcgaccgagtaatggccgtagcgttcggtctcggcacggaacggacggaccatctgcgagtggcagccgacgcagccttcgcggatgtagatgtcgcgaccttccagttccagggcggtacgcggcttcatgccttcgaccggggtattggtcacgtcctggaagaacagcggaacgatctgggtcaggccgccgatgctga

SEQ ID NO: 6543 - DNA, 1218 bp, Pseudomonas aeruginosa
agatggccagcaggccgacgttcttctcgagtatttcgtggttcttcatttacgtcgggctcctcaggcgatctgcgcggcggcttcgtattcggccggcttggcagcacgcacggtgcgccaggtgttgtaggccatcagcagcatgccggtgaggaagaaaccaccgccgatcatgcgcacgatgaagcccgggtggcttgcgaccagtgcttcaacgaaggagtaggtcagggtgccgtcctcgttgaccgcgcgccacatcaggccctgggtgatgccgttgacccacatcgaggcgatgtacagcacggtgccgatggtggccagccagaagtgcgcgttgatcaggccgatgctgtgcatctgcgggcgaccgaagactttcgggatcaggtggtagagcgagccgatggagatcatcgccacccagccgagggcgccggcgtgcacgtggccgatggtccagtcggtgtagtgggagagggcgttgacggtcttgatcgccatcatcgggccttcgaaggtggacatgccgtagaaggccagggacaccaccaggaagcgcaggatcgggtcggtgcgcagcttatgccaggcgccggagagggtcatcatgccgttgatcatgccgccccagctcggtgccaggaggatcagcgacatcaccatgcccagcgactgcgcccagtccggcagcgcggtgtagtgcaggtggtgcgggccggcccagatgtacagggagatcagcgcccagaagtggacgatggacaggcgataggaatagaccggacgctcggcctgcttgggcacgaagtagtacatcatgccgaggaagccggtggtcaggaagaagcccacggcgttgtgcccgtaccaccactggaccatcgcatcggtggcgccggagtaggcggagtaggacttgaaccagctcaccggcagcgacatgtggttgacgatatgcagcatcgccgtcaccaggatgaaggcaccgtagaaccagttgcccacatagatgtgcttgaccttgcgcttgacgatggtgccgaagaacacgatcgcgtaggtgatccagacgatcgccaggaggatggccagcggccattccagttcggcgtattccttggaggtggtgaaaccctgcggcagggtcagcacggcgcccacgatcacggcctgccaaccccagaaggtgaaggccgccagcgtgtctga

SEQ ID NO: 6544 - DNA, 270 bp, Pseudomonas aeruginosa
ctcgactacctgtcgcagcgacatacctttgaactccggtcgttgggcaaagtattgcgggcaccggctgagtcgagccttgagtgtccgtgctacctcagctgtaaagtggtcggctggcatgtcgcccatcagctcgaagaaatcccgaagcgcccgctgtacgtcgaggctgctgacttctcgccatgtaccgccgcgttgtccttcctttatatagatcttcgacagtgtgctaagcagcggagagtttcctgccgcagtggttag

SEQ ID NO: 6545 - DNA, 915 bp, Pseudomonas aeruginosa
  unsure (318): Identity of nucleotide at the above locations are unknown.
ccgaccaggccatcgccttcggcgagggcaaggtgctggccgcagacgtgcgggcgatgctcggtaccctcgatcacggccaggtctatggcgtgctcacaggccttgctggagggcgatgcgcgcgccctgctcgaagcggtgcgccacctggccgagcagggcccggactggggcggcgtgcttgccgaaatactcaacgtgctgcaccgcgtcgcgatcgcccaggccctgccggaagcgatcgacaatggccagggcgaccgcgagcgggtgctggccctggcccaggcgttgccggcggaagacgtacagttntattaccagatgggcctgatcggccgccgcgacctgccgctggcgcccgatccgcgtagcggcttcgagatggtgttgctgcggatgctcgcgttccgcccggcggacgccgacggcgtgccgaggacgccgctaaaggacctggggatcagcaaggccacgactgatcccgccaactcccccgtggccggcgcggcctcgcctgcgccggtcgctaccgttgctcccgcgcctgtcgtggctgcgcccgtcgaagccccggctgccccgccggcagcgccatccgcgccgccggcggcggtcgaggcgcgcgtcacggaagcggttgtcgaagagcccgccgccgcggcagaggtcgtcgacttgccctgggaagagccggcgccgagcctcgctgccgagcccgagcccgagcccgagcccgagcccgagcccgagcccgagcccgagcccgagcccgagcccgagccgctagccgtggaagctccctcgatccctccggcagtggcggtcgaggcggtggtggaaaccgttctggaagccctgccggctgcgttgccggtatcacctgacgagcaggacgagcaggacgactag

SEQ ID NO: 6546 - DNA, 513 bp, Pseudomonas aeruginosa
ccaccgcccgcagacgactactacgaagtcgacatggataccctggcctacttggatgccgcgcccgagcctgacgtggtcgtggtggaggagccgctgccggcggcgaagccggccaccggcctggccgcggagtggctggagctgttcccgcggctcggcctcggcggcctgaccgccagcatcggtgccaactgtacgctggtagctgccgacggcgaccactggcatctgcatctcgatccgggccagagcgcgctgttcaacgccacccagcagcggcggctgaacgatgcgctgaaccagcacctggggcgcaccctcaaactggaggtgaccctgcagaagcctgagcaggagaccccggctcaggcagcggcacgccggcgtgccgagcgccagcgggcggccgaggcatcgatcgatgccgacccgttggtccggcagttgcgcgagcagttcgccgcggtggtccgtgacggtaccatcgaacctttggaagccaaggcctga

SEQ ID NO: 6547 - DNA, 372 bp, Pseudomonas aeruginosa
ccggcgcttggcgcacgcaacaagacgacattcgaggtgaagaacatgatgaaaggtggcatggccggcctgatgaagcaggcgcagcagatgcaggaaaagatgcagaagatgcaggaagaactggccaacgccgaagtgaccgggcaatccggcgccggtctggtcagcgtggtgatgaccgggcgccacgacgtcaagcgcgtcagcctggacgacagcctgatgcaggaagacaaggaaatcctcgaagacctgatcgcggccgcggtcaacgatgcggtgcgcaagatcgagcagaacaaccaggaaaagatgtccggcttcacctcgggcatgcaactgccgcccggcttcaagatgcccttctga

SEQ ID NO: 6548 - DNA, 675 bp, Pseudomonas aeruginosa
tcccgcgttcgtgccgggtccgccttcttcggacggcgcccggcagccattcccctccctctatccgacgagtcctgcatgagtttcagcccgctgatccgccaactgatcgagtccctgcgcattcttcccggtgtcgggcagaagtcggcccagcgcatggcgctgatgctgctggagcgcgatcgcagcggcggcctgaagctggcccaggcgttgaccgccgcgatggaaggggtcggtcattgccggcagtgccgtaccctcagcgaggaggagttgtgcccgcagtgcgccgacccgcgacgcgacgactcgctgctctgcgtggtggaaggcccgctggacgtattcgcggtggagcagaccggctaccgcggccgctatttcgtgctcaagggacacctgtcgccgctcgacggcctggggccggaggcgatcggcattcccgaactggaagcgcggatcagggacggagccttcagcgaggtgatcctcgccaccaaccccaccgtcgaaggcgaggccaccgcccactatatcgcccagctactggccggccgcggcctgaccttgtcgcgtatcgcccatggcgtgccgctgggcggcgagctggagctggtcgatggcggcaccttggcccacgccctggccggacggcggccgatctcctga

SEQ ID NO: 6549 - DNA, 1038 bp, Pseudomonas aeruginosa
ggaaggggagggttcatgacggccgtaccctggagactggccgtcgagtatgacgtgccgggcagcctagcggctacccggcgggcctgttcactgggcgccctgggggctcttcgggcgcggcgcgaagcgcgctgccaggcgcatgctggcggtgaccaggcgctggtagagcactggtgccaggcgcagcatcacgtcgatcgcgtgggcgtcggtgccgatcaggatgcgccggctgtcgcgctgcacgccgcgcaggatgacctgggcggccttctccggggtggtccgcagcaactggtcgttgaattgctcgcgagccttgtccggagcctggccggtgaccttggccatgctctcgttcattcgcgcggtcttggcgatgttggtcttgatcccgccgggatgcacgcaactggcggagacgccggagtcctccatgtccagttcctggcgcaacgactcggtgaagccgcgcaccgcgtacttggtggcgttgtaggcgctcatgccgggctgggcgaacagcccgaagacgctggagacattgaccacgtggccgttgccggaggccttcaggtgcggaaggaacgccttggtgccgttcaccacgccccagaagttgatgttcatgatccactcgtattccgagtagtcgctgccttccacggtaccggcgtgggcgacgcccgcgttgttgaaaatcaggttcacccggccatgttcgctggccgccttgtcggcccaggcctgcacctgctcgcggtcggccacgtcgacgaccgcggtggagacgcgtaccccgctgctggcgagcaattggcgggtttcctcgagagctgcggcattgacgtcggccagggccaggtgacaaccctgcctgcccagctccacggccagggcgcgaccgatgcccgagcctgcgccggtgatggcggcgactttgttttcgaacgacttcatgcgggtaccccttcggcctgttggcaggcttcgttgctcagggcggcgagcggtgtcgtggtgaggtggtag

SEQ ID NO: 6550 - DNA, 966 bp, Pseudomonas aeruginosa
cgctggacgaagctgtccacggtcatgcgcagcgcgcgtggcgactggaacagcggggtgatgtcgcggaacaccacgccgggcttgggaaagtccggcacggcgcggatctgcgacttgagggtgaactcgtcgaaaatcatggaagatcctgggctgggcgtttttcggggcccatcatacaacgggcccgcgctgaggcgggcccgttggcggttcgcaggcgcttcagccttccagctggccgccggcgagggcgcacagctcgatggagtcgaggatgtgcacttccttgccttccgcgctgatcaggccgttctgctggaagcgggtgaagacccgcgacacggtttccacggccaggccgagatagttgccgatctcgttacgcgacatggccaggcggaactgctgggcggagaagccacgggcacggaagcgcgccgacaggttgaccaggaaggtggcgatgcgctcgtcggcagtcttcttcgacagcagcagcatcatctgctggtcatcgcggatttcccggctcatcaggcgcatcagttgacggcgcagctgcggcagctgctcggacagttcgtccaggcgctcgaagggaatctcgcagaccgaggtggtttccagggcctgggcggataccggataggtctcggtatccatcccggacaggccgaccagctcgctgggcaggtggaagccggtgatctgctcttcgccggcatcggtgatgctgaaggttttcagggcgccggagcgcacggcaaagaccgagccgaaaggatcgccctggcggaacaggaattcgcctttcttcaggggacgaccgcgcttgacgatctcgtccagcgaatccatgtcttccacggtcagcgacagggggaggcacagcggggccagactgcaatccttgcagtgtgcttggggcagtgcgcgcaccttgatggtttcggccattga

SEQ ID NO: 6551 - DNA, 624 bp, Pseudomonas aeruginosa
ggtgctgtagaccagcccgcagggcagccagccccagatcgctccgagcagcagggcccgtggcaggctggagaccggcagcaggcgccgggcgaagggttccaggtggcgccagaggccgcgaccgagcgcctcgacgcgggtcaggccgctccaccagccggccaggtagagtcccatggcgatcagcagcagcccggcgaccacccgcagcgcgccggccaacggggtgcgcgccaccgcccagccggccaggccgagcagcaggccggcgcaggcgtagctgaggatgcggccgaggttgtaggccagcagcaggcgcagacgacggccgcgctgttcggcgggaatggccagggtcagggcgcccatcaggccgccgcacatgcccaggcagtggcctcccccgagcaggccgaggatcagcgcggaaaccagcagcggcgccagttcagccacgcggtcggtcctcgggtttcgacggcttctccgcttcgtcgacgccggcctggtgcttcgggtcttcgtcgtcgaagagaatgctgtgggcggggccgtcgagatcgtcgtactggccgctgtccaccgcccagaagaacacgtagatggcgatggcgacgatga

SEQ ID NO: 6552 - DNA, 510 bp, Pseudomonas aeruginosa
cgatcgcgacggggatcaggatgtagagcgcggccatacggacctcggcgaagggattcgggtcagccgcagggcgttgaccaccaccagcagcgaactgaccgacatgccgatcgccgcccagcccggggtgatccagccgagcgcggcgaagggcaggaccaggccattgtacaggctggcccaggccaggttctcgatgatgatatggcgggtgcggcgcgccagccggaaagcctgcaccaggctgtccaggcggttggacaggagcaccgcgtcggcgctggtcttggccaggtcggtggcgctgcccatggcgacgctgatgtcggcaccggcgagcaccggtacgtcgttgactccgtcgccgagcatcagcacccggcggccctcgccgtgcaggcgttcgagcatggccagcttgtcgtccggggtcaggccgccgcgggcttcgtcgatgcccagttcggcagcgacgctggcgaccatcggcgaggcgtcaccggatag

SEQ ID NO: 6553 - DNA, 1740 bp, Pseudomonas aeruginosa
cacctgcttgagcgtcaggcggccttcggtgagggtgccggtcttgtcgaagattaccgtgtcgatgtggttcagcccttccagcacgtgcccgcgcgtgatcagcaggccgagcttgtgcaggctgccggtggccgcggtgagcgcggtgggcgtggccagcgacagggcgcaggggcaggtggcgaccagcagcgacagcaccacccagaaggcgcgctggtggtcgacctgccaccacagcgcgccgaccgctgcggcgaccagcaggacgatgagcaggaaccactgcgccaccttgtcggccagttccgccaggcgcggcttgtccgcctgggcgcgttccagcaggcggacgatggccgacaggcggctgtcgtcgccaagggcgccgacctcgacggtcagcggcccctcgacgttcagggtgccgccggtgacggcgtcgccggcctggcgtggatggggcaggtactcgccggtgagcagcgactcgtcgacgctggactggccgtcgaggatcactccgtcggccggcagcacggcgcctggcggtaccagtacgcggtcgccgacgcgcagttcgctgagcaggatgcgctcgccctggttggcggcgtccaggcgcaggcaggacgccggcagcaggttgaccagttgcgcggtggaggcggcggtgcgctcccgcgcgcggcgttcgaggtagcggccggcgaggaggaacagggcgaacatgccgaccgcgtcgaaatacagctcgccctggccggtgatcgtcgaccagatgccggcgacgtaggcgccgccgatcgccagcgacaccgagacgtccatggtcaggtggcgggtgcgcaggtcgcgcagggcgccacggaagaactggccgcagcagtagaagacgatcggcgtggtgaggatcaggctgacccagcgcaggatgcggtccatgccggcggaaaggtcgaggttgaattccggccaggtcgccattaccgccatcatcacctggatccacagcagcccggcgacaccgagctggcgcagggcgtgacggttctccatggccaggcgctcggtggcgcggtcgggttggtagggatggccggcatagccgatctggcgcagttcgccaagcaactggctgagcggcaactggctgtcctgccagcgcacgtgcaggcgatggttggacaggttgagccgcgcctcggccacgccaggcaactggcgcaggtgcttctcgatcagccagccgcaggcggcgcaactgatgccttcgatcatcaggctggtttccgccagctcgccctcatggcggacgaagccgcgctgtacgtccgggcggtcgtagagctgcaactcttcgctgagcgccttgggcaaggcttcgggattggcggcgttttcgctgcggtgccggtagtagctttccaggccgccggcgacgatggcctcggccaccgcctggcagcccggacagcacatggcccgcgtctcgccgagcacgcgggcctcgaagcggctgccggcggggaccggcaagccgcagtggtagcagggcaggggggcgctcatgggcgcttcgcttctgctccctggagcggttcgtcacccagctccatgaccacggtcggcgataccacctcttcctcgaaaagacgccactggccgctgccttcctggccgagcagttcgacgaagcgacggccctcgacggcgtcggtcagttgcccgacgtag

SEQ ID NO: 6554 - DNA, 456 bp, Pseudomonas aeruginosa
  unsure (204): Identity of nucleotide at the above locations are unknown.
tcatgtacggagtcaagtggtatggaaaagaatttggaaaacctgaccattggcgtttttgccaaggcggccggggtcaatgtaaagaccatccggttctaccagcgcaagggcttgttgccggaaccggacaagccttacggcagcattcgccgctatggcgcggcggatgtaacgcgggtgcgctttgtaaagtcggcccancggctgggcttcagcctggatgagattgccgagctgttgcggctcgacgatggcacccactgcgaggaagccagcagcttggctgagcacaagctccaagacgtgcgcgaaaagatggccgacctggcgcgcatggaggccgtcctgtctaatcttgtgtgcgcctgccatgcccgaaaggggaatgtttcgtgcccgctgattgcgtcgctacagggcgaaacaagcttggcaaggtcggagacgccttag

SEQ ID NO: 6555 - DNA, 459 bp, Pseudomonas aeruginosa
gagggatatgccaatgaggcggtgacgcctaatgtacacctttgcacgtcgaagacagctaggaaaaaaattggccatttggtggccaattggttgttggactatgtcaactggctactgctttacctgtgcaagggggctgcatgggggctgctgcgtagcagtgggagtatcttcgtcctaccggacacacgaagagcaagatcaagagcttgggttttggtgattgcttttcttgtgtatccggaggatgccggtcaggtttgtgtgggcgggagctctgaggggttactcattcatgctgccgcatgtgtgcaatccagctcagagctgtcgccctgtgtccagtgtccgatctatatatatggtggggtcacttcggacgcttgcattctagagccagccttgagcttcgatatagtcgaggaaggcattactgttcgatggctctggtattag

SEQ ID NO: 6556 - DNA, 942 bp, Pseudomonas aeruginosa
acatctgtatacttcagggtcaagccaaccttaggtagggtcgtcgcggcgcaacggccgaacttgtggcgcatggaaacaaccaggtggaacatgagcgatatgaacgaaacgaaggacagggttgccgacgctcccggcaaacgcgccttgctggaggcggccttgcgcctgggcagcagcagccgcagcctgggggccatcggcttgcgcgagctggcgcgcgaggcgggcctgaatccgaacaccttctatcggcatttccgcgatatcgacgatcttggcctgaccatgatccgcgacatctctacccagctgcgccagccgctgcgccagcttcgccgcgaggccgcgactcgtgcggcgcccggcgcccgagcgcagacgacgccgttcgggctggacctggaaagggggcggcgggtctgccgggagacggtgcggctgttcttcgacttcgtggagagcaatcccgccgcgttcatcgtcggcgtgcgcgaactgcatggggcttcgccggtgctgcgtggtgccctgcgtcagatcatggatgagttcgccgaggacatgtcggaggacatcatcgaattcaggttgttgccggcggtgagcgaggcgaccatccgtcgcctctccagcctgatcggccgccagctgtttcagttgtcgctggactatatcggccagccggagcggcgtcgggaaatctgcgccctgggtgaggaacagatactgctgttgttcaccggcgccgcggtcctgcagatgatgggcgtttcgttggacgccgaggcgtcaggccagcttgagcaggctcatgccggccagcagcagcaacaggccgagccagccgcgccaggccaggcgctggccgaacagcgcccagcccatggcgacggtggcgaggatgccgaagccgccccagatcgcataggcgagtga

SEQ ID NO: 6557 - DNA, 564 bp, Pseudomonas aeruginosa
aggcacaacaggagtaagggtaacgcagccgcgatgcgggtgccagccataggtctggcaacgaccatttctgacaggccgatggcgtttccaatcagtgacttgcgtcaaacaactgcgactacctgtcgcaccctgtcaaggggcgacgaaaagggggctcaagttcgcgacgcgtgggccgatccaatggaagaattccatttttcccggagtgactggaatgttgaccctcagtggctggatcaccacccaggtgccaccctcgtcgcgcgccgccgcggacgccaaggccgcgcggaccggcaccgccgagcaggcggaagacccggccgccggcaccgacgccgccgatcagcatgtacggctttcccaggcagggcgcgagctggccgccaccatgggggtgccggtggaggaggaggacgaggatatcccgcaggagttgcggccgatggtgaagatgatccgccagttgaagaagaagatcgaagagaagctcagggagctgcaggaggccatgaggtcgtccgatccgggggcgaaggaggctcgcgtgcctga

SEQ ID NO: 6558 - DNA, 1899 bp, Pseudomonas aeruginosa
gccagcagcaggcgcagacgacggccgcgctgttcggcgggaatggccagggtcagggcgcccatcaggccgccgcacatgcccaggcagtggcctcccccgagcaggccgaggatcagcgcggaaaccagcagcggcgccagttcagccacgcggtcggtcctcgggtttcgacggcttctccgcttcgtcgacgccggcctggtgcttcgggtcttcgtcgtcgaagagaatgctgtgggcggggccgtcgagatcgtcgtactggccgctgtccaccgcccagaagaacacgtagatggcgatggcgacgatgacgatcgcgacggggatcaggatgtagagcgcggccatacggacctcggcgaagggattcgggtcagccgcagggcgttgaccaccaccagcagcgaactgaccgacatgccgatcgccgcccagcccggggtgatccagccgagcgcggcgaagggcaggaccaggccattgtacaggctggcccaggccaggttctcgatgatgatatggcgggtgcggcgcgccagccggaaagcctgcaccaggctgtccaggcggttggacaggagcaccgcgtcggcgctggtcttggccaggtcggtggcgctgcccatggcgacgctgatgtcggcaccggcgagcaccggtacgtcgttgactccgtcgccgagcatcagcacccggcggccctcgccgtgcaggcgttcgagcatggccagcttgtcgtccggggtcaggccgccgcgggcttcgtcgatgcccagttcggcagcgacgctggcgaccatcggcgaggcgtcaccggatagcaggagggtgcgccagccgcgcgccttgcaggcggcgagcagggcgggggcgtcgctgcgcaggcggtcgtcgagaccgaaccaggccagcggtccctgctcgtcgccgagcagcagccactgtccggagtcgccgggcatcgcgggcgtggcgctgccgcccaggttgctgacgaaggcggcctggccgatgcgcaggcggcggccttccaccaggccttcgaggcccagtcccggatggcttgcgacgctgtcggcggcctccggcgcacggccgaaggcgcgggcgatggggtgttcggaacggttctcgagggcggcggcgagggccaggcagcgatccgcgtcgagatcgcgcaggggtagcacctgcttgagcgtcaggcggccttcggtgagggtgccggtcttgtcgaagattaccgtgtcgatgtggttcagcccttccagcacgtgcccgcgcgtgatcagcaggccgagcttgtgcaggctgccggtggccgcggtgagcgcggtgggcgtggccagcgacagggcgcaggggcaggtggcgaccagcagcgacagcaccacccagaaggcgcgctggtggtcgacctgccaccacagcgcgccgaccgctgcggcgaccagcaggacgatgagcaggaaccactgcgccaccttgtcggccagttccgccaggcgcggcttgtccgcctgggcgcgttccagcaggcggacgatggccgacaggcggctgtcgtcgccaagggcgccgacctcgacggtcagcggcccctcgacgttcagggtgccgccggtgacggcgtcgccggcctggcgtggatggggcaggtactcgccggtgagcagcgactcgtcgacgctggactggccgtcgaggatcactccgtcggccggcagcacggcgcctggcggtaccagtacgcggtcgccgacgcgcagttcgctgagcaggatgcgctcgccctggttggcggcgtccaggcgcaggcaggacgccggcagcaggttgaccagttgcgcggtggaggcggcggtgcgctcccgcgcgcggcgttcgaggtag

SEQ ID NO: 6559 - DNA, 1266 bp, Pseudomonas aeruginosa
accaggcccagaagtgtttgtaccagggttgagggtgggtctcggactgcatgctcaagttactcaacgggtgcgtgggccaatgaagcgactcttcgcttctttatggatgctcgggtcgtcggccgactcgatggtgaagacgatctcgttggtggtcgaaggcagcttctccggctcgatggacagttccatcggcaggttgaggatgtcgcccgccgccaccttcagctcgcgccggccttccagggtcaggccttcgaggcccttggcgccgaggatgtaggtgtggtcctgctgatccttgttcatgatcttcaggctgtacacgttctcgatgcggccgagttcgttctcgcggtagagcacgcggtccttgctgacgtcgaagccgaccagcggacgcaggaccaccgcggtgatcagggcggagatcatcagcaccagggcgatggcgtagccgatcaggcgcggccgggccaggtgggtcttctggccgttgaggttgtgctcggtggtgtagctgatcagccctttcgggtagttcatcttctccatgatgctgtcgcaggcgtcgatgcacgccgcgcagccgatgcactcgatctgcaggccgtcgcggatgtcgatgccggtcgggcagacctgcacgcacatcgtgcagtcgatgcagtcgcccaggccctgggccttgtagtcgagggacttcttgcgcgggccgcgcttctcgccacgacgcggatcataggagacgatcagggtgtccttgtcgaacatcacgctctggaagcgcgcgtaggggcacatgtagatgcacacctgctcgcgcagccagccggcgttgccgtaggtggccagggtgaagaagccgacccagaagtaggcccagccgtcggcctggccggtgagcagctcgggaatcagctcgcggatcggcgagaagtagccgacgaaggtcaggccggtgaccaggccgatcagcagccacaggctgtgcttggcggtcttgcgcagcagcttgttgccgctcatcggggccttgtccagcttgatgcgctggttgcggtcgccttcggtgaccttctcgcaccacatgtagatccaggtccacacgctttgcgggcaggtatagccacaccagacgcgaccggcgaacacggtgatgaagaacaggccgaaggcgcagacgatcagcagccaggacagcagcatgaagtcctgcggccagaaggtggcgccgaagatgtagaacttgcgctcgggtag

SEQ ID NO: 6560 - DNA, 1305 bp, Pseudomonas aeruginosa
tctgggtcagtccggcggggatcagcgaggttgcacgttgagcgcctggtcgaggtgccggccggccttgttcgacaattcgccttcaggatagtcgagcaactggcgacgcaggtattcgatggccttgtcgcggttcgggtgcgggttgtccggcgccaggtacatcaggccgagctggtagagggctttttcctttataccggcaggaatcgccggatcgttgaccgccagcaggtagagctcggcggcttcgtcgacccgatccttgagcaccgcgcggcgcgacagcagggtcatgtccgggtcgaggctggtcttgtagagatcgaggttctgctgtggcttccaggtggcgagcaattcgcgagcgctcttctgcaccggctccctggcccgctggcgcattgccagcaggcgcgcctgggcatgctcggcggcgtgggtgccggggaactcgcggaccacgcgctggaagtagtcggtggccttggcgtcgtcgcgctggtcgttgtagcggctcatgtagatcaggccgatctggtacagcgagataccgcgcacctcggcgctgtagcggcgattgtcgtagccggtgaggtagagcttttccgcctcggcgctcctgttgtcgcggatcgccatggcgctgtaggtcagcaggtcgccttcctcctcgatggcggcggtcatgcggttgctcttcatctgcttgtattcggcgacttcgccagtggtcacctgggcgacgaacagcggcgtggtcggcgagcaggcggccagcagcgacagcaacgggagcaggacgagacggcgggcgaagcgcatggcatctccttggcgccagggcgaggggcatcccagtctagtcaggcccttcagtcacgccaatacgcgccgatacagttcccaacggaggatatgcctatgcgaagcttgatcgttgcctgcctggcgctgagtgccaccggttgtaacagctggtcgctgaacagcgacctgaacggggcctaccgcgcctacgacaaaggcgattgcgcacaggtgatgctcgacctgtcgcgggccgaacggcggattcgcgcgcggccctacctgcagccggaaatctcgctgctgcgcggccagtgcctggaacgccagagcctgttcgtcgacgcggcgcagacctaccacttcatcatcgcccgttaccccaccagcgaatatgcctaccgtgccaaggcgcggctggagacgttgcgccagctgggccggctgagcgagacgccggcctcggccagcgccgtgccgacccgcctgtag

SEQ ID NO: 6561 - DNA, 525 bp, Pseudomonas aeruginosa
gcggccgggagggattggacgggcgttcaggctgaccgtcggtcgcatgggacaccggtctatccggtaagcttcgccctggatttcacggaggaggttcgcatgcgtgccctgtggttctgtgtcgccctgatgcccgtgctggcgcaggcggacatctatcgctggaccgatgcccagggcaaggtacacttctccgccacgccaccggccggcgcgcaacgcgtcgaagtcaggccgcaggtggtggaacgtgacgccgcgacccgccagcgcgagcagcgcacccaggagtatttcgatgctcgtcgcgaggaacgcaccgccgccgccgaacgtgccggccagcgccaggctgcgctggccgaggaatgcgggcgcttgcggcaacagttgtcccagctcgaacgcggcggccgcttctatcggcaggacgccggcggcgggccggtttatctgagcgatgccgagctggacgccattcgtcgcgaactggcctcgcgggagtccgaacgctgccgctga

SEQ ID NO: 6562 - DNA, 372 bp, Pseudomonas aeruginosa
cgaaatgccattatgggtcttcaacgacatatccagcgccatcagttgcccagctacctgaaggtgttcaatcgcatcaccgataagccgatgggctacatcggcaacgtctccgaggacggcctgctgctgatcagccaattgccgatgctggtcggcgcgcgtttcgaactgcgcctgaaggttccgggactgggcggtcgcccgcaatgcatcgatttttccgccgactgccggtggacctgcgaggacgtcacgcccggtcatttcgattccggcttccatctgctggcgccgcccgccgaattcctcgaactggtggaggcgctgcgccgctacttcagcttcccccgccagccgcagtcggtctga

SEQ ID NO: 6563 - DNA, 1644 bp, Pseudomonas aeruginosa
gctggcggctcagcttcggcaccgcctggcggcgcgcccacagggcgtccagcaggccgagcaggagcagcgcggcgagcgccgcccaccagaatgtatgcagttgcgcaggcaaccgctggccgagcgccgacaggctgcccaggccgatggccagcagcaggagcgcggcgaacagcgccagcagggcgcgcgatggcttcatacgcggggggccggtacctggtcgagcaactgttgcaggacctggtccaccgacagcccctcgatgtccagctccggagacagccggacccgatggcgcaggaccgccagggcacagcccttgatgtcgtccggcaccacgaactcgccgccgcgcagcagcgcccgcgcccggccgcaacggaccagggcgatcgacgcgcgaggtccggcgccgagggccaggcccggccagttgcgggtggtgcgggccaggcgcacggcatagtcgaggacctggtcgtcgatcggcaggtcgctggcgatccgctgcagggcgagaacgtccttgtccttcagcagcggccgcaggttggccacgtcgagcatgtcgctgcgcgcggagcgggtcacctggcgcaccagggtctgttcctcggcttcggccgggtaatcgatgcgcagcttgagcatgaagcggtcgagttcggcttccggcagcggataggtgccttcctgctcgatcgggttctgcgtcgccagcaccatgaacggctgcggcaccggcagggcgcgtccttccagggtgacctggcgctcctgcatcacttccaggagggcggcctgggtcttggccggcgcgcggttgatctcgtccgccagcagcaggtggttgaacaccggccccttgcgcagcttgaatggttcgctggcgaggtcgtatacggcgtggccggtgacgtcgctgggcatcaggtcgggggtgaactggatgcgcgcgaagccgccgtcgaagcagcgcgccagggcgcgtaccagcaggttcttgccgagccccggcacgccttccaccagcacgtggccgccggcgagcaacgcggtgagcacgtcgtcgatcactgcgccctggccgatcagggctttctgcagttcgctgcgcagggcctgggccagctggctggcgcgctggcgctggagcgccgggttgggcgcggtgctcggttgttcgggcgtctgttcgctcatagggcattcctgaggctttgcaggtgggcgacctggcgggtgaagtcggcagcggaaaggcgctgcgccggatatgggcgcatggcctggctgatggcgctgggtggcaggcgggtcatgcgcccgaggatctgccattgctcggcgacgccgagctgttcgaaaccggggtggcgacgccgcgccctgcgcaggatgtcgcgttgcagaccgtgcagcaaggcgacgtggccgcgctggcggaggaggaagtcggcgccggcgcgcaggtgttcctccagttgccggcgcgaacggctggccaccggctgcaagggaccctggcgcagccctgcgcgccacaggccggcgagcaacaacagcagcgctgccgccagggcctcggggaagtggcgggcgagcagggtggcgaggctgtcgcgttcggcgcggtag

SEQ ID NO: 6564 - DNA, 420 bp, Pseudomonas aeruginosa
tccggcacgctgtcggcgggctcttcttcctcgccggcggtgtcctccggcggcgcttcggtcgcgtggtcgtcgacgctaccttcgtcggcgtcggcgtcggcggtttcctcgctggcccggtcctggctgtcgtcgaagtcctcggtgaggtactggcggatatccaggctgtcgagcagcaggtcgccgctcttcttctcgtcctcgtcccacaggcgttcggcgatcagcaccagatgcccgccctgctcgctccattgcagcaggcggcgagcctggccgggagtcatgccggagcggctgccgagcaggagcagggtatgcccggagggcggcagctccttgaggacctcaaggccgtcggcgcggctcaccgtgaccccctgcttgcgcaggaacagttcggcggccaggtag

SEQ ID NO: 6565 - DNA, 993 bp, Pseudomonas aeruginosa
tgggtgtcgaggacctcggcgcctggccgggaggtgggcgcgacgaggcgggcggctgcgttcggtggcatcggggggccgtgtcggggaaagtcagatgctagccagcgtggcgtcatcaggcaaccgggccgccgcgacggcccggtctgcacctcagttgcccagcgggcgaacgccgaagatggtgcggtagagaatacccatggagacgacgaacagcgggccggtccagatcaggccgatgaacagcgggatcatgctcaccagcatcagcaggctcagcaccagcagcaggccgaacaccttgaaccagtggcggctgatggccttgcgcgaggtttccagggcctgccagggcgtcaggccgcgctcggccaccagcggcagggcgagcatgtaggcgacgctcaggtagagaccggggatgatcagcaggaagaagccgacgtagaccatcagcatcatcagcaggccggtgagcagcagcggcaccagcatgccgaagtagttgaacatttcgttgaaggtcgccggctggtcggcggcgcggcggatgccgatcatggtcaggccggtgaagaacgggtagcccaccgccgtggcgaccaggctggcgatcatctggccgaccgcgaaggcgatgggatcggcctcgctcatcaggccgataccgccgaagagcagggtgaggatgaaggtgatggtctggatcaccacgctgtagaccacgaaggcgccgatcaggatgcctttgacgcccttgatcttggcccaggcttcgctgatcacgtcgccgatgcggaagtcgtagtcgccgatgaccggcggcaccgcctgggtcggttgcagggcgctggcgggggtggcgtagggattgctggtgtcgttcatggtgctgtccttgtcagtgaaacgggcatccgtgcgagcggaatgctagcgagggcggaggggacaacgcaaggttcggatggcagatatgcgcactga

SEQ ID NO: 6566 - DNA, 888 bp, Pseudomonas aeruginosa
aatggcggcctttcgcgatgtttctggagtatacccatgcgcacttttcggctggtgatcgcctgtcccgacggggtcgggatcgttgccaaggtgagtaacttcctggccacctacaatggctggatcaccgaagccagccatcattccgacaacgataacggctggttcttcatgcgccacgagatccgtgccgactctctgccgttcgacctggatggcttccgccaggctttcgccccgatcgcccgcgaattctccatggaatggcggatcaccgattccgaggtgaagaagcgcgtggtgctgatggccagcaaggagtcccattgcctggccgatctgctgcaccgctggcacagcggcgaactggactgcgagattccctgcgtgatcgccaaccacgacgacctgcgcagcatggtcgagtggcacggcatcccgtatttccacgttcccgtcgatccgcaggacaagcagccggccttcgatgaagtttcccggctgatcgacgaacatggcgccgactgcatcgtcctggctcgctacatgcagatcctgccgccggacctgtgccgcaagtacgcccaccaggtgatcaacatccaccacagcttcctgccgtccttcatcggcgccaagccgtatcaccaggcgtcgaagcgcggggtcaagctgatcggcgcgaccagccattacgtgaccgaggaactggatgccggtccgatcatcgagcaggacgtggtgcgggtcactcaccgcgacaacgtcgaagacatggtgcggctgggcaaggacgtggaaaagctggtgctcgcgcgcggactgcgctatcacctggaagaccgcgtactggtacacggcaacaagacggtggtgttcgactga

SEQ ID NO: 6567 - DNA, 807 bp, Pseudomonas aeruginosa
ctctcggtcatggtactgaccgcttcctgggcgccgatctgcagttcctcgatcatcttctggatctgctgggccgactcctgggcgcggtgggccaggttgcgcacctcgtcggcgaccactgcgaagccgcgtccggcttcgccggcgcgcgcggcttcgatggcggcgttgagggcgagcaggttggtctgctcggagatgcccttgatcacttcgaggatctggccgatgttcaccgtgcggctgttgagggcctcgatgttggcgcaggaggcgctgatcttctcggaaagctcgttcatcgcgcggatggtctgctcgaccacctgcttgccgtcttcggcctggtggttggcgtcggaggcgtggtgcgaggcatcggcggcgttgcgggcgatttcctgggcggcggcgccgagttcgttgatcgccgcggcgacgctgttggtgcggttggactgctcgtcggagttggccatcgaggagttcgaggcgttcaccaccagttgcgccacatcgtgcagttggcgagcggtgccggcgacctcgcggatcgattcgtggatacgctcgacgaagcggttgaaggcattggccaacgtaccgaattcatcgttgctggtgaccttcaggcgcttggtcaggtcgccttcgccctgggcgatgtcctgcatggcgcggcccatgtcggtgagcggttgcatcagtacgcggatcagcatgccgaggaggaggacgatggcgaccaccgcgatcagcgcggcgacgatcgccgaggtacgcagcttggtgagcatggcatag

SEQ ID NO: 6568 - DNA, 807 bp, Pseudomonas aeruginosa
ctctcggtcatggtactgaccgcttcctgggcgccgatctgcagttcctcgatcatcttctggatctgctgggccgactcctgggcacggtgggccaggttgcgcacctcgtcggcgaccaccgcgaagccgcgtccggcctcgccggcgcgcgcggcttcgatggcggcgttgagggcgagcaggttggtctgctcggagatgcccttgatcacttcgaggatctggccgatgttcaccgtgcggctgttgagggcctcgatgttggcacaggaggcgctgatcttctcggaaagctcgttcatcgcgcggatggtctgctcgaccacctgcttgccgtcctcggcctggtggttggcgtcggaggcgtggtgcgaggcatcggcggcgttgcgggcgatttcctgggcggcggcgccgagttcgttgatcgctgctgcgacgctgttggtgcggttggactgctcgtcggagttggccatcgaggagttcgaggcgttcaccaccagttgcgccacatcgtgcagttggcgagcggtgccggcgacctcgcggatcgattcgtggatacgctcgacgaagcggttgaaggcattggccaacgtaccgaattcatcgttgctggtgaccttcaggcgcttggtcaggtcgccttcgccctgggcgatgtcctgcatggcgcggcccatgtcggtgagcggttgcatcagtacgcggatcagcatgccgaggagaagcatgatgccgaccaccgcgatcagcgtggcgacgatcgccgaagtgcggaattcgctgagcatcgaatag

SEQ ID NO: 6569 - DNA, 3741 bp, Pseudomonas aeruginosa
cccatgaagtgccttgaggggagccggcatatgcatcggagcaccgggataggcgtgtcgcgctggctgggagggctgctgggggtggcgttggcgctgccggcactggctttgccgcagggctgcatcgagttgctggcgcaggcgccgcgggtcgacgtcgtccagggacaacagcgtgacctgcgcctggcggtgccgatcgaacggctggccatcggcgatccgaagatcgccgacgtacagttgctggatcgtcgcggcttcctggtcaccggcaaggaacagggctccaccagcctgctgatctggaccggctgcagtcccgagccgttgcgcagcctggtggaggtcgagggacgcggtagcgtcgatacccgcggtgctccagcgttcaccgtcggcgccgtggaggagctgccgaaccaggtgcagaccgatatccgcttcgtcgaggtcagccgcagcaagctgaagcaggccagcacctcgttcgtccgccgcggcggcaacctctgggtgctcggtgcgccgggcagcctcggcgatatcaaggtcaatgccgacggcagcggcctgggcggcaccttcggcaccggcagctcgggattcaacctgatcttcggcggcggcaagtggttgagcttcatgaatgccctggagggcagcggcttcgcctataccctggcgcgcccgagcctggtggcgatgagcgggcagagcgcgtcgttcctcgccggcggcgagtttccgatcccggtgccgaacggcaccaacgacaacgtcaccatcgaatacaaggagttcggcatccgcctgaccctcaccccgacggtgatgaacaaccgccgcattgctctcaaggtggcgccggaggtcagcgaactggactacagcgccggcatccaaaacggcggggtggcggtgccggcgctgcgcgtccggcgcaccgacaccagcgtgatgctggccgacggcgaaagtttcgtgatcagcgggctgaccagcagcaactcggtgagcaacgtggacaagtttcccttggctggggcgacatcccgatcttcggtgcgttccttccgctcgaccaaggtggacaaggacgaccgcgagctgctgatgatcgtcaccccgcacctggtccagccgtggcccgcagacgcacagttgccggacttgcccgggggagggcctgcggcaatacgatccggggttctcgcgcctgtacttcttcgagcgcggcgagtacgacggccagcagaacgacaccggtctgtcggattaggaggcgcgcatgaaccagaacttcgtggcgctgacccagcatcccggcgaactcgactggttgcagaacagcctggcgtccgccggccaggtggttccggcaggcagcgccagcctggaggagctgctggcgctgctcgacgtcaccgccgccggggtgctgttcatcagcctcggcaaaagcaacctggtgtcccagggcgcgctggtcgagggattggtatcggcgcggccgatgctctcggtggtggccatcggcgacggcctggacaaccagttggtgctggcggcgatgcgcgccggcgcgcgcgacttcatcacctacggcgcccgcgccagcgagctgaccgggctgatccggcgcctcggcggacgcctgcccagcgtgccggtgagcgcggcgcgccagggcgagctgctgaccctggtcagcgcccgaccggacgccgacggcgccttcgtcgccttgcacctggccaaggcgttacaggagcagacgccgaaccaggtcctgctgctggacgtcggccagcccaccggcgaggcgctggcgatcctcggcctggactcggccttcaccttcagcgatgccttgcgcaacctgcggcgcctcgaccagaccctgatcgacagcgccttcacccgcctcgacagcggcctgcggatactcagcctgaccgacgagcccggcgtgctggagcgagtcaccaccgccgaactctatctgttgctgggcaacctgcgcggggcgttcagccatgtggtggtcaacctcaccgggctgcccgagggcgagctgagcaaccagctgctggtgcaggccaaccgcgtgctgtggatggtcgaccagagcgtgccgtcctgcaagaagggcctggagcgcctgcgccgcctgcgcgagcgcaacctgccgttgccctccatcgagttgctgatcgagcgctacctgcccaatgtggcgccggaccagcaggccctaagccggatgttcgacctcgatctgttcggtgtcctgccgttgtccccggaatcgcgcctgcgcgcgaagaacctcggcaagagcctgttcgaggtggcgccgcgcgacccattggcggccaagctgcggcaactggcggacagcctgtgcgtgacacgcggcgagcgccgttcgctgctgtcctggctcggccgggccaaggcggcgctgctatgagcacgggattcggcgcgcgtcctgacggcggtgccttccactcccgccaggagcaggacatccaggcgctgaagctgcgcctgcaccgctacatcatcgacgagatcgacgaagacggcatgaacctgctggagggcgcgcgctccgccgtggtccagtacgtctcggaaaaagtctgcgaatacggctcgcgccatcaactggcgatctcccgctacgaactggaccgcctggccgaagaggtggtcgatgaactcaccggcttcggcccgctggagatcctcctgcgcgatcccggcgtctcggaaatcctcgtcaacgggccgggccgggtgttcgtcgagcgggaagggcggctctaccagagcgacctgcgcttcatcgacgaccaccatgtgctgcgggtgatccagcgtatcctcgcgcccctcggccgacgcctggacgagtccagcccgatggtcgacgcgcgcctgccggacggcagccgggtcaacgcgatcattcccccggtggcgctggacgggccgtgcatctcgatccgcaagttcagccaggagctgctgcgcagtgccgacctgctggcctaccagagcgtcgacgaagccttgctcgagttcctccgccaggcggtctcgcgccgctgcaacatcctcatcagtggcggcaccggcaccggcaagaccaccttgctcaacgtcatcagcggcttcatcgacgaacgcgagcggatcgtcaccatcgaggacaccgccgagctgcaactcggccacgaccacgtggtgcgtctggagacccgtccgccgaacgccgagggctacggcgaggtgaccgcccgcgacctgatccgcaacgccctgcggatgcgtccggaccggatcatcctcggcgagatccgcggcgtcgaggtactcgacgtgctgcaggcgatgaacaccggccacgacggctcgatgagcacggtgcacgccaactcggcgatggattcgctgctgcgcatggagatgctggtcggcctgaccggcaacaggctgccggagcagaccttgcgcctgatgatctgcgccgcgctggacgtggtggtgcagatcacccgcctggccagcggtcggcgttgcatcagcgaagtgctggaggtgctggaggtgcgcgacggcgtgtacgtcaccaataccctgttcagtctcgaccggcgcggtagcgggcagttcgtccgccaggccgcgccggtcgggcagaaattccgccaggcgctgctgtga

SEQ ID NO: 6570 - DNA, 630 bp, Pseudomonas aeruginosa
tctcggtgttcctcacgccgctgctgttcgttctcctggtcttgctggtcaagctgctgcgcgccgaaagcgaagcgtcctacgcggtgccgctgctgttcgccgccggcatcggtttcctcctgcccaagcaggtgctcaagccacttcgccaaagcgcgccgggcgctgatcgccgacgaaatgatcctgttcgtgcaactgatccgcatcctcttcgacgccggcctgaccgtggagcagacgctgcgcgtggtctgcctggaaggccgcgggatcaccccgcaactggcccgcgagctggacctggcgctgacccgtgccgacaacggcatcgacctggcggaagagctggaggcgcttgcccggcgcctgcaggtggacccgctgaacgactgctgcggcgtgctacggcagatgttgcgccagggcggcagtgcgcgcagcaccctgctgacgctcaagcaactgttcgaagaccggcgcctgaccaccttgcaggaacgcatcggcaagctgtcggcgaagatgagcctggtgatgatggtgctgctgttcccggcgctgctgatcgtcctcgccggtccgggcgtcattgccatcaccaaggccttgggaggactgggatga

SEQ ID NO: 6571 - DNA, 288 bp, Pseudomonas aeruginosa
accatgcacgagcgaatcctgttcggcgtcttgctgctcctgtccggcacggcctgggccgcggacacgccggcggtccgtcctgccgcgccagcgacggccgaaccgcagaccgccacccgcgcctggctggccatccaggcgagcggccgggccgccagcccggttcggcaaagcgcgaccgccgccgagcgccagcgtgcctaccagcgctacctgaaaagctatgagcacgagattcccgagtacctgctggaagatcgcggcttcggcgagagcaagaactga

SEQ ID NO: 6572 - DNA, 1695 bp, Pseudomonas aeruginosa
cggttcctggcggaggggcagggcatgaacggatggcctgcaagacagcgcggggcgatcggcatcctggcggcgaccaccctgctgctggccttgatctgcctgttgctggtggtggataccgggcggctctacctggagcagcgcaacctgcagcgagtggcggacgtggcggcgctggagagtgcctcccagggagccttgtgcggcgaccagagttctgcccaggcgacgtctttcgccaaggccagcgcgatgctcaacgggttcgatgcggacgccgccggctccagcctgtcggcggaggtcggcggcgtgctgagtgccggcggcctgcgcagtttcatagccagcgcgtcgaacgcggctgccgccaacgaggcggtgcatgtcgaggtgaccaagagcgttcccggcagcctggtcgccaacctcgggggactgttcggcggcggcaatgccaacgtcgatctccgcgcagaggctgtggcgcgacgcctgccgaacgccacgatttccgcaggcacggggctggcgagcgtgaacagtggccaatcggcgttgctcaaccccatcctgagcggattgctgggcacccacatcgatctctcggcggcggcctacaacggtatcgccgacgcgaagctcagtgtgctggacattctcggcgcggatggaatgggcttgatcggggtcgataccagcctggggaccatcgaacagttgttgaataccaacgtcggcttgcagcaggtactcgccgccagcgtgaacgtcctggcgaagaacggcgtagcctcggtcgaggccctgagagcgcaattggtgggggtaaagtcggccacgttgaaactgggagacttgctggggctgagcgccggcgaggtgaacagcatgtcgcagctggatacggcgatcaatgcgctggatctcatcatggcggttgcccaggtcgccaacaagaattccgcggtcgccgtgaacctgggtatccctggattggccaatgcacggctcacggtcgtagagccgaagaggatcgtctccgggccgccagggcaggatgagagcggtgcctggcgcacggaggtgcgccagtcccaggtacgacttacggcggacatcgattccgggttcctgtccattctcgccaccacgaaactgcaactggccatcgaaggcgcgtcgggagccgtctggctgaaaagcatggcctgtacccgcccggataccgcgttggaattcggttggagaagcagcggagcgacgataaagatcggcagtccggccaacatcgatcaggtcggctcgattctggtgcttggcggcttggtgcgattggatctcaagctcgatacctcgatcgccggcagctcgggcgatacgcgattcaacgtgaaagccgacggttccgatctcgtccagagccgcaggttgccggaaagcggctttctcgccagtaccctgaaaaccagcatcaacgtcaatcccgtggtgctcggactgtgcttgcctttgctgtgcggctcgacggcgctcaccgacctcatcgtgaattccgtggtggcacctctggtcgatgggctgctgacgccgatcctgaatctggtcctgcccttgctgggggtacaacttggatacatcgacgcggagattctgaaggtcgatgtcggcagggcggaactgctgatctag

SEQ ID NO: 6573 - DNA, 1440 bp, Pseudomonas aeruginosa
ggatgcggatcggggatgtcagctcatgctcggaaaagcttcccggcgacgccagcacggcgccgtcgccatcgaattcacagcgatcttcctgctgtttttcgcgctggtctacggtctgatcagctacagcattcctttgctcatgttgcagtcgttcaacgatgccgctgccgtgggggcccgtgcggcgatcgctgtcgatccctccgatgcgggctacgagagcctcgccgaagcccgtgccagggacgagttgctcgcgcgcctggactggatgccggcggcctggcgggcgaacctccagccctgtgccggcaatggccagtacgccgactacgtcagcgccacgtcgcggatcgaggtctgcgtgcagtacccgtacggcgatccgggcaaggcgatcatccccgtgctgagcttccccggcatcggcgcgattcccaacctgccgcagacgctgaaggcgagtgccaacctgttgctgtgaggtggtcgcatgttcgaattttcccgctcgtcgtccgccgaggccgagaggccggaacccttttcgcaggaaggccccgccctctggagcgcttcgctgaggagttgggacctgtgtttcgagatggacgaacaggaccgcgtgatccgggtcggcgggcggcaggcgtatcgtctgcagtgcgcccatgggcttggcgaacagccgcggcctttcgccgagtatctggagcggcgcgcccccggtgcgccgacgctggccggcctgcgccggggcgagcgtctcgacctgacgctgcgcagcgatgccgccgcgccattgacctgtcgtttccagccgatgcagccgctcgacggcctgggacgctcgctgctgctgggcatggacatctccgacctcaactggcagtccgacaaccagcagcaccagttgcagagcctgagcctgggcaagctgatcctttcgcgtctgcgccatgtctcccacggacacctggcggaggcggtccaggagattctcgaatcgctctccggcgcgttccagatgcaggctatcgccctgctgctgggcgacggcaagggtttctgcacggtcttcgccagtcatgtgcggcctggcagcgacagtttgctgcgaccgaccctgcaactcgccgacgacgacctgcgcgaaggggcgggcgcgcgcttgctacgccgtggcgaaggcgcctcgacgctgctccggcagatcggcgaggacgcgctctacctggtgccggcggcgatgcgcggtggccgcctgggggcgttgctggtccggccgatgtcgctggagcagctcgcccaggggcccgcgccgcaggactggcaatacctcgcggaactgctggcgaaccaggtggcggaccgctgcgaactccacgagcagcacgacagttcgcgcaagctggggctgttgcaggaagatga

SEQ ID NO: 6574 - DNA, 534 bp, Pseudomonas aeruginosa
cggcggccaaccagggggagggtgcgttgttcgtggttcgcttgccgctggcggcgcccgccgaggcgggcggatgacgtcggtgggagcgcggcaaaaaaacgcctgcggacaagcaggcgttttttcaaccggcgaggcggctcagatgaattgcgaggccagccagaacaggccggcggacagcgccatcgaagtcggcagggtgagtacccaggccatcaggatgttgcgcacggtgccgccgtgcaggccgctcttgttcgccaccatggtcccggccacgccggaggacagcacgtgggtggtggacaccggcaggctgtagatgttggccatgccgatggcggcggcggcggtgatctgcgcgctcatgccctgggcgtaggtcatgccctgcttgccgatcttctcgccgacggtgagcactacgcgcttccagccgaccatggtgccgatgccgagagccagggccaccgcgatgatgacccagaacggcgcgtattcggtggtcgcggtcaggtccttgcgtag

SEQ ID NO: 6575 - DNA, 1065 bp, Pseudomonas aeruginosa
ctgactgaggtgcagggcggcgtcgcgggtgcgctcgatctggtaggtggtgctgttcaggtcgaggacgaacttggccgggacgatgccgatcagtaccagcatgatcaggccgatacccttctggccgtcgttggagccatggacgaagcttaccgccatggcggaaagcaccagcaccaggcggttccagaacggcgggtgcttcttctcgtcgagttcgcgacgggtttccggggtcttgtgcatcttcgacagcggacgccaccatttcagtccgagcaggaccaacgcggcgaccatgaagccggccagcggcgagaagatcagcgacaggccgatgtcgatcgccttctgccagttgatcccttcggccagcggcacgtcggtgatcagcgcattggccaggccgacgccgaggatcgagccgatcagggtgtgcgagctggaggccgggatgccgaagtaccaggtgccgaggttccaggcgatggcggcggcgagcagggagaagaccatcgccaggccatggccggtgttcacgttgatcagcagctccaccggcagcaggtgaacgatggcgtaggctacgccgacaccgccgagcagcacgccgaggaagttgaacacaccggagagcatcaccgcccggtagggggacatcgctttggtgtagatgacggtggccaccgcgttggcagtgtcgtggaagccgttgatgaactcgaaggtgaggacgaaggccagggccagcaccaggctgatacccacccaggcatcgagcccgctgaaaagatcgaacatgtgagaaaccggtcagagacggggcggcgattatgccagatgcgtttttatccgtctggaactccggaaggttgccattgtcgcgggcaacgccccgtcgcatcgggctttgcgggaaaaacgaaacagattgaaacgcttcgttatccgtcgctctcctgtcggttggaggtaaatggaatggggttcgctgcttcctgcccggccttgagacgctcttcttcgatcttctgcagttctctgtcgaacgcctgctcctga

SEQ ID NO: 6576 - DNA, 1647 bp, Pseudomonas aeruginosa
cgcaacgccccggaggccggagatttactcatgcagcccgctcgttcccgcatcctcttcgtctgcctgttgcagagcctggccctggttctcctgctggtcggcgcccggcatggctggctgccgctgtacctggccctgccgctcggcgtggcgctgctctggttgccctggctgcttcccggcaaccgcacggcggtggcgaccgtcggcgagcccgacatcgcccggctggctcgcgacctgtcccataacaccagccagaacgccttgtcggccgccggcgtggcgttctcggtgaagcgcctggcggagaagctgcaatcccagctcgacgccgccgaacagatcgtcggcagcgccgaagtgatgatccacaccgagcgcgccacctccaatctggcgcgccaggccatggacgccgccacccgggcgcgcgccggcagcgacgaaggccaggtgctgctggcctcgaccatcgagcgcatgcatcggctcagcgagcggatgggcgccagccgcgaggcgatcgaggcgctgaaccagcgcagcgaggacatccagcgggtcaccctggtgatccagggcatcgccagccagaccaacctgctggccctcaacgcggccatcgaggcggcccgcgccggcgagcatgggcgcggcttcgcggtggttgccgaagaggtgcgcggcctggccggacgtaccgccgaggccaccgaggaagtcggccagatggtcgccgagatccagcgccagaccagcgaggtggtcgagcagatccgccagctttccgaagagttgggggaaggggtcggccaggtcgagctgaccggtcggcaactggaaggcattgccgaactggcggccggggtggaaagccagattaccgagatcgcccagggcgccgagatcaaccgcagccaactcgccagcctgttcgccgcggtcgagcaggtgcgcggcgacctcagcgccagcgaggaacagaccctgcgcctcggcgaagctgccagccagttggagaaccaggccgaggtgatcagcgagcgcctcgccgaggtcagcctggacgcctaccaccagtcggtctacgacctcgcccgggagggcgcggcggctatcgccgctcgcttcgaggaggacgtgcgcagcgggcgcatcgacctcgacgacctgttcgaccgcagctaccagccgttgcccaatacccagccgaccaagtaccggacccgcttcgacagctacaccgaccaggtcctgccgggcatccaggagcagttgctggagcgcaaccgcaacctggtattcgccatcgcctgtacccccgaaggctacgtgcccacccacaatcgcgccttcgcccatccgcccagcggcgacccgcagacggacgcgttgcgcagccgcagcaagcgcctgttcaacgaccgcaccgggattcgctgcggcagccaccagcagccgctgttgctacagacctacacccgtgacaccggcgagctgatgcacgatctttcggtgccgatcttcatccacggcaagcactggggcggcctgcgcctcggctaccggccggagggcgcggagccgggcaaggcggccgcgccggcggcgcaggggctgagcctggccttgaatggctag

SEQ ID NO: 6577 - DNA, 1047 bp, Pseudomonas aeruginosa
acgtcgaaagactgcccctggagatcgggaaggcgcagcaaggtggtggtcgacatgtccgaacctacgggtggtttgtctggagttcattatacgtctgtattcggactggctcagaatggccgcgtattcctttttcatagtgcggaacctcccatgcaatacctgtttcccctgctggccgtgttcatctgggccggcaacaccgtcgtcaacaagctcgccgtggggatcatccagcccgccgagatcggtttcttccgctggctgctggtcggcctggcgctgacgcccttcatgctcggcccggtgctgcgcaaccgccgctacatcctcgccaacctcggcaagttcgtggtcctcggcctgctcggcatggccgtctaccagagcctggcctactacgcggcggcgctgaccagcgccaccaacatgggcatcatcctgtcgctgatgcccctgatgtcgctgggcctggccagcagcatcctggcccaccggctgaacgccggggcgctgctcggcgcgctggtgtcgctggccggcgtggtgctggtgatctcccagggccatctcggcgctttgctggagcatggagtgaatctcggcgacgcgatgatgatcgtcgccaccctggcctatgcggtgtacagcgtgctgctgaagaaatggagcctgaagctgccggccatgcaactgctctacctgcaggtgctggtggcgatcctcgccctgctgccgctgtacctgctgtcgccgcgcaccggcctgaacgccgccaacctgccgctggtgctgtacgccgcgctgttcgcctcgatcgtcgccgcgctggcctggatgcacggtgtcgcccgtctcgggccgagccggatggccctgttcttcaacctgctgccgatcatcaccgcctgcatcgccaccctggtgctcggcgagcgcctgaccgtccatcacctggtcggcggcgcgctgaccctggccggggtcctgctggccgagttctggcagcgccgcccggcccgtctgcgctcggcaacctgctga

SEQ ID NO: 6578 - DNA, 3273 bp, Pseudomonas aeruginosa
agctggcattggccgaagatccccgcgaggacggcggcggcggtggcggcatcgccgcggcgctggaggtgcagttgccggcgcagttcctctggcaggcctatcgcgcggtgctgggcccgcgaaagcattcccgaggtttccgaactggacaaggcgccgctgacctggcgcctgatgcgtctgcttcccggattgctggagcgtcccgagttccgcaccctgcaacgtttcctcgccgacgatgccgacctgcgcaagcgtcatcaactggccgagcgcctggccgacctgttcgaccagtaccaggtctatcgcggcgactggctcgacgactggagccagggccgcgaccagttgcgcacggcgaacgggcaggcgcgcccgctcggtgccgacgagcgctggcaggccgaattgtggcgcgcgctgctcgccgacgtcggtgccgatagcctggcccgcagccgctccggcgtgcaccggcgcttcatcgaggcgctgcgctccgccagcgcggcgccgcgcgcgttgccgcgacgagtggtggtgttcgggatttcctcgatgccggcgcagaccctcgaggcgctggccgccctggccaggttcagccaggtgctgctctgcgtgcacaacccctgtcgccaccactgggccgacatcgtcgccgacaaggacctgttgcgccacgagtaccgccgccagcagcgccgcgccggcgtccccgccgacctcgacgaggaccgccagcaccagcatgcccagccgttgctggcggcctggggcaagcagggccgcgactacatcaacctgctcgacagctacgacgacccggacagctatcggaacctgttcggcgaggtcaacggcgggcgcatcgacctgttcagcgaggaggccccgcacgggctgctcggccagttgcaggacgatatcctcgaactgcgcccattggcggaaacccgcgagcactggccgccggtggcgccgcggagcgacgcctcgatccgcttccatgtggcccacagcgcgcagcgcgaagtggagatcctccacgaccagttgctcgcccgcttcaacgccgatccgagcctgaagccgcgcgacgtgatcgtcatggtccccgacatcaacgcctacgcgccgcacatcgaggcggtgttcggccaggtgccgcgcgacgaccagcgcttcattccctataccctggccgaccagggacagcgcggtcgcgagccgctgctgatcgccctggagcacctgctgaaactgcccgacagccgtttcgccgtgagcgagatcctcgacctgctggacgtcccggcattgcgccggcgtttcggcgtcgacgaggccgacctggcgaccctgcaccgctggatcgaaggcgccggcgtgcgctgggggctggatgccgcgcagcgcgagcgtctcggcctgccagcgggactggagggcaacagttggcgcttcggtctgcggcgcatgctgctcggctacgcggtcggcgaaggcgcggccctgcaaggcatccagccctacgatgaggtcggtggcctggacgccgccctggcaggcccgctggctgtgctgctggagcgcctcgaggtggcctacgccgagctggccgaaccggccaccccggcgcagtggggcgagcgcctgcaggccttgctcacggtgttcttcgaggcccacgacgagcgcgacgagctgctcctcacccagctcctgcaactgctcgagcgctggcaggagcactgcgcctgtgcggccttcgccgagccgctgccgatcagcgtgatacgcgaggcctggctcggcggcctggaccagggcggcctgaaccagcgcttcctggctggcgcggtgagtttctgcacgttgatgccgatgcgcgcgatcccgttccggctggtctgcctgcttggcatgaacgatggcgactacccccgccagcagtcgccgctggatttcgacctgatgcgcaacgactaccgccccggcgaccgctcgcggcgcgaggacgaccgctacctgctgctcgaggcgctgctctcggcgcgcgagcagctctacgtgagctgggtggggcggagtatccgcgacaatggcgagcggccgccctcggtgctgatcggccagttgcgcgatcacctggcggccggctggcgtctggacccggacggcgacggcgaggcgctgctgcgtgccctgacccaggagcatccgctgcagccgttcagccgtcggtattttcacgatgcgccggagcagggcgtcgatggcctgttcacctacgcccgcgagtggcgcgaggtccatagcgaggacgacatcgccgttcccgacgccgaagcgtccctgccgccgcttgaactggagggcgcactggggctgcgagcgctggcggagttcctcgccaacccggtgaatgcgttcttccagcagcggctcaaggtgcgtttcgacgacgagcaattgaccggcaacgacgaagaacctttcgaactggacgcgctggacaactggaagctgcaattcgagctgaccgaacgcatgaagcgctgggtcgagcgggactgggatgccgagggcctgccggcgcagttgcaggcccaggtcgagcgactgcggcgacagggtcgcctgccgctggcggcgttcggcgagttctccgcgcgccatttgctgcaaccgctgcccgacctgctctggcgctaccgccaggaaatcgagcgctggccggaggcggtcgagcagcagcaggagttgcgccatcgccatccgtccgggctggagctggaggactggctcggcggcttgcgtcgcgacgcttccgggcgcctggcgcgcctgcagttgctcagcggcaagctccatgaagggcgcggcttcaagtggcacagcctggtgcgccactggttgcagcacctcgccctccaacgtctaggccagccggtgagcagcgtgctggtgagccagaccggcaccctggagattccgccgttgccgagcgagcgtgccggcgagtacctcgaccagttgatcgacgcctggcgccagggcatgcgcccagccgttgccggtggcctgccggaccgctttcgcctggctcgcccaagtggtggcgccgcagagccccgagaaagccatgcgcgaggcgcgcaagcgctacgagggagggttcggcatggggggcgaggtggacgcctcgccggcgctggctcgggtctatccggatttcgaccggctgctcgccagcggtga

SEQ ID NO: 6579 - DNA, 3810 bp, Pseudomonas aeruginosa
gttcgcgcactgggccgagcagctctacgcgccgctgctggctgccctgggacgtggcgcggaggagcaggcatgagccagcagcagatgcccgtggccctcgatccgctggacttcccgttgcacggcagccgcctgatcgaggccagcgccggtaccggcaagacattcaccatcgccctgctatacgtacgcctggtcctcgaccatggcggcgagaacgctttcggccggccgctgagcccgccggaaatcctcgtggtgaccttcaccgatgcggcgacccaggaactccgcgagcgtatccgcagccgcctgggcgaagcggcgcgttgtttcgccgagccgcaggagcgccacgacggcctgctggtcgcgttgcgccagcagtatcccgccgagcgctggccgggctgcgcgcgcctgctgcgcctggccgcggagtggatggacgaggccgcggtatcgaccatccacagttggtgctaccggatgctgcgcgagcacgccttcgacagcggcagcctgttcacccagaacctggaaaccgaccagagcgaattgctcgccgaagtggtacgggactactggcggcgtaacttctacggcctgacggctccggcggcgcaagccgtggccagttgctacagcgggccggagacgctgggcaaggccttgcagccgctgctggcgcggcaggacgccgacttccgctacgccgaccaggcgctgagtgcgcccgagtcactgacagccttgctggagcagggcggcgactggtatcgccagctcgaccaactggacgcgcaggcccgcgccgcctggcgcgcagcgcgcgtcgaactggaagcgctgctgcgcgacctgcgtccctacctgaacggcaacagctatcgcggcaaggacagcgacgagaccttcgacgcctggctgcaagcgttggcggactggagcgagggcggcgagcagccggccaacctcggcaagttcggccagacccggatcaagctcaccgccaagcgcgtggcgcccaagcatgccgcgctaagggccatcgacgcctgggccgcgcatcaggaagagcgtcccgatctcgctccccacctgttgttgcacgcgttgggcgaagtcgggcacgaactggagatcgagaagcagcggcgtgccgagatcggcttcgacgacctgctcagccgcctcgaccgcgccttgcaggggcctggtggcgagcgcctggcgcaattgatccgcgagcagttcccggtggcgctgatcgacgagttccaggataccgacccggtgcagtaccggatcttcgagcgcatctaccggatcgccgccgatccctacgagccccaggcgcgggaaaccggcctgttcatgatcggcgaccccaagcaggcgatctacgccttccgcggtgccgacatccatacctacctgcgcgcccgcgaggccactcgcgggcggcattacacccttggcaagaacttccgctcgaccgccgccatggtggcggccgccaaccgctgcttcgccttcgccgaagagcatccgcgcggcgccttccgtttcgcccgcgaggggctggaaaacccggtgccgttccatgcggtggacgcccaggggcgcgccgaacgtttgttgatcgacggtgccgaggcgccagcgatgacgttctggaaccttgatgtcgaagccggcgtgctcggctccgcggcgtatcgccaggaaatggccgagcgcagcgccagcgccatccgccgctggctgagcctggccgacctgggccgcgccggcttcgccgacgagcagggcggctggcgggcgttgcgcccggcggatattgccatcctcgtccgcggtcgcgccgaggccgaggcgatccgcagcgcgttggcggcgcgacgactggccagcgtctacctgtccgaccgcgactcggtgttcgacagccaggaagccgccgacctgctgcattggctgcgtgcctgcgccgaccccggcgccgatgcgctgctgcgggtcgccctggctacccgcagcctgcacctggactgggcgaccctggaacgattgaaccaggacgaactgttctgggaacggatggtcctgcgcttccgcgactatcgccggtcctggcaggcccagggcgtattgccgatgctgcggcgcctgctcgccgacttcgaactgccggcgcgcctgctgcggcatgccgatggcgagcgcagcctgaccaacctgctgcacctggccgagtggctgcagcgcgcggcggtggaactggacggtgagcacgcgctgatccgccatctggccgagcaggtgcagagtccggggagcgaagagatcctccgcctggaaagcgacgccgacctgatcaaggtggtgaccatccacaagtccaaggggctggaataccccttggtgctgctgcccttcatctgcagctggagggagctggacggcaacagcggcgcgccggcgagtttccacgaggatggcgctgcagggcgggtcatcgagctggcgcggcgcaaggagcaggctgcgcgggcctacgagcaggccaacgacgagcgcctcggcgaagacatgcgcctgctctacgtggccctgacccgcgcccgccattcggtgtggctgggcatcgcgccgctggtggcgagcaacagcaagtcgccggagttgcacaagggggccctgggctacctgcttgccggcggcgcgaccatcggcagcgatggcctcggacaatgcctcgccgcgttgcgcggcgagtgccgggagatcgtcgtcgagccggcccccgaggcggacgccgaacgctatgtcgcacggcgcggccagggccttgggcaggcccgcgaaactcgccgcagcagccgcgagaagtggtgggtcgccagctattccggcctgcaattgcaggcctccgccgggctggacgatgacgatgtgttggagagcgacgaatcgcaggagccgatcagcgccgaggaagccaccttccccgaagaaggccgttccgccgaacagccgccggtcgcgcacgccagcgagatgcgcgacgacctgcatcgcttcccgcgcggaccggctcccggcaccttcctccacgggctgctcgaatgggccggccgcgaaggcttcgatgtggcgcgcgccgatgcccagcggcgccgcgaactggtcgcgcgacgctgcgatctgcgtggctggaaggactgggccgaaccgctcgacctgtggctggagcagtatctcgccgaaccgctgcgctggcccggtggcgaaaccagcctggccgggctggtcgcctaccaggtggaaatggagttctggttcgccacccaccaggtccaggccgaggcgatcgacgccctggtccggcgccataccctcggcggcgcggcgcgtccggcgctggcgccgaccctgctgaacggcatgttcaagggcttcgtcgacctggtcttcgagcaccaggggcgtttctacgtggccgactacaagtccaactggctgggcgccgacgatggcgcctacagcccggaagcgatgaccgccgcggtgctggagaaccgttatgacctgcagtacgtgttgtacctgctggccctgcaccggcagttgaaggcgcgcctgcccgactacgactacgaccgccacatgggcggcgccgtgtacctgttcctccgcggcgcccgcgcggcgacccagggcctgcacttcgagcgcccgccgcgggaactgatcgaacgcctggacgcgctgttcagcggccagccgggagccgagcgatga

SEQ ID NO: 6580 - DNA, 462 bp, Pseudomonas aeruginosa
aggccggcgcggtgctcggcgatctctgccgggatgccgaggagggctggtacagcgccgagacccgcgcctggttgcagcgggtcagcggcgaaacctggcagggcttgcgcgaaggttcggcgcaggcgcatccgctggcgcaacagaccgtcatgctgcggcattcccggcgcttcggcgcgagcagcgggatcgggcgcctggcgcggttggtcaaccggcaacaggccggcgacgcgcgcgcgctgctggacagtccgcccgccgacctcttcgacctgcgcctgcgcggggagcgcgatgcagccttcgcccggctgttcgtcgacggtcatccgcaggcgccgggcacgccgtacggctaccggcactacctgcaacgcctggccgagggccgcccggccgccggactggcgctggaggatggcgcctgggagcgctgggcgcagtcggtactga

SEQ ID NO: 6581 - DNA, 1794 bp, Pseudomonas aeruginosa
aggttccgggactgggcggtcgcccgcaatgcatcgatttttccgccgactgccggtggacctgcgaggacgtcacgcccggtcatttcgattccggcttccatctgctggcgccgcccgccgaattcctcgaactggtggaggcgctgcgccgctacttcagcttcccccgccagccgcagtcggtctgatccgtcaaagcacgccggcgcgcttccagcccaggtagcggctgatcagctccggcccgagttcgctgggacgcgcatcgagcactggcacgccgtgggccgcgagcttctcgtggaggccgttgcgcgcattcaggtagtcgatggtgccggtgtaggcgagcgcctgctcgtagcgggcgaccggctcgtggcgcagggtgtcgagcacttcctcgcgcaggctggcgaccagcacccggtgctggcggcccaggcgtttcaccgcgccgagcagttcttcgtcgtcctcgtcgcgcaggttggttaccaggatcaccagggcccgccgccgctggcgggacagcaccgcctgcacggcttccgggaaatcggcgggacgctggctggtctgcaggtcgtagacggtgttgagcagcgcgccgagctgggcgctgcccttgcccggcgggagatgccggcggtcgtcgccggcgaaggtcatggcgcccaccgcgtcgccctggcgcagggccacgtaggccagcagcaggctggcgttgagggcatggtcgaagtgcgacaggtcgccgtcctggctgcgcatgcggcggccgcagtcgagcaggaagaggatctgctggtcgcgttcgtcctggtattcgcgggcgatcggcgtgcgtttgcgagcggtggccttccagtcgatctggcgcagggtgtcgccgtcgcggaattcgcgcaactggtggaactccaggccgaggccgcggcgctggccgccgcgtacgccgatctggttgagccagtggtcgaccgccatcagttcggcgccgtagaggcgggcgaagtccgggtagacgcgggtctcgccgcgtgcttccaggtagcggcgctgccgccacaggcgcagcgggctgggcagttccagctcgcagcggggaaacacgaagtgaccgcggttgagcggccgcacccggtagccgacctcggtgctttcgcccgggcgcagttcgacctcctgcggcaggtactcgaaatccatgccggccggcaggtgatcgaacagggtcaggcgaaccggacgccgataggtgtgctgcagatgcagacgcacttcgctccagcgccccagcggcaggttgccgctgagctggcggctcagcttcggcaccgcctggcggcgcgcccacagggcgtccagcaggccgagcaggagcagcgcggcgagcgccgcccaccagaatgtatgcagttgcgcaggcaaccgctggccgagcgccgacaggctgcccaggccgatggccagcagcaggagcgcggcgaacagcgccagcagggcgcgcgatggcttcatacgcggggggccggtacctggtcgagcaactgttgcaggacctggtccaccgacagcccctcgatgtccagctccggagacagccggacccgatggcgcaggaccgccagggcacagcccttgatgtcgtccggcaccacgaactcgccgccgcgcagcagcgcccgcgcccggccgcaacggaccagggcgatcgacgcgcgaggtccggcgccgagggccaggcccggccagttgcgggtggtgcgggccaggcgcacggcatag

SEQ ID NO: 6582 - DNA, 438 bp, Pseudomonas aeruginosa
tggcgctgggtggcaggcgggtcatgcgcccgaggatctgccattgctcggcgacgccgagctgttcgaaaccggggtggcgacgccgcgccctgcgcaggatgtcgcgttgcagaccgtgcagcaaggcgacgtggccgcgctggcggaggaggaagtcggcgccggcgcgcaggtgttcctccagttgccggcgcgaacggctggccaccggctgcaagggaccctggcgcagccctgcgcgccacaggccggcgagcaacaacagcagcgctgccgccagggcctcggggaagtggcgggcgagcagggtggcgaggctgtcgcgttcggcgcggtagagcagggtcacctggttgtcctgggtcaggtaccagagcagccaggcgttgtcgtactgctcgatgttgcggttccgccagatccaggcgtcggtga

SEQ ID NO: 6583 - DNA, 1842 bp, Pseudomonas aeruginosa
ccccctgcttgcgcaggaacagttcggcggccaggtagggattgcgccgggcctccggcgatgggccgaggtcgatcgtctccgtatagggttgcaggcggctggccaggaagatcgccagcagcccggccagcagcaggagcacggccagcagcaggaagcgcgcgcgccggctcatcatggcttggctcccgcggcgaaaaggctgcgccagccgtcgcagaggcgctggcgagcgtcgtcggccggcagccggtggccgtaggcgagcgcctgccattgggcggtcagcagttggctgtagtgcagcagcggccgttgttgctccagtccttcgaccagacgcaggacctcgccctcggtatgggagcccttcaacggcaggcggtagtcatgcagcagtcggctgagcagcccgcggtagagcaggccgagggcttcccgtggtttctcgttccagagccgttcggcgttgccggcgatgtcgtcgggcaggctttccggactgagatcgaggccgaacatcaccgtcggcgcttcgcggcgggcccgttgcggcaagcccaggttgccgacgaacaggcgcagccattcacggtagcgccagaccagcaggaacaccgcgctgaacagcagcgcccagagcagcacttcgatgacctgcgccgcgtgacggaacggcacccagttggccagggcctcgaagaatgccttgagccgctcttcgtcctccttgcggctgtcctttttctcggtcttgtcgccgaagcgccagcccgtaacggtctcgctgttcttgaacggcgcgccgtcgacgatcgcccggatctgcttgccggcctgttcgctgttgagtttctgccgcagcaggcgggcctgctcgggcggcagctcggcttcgccggcgctggtggcggccgccggctcggcataggcggaaggggcgggcagccaggccagcgaagcggtcaggccgagcagcaggacataggcgctgccgaccagacgctggcgcaggcggcggaacaccagctcgatgtcccaggcctccagttcggtgcgccggttcaagtagagggtgaagccgcaggccacgtagatcggctcccagactaccagcaccaggacgtagagcaggttcgacaggtgctccagccagagccactcgccggcttccgggtcgagcaggctctgccagttccagtcgatctcgttctgcgccgggatcagcaggtagagaagcatggcgaagccggcccagagcgccatttccaggtgcacgccgaccacggtcagccaggtcgcgccgccggcgttgcgctgggacaatacgatcaggcgctggctgcggggctccccggcgagcccttccagttgcaggaccggcaggtcgaagctgcgcgtcggactgaagcggcgccacagcaggctggccggcaactgcttcctcagcagggcgggataggcgcgcagggcctgcctcagggttggcgtatcgccgaacagggcgtgcgagagaatgtacagcggcagccgttcgaaggccggcttgagccaccagaagatcaggatcgccagggtcggatgctgccacagcaggaggctgagcacggcgaacagcggcagggtcagcaacgcccagctgcccatcagcaggcgcgcatggcgatgcgccaggaggatgccgaggtcgagcgcttcccaggcgctgcgcgggcggatcgccacgctggcgtcagtcaggcgcatggcggctccgtccggcgaacaggaagtagctgccgaccagcagccagaggaccgcgccgaccgcgtacttcacccgcggctcgaaatgactga

SEQ ID NO: 6584 - DNA, 702 bp, Pseudomonas aeruginosa
ccgctgggacctgatcgacatggtccgtaccgcctatgccctgcgcccggagggcatccagtggccgcagctggacggccggctgtcgctgaagctggaaatgctcaccgcggcgaacggcctggagcatgggcaggcccacgacgcgctttccgatgtccgcgccaccattgccctggcccgcctgatccgtcagcgccagccgcgcctgtacgattacctctaccagttgcgcagcaagcacaaggtgctcgaccaggtgcgcctgctgcagccgctggtgcatgtctccggacgcttttccgcggagcgccatttcctctcggtggtcctgccgctggcctggcacccgcgcaaccgcaatgctctgatcgtctgcgacctctgcgccgatcccgcgccgctgctggagttgtcggccgaagacttgcgcaggcgcctgtatacccgtcgcgacgaactggccgagggcgagttgccggtgccgctgaagcagatccaggtcaaccgttgcccggtggtggcgccgctgtcggtattgcgcgccgaggatcgccagcgaaccggcatcgaactcgaggagtgccagcgaaaagccgagctgttgcgccagcatcaaaccgtctgggcggacaaactgacagcgctatatggcgaagaaagtttctccgccagcgacgaccccgagcaacagttgtatga

SEQ ID NO: 6585 - DNA, 1974 bp, Pseudomonas aeruginosa
ccgcatcgcggttgtccgccggttcggcgacgagaccggccggtctcagatcttgaagctgtccaccagttggcgcaggcgcccggcctgggtttccagctcgccacaggcgcgcagggtggcctggaggttctccacgccttcctggttgagggtgttgatctcggtgatgtccatgttcagcgagtcgaccaccgcggtctgctcctcggtggcggtggccaccgactggttcatcccgtcgatctcgccgatccgccgggtcacgctgctcaggctttcgccggcacggttggcgatctccacgctctccaggctgtagcgctggctctcggtcatggtggccaccgcctcgcgggcgccgacttgcagctcttcgatcatcttctggatctgctgggccgactcctgggcgcgatgggccaggttgcgcacctcgtcggcgaccactgcgaagccgcgtccggcctcgccggcgcgcgcggcttcgatggcggcgttgagggcgagcaggttggtctgctcggagatgcccttgatcacttcgaggatctggccgatgttcaccgtgcggctgttgagggcctcgatgttggcgcaggaggcgctgatcttctcggaaagctcgttcatcgcgcggatggtctgctcgaccacctgtttgccgtcctcggcctggtggttggcgtcggacgcatggtgcgaggcatcggcggcgttgcgggcgatttcctgggcggcggcgccgagttcgttgatcgccgcggcgacgctgttggtgcggttggactgctcgtcggagttggccatcgaagagttcgaggcgttcaccaccagttgcgagacgtcgtgcagtttgtgcgcggtcccggcgacttcccggatcgagcgatggatacgctcgacgaactggttgaaggcatcgccgagcactccgaattcatcgcggctggtcacggcgaggcgcttggtcaggtcgccctcgccctgggcgatgtcctgcatggcacggcccatcaggtgcagcggctgcatcagcaggcggatcagcaggccgagcaggaccaggatggcgacgatggagatcagcgcggcggcgatggccgagacgcggaacttgctgagcatggcgtaggccttgtccttgtcgatggacagcgccaggtaccaggtcaccgaaggcaggcccttgataggggtaaaggcgaggatgcgggtatgcccgtgcaattcggcctcgctgaaaccggtggcgatcttcggcgtgttctgcgggtagacctcgctcagggtcttcatcacctgctctttgtccgggtgcaccaggatcttgccgtcgccgctgaccaggaaggcgtagcccatgccgctgaagtccagcgaattgatgatctgcaccagggtcttcaggctgaggtcgccgcctaccacgccgagggtgttgccagcggccttcaccggtgtcgccgcggtgatgatcaattcctgggtggcggcgtcgacgtagggttcggtcagggtcaggccgccggccgccacggcgtccttgtaccagggccggctgcgcggatcgtagccggccggcatcgggctgtccggacgcatggtgaagacgccgtcctgctggccgaggtaggtgaagctgaaggtcgaggtcagggccggctgttcgagcagggcgctgacggtttccgggctgtggtcgcgggccagggtctgggcggtctgctcgaccagcagcagacggccgccgagccagttctgaatgttgctggaagtcacgtcacccatttcccgcaggtagctttcgaggtcctcgcggatcgcgttgcgctgcaggtaatcgttgtagagggtgaacagtgcgaaagcggcgaacaccacgagggaggccgcgaggaggatcttgtggctgaacttcagacttttgatcatgttgtattgcgtccaggagtatgtagcgccagtctttga

SEQ ID NO: 6586 - DNA, 1647 bp, Pseudomonas aeruginosa
agctggacggccagatcgggtcgatgcgctggcccgacgcccttcgcgggaacccgcgcatattggtacgcgggttccgctggaagccccgttgcacaagggctttcccttactgtcggcacagcgtgccggagctttagtcccgaggatgaatggatgtcgcaagcgaatgagttgttgatcggcgctggccccgatggccagccggtaggacaggcctggcgcctggccaaccgtcatggattgatcgccggcgccaccggtaccggcaagacggtgaccttgcagcacctcgccgaatccttcagcgatgccggtgtcgcggtgttcgccgccgacatcaagggcgacctgtgcggcatcgccgcgccgggcaacccgcagggcaaggtcgccgaacgtatcgccagcatgccgtggctgaactaccagccgaaggcctacccgaccacgctctgggacatcgccgggaagaccggccacccgttgcgcaccaccatcagcgagatgggcccgctgctgctggccaacctcctggagttgaccgatagccagcaggccgcgctgttcgccgccttccaggtggccgaccgggaaggcctgctgctgctcgacctgaaggacctgaaggcgctgctcaaccatctgaaggacaatccggaaatccttggcgaggaccgggcgctgttcactggcgcttccgggcaggcgctgctgcgccgcctggccactctggagcagcagggcgccgaggccttcttcggcgagcctgccctgcaactggaagacatcctccgccccgagccggacgggcgcgggcgcatccacctgctcgacgccagccgcctggtgcacgaggcgccgaaggtctacgcgactttcctgctctggctgttggccgagctgttcgagcaactgccggagcgcggcgatgccgacaagccggtgctggcactgttcttcgacgaggcccacctgctgttcaacggcacgccgaaagccttgcgcgaccgcctggaacaggtggtccggctgatccgctcgaaaggcgtcggggtgtacttcgtcacccagtcgccgggcgacctgccggacgatgtcctggcccagctcggcctgcgtatccagcatggcctgcgcgccttcaccgccaaggagcagaaatcgctgcgcgcggtggccgacggtttccgcccgaacccggcgttcgacaccctgggggtgctgaccgaactgggtatcggcgaggcgttggtcggcaccctggaggaaaagggcacgccggccatggtccagcgcgtcgcggtggcgccgccctattcgcggatcggcccgctgagcgacagcgagcgcgctgaactggtccagcggtcgccgttgaagggtcgctacgaccagccgatcgatcgcgagtcggcctacgaggtgctggcgaacaaggcgggcgccaagcccgaggtccagggccaggcgactgctcagcaggaaagctcgtccggcgtcggcggcatggccgggcagattctcggcagcctgctgtccaattcgacggtgaagagcgccatgcgccaggcggccaaccagttgagccgggagctggtgcgtggcctgctcggctcgttgatgggcgggaagaagcggcgctga

SEQ ID NO: 6587 - DNA, 423 bp, Pseudomonas aeruginosa
cgagcgggacggcgaatcgaccccgctggcgcaactggtgttgcctggcgtccgggtactgacctacggcgagcggatcgccgtgggcagcgatggacaggaccgctcgaaccaggaaaaggacccgcgtccgccgcgtaccgcggtgctggcggtaccggaggacggcgtggcgcggctgatgctggcgagccaggccggttcgctgcgcctggccatccgcagcaaggacgaagaactctaccgcagggagcaggaaggcgcgctgctgcaagcgtcgctgggcgcgccgagcgcggcgctgagtctcgaccaactgctggagcgccgcaaaccgacggcgccgagcgtgcgcagcgcggctccgcgcgtgccggtggccaacggggtcacggtctaccgtggcagcgccatgacccatga

SEQ ID NO: 6588 - DNA, 1194 bp, Pseudomonas aeruginosa
gaggcgcgcatgaaccagaacttcgtggcgctgacccagcatcccggcgaactcgactggttgcagaacagcctggcgtccgccggccaggtggttccggcaggcagcgccagcctggaggagctgctggcgctgctcgacgtcaccgccgccggggtgctgttcatcagcctcggcaaaagcaacctggtgtcccagggcgcgctggtcgagggattggtatcggcgcggccgatgctctcggtggtggccatcggcgacggcctggacaaccagttggtgctggcggcgatgcgcgccggcgcgcgcgacttcatcacctacggcgcccgcgccagcgagctgaccgggctgatccggcgcctcggcggacgcctgcccagcgtgccggtgagcgcggcgcgccagggcgagctgctgaccctggtcagcgcccgaccggacgccgacggcgccttcgtcgccttgcacctggccaaggcgttacaggagcagacgccgaaccaggtcctgctgctggacgtcggccagcccaccggcgaggcgctggcgatcctcggcctggactcggccttcaccttcagcgatgccttgcgcaacctgcggcgcctcgaccagaccctgatcgacagcgccttcacccgcctcgacagcggcctgcggatactcagcctgaccgacgagcccggcgtgctggagcgagtcaccaccgccgaactctatctgttgctgggcaacctgcgcggggcgttcagccatgtggtggtcaacctcaccgggctgcccgagggcgagctgagcaaccagctgctggtgcaggccaaccgcgtgctgtggatggtcgaccagagcgtgccgtcctgcaagaagggcctggagcgcctgcgccgcctgcgcgagcgcaacctgccgttgccctccatcgagttgctgatcgagcgctacctgcccaatgtggcgccggaccagcaggccctaagccggatgttcgacctcgatctgttcggtgtcctgccgttgtccccggaatcgcgcctgcgcgcgaagaacctcggcaagagcctgttcgaggtggcgccgcgcgacccattggcggccaagctgcggcaactggcggacagcctgtgcgtgacacgcggcgagcgccgttcgctgctgtcctggctcggccgggccaaggcggcgctgctatga

SEQ ID NO: 6589 - DNA, 423 bp, Pseudomonas aeruginosa
tccagcgtatcctcgcgcccctcggccgacgcctggacgagtccagcccgatggtcgacgcgcgcctgccggacggcagccgggtcaacgcgatcattcccccggtggcgctggacgggccgtgcatctcgatccgcaagttcagccaggagctgctgcgcagtgccgacctgctggcctaccagagcgtcgacgaagccttgctcgagttcctccgccaggcggtctcgcgccgctgcaacatcctcatcagtggcggcaccggcaccggcaagaccaccttgctcaacgtcatcagcggcttcatcgacgaacgcgagcggatcgtcaccatcgaggacaccgccgagctgcaactcggccacgaccacgtggtgcgtctggagacccgtccgccgaacgccgagggctacggcgaggtga

SEQ ID NO: 6590 - DNA, 789 bp, Pseudomonas aeruginosa
ggagctgcgcatcctcgccctgggcgtctcggtcaaccaccgttatggcggcaataccagcgacctgctggacagcatcgtcaagctcatccacgagcgcgagaagctcagccggcagttgcacgcgatgaccggcgagacacggatcagcgcctatgtcctggccggcgtgccgagcgccctgggcggctacatcctggcgagcaacccgggctatctgctgaacatgtgggccgacggcaccgggcgtttcctgctgctggcctcgctcgggctgcaactgctcggctgctatgcgctgtggcgcatgctcaagagcgtctaggaggtggccatgcaggcacagtggctgattttcgcggcgctcctgatggcggtcggcggtgccttgttgctgttgctccaggcgcgcaacggcagccgcgagcagcgcctgatcgagaggcgcctgggagcgctggccaaccctggcggctcgaccaggtggctggccggcatgaccgagcggatggacgacagcttctgggtgcggcgcctgcaactgatggacagcgaggcccgccagttgctgcaacaggccggctggcacgagagtcgctaccggaccctgtacctgatctcggtgttcctcacgccgctgctgttcgttctcctggtcttgctggtcaagctgctgcgcgccgaaagcgaagcgtcctacgcggtgccgctgctgttcgccgccggcatcggtttcctcctgcccaagcaggtgctcaagccacttcgccaaagcgcgccgggcgctga

SEQ ID NO: 6591 - DNA, 1032 bp, Pseudomonas aeruginosa
tcgtcctcgccggtccgggcgtcattgccatcaccaaggccttgggaggactgggatgaaagcactgatcggcatcggcctgtgcgccgccctgctcggcggttgcgccgcgctgccggggcgggacggcccacgggagtgttcgcagcagctcggccaggagcaggaactgcagatgaacatggtccgcgacatgatccgcgagggccgcctgcatgcggccctggccaacctggaaagcatgccgccggggttgctcgacgtgcgcgaagaaagggcgctgatcctgcgccggatcggcgacccgcgggccagggccgagtaccaggccctgctggaaacctgcaaggcacccgaggcgcaccacggcctcggcctgctcgccctgcgcaatggcgacagcgcccgggcggtcctcgagctgcgcgaggcggcgcgcctgcggccgaccgagagccgcttccgcaacgacctgggggtcgccctgctcaagcgcggcgaccgtgtcggcgcgcgcttcgaattcatcactgcgctggagttgcagcagggtggcaagctgccggcgaccaacctgctcggcctgctgtacctgcaaggcgaccgggaagatgcgcagcgcctgatcgagcgtttgcagctggatgcccgggacatccgcgcggccgaggcgcgggcgcgcagctggggtgccgtaccgacacccggcgcggcgccggcaagcgacgacccgctggcggaactgccggcggaggcgaatatgcataccgcgatggccaacgaggcgccctgagccggcgccggagaggtgaaccatgcacgagcgaatcctgttcggcgtcttgctgctcctgtccggcacggcctgggccgcggacacgccggcggtccgtcctgccgcgccagcgacggccgaaccgcagaccgccacccgcgcctggctggccatccaggcgagcggccgggccgccagcccggttcggcaaagcgcgaccgccgccgagcgccagcgtgcctaccagcgctacctga

SEQ ID NO: 6592 - DNA, 579 bp, Pseudomonas aeruginosa
ttgctccatcctgttcttcagccttttttcgacatctggattaataccttttcagtaacgttggcggagcgaatgacgactagtattaaggatgcggatcggggatgtcagctcatgctcggaaaagcttcccggcgacgccagcacggcgccgtcgccatcgaattcacagcgatcttcctgctgtttttcgcgctggtctacggtctgatcagctacagcattcctttgctcatgttgcagtcgttcaacgatgccgctgccgtgggggcccgtgcggcgatcgctgtcgatccctccgatgcgggctacgagagcctcgccgaagcccgtgccagggacgagttgctcgcgcgcctggactggatgccggcggcctggcgggcgaacctccagccctgtgccggcaatggccagtacgccgactacgtcagcgccacgtcgcggatcgaggtctgcgtgcagtacccgtacggcgatccgggcaaggcgatcatccccgtgctgagcttccccggcatcggcgcgattcccaacctgccgcagacgctgaaggcgagtgccaacctgttgctgtga

SEQ ID NO: 6593 - DNA, 1176 bp, Pseudomonas aeruginosa
ggtggtcgcatgttcgaattttcccgctcgtcgtccgccgaggccgagaggccggaacccttttcgcaggaaggccccgccctctggagcgcttcgctgaggagttgggacctgtgtttcgagatggacgaacaggaccgcgtgatccgggtcggcgggcggcaggcgtatcgtctgcagtgcgcccatgggcttggcgaacagccgcggcctttcgccgagtatctggagcggcgcgcccccggtgcgccgacgctggccggcctgcgccggggcgagcgtctcgacctgacgctgcgcagcgatgccgccgcgccattgacctgtcgtttccagccgatgcagccgctcgacggcctgggacgctcgctgctgctgggcatggacatctccgacctcaactggcagtccgacaaccagcagcaccagttgcagagcctgagcctgggcaagctgatcctttcgcgtctgcgccatgtctcccacggacacctggcggaggcggtccaggagattctcgaatcgctctccggcgcgttccagatgcaggctatcgccctgctgctgggcgacggcaagggtttctgcacggtcttcgccagtcatgtgcggcctggcagcgacagtttgctgcgaccgaccctgcaactcgccgacgacgacctgcgcgaaggggcgggcgcgcgcttgctacgccgtggcgaaggcgcctcgacgctgctccggcagatcggcgaggacgcgctctacctggtgccggcggcgatgcgcggtggccgcctgggggcgttgctggtccggccgatgtcgctggagcagctcgcccaggggcccgcgccgcaggactggcaatacctcgcggaactgctggcgaaccaggtggcggaccgctgcgaactccacgagcagcacgacagttcgcgcaagctggggctgttgcaggaagatgatcggcggcggctggtggcgttactgggcggagcaggaactcttcgaactggcgccggccttgcacgacagcctggggttggccggcgagtatcgtcgggtgccgctggaacacctgcagggcctgctgcaaccggcggacgccgacgaactcggcctgcgcctgcgtgccagcctgcgcagcggccaggcgctggcccaggacctttgcctgcgtcagccggatag

SEQ ID NO: 6594 - DNA, 612 bp, Pseudomonas aeruginosa
ccgcggcgagcgccgctggctgcgcatcgagggtcgaccgctggggcgcggcagcgcgctggggctgtccggcgtgctgctcgacatcagcgaaggccggcgccaggaggaacgggcacaggcggcccacgcgcggctgcgcagcctgatcgacagcgcgccggtggtgatctacgtccagcgggtcgagcaggggcacctggtgccggagttctacagcgaaagcgcgagcaacctgctcggcctcgacttgcagggacagagttggcaggcgctcgccgaacgggtgcatccggacgacctggaggcctttttcgcccgtggccgcgagttgctttgcgagggccgggtgaagacccgctatcgcctcgccgatggccagggcaactggcactggctctacgacgaagccaagctgctgcgcgatgcccagggcctgcccagcgaggcggtgggcctgtggctggacgtgaccgagcagcacctggcggcacagcgtatcgccgagagcgaggaacgctaccgggtcctggtggaggattcgccggcgctgatctgtcgctataccgccgacctggtgctgacctacgtgaaccggaccttcgccgatag

SEQ ID NO: 6595 - DNA, 909 bp, Pseudomonas aeruginosa
cctcgcgaccagcccggagcgcctggtcggtcgccggctcgacgagtggctggcggcggaagacgccagcgccttgcgcgcgcgtctgctgggttcgccgcgggagggcgccagcgaggtgccggaactgcgcttcaacctgccggggcaacgttttctctggctggtgtgggccgagcgaccgttgttcgacgcccggggcgaattgtgcgaggtacaggcggtgggacgcgacaacacgccggtgcgtcgggcccagcagcaactggcgcaaggcgccaagatggccagcctgggggagatggtcagcggcctcgcccacgaggtgaagcagccgctgcacgtgctgcgcatgaccctcttcaacatgcgccagcggatgaacagcgtcggcctcgacggcgactacctgggcgagaaactggagcgcatggatgcccaggtcctgcgcgtcgaccgcctggtcagccacctcggcgtgttcagccgcaagtcggcgctggaggcgctgccgttcgacccctatgccgccttcgaaggcgccctgggcctgctcggcgaggggctgcgtcagcacgccatcgaggtggagtgcccggcgccgacgcagcggatggtggtgcgagggcaggcggaccagttggaacaggtgatcatcaacctgctcgccaacgcccgcgatgccctgcttggcaatcccggcctggccagccggcgtgttcgcctggagcaggtggcttgccgcgaaccgggctgggtcgaattgcacgtgcacgacaacggcggtgggatcgaaccgctcctgctggagcggatattcgaacccttcttcaccaccaaggcggagggcaagggtaccggcctgggtctctcggtcagccacgatctggtgcgcaacatgggcggtag

SEQ ID NO: 6596 - DNA, 465 bp, Pseudomonas aeruginosa
tcagcgagcgcctcgccgaggtcagcctggacgcctaccaccagtcggtctacgacctcgcccgggagggcgcggcggctatcgccgctcgcttcgaggaggacgtgcgcagcgggcgcatcgacctcgacgacctgttcgaccgcagctaccagccgttgcccaatacccagccgaccaagtaccggacccgcttcgacagctacaccgaccaggtcctgccgggcatccaggagcagttgctggagcgcaaccgcaacctggtattcgccatcgcctgtacccccgaaggctacgtgcccacccacaatcgcgccttcgcccatccgcccagcggcgacccgcagacggacgcgttgcgcagccgcagcaagcgcctgttcaacgaccgcaccgggattcgctgcggcagccaccagcagccgctgttgctacagacctacacccgtgacaccggcgagctga

SEQ ID NO: 6597 - DNA, 867 bp, Pseudomonas aeruginosa
ccctggccggggtcctgctggccgagttctggcagcgccgcccggcccgtctgcgctcggcaacctgctgatttcccggcaacttcctcgcgattacggcgcacggaggcgccgccactggctatcataggcagcgctccccgcgtgggggccgagccgtgccagcctggaagaggaagaatcgtggtcgaagtgttttccgtgcaggatgggctggacgccgagcgcgccctgctcgacgaggtgtgtggcggtgcccgcgagcatggcctgttgctctggcagccctgcgatcgggcgctggtcatgccgcgccggatggagcgcctggaaggattcgcgccggccagcgcagcggtcgccgaacgcggctggccggtgctgctgcgcgataccggcggcgagccggtgccgcaatcgccgggcgtgctgaacatcgccctgtcctatgcgctggggcccggcgacaacgagcagacccgtatcgaaaccgcctacctgcggctgtgccagccgatctgcgactggctccgcgagcgcggcctggacgccggcgtgggcgccgtggccggttccttctgcgacggccgctacaatgtcaccctggatgggcgcaagctcgccgggaccgcgcaacgctggcggcgcaacggcgccggccggccggtggtgctggcgcacgcggcgctgctggtcggcgccgagcgcgaggagatggtcgaggtggtcaacaccttcacccgccgttgcgccagtgccccggattgccaggcggacagccatctcggcctgagcgagcgctggagcgatttccgcatggccgacagcctcgaactggaacgacgcttcgtcgccgcccgatcctga

SEQ ID NO: 6598 - DNA, 921 bp, Pseudomonas aeruginosa
tgcgtctgcttcccggattgctggagcgtcccgagttccgcaccctgcaacgtttcctcgccgacgatgccgacctgcgcaagcgtcatcaactggccgagcgcctggccgacctgttcgaccagtaccaggtctatcgcggcgactggctcgacgactggagccagggccgcgaccagttgcgcacggcgaacgggcaggcgcgcccgctcggtgccgacgagcgctggcaggccgaattgtggcgcgcgctgctcgccgacgtcggtgccgatagcctggcccgcagccgctccggcgtgcaccggcgcttcatcgaggcgctgcgctccgccagcgcggcgccgcgcgcgttgccgcgacgagtggtggtgttcgggatttcctcgatgccggcgcagaccctcgaggcgctggccgccctggccaggttcagccaggtgctgctctgcgtgcacaacccctgtcgccaccactgggccgacatcgtcgccgacaaggacctgttgcgccacgagtaccgccgccagcagcgccgcgccggcgtccccgccgacctcgacgaggaccgccagcaccagcatgcccagccgttgctggcggcctggggcaagcagggccgcgactacatcaacctgctcgacagctacgacgacccggacagctatcggaacctgttcggcgaggtcaacggcgggcgcatcgacctgttcagcgaggaggccccgcacgggctgctcggccagttgcaggacgatatcctcgaactgcgcccattggcggaaacccgcgagcactggccgccggtggcgccgcggagcgacgcctcgatccgcttccatgtggcccacagcgcgcagcgcgaagtggagatcctccacgaccagttgctcgcccgcttcaacgccgatccgagcctga

SEQ ID NO: 6599 - DNA, 510 bp, Pseudomonas aeruginosa
gcgagatcctcgacctgctggacgtcccggcattgcgccggcgtttcggcgtcgacgaggccgacctggcgaccctgcaccgctggatcgaaggcgccggcgtgcgctgggggctggatgccgcgcagcgcgagcgtctcggcctgccagcgggactggagggcaacagttggcgcttcggtctgcggcgcatgctgctcggctacgcggtcggcgaaggcgcggccctgcaaggcatccagccctacgatgaggtcggtggcctggacgccgccctggcaggcccgctggctgtgctgctggagcgcctcgaggtggcctacgccgagctggccgaaccggccaccccggcgcagtggggcgagcgcctgcaggccttgctcacggtgttcttcgaggcccacgacgagcgcgacgagctgctcctcacccagctcctgcaactgctcgagcgctggcaggagcactgcgcctgtgcggccttcgccgagccgctgccgatcagcgtga

SEQ ID NO: 6600 - DNA, 297 bp, Pseudomonas aeruginosa
tcgacgcctggcgccagggcatgcgcccagccgttgccggtggcctgccggaccgctttcgcctggctcgcccaagtggtggcgccgcagagccccgagaaagccatgcgcgaggcgcgcaagcgctacgagggagggttcggcatggggggcgaggtggacgcctcgccggcgctggctcgggtctatccggatttcgaccggctgctcgccagcggtgagttcgcgcactgggccgagcagctctacgcgccgctgctggctgccctgggacgtggcgcggaggagcaggcatga

SEQ ID NO: 6601 - DNA, 825 bp, Pseudomonas aeruginosa
cccgcgcccgccattcggtgtggctgggcatcgcgccgctggtggcgagcaacagcaagtcgccggagttgcacaagggggccctgggctacctgcttgccggcggcgcgaccatcggcagcgatggcctcggacaatgcctcgccgcgttgcgcggcgagtgccgggagatcgtcgtcgagccggcccccgaggcggacgccgaacgctatgtcgcacggcgcggccagggccttgggcaggcccgcgaaactcgccgcagcagccgcgagaagtggtgggtcgccagctattccggcctgcaattgcaggcctccgccgggctggacgatgacgatgtgttggagagcgacgaatcgcaggagccgatcagcgccgaggaagccaccttccccgaagaaggccgttccgccgaacagccgccggtcgcgcacgccagcgagatgcgcgacgacctgcatcgcttcccgcgcggaccggctcccggcaccttcctccacgggctgctcgaatgggccggccgcgaaggcttcgatgtggcgcgcgccgatgcccagcggcgccgcgaactggtcgcgcgacgctgcgatctgcgtggctggaaggactgggccgaaccgctcgacctgtggctggagcagtatctcgccgaaccgctgcgctggcccggtggcgaaaccagcctggccgggctggtcgcctaccaggtggaaatggagttctggttcgccacccaccaggtccaggccgaggcgatcgacgccctggtccggcgccataccctcggcggcgcggcgcgtccggcgctggcgccgaccctgctga

SEQ ID NO: 6602 - DNA, 966 bp, Pseudomonas aeruginosa
tcgaacgcctggacgcgctgttcagcggccagccgggagccgagcgatgaatccgaccctcaagcaactggccggcgaagtccgcgatggccgcgacgaccaggtagcgcaaccgctggcggcacgccacgacctgctgcgccagctcgacctgtgggtggcgcgcggctggctacgggcgctggaccgggcgttcgtcgccttcctcgtcgagttgcagccgcaggccgatccccgggtgctgctggcggcggcgctgaccagccaccaactgggccacggtcacgtctgcctggacctggaggcgaccctcggcgcgcccgacgcggcactgtcgctgccgccggaaggcgacgaaggccgcgatgtgctgttgccgtcgcaactgctgcacggcgtgcgcctcgacgcctggcgcgaggccctggcggcgtcaccgctggtggaggtggtcgacgagcgcccaggcgatcccgagccgagcgagacggcgacctcgccgctggtgctttgcgcccagcgtctctacctgcgtcgttattggcggcacgagttggagatcgccctggccctgcgcgagcgcctgggtcggcaggcgcccctggccgccgacctggcgccgcgcctggccgcgctgttcgcgcaggcgcctacggaagacggccagcgcgtcaccgactggcagaagctggcctgtgccctggcggcccgcggctatttcagcctgatcaccggcggtcccggtaccggcaagaccaccaccgtggtgcgcctgctcggtctgctccaggcaccggcggtagccgccggccagccgctgcgcatccgcctcgcggcgcccaccggcaaggccgcggcgcgtctctccgaatccatcggccagcaggtccgggccctgccgctggcggaagacgtgttgcaggcgatccccgccgaggtcactaccctgcaccgtctgcttggtag

SEQ ID NO: 6603 - DNA, 543 bp, Pseudomonas aeruginosa
acagcgactcgatgcgcagcttgctcgatgccatcgaggccaggccgagcgccagggccagggaaatcaggaaggtctcgccgccggagagcgaatacaccgagcgcagttcgtcgcccatctcggtgtccaccaccagcaggcccagttcgctgccgccgcgctgcaggcggtagcgccgcgccaactggcgcaactgcacgttgctgtgctgcaccagcaggtcgaggttgtagccctgggcgatgcggcggaacttgtcgccgctggacgaaccgatcagttcgttcaggcggccccatctgcggaactcggcgcgggctcgctccagttcggcaagcagcgcctggctctgctcgcggcgctggttgtcggcctgcaactggctgtaggtctccaggtaggcctgttcgctggcggccaggcgttcgcgctgttgccgcaggttgtcttccagcgcctcgcggtcggtttccggccgctgccggcgatgctggagcagttgcgcctggcgctctgcttccagcgtctgctggcgggtga

SEQ ID NO: 6604 - DNA, 477 bp, Pseudomonas aeruginosa
gctcctgcagacgctgttcgatttgctgaagccgcgcctgttgctgccggcgttgctcgatggactcgccgagtgcctggaaagtccgcagcggatctgcctgccagcgctgccagtgctcgtcggagagcaatggacgcaattgctggctgtcctcctcgacctgctgctgcaaatgttcgtagcgctgccgttgttccgtcagcgcctgctggcgctgttgcaggatcgtctcgacggcccgcagttcctgctgcaattgctgggtctggcgttggcgggcgatcagccggtcgaagtctcgttggcactgctggcgctgccctgccaggtcgtccaggcgttgtgccagccactccaactgcgcggacggctgcaggagtcgcagttcttccggcagcgtccattggtccagttgccgatcgagcgcggccagttggccagtcagttcctgctgctcctggcgactctggttga

SEQ ID NO: 6605 - DNA, 927 bp, Pseudomonas aeruginosa
cctgcagggcctgctccgccgccttcacctcctcggcgcattggctgccttgtcgtttcaggtcgagcaatgcctgctcctgctcgaccatacgctggtcgagttcgcccaggcgtcgagccaggccggtgcgttggtcgagggcctgttgccattccttgtggagcgcttgttgtcgttccaggctatcggtctgccggcgcaattcgtccaggcgtgccgccaggtcgtccggctcgctgccatggagggcggtccattgcgcctgcaagcgttcgagcggttccccggcgtgggccagggatttttccagctcggggagctgcgcctggctttcgagcgcgcgctggcgacgttgcacgaaggcggcgagctggccctggtgggtcgcccaggcgtcgccgagcgcggcgagagcctggctgtcgcgcaatgccgcctgcagttgcgcctgttccgcgacatggcgctgctgctgcatatccagttgccgagcggcgtcgctttgctgggcgtggcgctggttcgattgccgatggagttcctgtcgctcggccagcgttcgctccaggcgcctggcctcgctctccagctggaaagcctcgcgcaacggcgcctgggcctgacgcagatggttgtcggcctgggcctggcgctcgcgcgcctcctgcaagcgggcctgcaatccttgcaagcgctcggcgcccgcggcttgctgctcggtgcgctgccgctgctgctgctcggagtgccggagttcctgctcgagttgcttcaggcgttcgatcagtccgcgaaccggagccaggcgctccagccattgcagggtttcccgctccgtcgccagggcgtcccaggcctgcctggcctcggccagttgaccttgtgcgtgctcgcaggattgcagcagccgctgctcctcggtga

SEQ ID NO: 6606 - DNA, 1389 bp, Pseudomonas aeruginosa
agtcgatttcctgctcgccagcgagggaggcgaggttcttcaggcggatggcgagaatcttcatggaacggcttatttccccgggggctcttcggtggccagttcgacgctttgcagcaggctggcgaagtcatccagcgcctgcgcatccgggccggagccataggcgctttcccaggcgcggctgaacagttcctgggggttgagttggtcgagcccgagcagcggcgcctgctcttcgtcgcggcgctggtactcgctggcgatgcgcaccagacggcaagccttgcccagcagggcgctctcgacctgctggcgcaggtccggttgcggctgatccagcatgacgcggacttccagccagggccgctgttcgttcagcaggtcggcctcggccagttcgccgattcgatcgagcacctcgccaagaggcgcggggccgatgcgcaacagttccaccgcgcgtggcaccgggagactctgtacatccttcaggcgctcaccttccagggtgacgaggaggacctggtggcgatagttcacttcggcgaaggacagcggcagcggcgagccgctatagcgaatgcgctcctgtccggcgactttctgtggcttgtgcagatgaccgagggctacgtaggcgatctgctccggaaacaggctggcgggcagcgcttcgacgttgccgatgatcaggtttcgctcggagtcttcggaaaccgagccgccggccatgtgtgcgtggctgacggcgaccagtgcctgtcccggcgtgcgacggacgtgcgcggcggcaaccaggcgttcgtgcacctggcggataccggccaggtaatcgtcgccgagcccgcctccggtgacttcggcgggacgcaggaagggcagggccaggcaccaggcggcgacctggccatccgcgtcgtgcaggggcagaagcaggcgatcgctatcgaggctttcgtctatccagccgatccggccgatggcatgggcgttcagtcgtttcatcagcggagcgggcagttcgatgcgcgcgccggagtcgtggttgcctgcgatcatcacgatctccagccgcggcagccgccgatgggcgctgacgatgaagtcgtagaggcgctcctgggctttgagcggtggattgatcgtgtcgaagatatcgcccgcgatcagcaggacatcggcgcgctgctcttccagctggcgcagcagccagtcgaggaagcgcgcatgctcatgatcgcggtcctggccgtgcagggtctggcccaggtgccagtcggaggtatgtatgaggcgcatggaacactcgtcgaaagcggcggagccgtggctcgcattccttatatgaggcaacagaaggagagggcggggcaagccagcctataa

SEQ ID NO: 6607 - DNA, 2577 bp, Pseudomonas aeruginosa
gcccagccaggccgcaaactggcggcccggggggaattgccgtgcatcaccggcggatgccgccaccgcgctggggctgatcgggccgatgccttccaccgccagcaggcgctggatgcgggcatccccacgtacgtgagcctgaatctgtcgttccagtcgagcgatgcgcgcctccagcgtctgcaattcatctttcaattcacgcaacagttcgcccatcggggccggcaagggcgccggttcggtagccgtgaccgtttcgagcaaggccatcgtcgccgctcgcccacgtcgcgtcgcgatcagcccgaactcgcccagcaagccacgcacctcattgcacaacgccgtgcgggcccgcaccagacgactgcgcacccgatgcaccgactgcacggcctgctgctctgcgctcttcaccgggacatagcgcatgctcggacgactggcggcttcgcagatcgcctcggcgtcgtgtgcatcgtgcttgtcccccttgacgtagggtttgacgaactgcggtgcgatcaggcgtaccgtgtggcccagctcccgcaactcgcgcgcccagtagtgcgcactgccgcaggcctccatcgccaccaggcacggcggcagttggcgaaagaaatcccgcacctgtgcccgcttgagttggcgacgacataccacatgctcgtgacgatcaacgccgtgcacctggaatacttgttttgccagatccagaccaatgcgactaaggttcatgctgactccccctccgggacttgtggctgcaccattagtctggcgcttgacgccgtaggagggaggagtccatttcattgccctacaccaggttgggccagcggagcgccggtccgtagggtggataacgccccaggcgttattcgccgcgatgcggctgaaacggcggataaccgcgtagcggttattcgccctacaccacgttgggccagcggggctccggtccgtagggcggataacgccacgggcgttatccgccgcgacgtgcgcttataccagcaggtcgccgacgtgcagcaccttcatggtgttggtgccgccctgggcggtgtagctgtcgcccttggtcaggatcacccagtcgcccttggtcaccacgccgcgcttgagcaactcgtcgaccgcggcctggctgaccttctccgccggcagcgccgccgggtcgaaggggatggtttccacgccgcggaacatcgccacgcgagcctgagtctcgcggtgcggggagtaggcgtaaatcggtaccgacgagcggatgcgcgacatgatcagcggggtgaagccgctttcggtcaggcagatgatcgccttgatccccgggaagtggttggccgtgtacatcgacgccagggcgatgctctcgtcgcagcggtcgaaagtctggccgaggcggtggctggatttctggctggtcgggtgcttctcggcgccctggcagacgcgggccatggctttcaccgcttccaccgggtactcgccggcggcgctttccgccgagagcatcaccgcgtcggtgtagtcgagcacggcgttggccacgtcggagacttccgcgcgggtcggcatcgggctgtggatcatcgactccatcatctgggtcgcggtgatcaccactttattgttgcggcgggcgtgcaggatgatcttcttctggatgccgaccagctcggcatcgccgatttccacgccgaggtcgccacgggccaccattaccgcgtcgctggcacgaatcaggccgtcgagtgcgtcgtcgtcggcgaccgcctcggcgcgctcgatcttggctaccagccaggccttgcctccggcctcggtgagcaggcggcgggcgtattccatgtccttggcgtcgcgcgggaaggaaacggccacgtagtccaggtccatgtccgcggccagcttgatgtcggccttgtccttgtcggtcagcgccggcgcggtgagaccgccgccgcggcggttgatgcccttgtggtcggacagcgggccgccgatcagcacccggcagcgcagttcgtcggcggcgacttcctcgaccaccatcaccacccggccgtcgtccagcagcagttcatcgccgaccccgcagtccttcaccaggtccgggtagtcgatgccgaccacttcctgggtaccggcgtcgcgggcgtggctggtggagaagcggaacttgtcgccgacctgcaattcgatgcgcttgttggcgaacttggcgatgcggatcttcggtccttgcaggtcgccgagcagggcgacgaagcggccgtgcttggccgccagttcgcgcaccagcctggcgcgggcgcggtgttcatcgggggtgccgtgggagaagttgaggcgggcgacgtcgatcccggccaggatcagttgctccagcacttccggggaattgctggctgggccgagggtggcgacgattttggtgcggcgaacggacatgcaaaggactccttggataacgctggcgtgcaggctaccaccggcgaggctcggcggcgactgcggagtcatactatctgcatcagatgtcatttgtcggtttga

SEQ ID NO: 6608 - DNA, 558 bp, Pseudomonas aeruginosa
gcaccagcaggtcgcattccacctcctccaggacgcgttcggcggtctgcccgatcagcgcgttgtccaggtgcccccgggcgaccgcgcccatcagcagcaggtcgatgtcgttggcccggacgaagtcggggatcgcctgctcggcatagccggccagcaggtggcggcgctccgcggcgatctccgggtaggctgccagcaggtcgtcgaaggcctggcggtgacgttcctcatgttgcagcacgaaacgctcgtaaccggcgagcatttccgcgtcgaacagcaggctgcgcggcatcgccgcgtgggtatgcaggtagtcggcgcgcagccccaggctggcttcgagctggcgggcggcggcgatcagccggtgatcgagggcggccggcttgtcgctggcatgcagcgggtcgagcgccgcgcacaggcgctggccgcgccaggcgtcgtgatggaccagccagagcggctgcgggcagtggcggatcaattgccagtcgctgttgcccagtagcaggcggcgcagcaggttgtgcttgcgggtgctcttga

SEQ ID NO: 6609 - DNA, 1350 bp, Pseudomonas aeruginosa
ggcattcctgaggctttgcaggtgggcgacctggcgggtgaagtcggcagcggaaaggcgctgcgccggatatgggcgcatggcctggctgatggcgctgggtggcaggcgggtcatgcgcccgaggatctgccattgctcggcgacgccgagctgttcgaaaccggggtggcgacgccgcgccctgcgcaggatgtcgcgttgcagaccgtgcagcaaggcgacgtggccgcgctggcggaggaggaagtcggcgccggcgcgcaggtgttcctccagttgccggcgcgaacggctggccaccggctgcaagggaccctggcgcagccctgcgcgccacaggccggcgagcaacaacagcagcgctgccgccagggcctcggggaagtggcgggcgagcagggtggcgaggctgtcgcgttcggcgcggtagagcagggtcacctggttgtcctgggtcaggtaccagagcagccaggcgttgtcgtactgctcgatgttgcggttccgccagatccaggcgtcggtgagcaccgtgaccaggcccttgccgtgctgcatctgcaacaggtgggtggcgtcgccgctgttggcccaggcgtaggcgtggttctgcggatcgtacaggtggtagtcgggatcgaagccgatgtaggccggcgagcgctcgttttccaggtacaggcgggtcagtgcggaatagtccggcacgctgtcggcgggctcttcttcctcgccggcggtgtcctccggcggcgcttcggtcgcgtggtcgtcgacgctaccttcgtcggcgtcggcgtcggcggtttcctcgctggcccggtcctggctgtcgtcgaagtcctcggtgaggtactggcggatatccaggctgtcgagcagcaggtcgccgctcttcttctcgtcctcgtcccacaggcgttcggcgatcagcaccagatgcccgccctgctcgctccattgcagcaggcggcgagcctggccgggagtcatgccggagcggctgccgagcaggagcagggtatgcccggagggcggcagctccttgaggacctcaaggccgtcggcgcggctcaccgtgaccccctgcttgcgcaggaacagttcggcggccaggtagggattgcgccgggcctccggcgatgggccgaggtcgatcgtctccgtatagggttgcaggcggctggccaggaagatcgccagcagcccggccagcagcaggagcacggccagcagcaggaagcgcgcgcgccggctcatcatggcttggctcccgcggcgaaaaggctgcgccagccgtcgcagaggcgctggcgagcgtcgtcggccggcagccggtggccgtag

SEQ ID NO: 6610 - DNA, 2031 bp, Pseudomonas aeruginosa
gcgcgcagggcctgcctcagggttggcgtatcgccgaacagggcgtgcgagagaatgtacagcggcagccgttcgaaggccggcttgagccaccagaagatcaggatcgccagggtcggatgctgccacagcaggaggctgagcacggcgaacagcggcagggtcagcaacgcccagctgcccatcagcaggcgcgcatggcgatgcgccaggaggatgccgaggtcgagcgcttcccaggcgctgcgcgggcggatcgccacgctggcgtcagtcaggcgcatggcggctccgtccggcgaacaggaagtagctgccgaccagcagccagaggaccgcgccgaccgcgtacttcacccgcggctcgaaatgactgatggaagaccaataggcctcggtgaaggccgccagcagcaacagcacgatcaccccggcgatcagttgcacgctgcgccgggcggccagccgcagggcttcgccgcgggtcaggcgacctggcgcgagcagcgcccagccgagcttgaggccggcggcgccggcgaaggtgatggcggtcagttcgaacgcgccgtggccgatgacgaacggccagaaggtctgcacgtagccgatctgcgtcaggtggccggccaccgaaccgatcatcaggccattgaacagcaggaagaacaggctgccgagtcccagcagcacgccgctggcgaaggtctgaaaggcgatgccgatgttgttcatgatgtagaagccgaacatttcccagtcgtcgctggtgtcgcgtgcccccaacggacccaggcgggtggtttccggggcgtacatagactccatctcgctgaccttgtccgggctgaccacgctgtagatcaggtcgggaaagtgatagaccagcagccccatgagccagggcgctgccgtagaacagcaggctggccacggcgatgctgcgccattcctcgcggaccaggcgcggcaggccggcgagcaggaagccgaggatgcggctgccgaggtggctgcggtgccggtagaactgctggtggccgcgcatcgccagttgctgcaactggtcgatcaggtgactgctgtagccgcgctcctgggccagcgccagttgctggcagaggcgccggtaatcggcggcgaagtcgtcgctggagccttccagcttcttgcctttctcgaggaaggcgaggcgtttgtcgaagcgttgccaggcggcctggtggcgctgttcgaagaggctctgtttcatgcgctctcctgacgcaggccgagaaagccgcgggcgatgccgttgatctcggcctgggcgcgtaccggctcgacgcccagcggttcggcgagaatgcccgccagttcctcgcggcgtgccgaggaaagcgccgcgccgcgttcggcgaaaccgaggaaggcgcgctgttcttccaggctcatggggaagggcggcagttgcggctcgacgtcaggcaggctgggccggctcagttcgggttcgcggtagaccaccagggtgccggcggcgatgtcgcccaggcgcttgaaggccggatggttcaggcaacagagcagaccgagggcgtagccgaagggcaggatgtcggcgaagcgcagcaggttgcgcagcagcgacgcggcccagcccaccggagtgccgtcgtcgtggacgacgcgcagtcccatcatctgcttgccgggcgagcggccctggttgagcacctcgaagaggaccatgtaccaccacgtcatgacgaaggtcagcagcaggccgaggccggcgccgagcttgccgaggaacgccaggccgagcatcagcaccagcatgatcaggccgcggatgcagaggtcgatggtataggccagggcccgggggacgacgccggcggggcgcaggagcaggtcgatgccttccggcgtttccacgtggtagtgggtgtcgaggacctcggcgcctggccgggaggtgggcgcgacgaggcgggcggctgcgttcggtggcatcggggggccgtgtcggggaaagtcagatgctag

SEQ ID NO: 6611 - DNA, 1530 bp, Pseudomonas aeruginosa
gttcgttggaaaacctggaaatccccgaagtgggtcgcgagcttcgcggcagtcactggtagactgcccggtgccgccagaaagggaatgaccgtgaacgcgagtattttttggtacgactacgaaaccaccggcatcgaccctcgccgcgaccggccgttgcagatcgccgggatccgcacggacgaggcgctgaacgagatcggcgagccgatgaacctgtattgccgtcccagcgacgatatcctgccccaccctatggcttgcctgatcaccggcatcactccccagcggctggccgagcgggggctgtccgaggccgacttcatgacccgggtacacgcccagctggcgcagccggcgacctgcgtggccggctacaactccctgcgcttcgacgacgaagtgacgcgctacagcctgtaccgcaacttcttcgatccctacgcccgcgagtggcaaggcggcaatagccgctgggacctgatcgacatggtccgtaccgcctatgccctgcgcccggagggcatccagtggccgcagctggacggccggctgtcgctgaagctggaaatgctcaccgcggcgaacggcctggagcatgggcaggcccacgacgcgctttccgatgtccgcgccaccattgccctggcccgcctgatccgtcagcgccagccgcgcctgtacgattacctctaccagttgcgcagcaagcacaaggtgctcgaccaggtgcgcctgctgcagccgctggtgcatgtctccggacgcttttccgcggagcgccatttcctctcggtggtcctgccgctggcctggcacccgcgcaaccgcaatgctctgatcgtctgcgacctctgcgccgatcccgcgccgctgctggagttgtcggccgaagacttgcgcaggcgcctgtatacccgtcgcgacgaactggccgagggcgagttgccggtgccgctgaagcagatccaggtcaaccgttgcccggtggtggcgccgctgtcggtattgcgcgccgaggatcgccagcgaaccggcatcgaactcgaggagtgccagcgaaaagccgagctgttgcgccagcatcaaaccgtctgggcggacaaactgacagcgctatatggcgaagaaagtttctccgccagcgacgaccccgagcaacagttgtatgacggatttattggcgatcgggatcgacgcctttgtgaacagctgcgccttgccgaaccggagcaattggccaaagaacaatggcccttcgacgatgcccgtttgcaggagttgttctttcgctatcgtgcgcgaaatttcccggaaactttaaatgtggccgagcgccaacaatgggaaagcttctgccgcaatcgtttgtcccatgaagaatacggcgcaccgaatactttgccggccttcgaggcggcgctggaggcttgtcggcaagagcagggcggcacattgccggcggtacttgcggcctggcgcgattacgccgcggaactgcgtcaacgctattcgctggagacttga

SEQ ID NO: 6612 - DNA, 543 bp, Pseudomonas aeruginosa
cacgccgagccgcgccagaacccgcccgttgaagcggattacctggtgcaggtagcggatcagcattaccgcgccgacgaacaggccgaccaggaataccgcgctgaagatcaggctcgattccatgttcgggctcagcgaatggctgagggcatagatcaggatcgcgccgagggcgcagaggaagaacgtcaggtcggccaactggtcgaccgcgaacaccgcgctggtctgtgccgggcgcaggccgcgccgggccagcagcgccatcagggtcaacggcccgccgctgccgcccggagtggcgcagaaagcgaattcgctggccatgatgatgccgacgctctgcaattgcccgagcttgccggcacgcccggcgagcagcaggcgcaggcgcaggccgttgatgaaccagcagaccacgatcatgccgaacatcagcagcagactgtccagcgggaaggcgcgcaagcgcgggaacatgtcgctgccgccgagcaccagcggaatcagcgaggcaccgatcaaaccgaacagcagtaa

SEQ ID NO: 6613 - DNA, 1380 bp, Pseudomonas aeruginosa
tccggccaggtttccggggccacgtcgtgcaacaccagcagcaggctgcgttcagccatagcgcgggaacctcgcctcgctgtcgccgagtaccgcgtggtagtgcaggagcagaccggcgaccaccgcgtcccaggcatgctggcgctcgacgtgacggcgggcgcgctggccgcgcagctcgacgtcgtggctgaacagttcgcgcaccgcgcaggccatggcgtcgccgttgttcggtgcgcagagcacgccgcaacgctccgggactatttccgccagtgccccggcgcgcaccgccaccaccggaatgccgctggccatcgcttcgagtgcgaccaggccgaaggtctcctggtcaccggcgtgcagcagcgcgtcgctgctcgccagcaggcgggcgacttcgcggctgtcgcagaaatggtcgaccacgctggtgttgcgcggaacccgggtcggcatgttggaacccaccagcaacaggtgatagccgtcgccgaggcgctggatggcgtcgagcagtaccggcaggttcttttcccgcgaaccgcgcccggcgaacaccagcaggcgggtttcctcgtccaggccgagttcctggcgcagccccggatcgcggttgctcggatggaaggtgacgaggtcgacgcccagcggttgtacatgcacgtcggcgacgcccaggcgcatcagcttttccgccattacccgactgggggccaggacccggtcgaagtggccgtacagcttgctgacgtagttgtccgcgttggtgccgagccaggcgcccatgcgattgctcaccagcagcggcaggtcggagtggtagaagccgatcaccggcacgtccagccgacgtcgcgcgtcgagcgccgcccaggcggtgaggtaggggtcgccgacctcgatcaggtccggttgcagattgcgcagcaccttgcgccaggggccgcgacggagagggaagcggtagccattgccgaatggcagcggcggcgccggcacctcgtggatgccgttcgcctggcggtagctggcgccgggaaccagcacgctgtggcgaatgccgggatagtgccagagatggcgatgcttggcttcgagataggtgcgtacccccccgctggcaggcgcgtagaacatggtcatatcggcgatgtgcacgatgggccttcctccgttgagcttgttccttctgccactcagtggaccaccggcaccggcagtcgttcgaacggtgtgcgggagccgtgggtagcttcaagtctaggaaagaaagcgcgagccggcgcgcttgcggcagccagcgcgggaataggtcgcagagggagcgggcggagaggaaggcatgcctcgggaggcatcctggcaggataa

SEQ ID NO: 6614 - DNA, 2028 bp, Pseudomonas aeruginosa
acaactccgttggcgttgttcaccctaacaatggccgggggcttggcggatacacgcggcgcgattatccgccggcttcggctacgggtcgggcagtgctcagatcttgaagctgtccaccagctggcgcaggcgcccggcctgggtttccagctcgccgcaggcgcgcagggtggcctggaggttctccacgccttcctggttgagggtgttgatctcggtgatgtccatgttcagcgaatcgaccaccgcggtctgctcctcggtggcggtggccaccgactggttcatcccgtcgatctcggcgatccgtccggtgacgctgctcaggcgttcgccggcacggttggcgatctccacgctttcaaggctgtagcgctgactctcggtcatggtactgaccgcttcctgggcgccgatctgcagttcctcgatcatcttctggatctgctgggccgactcctgggcgcggtgggccaggttgcgcacctcgtcggcgaccactgcgaagccgcgtccggcttcgccggcgcgcgcggcttcgatggcggcgttgagggcgagcaggttggtctgctcggagatgcccttgatcacttcgaggatctggccgatgttcaccgtgcggctgttgagggcctcgatgttggcgcaggaggcgctgatcttctcggaaagctcgttcatcgcgcggatggtctgctcgaccacctgcttgccgtcttcggcctggtggttggcgtcggaggcgtggtgcgaggcatcggcggcgttgcgggcgatttcctgggcggcggcgccgagttcgttgatcgccgcggcgacgctgttggtgcggttggactgctcgtcggagttggccatcgaggagttcgaggcgttcaccaccagttgcgccacatcgtgcagttggcgagcggtgccggcgacctcgcggatcgattcgtggatacgctcgacgaagcggttgaaggcattggccaacgtaccgaattcatcgttgctggtgaccttcaggcgcttggtcaggtcgccttcgccctgggcgatgtcctgcatggcgcggcccatgtcggtgagcggttgcatcagtacgcggatcagcatgccgaggaggaggacgatggcgaccaccgcgatcagcgcggcgacgatcgccgaggtacgcagcttggtgagcatggcataggccttgtccttgtccaccgagatgccgatgtaccagtccaggccggacaggcccttgaccggagagaaactgaggatccgggtgttgccgtgcagctcggcctcgctgaagccgctgccgatcttcggcgtgttgcgtgggtagacgtcgctgaggctcttcatgacctggtccttgtccggatggacgaggatcttgccgtcgccgctgaccaggaaggcgtagcccatgccgccgaagtccagcgagttgatgatcttcaccaccgtctgcaggctgaggtcgccgccgaccacgccgaatggctggccgccctggcgcgccgggctggcgatggtcagtaccagctcgtggatggccggctccatgtagggttcggtgagggtggtctggccggcgctggtggcggcgttgtaccaggggcggcggcgcgggtcgtagtcggccggcaggtcgctggtggggcgcgcggtgtaggtgccgtcggtctgccccaggtaggtgaagaggaaggtcgagcccagcagcggctgttccagcagggcctgggtggtctccgggctgtggtcgcgggccagggtctgggccaggttctcgatcagcaggatgcgcccgctcagccagttctgcacgttgctggcggtgatctcgcccatttcgtgcaggtagtcctccaggtcctcgcggatcgaggcacgctgcagggagtcgttgtagagggtgaacagggagaaggtcgcgatcaccaccagcgcggcggcgagcaggatcttgtggctgaacttgagacttttgatcatggtttcttgcatccgggaggcgcgggcgcgctgtcgtga

SEQ ID NO: 6615 - DNA, 813 bp, Pseudomonas aeruginosa
cgctggctctcggtcatggtggccaccgcctcgcgggcgccgacttgcagctcttcgatcatcttctggatctgctgggccgactcctgggcgcgatgggccaggttgcgcacctcgtcggcgaccactgcgaagccgcgtccggcctcgccggcgcgcgcggcttcgatggcggcgttgagggcgagcaggttggtctgctcggagatgcccttgatcacttcgaggatctggccgatgttcaccgtgcggctgttgagggcctcgatgttggcgcaggaggcgctgatcttctcggaaagctcgttcatcgcgcggatggtctgctcgaccacctgtttgccgtcctcggcctggtggttggcgtcggacgcatggtgcgaggcatcggcggcgttgcgggcgatttcctgggcggcggcgccgagttcgttgatcgccgcggcgacgctgttggtgcggttggactgctcgtcggagttggccatcgaagagttcgaggcgttcaccaccagttgcgagacgtcgtgcagtttgtgcgcggtcccggcgacttcccggatcgagcgatggatacgctcgacgaactggttgaaggcatcgccgagcactccgaattcatcgcggctggtcacggcgaggcgcttggtcaggtcgccctcgccctgggcgatgtcctgcatggcacggcccatcaggtgcagcggctgcatcagcaggcggatcagcaggccgagcaggaccaggatggcgacgatggagatcagcgcggcggcgatggccgagacgcggaacttgctgagcatggcgtag

SEQ ID NO: 6616 - DNA, 2073 bp, Pseudomonas aeruginosa
tcgccggctaaccgcttcgcggttagccggcctgtgggacggacgggctcagatcttgaagctgtccaccaggtgccgcaggcgcccggcctgggtttccagctcgccgcaggcgcgcagggtggcctggaggttctccacgccttcctggttgagggtgttgatctcggtgatgtccatgttcagcgagtcgaccaccgcggtctgttcctcggtggcagtggccaccgactggttcatgctgtcgatctcgccgatccggctggtcacgctacccaggcgttcgccggcacggttggcgatctccacgctttcaaggctgtagcgctgactctcggtcatggtactgaccgcttcctgggcgccgatctgcagttcctcgatcatcttctggatctgctgggccgactcctgggcacggtgggccaggttgcgcacctcgtcggcgaccaccgcgaagccgcgtccggcctcgccggcgcgcgcggcttcgatggcggcgttgagggcgagcaggttggtctgctcggagatgcccttgatcacttcgaggatctggccgatgttcaccgtgcggctgttgagggcctcgatgttggcacaggaggcgctgatcttctcggaaagctcgttcatcgcgcggatggtctgctcgaccacctgcttgccgtcctcggcctggtggttggcgtcggaggcgtggtgcgaggcatcggcggcgttgcgggcgatttcctgggcggcggcgccgagttcgttgatcgctgctgcgacgctgttggtgcggttggactgctcgtcggagttggccatcgaggagttcgaggcgttcaccaccagttgcgccacatcgtgcagttggcgagcggtgccggcgacctcgcggatcgattcgtggatacgctcgacgaagcggttgaaggcattggccaacgtaccgaattcatcgttgctggtgaccttcaggcgcttggtcaggtcgccttcgccctgggcgatgtcctgcatggcgcggcccatgtcggtgagcggttgcatcagtacgcggatcagcatgccgaggagaagcatgatgccgaccaccgcgatcagcgtggcgacgatcgccgaagtgcggaattcgctgagcatcgaataggcggtgtcgcggtcgaggaccagggcgacgtaccaggtcacgccgggcagtcccttcaccggggtgaaggaaacgaactggctgcgaccgtcgagttccacctcgtggaccccggggacgatgttcggtgcgcctttgggataggcttcggcgagggtcttcaggaccagcccggagtcggggtggaggaggatcttgccggcgtcgctgaccaggaaggcgtagccggcaccgtcgaacttcagggaattgaggatcgcggtcagggtctccagcttcatgtcgccggcggcgacgcccagcagttgaccggcgtgccgcaccggcagcgacatggcgaggatctgctcgccggtgccggcatcgacgaaaggttcggtgacgatcagccggtcggccgccagcgcgtccttgtaccaggcgcgggtacgtgggtcgtaaccttccggcatggcgtcgtaggggcgcatggtgaaggtgccgctggccgcctcgccaagatagaccgacgcgaaattgcggctgaagacgggctgttccagttgccttgcgatattcgcctcgtcgggctggtcgagcagcgccagttgcgaggccaggccttccaccaggtgcatgcggccttccagccagctctggatgttgctggcggtcagggtgccgatttccccgaggtagttttccgtgtccgtgcgcacggcctcgcgctgtcggtaatcgttatagaggatgaagcaggtgaaggcgaaaaccaccaccagcgcggcggcgagaaggattttcttggcaaacgacagcgagcgaagcatgagcgatgcgtcctggcaaaagcctcaagaagggcggggagcccaggccaccaggtagggagcttgcgggggaaagccatgatccagcgcctgaacggccggctttgtagcatagtgccagcataa

SEQ ID NO: 6617 - DNA, 957 bp, Pseudomonas aeruginosa
ttttccgttcatcgacctgtccggacgcatagcaggggtctgcccatgaatagcaaggtgctgatggccctggccggcctgctgctgctcggtgcggtgttgctcggatacctcggcgtatccatcggccgcgcgccatcgaacgcgcacgctccatccgtggcgccggcttcggcgacggtggacgcttcgctggaaaagctcgaacgcaagccggtgctggtggccagtcgcgatctcccggcgctggcggtgatcggcaaggacgacctgagcgtcgagctgttgcggaccgcaccggtcggtagctacgacaggcccgaggcgttgctcggcaagcgggtctgggtcgcggtgccggccggcagcattctttccgccgcgaccctcgaacccggcggtccgctggcccggaccatccgtccggacgagcgggcgatggcgatcgctgtggacgacgtggtcggcggcggcggcttcgtcctgcccggcgactatgtcgacgtgatgctcttcgtgcgtgacgagcgggacggcgaatcgaccccgctggcgcaactggtgttgcctggcgtccgggtactgacctacggcgagcggatcgccgtgggcagcgatggacaggaccgctcgaaccaggaaaaggacccgcgtccgccgcgtaccgcggtgctggcggtaccggaggacggcgtggcgcggctgatgctggcgagccaggccggttcgctgcgcctggccatccgcagcaaggacgaagaactctaccgcagggagcaggaaggcgcgctgctgcaagcgtcgctgggcgcgccgagcgcggcgctgagtctcgaccaactgctggagcgccgcaaaccgacggcgccgagcgtgcgcagcgcggctccgcgcgtgccggtggccaacggggtcacggtctaccgtggcagcgccatgacccatgaagtgccttga

SEQ ID NO: 6618 - DNA, 930 bp, Pseudomonas aeruginosa
cgtcgatacccgcggtgctccagcgttcaccgtcggcgccgtggaggagctgccgaaccaggtgcagaccgatatccgcttcgtcgaggtcagccgcagcaagctgaagcaggccagcacctcgttcgtccgccgcggcggcaacctctgggtgctcggtgcgccgggcagcctcggcgatatcaaggtcaatgccgacggcagcggcctgggcggcaccttcggcaccggcagctcgggattcaacctgatcttcggcggcggcaagtggttgagcttcatgaatgccctggagggcagcggcttcgcctataccctggcgcgcccgagcctggtggcgatgagcgggcagagcgcgtcgttcctcgccggcggcgagtttccgatcccggtgccgaacggcaccaacgacaacgtcaccatcgaatacaaggagttcggcatccgcctgaccctcaccccgacggtgatgaacaaccgccgcattgctctcaaggtggcgccggaggtcagcgaactggactacagcgccggcatccaaaacggcggggtggcggtgccggcgctgcgcgtccggcgcaccgacaccagcgtgatgctggccgacggcgaaagtttcgtgatcagcgggctgaccagcagcaactcggtgagcaacgtggacaagtttcccttggctggggcgacatcccgatcttcggtgcgttccttccgctcgaccaaggtggacaaggacgaccgcgagctgctgatgatcgtcaccccgcacctggtccagccgtggcccgcagacgcacagttgccggacttgcccgggggagggcctgcggcaatacgatccggggttctcgcgcctgtacttcttcgagcgcggcgagtacgacggccagcagaacgacaccggtctgtcggattaggaggcgcgcatga

SEQ ID NO: 6619 - DNA, 942 bp, Pseudomonas aeruginosa
cgggcagttcgtccgccaggccgcgccggtcgggcagaaattccgccaggcgctgctgtgaacggcgcgcaactgctggtgctgttcagcggcgtgctagctttcgccgcgctggccctggcgttcatgggctggcgcgccgggcgcaacgaactggtggttgaacggctgctgggacgccaggaggcggtcgcggtgcggccgcgcagcagtcactggctggctcgccagatgcgtcgcgccggtatccagcgcccgcgcccgtggttgttcggggcggcagtgctcgcgctgctgctggtctggagcggattgggcctgttcggcaccatcggcgcgctaggcggcctgctactggcggcgctgtcctgccgcgtcgccctgggcatgctctaccagcgccgcctgaagcgaatgatccggcagatgccgcgtttcctcgaccaggtggtgcgcagcctgcacgccgggcgcacgctgggcgacgcgctgatgcaggcagtggagaatgccgaggagccgctgcgcgacatcttcaccctggcgcgcaaccacgtgcttctcggcatccacctgccggaggcgttgcaggaagtcgccgaactctacgaggttgaggagctgcgcatcctcgccctgggcgtctcggtcaaccaccgttatggcggcaataccagcgacctgctggacagcatcgtcaagctcatccacgagcgcgagaagctcagccggcagttgcacgcgatgaccggcgagacacggatcagcgcctatgtcctggccggcgtgccgagcgccctgggcggctacatcctggcgagcaacccgggctatctgctgaacatgtgggccgacggcaccgggcgtttcctgctgctggcctcgctcgggctgcaactgctcggctgctatgcgctgtggcgcatgctcaagagcgtctag

SEQ ID NO: 6620 - DNA, 1656 bp, Pseudomonas aeruginosa
gaggtggccatgcaggcacagtggctgattttcgcggcgctcctgatggcggtcggcggtgccttgttgctgttgctccaggcgcgcaacggcagccgcgagcagcgcctgatcgagaggcgcctgggagcgctggccaaccctggcggctcgaccaggtggctggccggcatgaccgagcggatggacgacagcttctgggtgcggcgcctgcaactgatggacagcgaggcccgccagttgctgcaacaggccggctggcacgagagtcgctaccggaccctgtacctgatctcggtgttcctcacgccgctgctgttcgttctcctggtcttgctggtcaagctgctgcgcgccgaaagcgaagcgtcctacgcggtgccgctgctgttcgccgccggcatcggtttcctcctgcccaagcaggtgctcaagccacttcgccaaagcgcgccgggcgctgatcgccgacgaaatgatcctgttcgtgcaactgatccgcatcctcttcgacgccggcctgaccgtggagcagacgctgcgcgtggtctgcctggaaggccgcgggatcaccccgcaactggcccgcgagctggacctggcgctgacccgtgccgacaacggcatcgacctggcggaagagctggaggcgcttgcccggcgcctgcaggtggacccgctgaacgactgctgcggcgtgctacggcagatgttgcgccagggcggcagtgcgcgcagcaccctgctgacgctcaagcaactgttcgaagaccggcgcctgaccaccttgcaggaacgcatcggcaagctgtcggcgaagatgagcctggtgatgatggtgctgctgttcccggcgctgctgatcgtcctcgccggtccgggcgtcattgccatcaccaaggccttgggaggactgggatgaaagcactgatcggcatcggcctgtgcgccgccctgctcggcggttgcgccgcgctgccggggcgggacggcccacgggagtgttcgcagcagctcggccaggagcaggaactgcagatgaacatggtccgcgacatgatccgcgagggccgcctgcatgcggccctggccaacctggaaagcatgccgccggggttgctcgacgtgcgcgaagaaagggcgctgatcctgcgccggatcggcgacccgcgggccagggccgagtaccaggccctgctggaaacctgcaaggcacccgaggcgcaccacggcctcggcctgctcgccctgcgcaatggcgacagcgcccgggcggtcctcgagctgcgcgaggcggcgcgcctgcggccgaccgagagccgcttccgcaacgacctgggggtcgccctgctcaagcgcggcgaccgtgtcggcgcgcgcttcgaattcatcactgcgctggagttgcagcagggtggcaagctgccggcgaccaacctgctcggcctgctgtacctgcaaggcgaccgggaagatgcgcagcgcctgatcgagcgtttgcagctggatgcccgggacatccgcgcggccgaggcgcgggcgcgcagctggggtgccgtaccgacacccggcgcggcgccggcaagcgacgacccgctggcggaactgccggcggaggcgaatatgcataccgcgatggccaacgaggcgccctga

SEQ ID NO: 6621 - DNA, 2322 bp, Pseudomonas aeruginosa
tcctttcgcgtctgcgccatgtctcccacggacacctggcggaggcggtccaggagattctcgaatcgctctccggcgcgttccagatgcaggctatcgccctgctgctgggcgacggcaagggtttctgcacggtcttcgccagtcatgtgcggcctggcagcgacagtttgctgcgaccgaccctgcaactcgccgacgacgacctgcgcgaaggggcgggcgcgcgcttgctacgccgtggcgaaggcgcctcgacgctgctccggcagatcggcgaggacgcgctctacctggtgccggcggcgatgcgcggtggccgcctgggggcgttgctggtccggccgatgtcgctggagcagctcgcccaggggcccgcgccgcaggactggcaatacctcgcggaactgctggcgaaccaggtggcggaccgctgcgaactccacgagcagcacgacagttcgcgcaagctggggctgttgcaggaagatgatcggcggcggctggtggcgttactgggcggagcaggaactcttcgaactggcgccggccttgcacgacagcctggggttggccggcgagtatcgtcgggtgccgctggaacacctgcagggcctgctgcaaccggcggacgccgacgaactcggcctgcgcctgcgtgccagcctgcgcagcggccaggcgctggcccaggacctttgcctgcgtcagccggatagccgcggcgagcgccgctggctgcgcatcgagggtcgaccgctggggcgcggcagcgcgctggggctgtccggcgtgctgctcgacatcagcgaaggccggcgccaggaggaacgggcacaggcggcccacgcgcggctgcgcagcctgatcgacagcgcgccggtggtgatctacgtccagcgggtcgagcaggggcacctggtgccggagttctacagcgaaagcgcgagcaacctgctcggcctcgacttgcagggacagagttggcaggcgctcgccgaacgggtgcatccggacgacctggaggcctttttcgcccgtggccgcgagttgctttgcgagggccgggtgaagacccgctatcgcctcgccgatggccagggcaactggcactggctctacgacgaagccaagctgctgcgcgatgcccagggcctgcccagcgaggcggtgggcctgtggctggacgtgaccgagcagcacctggcggcacagcgtatcgccgagagcgaggaacgctaccgggtcctggtggaggattcgccggcgctgatctgtcgctataccgccgacctggtgctgacctacgtgaaccggaccttcgccgatagcctcgcgaccagcccggagcgcctggtcggtcgccggctcgacgagtggctggcggcggaagacgccagcgccttgcgcgcgcgtctgctgggttcgccgcgggagggcgccagcgaggtgccggaactgcgcttcaacctgccggggcaacgttttctctggctggtgtgggccgagcgaccgttgttcgacgcccggggcgaattgtgcgaggtacaggcggtgggacgcgacaacacgccggtgcgtcgggcccagcagcaactggcgcaaggcgccaagatggccagcctgggggagatggtcagcggcctcgcccacgaggtgaagcagccgctgcacgtgctgcgcatgaccctcttcaacatgcgccagcggatgaacagcgtcggcctcgacggcgactacctgggcgagaaactggagcgcatggatgcccaggtcctgcgcgtcgaccgcctggtcagccacctcggcgtgttcagccgcaagtcggcgctggaggcgctgccgttcgacccctatgccgccttcgaaggcgccctgggcctgctcggcgaggggctgcgtcagcacgccatcgaggtggagtgcccggcgccgacgcagcggatggtggtgcgagggcaggcggaccagttggaacaggtgatcatcaacctgctcgccaacgcccgcgatgccctgcttggcaatcccggcctggccagccggcgtgttcgcctggagcaggtggcttgccgcgaaccgggctgggtcgaattgcacgtgcacgacaacggcggtgggatcgaaccgctcctgctggagcggatattcgaacccttcttcaccaccaaggcggagggcaagggtaccggcctgggtctctcggtcagccacgatctggtgcgcaacatgggcggtagcctgacggcggccaaccagggggagggtgcgttgttcgtggttcgcttgccgctggcggcgcccgccgaggcgggcggatga

SEQ ID NO: 6622 - DNA, 1239 bp, Pseudomonas aeruginosa
caccagccagaacgccttgtcggccgccggcgtggcgttctcggtgaagcgcctggcggagaagctgcaatcccagctcgacgccgccgaacagatcgtcggcagcgccgaagtgatgatccacaccgagcgcgccacctccaatctggcgcgccaggccatggacgccgccacccgggcgcgcgccggcagcgacgaaggccaggtgctgctggcctcgaccatcgagcgcatgcatcggctcagcgagcggatgggcgccagccgcgaggcgatcgaggcgctgaaccagcgcagcgaggacatccagcgggtcaccctggtgatccagggcatcgccagccagaccaacctgctggccctcaacgcggccatcgaggcggcccgcgccggcgagcatgggcgcggcttcgcggtggttgccgaagaggtgcgcggcctggccggacgtaccgccgaggccaccgaggaagtcggccagatggtcgccgagatccagcgccagaccagcgaggtggtcgagcagatccgccagctttccgaagagttgggggaaggggtcggccaggtcgagctgaccggtcggcaactggaaggcattgccgaactggcggccggggtggaaagccagattaccgagatcgcccagggcgccgagatcaaccgcagccaactcgccagcctgttcgccgcggtcgagcaggtgcgcggcgacctcagcgccagcgaggaacagaccctgcgcctcggcgaagctgccagccagttggagaaccaggccgaggtgatcagcgagcgcctcgccgaggtcagcctggacgcctaccaccagtcggtctacgacctcgcccgggagggcgcggcggctatcgccgctcgcttcgaggaggacgtgcgcagcgggcgcatcgacctcgacgacctgttcgaccgcagctaccagccgttgcccaatacccagccgaccaagtaccggacccgcttcgacagctacaccgaccaggtcctgccgggcatccaggagcagttgctggagcgcaaccgcaacctggtattcgccatcgcctgtacccccgaaggctacgtgcccacccacaatcgcgccttcgcccatccgcccagcggcgacccgcagacggacgcgttgcgcagccgcagcaagcgcctgttcaacgaccgcaccgggattcgctgcggcagccaccagcagccgctgttgctacagacctacacccgtga

SEQ ID NO: 6623 - DNA, 708 bp, Pseudomonas aeruginosa
caccggcgagctgatgcacgatctttcggtgccgatcttcatccacggcaagcactggggcggcctgcgcctcggctaccggccggagggcgcggagccgggcaaggcggccgcgccggcggcgcaggggctgagcctggccttgaatggctagccggctgtggcgatcaggccgccggtcacggcgcaggcgagcaccacttgccagggcggcgtcttccaggcgagcagggccagcagggcgaagagcagcagggcgaagtcggccgggcgcaggatgccttcggtccagagcggctggtacagcgccgccagcagcaggccgaccaccgccgcgttgaccccggccagcgttgcccgtacccggcgttcgtggcgcaggcgttcccagaatggcaaggcaccggcgaccagcaggaacgacggcaggaagatcgccagcaggcacagcagcgcgccgctccatccgttcggcgccgggcccgaggctgcgccgaggaacgcggcgaaggtgaagagcgggcccggtaccgcctgggcggccgcgtagccggcgaggaaggtatcgccgtcgacccagcccttgggtaccacttccgcctgcagcagcggcagcaccacatggccaccgccgaataccagcgagccagcccggtagaacgcatcgagcaggcgcagccagtgttccggccagaggcgcgcggctag

SEQ ID NO: 6624 - DNA, 963 bp, Pseudomonas aeruginosa
tgcggaacctcccatgcaatacctgtttcccctgctggccgtgttcatctgggccggcaacaccgtcgtcaacaagctcgccgtggggatcatccagcccgccgagatcggtttcttccgctggctgctggtcggcctggcgctgacgcccttcatgctcggcccggtgctgcgcaaccgccgctacatcctcgccaacctcggcaagttcgtggtcctcggcctgctcggcatggccgtctaccagagcctggcctactacgcggcggcgctgaccagcgccaccaacatgggcatcatcctgtcgctgatgcccctgatgtcgctgggcctggccagcagcatcctggcccaccggctgaacgccggggcgctgctcggcgcgctggtgtcgctggccggcgtggtgctggtgatctcccagggccatctcggcgctttgctggagcatggagtgaatctcggcgacgcgatgatgatcgtcgccaccctggcctatgcggtgtacagcgtgctgctgaagaaatggagcctgaagctgccggccatgcaactgctctacctgcaggtgctggtggcgatcctcgccctgctgccgctgtacctgctgtcgccgcgcaccggcctgaacgccgccaacctgccgctggtgctgtacgccgcgctgttcgcctcgatcgtcgccgcgctggcctggatgcacggtgtcgcccgtctcgggccgagccggatggccctgttcttcaacctgctgccgatcatcaccgcctgcatcgccaccctggtgctcggcgagcgcctgaccgtccatcacctggtcggcggcgcgctgaccctggccggggtcctgctggccgagttctggcagcgccgcccggcccgtctgcgctcggcaacctgctgatttcccggcaacttcctcgcgattacggcgcacggaggcgccgccactggctatcatag

SEQ ID NO: 6625 - DNA, 741 bp, Pseudomonas aeruginosa
gcgagcgctggagcgatttccgcatggccgacagcctcgaactggaacgacgcttcgtcgccgcccgatcctgacctctttcgccagagccttgcgccaggaatagccgtaccgatgccagaacccttgggaaccaccgctctcacgcccggattcatgatcgtccacggcaatcgcctggacgacctgcgcgacctcgccgtttcctggatgcgccgctatccgctggcgccgctggaaagcgagcgggtcctggtgcacagcaacggcatcgcccaatggttgaagctggcattggccgaagatccccgcgaggacggcggcggcggtggcggcatcgccgcggcgctggaggtgcagttgccggcgcagttcctctggcaggcctatcgcgcggtgctgggcccgcgaaagcattcccgaggtttccgaactggacaaggcgccgctgacctggcgcctgatgcgtctgcttcccggattgctggagcgtcccgagttccgcaccctgcaacgtttcctcgccgacgatgccgacctgcgcaagcgtcatcaactggccgagcgcctggccgacctgttcgaccagtaccaggtctatcgcggcgactggctcgacgactggagccagggccgcgaccagttgcgcacggcgaacgggcaggcgcgcccgctcggtgccgacgagcgctggcaggccgaattgtggcgcgcgctgctcgccgacgtcggtgccgatag

SEQ ID NO: 6626 - DNA, 1095 bp, Pseudomonas aeruginosa
cctggcccgcagccgctccggcgtgcaccggcgcttcatcgaggcgctgcgctccgccagcgcggcgccgcgcgcgttgccgcgacgagtggtggtgttcgggatttcctcgatgccggcgcagaccctcgaggcgctggccgccctggccaggttcagccaggtgctgctctgcgtgcacaacccctgtcgccaccactgggccgacatcgtcgccgacaaggacctgttgcgccacgagtaccgccgccagcagcgccgcgccggcgtccccgccgacctcgacgaggaccgccagcaccagcatgcccagccgttgctggcggcctggggcaagcagggccgcgactacatcaacctgctcgacagctacgacgacccggacagctatcggaacctgttcggcgaggtcaacggcgggcgcatcgacctgttcagcgaggaggccccgcacgggctgctcggccagttgcaggacgatatcctcgaactgcgcccattggcggaaacccgcgagcactggccgccggtggcgccgcggagcgacgcctcgatccgcttccatgtggcccacagcgcgcagcgcgaagtggagatcctccacgaccagttgctcgcccgcttcaacgccgatccgagcctgaagccgcgcgacgtgatcgtcatggtccccgacatcaacgcctacgcgccgcacatcgaggcggtgttcggccaggtgccgcgcgacgaccagcgcttcattccctataccctggccgaccagggacagcgcggtcgcgagccgctgctgatcgccctggagcacctgctgaaactgcccgacagccgtttcgccgtgagcgagatcctcgacctgctggacgtcccggcattgcgccggcgtttcggcgtcgacgaggccgacctggcgaccctgcaccgctggatcgaaggcgccggcgtgcgctgggggctggatgccgcgcagcgcgagcgtctcggcctgccagcgggactggagggcaacagttggcgcttcggtctgcggcgcatgctgctcggctacgcggtcggcgaaggcgcggccctgcaaggcatccagccctacgatga

SEQ ID NO: 6627 - DNA, 507 bp, Pseudomonas aeruginosa
actggagggcgcactggggctgcgagcgctggcggagttcctcgccaacccggtgaatgcgttcttccagcagcggctcaaggtgcgtttcgacgacgagcaattgaccggcaacgacgaagaacctttcgaactggacgcgctggacaactggaagctgcaattcgagctgaccgaacgcatgaagcgctgggtcgagcgggactgggatgccgagggcctgccggcgcagttgcaggcccaggtcgagcgactgcggcgacagggtcgcctgccgctggcggcgttcggcgagttctccgcgcgccatttgctgcaaccgctgcccgacctgctctggcgctaccgccaggaaatcgagcgctggccggaggcggtcgagcagcagcaggagttgcgccatcgccatccgtccgggctggagctggaggactggctcggcggcttgcgtcgcgacgcttccgggcgcctggcgcgcctgcagttgctcagcggcaagctccatga

SEQ ID NO: 6628 - DNA, 1092 bp, Pseudomonas aeruginosa
cttctacggcctgacggctccggcggcgcaagccgtggccagttgctacagcgggccggagacgctgggcaaggccttgcagccgctgctggcgcggcaggacgccgacttccgctacgccgaccaggcgctgagtgcgcccgagtcactgacagccttgctggagcagggcggcgactggtatcgccagctcgaccaactggacgcgcaggcccgcgccgcctggcgcgcagcgcgcgtcgaactggaagcgctgctgcgcgacctgcgtccctacctgaacggcaacagctatcgcggcaaggacagcgacgagaccttcgacgcctggctgcaagcgttggcggactggagcgagggcggcgagcagccggccaacctcggcaagttcggccagacccggatcaagctcaccgccaagcgcgtggcgcccaagcatgccgcgctaagggccatcgacgcctgggccgcgcatcaggaagagcgtcccgatctcgctccccacctgttgttgcacgcgttgggcgaagtcgggcacgaactggagatcgagaagcagcggcgtgccgagatcggcttcgacgacctgctcagccgcctcgaccgcgccttgcaggggcctggtggcgagcgcctggcgcaattgatccgcgagcagttcccggtggcgctgatcgacgagttccaggataccgacccggtgcagtaccggatcttcgagcgcatctaccggatcgccgccgatccctacgagccccaggcgcgggaaaccggcctgttcatgatcggcgaccccaagcaggcgatctacgccttccgcggtgccgacatccatacctacctgcgcgcccgcgaggccactcgcgggcggcattacacccttggcaagaacttccgctcgaccgccgccatggtggcggccgccaaccgctgcttcgccttcgccgaagagcatccgcgcggcgccttccgtttcgcccgcgaggggctggaaaacccggtgccgttccatgcggtggacgcccaggggcgcgccgaacgtttgttgatcgacggtgccgaggcgccagcgatgacgttctggaaccttga

SEQ ID NO: 6629 - DNA, 639 bp, Pseudomonas aeruginosa
cgatgtgttggagagcgacgaatcgcaggagccgatcagcgccgaggaagccaccttccccgaagaaggccgttccgccgaacagccgccggtcgcgcacgccagcgagatgcgcgacgacctgcatcgcttcccgcgcggaccggctcccggcaccttcctccacgggctgctcgaatgggccggccgcgaaggcttcgatgtggcgcgcgccgatgcccagcggcgccgcgaactggtcgcgcgacgctgcgatctgcgtggctggaaggactgggccgaaccgctcgacctgtggctggagcagtatctcgccgaaccgctgcgctggcccggtggcgaaaccagcctggccgggctggtcgcctaccaggtggaaatggagttctggttcgccacccaccaggtccaggccgaggcgatcgacgccctggtccggcgccataccctcggcggcgcggcgcgtccggcgctggcgccgaccctgctgaacggcatgttcaagggcttcgtcgacctggtcttcgagcaccaggggcgtttctacgtggccgactacaagtccaactggctgggcgccgacgatggcgcctacagcccggaagcgatgaccgccgcggtgctggagaaccgttatga

SEQ ID NO: 6630 - DNA, 2376 bp, Pseudomonas aeruginosa
cctgcagtacgtgttgtacctgctggccctgcaccggcagttgaaggcgcgcctgcccgactacgactacgaccgccacatgggcggcgccgtgtacctgttcctccgcggcgcccgcgcggcgacccagggcctgcacttcgagcgcccgccgcgggaactgatcgaacgcctggacgcgctgttcagcggccagccgggagccgagcgatgaatccgaccctcaagcaactggccggcgaagtccgcgatggccgcgacgaccaggtagcgcaaccgctggcggcacgccacgacctgctgcgccagctcgacctgtgggtggcgcgcggctggctacgggcgctggaccgggcgttcgtcgccttcctcgtcgagttgcagccgcaggccgatccccgggtgctgctggcggcggcgctgaccagccaccaactgggccacggtcacgtctgcctggacctggaggcgaccctcggcgcgcccgacgcggcactgtcgctgccgccggaaggcgacgaaggccgcgatgtgctgttgccgtcgcaactgctgcacggcgtgcgcctcgacgcctggcgcgaggccctggcggcgtcaccgctggtggaggtggtcgacgagcgcccaggcgatcccgagccgagcgagacggcgacctcgccgctggtgctttgcgcccagcgtctctacctgcgtcgttattggcggcacgagttggagatcgccctggccctgcgcgagcgcctgggtcggcaggcgcccctggccgccgacctggcgccgcgcctggccgcgctgttcgcgcaggcgcctacggaagacggccagcgcgtcaccgactggcagaagctggcctgtgccctggcggcccgcggctatttcagcctgatcaccggcggtcccggtaccggcaagaccaccaccgtggtgcgcctgctcggtctgctccaggcaccggcggtagccgccggccagccgctgcgcatccgcctcgcggcgcccaccggcaaggccgcggcgcgtctctccgaatccatcggccagcaggtccgggccctgccgctggcggaagacgtgttgcaggcgatccccgccgaggtcactaccctgcaccgtctgcttggtagcggtccggatacccggcacttccgccaccaccgggacaaccctttggcgctggacgtgctggtggtggatgaggcctcgatgatcgacctggaaatgatggccagcctgctcgatgcgctaccgccgcaggcgcgcctgatcctgctcggcgacaaggaccagttggcctcggtagaggccggcgcggtgctcggcgatctctgccgggatgccgaggagggctggtacagcgccgagacccgcgcctggttgcagcgggtcagcggcgaaacctggcagggcttgcgcgaaggttcggcgcaggcgcatccgctggcgcaacagaccgtcatgctgcggcattcccggcgcttcggcgcgagcagcgggatcgggcgcctggcgcggttggtcaaccggcaacaggccggcgacgcgcgcgcgctgctggacagtccgcccgccgacctcttcgacctgcgcctgcgcggggagcgcgatgcagccttcgcccggctgttcgtcgacggtcatccgcaggcgccgggcacgccgtacggctaccggcactacctgcaacgcctggccgagggccgcccggccgccggactggcgctggaggatggcgcctgggagcgctgggcgcagtcggtactgacggctttcgacgccttccgcctgctctgcgcgctgcgccgcggcccatggggcgtggaaggactgaaccagcgggtagcggcggaactgctgcgccttggcctgatcgaggccgatcacggctggtacgaggggcggccggtactggtgacgcgcaacgactacagcctggggctgatgaacggcgatatcggcatcgccctgcgcctgcccgagcgcaacgacgacggcagcctgcgctttgcgctgcgcgtggccttcccgcgcaacgacggtagcggcggcgtgcgcttcgtcctgccgagccgcctggtagaggtggacaccgtgttcgccatgaccgtgcacaagtcgcagggttcggagttcgcccataccgcgctggtcctgccggacgcgctgaacccggtgctgaccaaggagctggtgtacaccggtatcacccgcgcccgcgactggttcagcctggtggaaagcctgcccggggtgttcgaggaagcagtgcggcgcaaggtgcgccggctcagcgggctgatgctgcatctgcggccggaaagggaagagcagccgccgcatgctccgggtgaacagaccgagctgccgttctga

SEQ ID NO: 6631 - DNA, 2715 bp, Pseudomonas aeruginosa
ttgccaatcctgggcgcaggcgtgctggcccaggtgagcgccgaggcgtccgttcagttcggcgagttccgcctgggccctttcctctgcctgacgggcttcgttgcgttgctcgtcgctttgcttcagttgccagctcgattcatcgcagcgctgcttgagctcctgcagacgctgttcgatttgctgaagccgcgcctgttgctgccggcgttgctcgatggactcgccgagtgcctggaaagtccgcagcggatctgcctgccagcgctgccagtgctcgtcggagagcaatggacgcaattgctggctgtcctcctcgacctgctgctgcaaatgttcgtagcgctgccgttgttccgtcagcgcctgctggcgctgttgcaggatcgtctcgacggcccgcagttcctgctgcaattgctgggtctggcgttggcgggcgatcagccggtcgaagtctcgttggcactgctggcgctgccctgccaggtcgtccaggcgttgtgccagccactccaactgcgcggacggctgcaggagtcgcagttcttccggcagcgtccattggtccagttgccgatcgagcgcggccagttggccagtcagttcctgctgctcctggcgactctggttgagtctttcccgctggctggaatagccctcgcgcagaccgaccagggtctgtcgcagccgctcgagggactgctcggcgcggacctgctcctggtcgtcgtgttcaccgagggcggcgagcagttgctcggaatggtgatagggatgctcctggctgccgcagaccggacaggcctcgccgtccaccaggccggcgcgcagttgctcgacgctggcgctgcgggccagacgttggcgctggagcaactcgcgggtgacctgcagggcctgctccgccgccttcacctcctcggcgcattggctgccttgtcgtttcaggtcgagcaatgcctgctcctgctcgaccatacgctggtcgagttcgcccaggcgtcgagccaggccggtgcgttggtcgagggcctgttgccattccttgtggagcgcttgttgtcgttccaggctatcggtctgccggcgcaattcgtccaggcgtgccgccaggtcgtccggctcgctgccatggagggcggtccattgcgcctgcaagcgttcgagcggttccccggcgtgggccagggatttttccagctcggggagctgcgcctggctttcgagcgcgcgctggcgacgttgcacgaaggcggcgagctggccctggtgggtcgcccaggcgtcgccgagcgcggcgagagcctggctgtcgcgcaatgccgcctgcagttgcgcctgttccgcgacatggcgctgctgctgcatatccagttgccgagcggcgtcgctttgctgggcgtggcgctggttcgattgccgatggagttcctgtcgctcggccagcgttcgctccaggcgcctggcctcgctctccagctggaaagcctcgcgcaacggcgcctgggcctgacgcagatggttgtcggcctgggcctggcgctcgcgcgcctcctgcaagcgggcctgcaatccttgcaagcgctcggcgcccgcggcttgctgctcggtgcgctgccgctgctgctgctcggagtgccggagttcctgctcgagttgcttcaggcgttcgatcagtccgcgaaccggagccaggcgctccagccattgcagggtttcccgctccgtcgccagggcgtcccaggcctgcctggcctcggccagttgaccttgtgcgtgctcgcaggattgcagcagccgctgctcctcggtgaaccattgttgctggccttccagacgttgcagtgcctgttgctcctggagacgcgcctgggcgtgggattccagcgccgcctcgagcccggcccgggcctgctcggccaggggcaggctgccttccaggcgttgctcgagttgcttgcgctgctcgtcggcctggctggcgcgctgataggcggctttgctcaattggctgtacaggccggtgtcggtgagtttctccagcaatgcgccgcggtcgttgtcgctggccttgaggaaggcgctgaattcgctctgggccagcagcacggcgcgagtgaactgggcgaaattgaggccgagcttctgctccagctgttcgcggaactcgcttttcttgttcgctgccagcatttgctgggtctccaggtcctggaggctctgctggctcttttgcaaggcgccgtccgccttgtcccgggagcgccgggtttcccagcgggcgcgatagcggtggccgtcgatgccgacgaaatccacttcggcgtagccgctggcgcaaccgcggcgcagcaggttgcgttcgtcgttgctggacagctcgttccggccatcgggaaccttgctgctggccgaagtgctttccagccgcggcgtgctgccgaacagggccaggcacagggcgtccagcacggtgctcttgccggcgccggtcggaccggtgatggcgaacaggccggcgctggacagcggttcgcgggtgaagtcgatttcctgctcgccagcgagggaggcgaggttcttcaggcggatggcgagaatcttcatggaacggcttatttccccgggggctcttcggtggccagttcgacgctttgcagcaggctggcgaagtcatccagcgcctgcgcatccgggccggagccatag

SEQ ID NO: 6632 - DNA, 1848 bp, Pseudomonas aeruginosa
acgaacagcggccctggctggaagtccgcgtcatgctggatcagccgcaaccggacctgcgccagcaggtcgagagcgccctgctgggcaaggcttgccgtctggtgcgcatcgccagcgagtaccagcgccgcgacgaagagcaggcgccgctgctcgggctcgaccaactcaacccccaggaactgttcagccgcgcctgggaaagcgcctatggctccggcccggatgcgcaggcgctggatgacttcgccagcctgctgcaaagcgtcgaactggccaccgaagagcccccggggaaataagccgttccatgaagattctcgccatccgcctgaagaacctcgcctccctcgctggcgagcaggaaatcgacttcacccgcgaaccgctgtccagcgccggcctgttcgccatcaccggtccgaccggcgccggcaagagcaccgtgctggacgccctgtgcctggccctgttcggcagcacgccgcggctggaaagcacttcggccagcagcaaggttcccgatggccggaacgagctgtccagcaacgacgaacgcaacctgctgcgccgcggttgcgccagcggctacgccgaagtggatttcgtcggcatcgacggccaccgctatcgcgcccgctgggaaacccggcgctcccgggacaaggcggacggcgccttgcaaaagagccagcagagcctccaggacctggagacccagcaaatgctggcagcgaacaagaaaagcgagttccgcgaacagctggagcagaagctcggcctcaatttcgcccagttcactcgcgccgtgctgctggcccagagcgaattcagcgccttcctcaaggccagcgacaacgaccgcggcgcattgctggagaaactcaccgacaccggcctgtacagccaattgagcaaagccgcctatcagcgcgccagccaggccgacgagcagcgcaagcaactcgagcaacgcctggaaggcagcctgcccctggccgagcaggcccgggccgggctcgaggcggcgctggaatcccacgcccaggcgcgtctccaggagcaacaggcactgcaacgtctggaaggccagcaacaatggttcaccgaggagcagcggctgctgcaatcctgcgagcacgcacaaggtcaactggccgaggccaggcaggcctgggacgccctggcgacggagcgggaaaccctgcaatggctggagcgcctggctccggttcgcggactgatcgaacgcctgaagcaactcgagcaggaactccggcactccgagcagcagcagcggcagcgcaccgagcagcaagccgcgggcgccgagcgcttgcaaggattgcaggcccgcttgcaggaggcgcgcgagcgccaggcccaggccgacaaccatctgcgtcaggcccaggcgccgttgcgcgaggctttccagctggagagcgaggccaggcgcctggagcgaacgctggccgagcgacaggaactccatcggcaatcgaaccagcgccacgcccagcaaagcgacgccgctcggcaactggatatgcagcagcagcgccatgtcgcggaacaggcgcaactgcaggcggcattgcgcgacagccaggctctcgccgcgctcggcgacgcctgggcgacccaccagggccagctcgccgccttcgtgcaacgtcgccagcgcgcgctcgaaagccaggcgcagctccccgagctggaaaaatccctggcccacgccggggaaccgctcgaacgcttgcaggcgcaatggaccgccctccatggcagcgagccggacgacctggcggcacgcctggacgaattgcgccggcagaccgatag

SEQ ID NO: 6633 - DNA, 597 bp, Pseudomonas aeruginosa
acacgacgaccaggagcaggtccgcgccgagcagtccctcgagcggctgcgacagaccctggtcggtctgcgcgagggctattccagccagcgggaaagactcaaccagagtcgccaggagcagcaggaactgactggccaactggccgcgctcgatcggcaactggaccaatggacgctgccggaagaactgcgactcctgcagccgtccgcgcagttggagtggctggcacaacgcctggacgacctggcagggcagcgccagcagtgccaacgagacttcgaccggctgatcgcccgccaacgccagacccagcaattgcagcaggaactgcgggccgtcgagacgatcctgcaacagcgccagcaggcgctgacggaacaacggcagcgctacgaacatttgcagcagcaggtcgaggaggacagccagcaattgcgtccattgctctccgacgagcactggcagcgctggcaggcagatccgctgcggactttccaggcactcggcgagtccatcgagcaacgccggcagcaacaggcgcggcttcagcaaatcgaacagcgtctgcaggagctcaagcagcgctgcgatga

SEQ ID NO: 6634 - DNA, 987 bp, Pseudomonas aeruginosa
gttccagcgccttcaggccgactggcaggcctggcgcgaacgccaggacaacctcgacgacagccgcctcgacgccctgctcggcctttccgaggaacaggcgacgcaatggcgggagcaattgcagcgactgcaagaggagatcacccgccagcagacgctggaagcagagcgccaggcgcaactgctccagcatcgccggcagcggccggaaaccgaccgcgaggcgctggaagacaacctgcggcaacagcgcgaacgcctggccgccagcgaacaggcctacctggagacctacagccagttgcaggccgacaaccagcgccgcgagcagagccaggcgctgcttgccgaactggagcgagcccgcgccgagttccgcagatggggccgcctgaacgaactgatcggttcgtccagcggcgacaagttccgccgcatcgcccagggctacaacctcgacctgctggtgcagcacagcaacgtgcagttgcgccagttggcgcggcgctaccgcctgcagcgcggcggcagcgaactgggcctgctggtggtggacaccgagatgggcgacgaactgcgctcggtgtattcgctctccggcggcgagaccttcctgatttccctggccctggcgctcggcctggcctcgatggcatcgagcaagctgcgcatcgagtcgctgttcatcgacgaaggcttcggcagcctcgacccggaatccctgcaactggcgatggatgccctggacaacctgcaggcccagggacgcaaggtggcggtgatttcccacgtccaggaaatgcacgaacggatcccggtccaggtgcgggtccagcgcgagggcaacggcatgagcagcctgaaggtggtcggctgagccgaccgcccaggcggcacgtcagaacggcagctcggtctgttcacccggagcatgcggcggctgctcttccctttccggccgcagatgcagcatcagcccgctga

SEQ ID NO: 6635 - DNA, 684 bp, Pseudomonas aeruginosa
taccggtgtacaccagctccttggtcagcaccgggttcagcgcgtccggcaggaccagcgcggtatgggcgaactccgaaccctgcgacttgtgcacggtcatggcgaacacggtgtccacctctaccaggcggctcggcaggacgaagcgcacgccgccgctaccgtcgttgcgcgggaaggccacgcgcagcgcaaagcgcaggctgccgtcgtcgttgcgctcgggcaggcgcagggcgatgccgatatcgccgttcatcagccccaggctgtagtcgttgcgcgtcaccagtaccggccgcccctcgtaccagccgtgatcggcctcgatcaggccaaggcgcagcagttccgccgctacccgctggttcagtccttccacgccccatgggccgcggcgcagcgcgcagagcaggcggaaggcgtcgaaagccgtcagtaccgactgcgcccagcgctcccaggcgccatcctccagcgccagtccggcggccgggcggccctcggccaggcgttgcaggtagtgccggtagccgtacggcgtgcccggcgcctgcggatgaccgtcgacgaacagccgggcgaaggctgcatcgcgctccccgcgcaggcgcaggtcgaagaggtcggcgggcggactgtccagcagcgcgcgcgcgtcgccggcctgttgccggttga

SEQ ID NO: 6636 - DNA, 591 bp, Pseudomonas aeruginosa
gcgcctgcgcgaacagcgcggccaggcgcggcgccaggtcggcggccaggggcgcctgccgacccaggcgctcgcgcagggccagggcgatctccaactcgtgccgccaataacgacgcaggtagagacgctgggcgcaaagcaccagcggcgaggtcgccgtctcgctcggctcgggatcgcctgggcgctcgtcgaccacctccaccagcggtgacgccgccagggcctcgcgccaggcgtcgaggcgcacgccgtgcagcagttgcgacggcaacagcacatcgcggccttcgtcgccttccggcggcagcgacagtgccgcgtcgggcgcgccgagggtcgcctccaggtccaggcagacgtgaccgtggcccagttggtggctggtcagcgccgccgccagcagcacccggggatcggcctgcggctgcaactcgacgaggaaggcgacgaacgcccggtccagcgcccgtagccagccgcgcgccacccacaggtcgagctggcgcagcaggtcgtggcgtgccgccagcggttgcgctacctggtcgtcgcggccatcgcggacttcgccggccagttgcttga

SEQ ID NO: 6637 - DNA, 2775 bp, Pseudomonas aeruginosa
gggtcggattcatcgctcggctcccggctggccgctgaacagcgcgtccaggcgttcgatcagttcccgcggcgggcgctcgaagtgcaggccctgggtcgccgcgcgggcgccgcggaggaacaggtacacggcgccgcccatgtggcggtcgtagtcgtagtcgggcaggcgcgccttcaactgccggtgcagggccagcaggtacaacacgtactgcaggtcataacggttctccagcaccgcggcggtcatcgcttccgggctgtaggcgccatcgtcggcgcccagccagttggacttgtagtcggccacgtagaaacgcccctggtgctcgaagaccaggtcgacgaagcccttgaacatgccgttcagcagggtcggcgccagcgccggacgcgccgcgccgccgagggtatggcgccggaccagggcgtcgatcgcctcggcctggacctggtgggtggcgaaccagaactccatttccacctggtaggcgaccagcccggccaggctggtttcgccaccgggccagcgcagcggttcggcgagatactgctccagccacaggtcgagcggttcggcccagtccttccagccacgcagatcgcagcgtcgcgcgaccagttcgcggcgccgctgggcatcggcgcgcgccacatcgaagccttcgcggccggcccattcgagcagcccgtggaggaaggtgccgggagccggtccgcgcgggaagcgatgcaggtcgtcgcgcatctcgctggcgtgcgcgaccggcggctgttcggcggaacggccttcttcggggaaggtggcttcctcggcgctgatcggctcctgcgattcgtcgctctccaacacatcgtcatcgtccagcccggcggaggcctgcaattgcaggccggaatagctggcgacccaccacttctcgcggctgctgcggcgagtttcgcgggcctgcccaaggccctggccgcgccgtgcgacatagcgttcggcgtccgcctcgggggccggctcgacgacgatctcccggcactcgccgcgcaacgcggcgaggcattgtccgaggccatcgctgccgatggtcgcgccgccggcaagcaggtagcccagggcccccttgtgcaactccggcgacttgctgttgctcgccaccagcggcgcgatgcccagccacaccgaatggcgggcgcgggtcagggccacgtagagcaggcgcatgtcttcgccgaggcgctcgtcgttggcctgctcgtaggcccgcgcagcctgctccttgcgccgcgccagctcgatgacccgccctgcagcgccatcctcgtggaaactcgccggcgcgccgctgttgccgtccagctccctccagctgcagatgaagggcagcagcaccaaggggtattccagccccttggacttgtggatggtcaccaccttgatcaggtcggcgtcgctttccaggcggaggatctcttcgctccccggactctgcacctgctcggccagatggcggatcagcgcgtgctcaccgtccagttccaccgccgcgcgctgcagccactcggccaggtgcagcaggttggtcaggctgcgctcgccatcggcatgccgcagcaggcgcgccggcagttcgaagtcggcgagcaggcgccgcagcatcggcaatacgccctgggcctgccaggaccggcgatagtcgcggaagcgcaggaccatccgttcccagaacagttcgtcctggttcaatcgttccagggtcgcccagtccaggtgcaggctgcgggtagccagggcgacccgcagcagcgcatcggcgccggggtcggcgcaggcacgcagccaatgcagcaggtcggcggcttcctggctgtcgaacaccgagtcgcggtcggacaggtagacgctggccagtcgtcgcgccgccaacgcgctgcggatcgcctcggcctcggcgcgaccgcggacgaggatggcaatatccgccgggcgcaacgcccgccagccgccctgctcgtcggcgaagccggcgcggcccaggtcggccaggctcagccagcggcggatggcgctggcgctgcgctcggccatttcctggcgatacgccgcggagccgagcacgccggcttcgacatcaaggttccagaacgtcatcgctggcgcctcggcaccgtcgatcaacaaacgttcggcgcgcccctgggcgtccaccgcatggaacggcaccgggttttccagcccctcgcgggcgaaacggaaggcgccgcgcggatgctcttcggcgaaggcgaagcagcggttggcggccgccaccatggcggcggtcgagcggaagttcttgccaagggtgtaatgccgcccgcgagtggcctcgcgggcgcgcaggtaggtatggatgtcggcaccgcggaaggcgtagatcgcctgcttggggtcgccgatcatgaacaggccggtttcccgcgcctggggctcgtagggatcggcggcgatccggtagatgcgctcgaagatccggtactgcaccgggtcggtatcctggaactcgtcgatcagcgccaccgggaactgctcgcggatcaattgcgccaggcgctcgccaccaggcccctgcaaggcgcggtcgaggcggctgagcaggtcgtcgaagccgatctcggcacgccgctgcttctcgatctccagttcgtgcccgacttcgcccaacgcgtgcaacaacaggtggggagcgagatcgggacgctcttcctgatgcgcggcccaggcgtcgatggcccttag

SEQ ID NO: 6638 - DNA, 561 bp, Pseudomonas aeruginosa
ctcgggcgcactcagcgcctggtcggcgtagcggaagtcggcgtcctgccgcgccagcagcggctgcaaggccttgcccagcgtctccggcccgctgtagcaactggccacggcttgcgccgccggagccgtcaggccgtagaagttacgccgccagtagtcccgtaccacttcggcgagcaattcgctctggtcggtttccaggttctgggtgaacaggctgccgctgtcgaaggcgtgctcgcgcagcatccggtagcaccaactgtggatggtcgataccgcggcctcgtccatccactccgcggccaggcgcagcaggcgcgcgcagcccggccagcgctcggcgggatactgctggcgcaacgcgaccagcaggccgtcgtggcgctcctgcggctcggcgaaacaacgcgccgcttcgcccaggcggctgcggatacgctcgcggagttcctgggtcgccgcatcggtgaaggtcaccacgaggatttccggcgggctcagcggccggccgaaagcgttctcgccgccatggtcgaggaccaggcgtacgtatag

SEQ ID NO: 6639 - DNA, 3084 bp, Pseudomonas aeruginosa
acgttggagggcgaggtgctgcaaccagtggcgcaccaggctgtgccacttgaagccgcgcccttcatggagcttgccgctgagcaactgcaggcgcgccaggcgcccggaagcgtcgcgacgcaagccgccgagccagtcctccagctccagcccggacggatggcgatggcgcaactcctgctgctgctcgaccgcctccggccagcgctcgatttcctggcggtagcgccagagcaggtcgggcagcggttgcagcaaatggcgcgcggagaactcgccgaacgccgccagcggcaggcgaccctgtcgccgcagtcgctcgacctgggcctgcaactgcgccggcaggccctcggcatcccagtcccgctcgacccagcgcttcatgcgttcggtcagctcgaattgcagcttccagttgtccagcgcgtccagttcgaaaggttcttcgtcgttgccggtcaattgctcgtcgtcgaaacgcaccttgagccgctgctggaagaacgcattcaccgggttggcgaggaactccgccagcgctcgcagccccagtgcgccctccagttcaagcggcggcagggacgcttcggcgtcgggaacggcgatgtcgtcctcgctatggacctcgcgccactcgcgggcgtaggtgaacaggccatcgacgccctgctccggcgcatcgtgaaaataccgacggctgaacggctgcagcggatgctcctgggtcagggcacgcagcagcgcctcgccgtcgccgtccgggtccagacgccagccggccgccaggtgatcgcgcaactggccgatcagcaccgagggcggccgctcgccattgtcgcggatactccgccccacccagctcacgtagagctgctcgcgcgccgagagcagcgcctcgagcagcaggtagcggtcgtcctcgcgccgcgagcggtcgccggggcggtagtcgttgcgcatcaggtcgaaatccagcggcgactgctggcgggggtagtcgccatcgttcatgccaagcaggcagaccagccggaacgggatcgcgcgcatcggcatcaacgtgcagaaactcaccgcgccagccaggaagcgctggttcaggccgccctggtccaggccgccgagccaggcctcgcgtatcacgctgatcggcagcggctcggcgaaggccgcacaggcgcagtgctcctgccagcgctcgagcagttgcaggagctgggtgaggagcagctcgtcgcgctcgtcgtgggcctcgaagaacaccgtgagcaaggcctgcaggcgctcgccccactgcgccggggtggccggttcggccagctcggcgtaggccacctcgaggcgctccagcagcacagccagcgggcctgccagggcggcgtccaggccaccgacctcatcgtagggctggatgccttgcagggccgcgccttcgccgaccgcgtagccgagcagcatgcgccgcagaccgaagcgccaactgttgccctccagtcccgctggcaggccgagacgctcgcgctgcgcggcatccagcccccagcgcacgccggcgccttcgatccagcggtgcagggtcgccaggtcggcctcgtcgacgccgaaacgccggcgcaatgccgggacgtccagcaggtcgaggatctcgctcacggcgaaacggctgtcgggcagtttcagcaggtgctccagggcgatcagcagcggctcgcgaccgcgctgtccctggtcggccagggtatagggaatgaagcgctggtcgtcgcgcggcacctggccgaacaccgcctcgatgtgcggcgcgtaggcgttgatgtcggggaccatgacgatcacgtcgcgcggcttcaggctcggatcggcgttgaagcgggcgagcaactggtcgtggaggatctccacttcgcgctgcgcgctgtgggccacatggaagcggatcgaggcgtcgctccgcggcgccaccggcggccagtgctcgcgggtttccgccaatgggcgcagttcgaggatatcgtcctgcaactggccgagcagcccgtgcggggcctcctcgctgaacaggtcgatgcgcccgccgttgacctcgccgaacaggttccgatagctgtccgggtcgtcgtagctgtcgagcaggttgatgtagtcgcggccctgcttgccccaggccgccagcaacggctgggcatgctggtgctggcggtcctcgtcgaggtcggcggggacgccggcgcggcgctgctggcggcggtactcgtggcgcaacaggtccttgtcggcgacgatgtcggcccagtggtggcgacaggggttgtgcacgcagagcagcacctggctgaacctggccagggcggccagcgcctcgagggtctgcgccggcatcgaggaaatcccgaacaccaccactcgtcgcggcaacgcgcgcggcgccgcgctggcggagcgcagcgcctcgatgaagcgccggtgcacgccggagcggctgcgggccaggctatcggcaccgacgtcggcgagcagcgcgcgccacaattcggcctgccagcgctcgtcggcaccgagcgggcgcgcctgcccgttcgccgtgcgcaactggtcgcggccctggctccagtcgtcgagccagtcgccgcgatagacctggtactggtcgaacaggtcggccaggcgctcggccagttgatgacgcttgcgcaggtcggcatcgtcggcgaggaaacgttgcagggtgcggaactcgggacgctccagcaatccgggaagcagacgcatcaggcgccaggtcagcggcgccttgtccagttcggaaacctcgggaatgctttcgcgggcccagcaccgcgcgataggcctgccagaggaactgcgccggcaactgcacctccagcgccgcggcgatgccgccaccgccgccgccgtcctcgcggggatcttcggccaatgccagcttcaaccattgggcgatgccgttgctgtgcaccaggacccgctcgctttccagcggcgccagcggatagcggcgcatccaggaaacggcgaggtcgcgcaggtcgtccaggcgattgccgtggacgatcatga

SEQ ID NO: 6640 - DNA, 1437 bp, Pseudomonas aeruginosa
gacagggcgatgttcagcacgcccggcgattgcggcaccggctcgccgccggtatcgcgcagcagcaccggccagccgcgttcggcgaccgctgcgctggccggcgcgaatccttccaggcgctccatccggcgcggcatgaccagcgcccgatcgcagggctgccagagcaacaggccatgctcgcgggcaccgccacacacctcgtcgagcagggcgcgctcggcgtccagcccatcctgcacggaaaacacttcgaccacgattcttcctcttccaggctggcacggctcggcccccacgcggggagcgctgcctatgatagccagtggcggcgcctccgtgcgccgtaatcgcgaggaagttgccgggaaatcagcaggttgccgagcgcagacgggccgggcggcgctgccagaactcggccagcaggaccccggccagggtcagcgcgccgccgaccaggtgatggacggtcaggcgctcgccgagcaccagggtggcgatgcaggcggtgatgatcggcagcaggttgaagaacagggccatccggctcggcccgagacgggcgacaccgtgcatccaggccagcgcggcgacgatcgaggcgaacagcgcggcgtacagcaccagcggcaggttggcggcgttcaggccggtgcgcggcgacagcaggtacagcggcagcagggcgaggatcgccaccagcacctgcaggtagagcagttgcatggccggcagcttcaggctccatttcttcagcagcacgctgtacaccgcataggccagggtggcgacgatcatcatcgcgtcgccgagattcactccatgctccagcaaagcgccgagatggccctgggagatcaccagcaccacgccggccagcgacaccagcgcgccgagcagcgccccggcgttcagccggtgggccaggatgctgctggccaggcccagcgacatcaggggcatcagcgacaggatgatgcccatgttggtggcgctggtcagcgccgccgcgtagtaggccaggctctggtagacggccatgccgagcaggccgaggaccacgaacttgccgaggttggcgaggatgtagcggcggttgcgcagcaccgggccgagcatgaagggcgtcagcgccaggccgaccagcagccagcggaagaaaccgatctcggcgggctggatgatccccacggcgagcttgttgacgacggtgttgccggcccagatgaacacggccagcaggggaaacaggtattgcatgggaggttccgcactatgaaaaaggaatacgcggccattctgagccagtccgaatacagacgtataatgaactccagacaaaccacccgtaggttcggacatgtcgaccaccaccttgctgcgccttcccgatctccaggggcagtctttcgacgtctatttccgctatga

SEQ ID NO: 6641 - DNA, 2163 bp, Pseudomonas aeruginosa
cgagttcggcgccgacacccattcgccgccgcacacccacgcctggggccagctcaactatgcagcccatggcgtgatgcagctggagatcgacggccagcgcttcctctcgcctccgcaatacgcggtatggataccaccggagcgggtgcacagctgctacaacagccaggccatcgtctaccgctcgctgtacctttccgccgagctgtcacgacgcctgccggcgacaccctgcaccctggcgatcagcgcgatcctcaaggcgatcctctcggacttcgccgagcgcggggtcaacctgccgacctcggcgcaggacctgcgcctggcccgggtcgtcatggaccagctggaatgcgcccagccccacgacgactacctgccctacggccgtaccccggcgctgcgcgaggtgctcgacgcactgcaggccgagccgggcgacaaccgctcgctggcgcaatgggcgcagcaggtgcacagcaccgagcgaaccctggcccggcactgccagcgcgaactgggcatgaccttcggcgaatggcgccaacgcctgcgcttcctcgcggccatcgaggcgctggaagccggcagggggatccagcagatcgccttcgacctcggctacagcagcccctcggcgttcatctcgatgttccgccggctggccggcaccacaccggaacaataccgcctggccagccgcgcccaggacatgccgatgctgtaacccgccgtgcatgcgttgcggctatgctcgcagcagccaccatccggagttcgcatgccaaccgccagccgccatcccgacaccgccctcgcggtgttcctcgccttcctcaagctgggctgcagcgccttcggcgggcccatcgcccacctcggctatttccgcgacgagttcgtccgccgccgcggctggctgagcgaaagcagctacgccgacctggtcgccctctgccagttccttcccggccccgccagcagccaggtcggcatggccctcggcctggcccgcgccggctatcccggcgccctcgccgcctggctcggtttcaccctgccctcggcgttgctactggtgctcttcgctctcggcctgggacgctggggcgcgctgttgcccgagggcgtgctgcatggcctgaagatcgccgcggtggcggtggtggcccaggcggtctggggcatgggacgcagcctgtgcccggatcgcccgcgcctgacgctgatggcgctgtcctgcgcgagcgtgctggcctggcccactgcctggacccaagtcgcggtgatcgccggtgccggcctggccggcctcgccctgttgaaaacggaagcagtggaaggccacgagcggctgccgatcgacattggctaccgcggcgcgctgctgttcctcaccctgttcgccgtgctgctggtctgcctgccgctagccgcgcgcctctggccggaacactggctgcgcctgctcgatgcgttctaccgggctggctcgctggtattcggcggtggccatgtggtgctgccgctgctgcaggcggaagtggtacccaagggctgggtcgacggcgataccttcctcgccggctacgcggccgcccaggcggtaccgggcccgctcttcaccttcgccgcgttcctcggcgcagcctcgggcccggcgccgaacggatggagcggcgcgctgctgtgcctgctggcgatcttcctgccgtcgttcctgctggtcgccggtgccttgccattctgggaacgcctgcgccacgaacgccgggtacgggcaacgctggccggggtcaacgcggcggtggtcggcctgctgctggcggcgctgtaccagccgctctggaccgaaggcatcctgcgcccggccgacttcgccctgctgctcttcgccctgctggccctgctcgcctggaagacgccgccctggcaagtggtgctcgcctgcgccgtgaccggcggcctgatcgccacagccggctagccattcaaggccaggctcagcccctgcgccgccggcgcggccgccttgcccggctccgcgccctccggccggtagccgaggcgcaggccgccccagtgcttgccgtggatgaagatcggcaccgaaagatcgtgcatcagctcgccggtgtcacgggtgtaggtctgtag

SEQ ID NO: 6642 - DNA, 1449 bp, Pseudomonas aeruginosa
caacagcggctgctggtggctgccgcagcgaatcccggtgcggtcgttgaacaggcgcttgctgcggctgcgcaacgcgtccgtctgcgggtcgccgctgggcggatgggcgaaggcgcgattgtgggtgggcacgtagccttcgggggtacaggcgatggcgaataccaggttgcggttgcgctccagcaactgctcctggatgcccggcaggacctggtcggtgtagctgtcgaagcgggtccggtacttggtcggctgggtattgggcaacggctggtagctgcggtcgaacaggtcgtcgaggtcgatgcgcccgctgcgcacgtcctcctcgaagcgagcggcgatagccgccgcgccctcccgggcgaggtcgtagaccgactggtggtaggcgtccaggctgacctcggcgaggcgctcgctgatcacctcggcctggttctccaactggctggcagcttcgccgaggcgcagggtctgttcctcgctggcgctgaggtcgccgcgcacctgctcgaccgcggcgaacaggctggcgagttggctgcggttgatctcggcgccctgggcgatctcggtaatctggctttccaccccggccgccagttcggcaatgccttccagttgccgaccggtcagctcgacctggccgaccccttcccccaactcttcggaaagctggcggatctgctcgaccacctcgctggtctggcgctggatctcggcgaccatctggccgacttcctcggtggcctcggcggtacgtccggccaggccgcgcacctcttcggcaaccaccgcgaagccgcgcccatgctcgccggcgcgggccgcctcgatggccgcgttgagggccagcaggttggtctggctggcgatgccctggatcaccagggtgacccgctggatgtcctcgctgcgctggttcagcgcctcgatcgcctcgcggctggcgcccatccgctcgctgagccgatgcatgcgctcgatggtcgaggccagcagcacctggccttcgtcgctgccggcgcgcgcccgggtggcggcgtccatggcctggcgcgccagattggaggtggcgcgctcggtgtggatcatcacttcggcgctgccgacgatctgttcggcggcgtcgagctgggattgcagcttctccgccaggcgcttcaccgagaacgccacgccggcggccgacaaggcgttctggctggtgttatgggacaggtcgcgagccagccgggcgatgtcgggctcgccgacggtcgccaccgccgtgcggttgccgggaagcagccagggcaaccagagcagcgccacgccgagcggcagggccaggtacagcggcagccagccatgccgggcgccgaccagcaggagaaccagggccaggctctgcaacaggcagacgaagaggatgcgggaacgagcgggctgcatgagtaa

SEQ ID NO: 6643 - DNA, 1482 bp, Pseudomonas aeruginosa
ccggtttctcacatgttcgatcttttcagcgggctcgatgcctgggtgggtatcagcctggtgctggccctggccttcgtcctcaccttcgagttcatcaacggcttccacgacactgccaacgcggtggccaccgtcatctacaccaaagcgatgtccccctaccgggcggtgatgctctccggtgtgttcaacttcctcggcgtgctgctcggcggtgtcggcgtagcctacgccatcgttcacctgctgccggtggagctgctgatcaacgtgaacaccggccatggcctggcgatggtcttctccctgctcgccgccgccatcgcctggaacctcggcacctggtacttcggcatcccggcctccagctcgcacaccctgatcggctcgatcctcggcgtcggcctggccaatgcgctgatcaccgacgtgccgctggccgaagggatcaactggcagaaggcgatcgacatcggcctgtcgctgatcttctcgccgctggccggcttcatggtcgccgcgttggtcctgctcggactgaaatggtggcgtccgctgtcgaagatgcacaagaccccggaaacccgtcgcgaactcgacgagaagaagcacccgccgttctggaaccgcctggtgctggtgctttccgccatggcggtaagcttcgtccatggctccaacgacggccagaagggtatcggcctgatcatgctggtactgatcggcatcgtcccggccaagttcgtcctcgacctgaacagcaccacctaccagatcgagcgcacccgcgacgccgccctgcacctcagtcagttataccagcgccataccgataccctcggcgacatgctggccctgggcaagagcaatggcagcgagatgccgcagttctaccgctgcgatccgaaacagaccgagccgaccatcaacgcgctgctccgcgacttgcgcggcgtgcccagctacaacgacctggacgccgacgagcgcgtgcaggtgcgtcgctacctgctgtgcctggacgacaccgcgaagaaggtcggcaagctgtccgacctgccggcgcgggagaaggccgacctggagaagctacgcaaggacctgaccgcgaccaccgaatacgcgccgttctgggtcatcatcgcggtggccctggctctcggcatcggcaccatggtcggctggaagcgcgtagtgctcaccgtcggcgagaagatcggcaagcagggcatgacctacgcccagggcatgagcgcgcagatcaccgccgccgccgccatcggcatggccaacatctacagcctgccggtgtccaccacccacgtgctgtcctccggcgtggccgggaccatggtggcgaacaagagcggcctgcacggcggcaccgtgcgcaacatcctgatggcctgggtactcaccctgccgacttcgatggcgctgtccgccggcctgttctggctggcctcgcaattcatctga

SEQ ID NO: 6644 - DNA, 660 bp, Pseudomonas aeruginosa
agcgcagttccggcacctcgctggcgccctcccgcggcgaacccagcagacgcgcgcgcaaggcgctggcgtcttccgccgccagccactcgtcgagccggcgaccgaccaggcgctccgggctggtcgcgaggctatcggcgaaggtccggttcacgtaggtcagcaccaggtcggcggtatagcgacagatcagcgccggcgaatcctccaccaggacccggtagcgttcctcgctctcggcgatacgctgtgccgccaggtgctgctcggtcacgtccagccacaggcccaccgcctcgctgggcaggccctgggcatcgcgcagcagcttggcttcgtcgtagagccagtgccagttgccctggccatcggcgaggcgatagcgggtcttcacccggccctcgcaaagcaactcgcggccacgggcgaaaaaggcctccaggtcgtccggatgcacccgttcggcgagcgcctgccaactctgtccctgcaagtcgaggccgagcaggttgctcgcgctttcgctgtagaactccggcaccaggtgcccctgctcgacccgctggacgtagatcaccaccggcgcgctgtcgatcaggctgcgcagccgcgcgtgggccgcctgtgcccgttcctcctggcgccggccttcgctga

SEQ ID NO: 6645 - DNA, 516 bp, Pseudomonas aeruginosa
tgtcgagcagcacgccggacagccccagcgcgctgccgcgccccagcggtcgaccctcgatgcgcagccagcggcgctcgccgcggctatccggctgacgcaggcaaaggtcctgggccagcgcctggccgctgcgcaggctggcacgcaggcgcaggccgagttcgtcggcgtccgccggttgcagcaggccctgcaggtgttccagcggcacccgacgatactcgccggccaaccccaggctgtcgtgcaaggccggcgccagttcgaagagttcctgctccgcccagtaacgccaccagccgccgccgatcatcttcctgcaacagccccagcttgcgcgaactgtcgtgctgctcgtggagttcgcagcggtccgccacctggttcgccagcagttccgcgaggtattgccagtcctgcggcgcgggcccctgggcgagctgctccagcgacatcggccggaccagcaacgcccccaggcggccaccgcgcatcgccgccggcaccaggtag

SEQ ID NO: 6646 - DNA, 2376 bp, Pseudomonas aeruginosa
tgcatatgcacaaccgcacacagctggcgctggccctgtcgcctgcggcgatgcagcagggcagcggagcggtggtgcactgacaggcgcgatggcccggcggacctgctagatcagcagttccgccctgccgacatcgaccttcagaatctccgcgtcgatgtatccaagttgtacccccagcaagggcaggaccagattcaggatcggcgtcagcagcccatcgaccagaggtgccaccacggaattcacgatgaggtcggtgagcgccgtcgagccgcacagcaaaggcaagcacagtccgagcaccacgggattgacgttgatgctggttttcagggtactggcgagaaagccgctttccggcaacctgcggctctggacgagatcggaaccgtcggctttcacgttgaatcgcgtatcgcccgagctgccggcgatcgaggtatcgagcttgagatccaatcgcaccaagccgccaagcaccagaatcgagccgacctgatcgatgttggccggactgccgatctttatcgtcgctccgctgcttctccaaccgaattccaacgcggtatccgggcgggtacaggccatgcttttcagccagacggctcccgacgcgccttcgatggccagttgcagtttcgtggtggcgagaatggacaggaacccggaatcgatgtccgccgtaagtcgtacctgggactggcgcacctccgtgcgccaggcaccgctctcatcctgccctggcggcccggagacgatcctcttcggctctacgaccgtgagccgtgcattggccaatccagggatacccaggttcacggcgaccgcggaattcttgttggcgacctgggcaaccgccatgatgagatccagcgcattgatcgccgtatccagctgcgacatgctgttcacctcgccggcgctcagccccagcaagtctcccagtttcaacgtggccgactttacccccaccaattgcgctctcagggcctcgaccgaggctacgccgttcttcgccaggacgttcacgctggcggcgagtacctgctgcaagccgacgttggtattcaacaactgttcgatggtccccaggctggtatcgaccccgatcaagcccattccatccgcgccgagaatgtccagcacactgagcttcgcgtcggcgataccgttgtaggccgccgccgagagatcgatgtgggtgcccagcaatccgctcaggatggggttgagcaacgccgattggccactgttcacgctcgccagccccgtgcctgcggaaatcgtggcgttcggcaggcgtcgcgccacagcctctgcgcggagatcgacgttggcattgccgccgccgaacagtcccccgaggttggcgaccaggctgccgggaacgctcttggtcacctcgacatgcaccgcctcgttggcggcagccgcgttcgacgcgctggctatgaaactgcgcaggccgccggcactcagcacgccgccgacctccgccgacaggctggagccggcggcgtccgcatcgaacccgttgagcatcgcgctggccttggcgaaagacgtcgcctgggcagaactctggtcgccgcacaaggctccctgggaggcactctccagcgccgccacgtccgccactcgctgcaggttgcgctgctccaggtagagccgcccggtatccaccaccagcaacaggcagatcaaggccagcagcagggtggtcgccgccaggatgccgatcgccccgcgctgtcttgcaggccatccgttcatgccctgcccctccgccaggaaccgtcagttcttgctctcgccgaagccgcgatcttccagcaggtactcgggaatctcgtgctcatagcttttcaggtagcgctggtaggcacgctggcgctcggcggcggtcgcgctttgccgaaccgggctggcggcccggccgctcgcctggatggccagccaggcgcgggtggcggtctgcggttcggccgtcgctggcgcggcaggacggaccgccggcgtgtccgcggcccaggccgtgccggacaggagcagcaagacgccgaacaggattcgctcgtgcatggttcacctctccggcgccggctcagggcgcctcgttggccatcgcggtatgcatattcgcctccgccggcagttccgccagcgggtcgtcgcttgccggcgccgcgccgggtgtcggtacggcaccccagctgcgcgcccgcgcctcggccgcgcggatgtcccgggcatccagctgcaaacgctcgatcaggcgctgcgcatcttcccggtcgccttgcaggtacagcaggccgagcaggttggtcgccggcagcttgccaccctgctgcaactccagcgcagtga

SEQ ID NO: 6647 - DNA, 411 bp, Pseudomonas aeruginosa
agatgtcgcgcagcggctcctcggcattctccactgcctgcatcagcgcgtcgcccagcgtgcgcccggcgtgcaggctgcgcaccacctggtcgaggaaacgcggcatctgccggatcattcgcttcaggcggcgctggtagagcatgcccagggcgacgcggcaggacagcgccgccagtagcaggccgcctagcgcgccgatggtgccgaacaggcccaatccgctccagaccagcagcagcgcgagcactgccgccccgaacaaccacgggcgcgggcgctggataccggcgcgacgcatctggcgagccagccagtgactgctgcgcggccgcaccgcgaccgcctcctggcgtcccagcagccgttcaaccaccagttcgttgcgcccggcgcgccagcccatga

SEQ ID NO: 6648 - DNA, 1539 bp, Pseudomonas aeruginosa
acagcaccagcagttgcgcgccgttcacagcagcgcctggcggaatttctgcccgaccggcgcggcctggcggacgaactgcccgctaccgcgccggtcgagactgaacagggtattggtgacgtacacgccgtcgcgcacctccagcacctccagcacttcgctgatgcaacgccgaccgctggccaggcgggtgatctgcaccaccacgtccagcgcggcgcagatcatcaggcgcaaggtctgctccggcagcctgttgccggtcaggccgaccagcatctccatgcgcagcagcgaatccatcgccgagttggcgtgcaccgtgctcatcgagccgtcgtggccggtgttcatcgcctgcagcacgtcgagtacctcgacgccgcggatctcgccgaggatgatccggtccggacgcatccgcagggcgttgcggatcaggtcgcgggcggtcacctcgccgtagccctcggcgttcggcggacgggtctccagacgcaccacgtggtcgtggccgagttgcagctcggcggtgtcctcgatggtgacgatccgctcgcgttcgtcgatgaagccgctgatgacgttgagcaaggtggtcttgccggtgccggtgccgccactgatgaggatgttgcagcggcgcgagaccgcctggcggaggaactcgagcaaggcttcgtcgacgctctggtaggccagcaggtcggcactgcgcagcagctcctggctgaacttgcggatcgagatgcacggcccgtccagcgccaccgggggaatgatcgcgttgacccggctgccgtccggcaggcgcgcgtcgaccatcgggctggactcgtccaggcgtcggccgaggggcgcgaggatacgctggatcacccgcagcacatggtggtcgtcgatgaagcgcaggtcgctctggtagagccgcccttcccgctcgacgaacacccggcccggcccgttgacgaggatttccgagacgccgggatcgcgcaggaggatctccagcgggccgaagccggtgagttcatcgaccacctcttcggccaggcggtccagttcgtagcgggagatcgccagttgatggcgcgagccgtattcgcagactttttccgagacgtactggaccacggcggagcgcgcgccctccagcaggttcatgccgtcttcgtcgatctcgtcgatgatgtagcggtgcaggcgcagcttcagcgcctggatgtcctgctcctggcgggagtggaaggcaccgccgtcaggacgcgcgccgaatcccgtgctcatagcagcgccgccttggcccggccgagccaggacagcagcgaacggcgctcgccgcgtgtcacgcacaggctgtccgccagttgccgcagcttggccgccaatgggtcgcgcggcgccacctcgaacaggctcttgccgaggttcttcgcgcgcaggcgcgattccggggacaacggcaggacaccgaacagatcgaggtcgaacatccggcttagggcctgctggtccggcgccacattgggcaggtag

SEQ ID NO: 6649 - DNA, 1308 bp, Pseudomonas aeruginosa
tccgacagaccggtgtcgttctgctggccgtcgtactcgccgcgctcgaagaagtacaggcgcgagaaccccggatcgtattgccgcaggccctcccccgggcaagtccggcaactgtgcgtctgcgggccacggctggaccaggtgcggggtgacgatcatcagcagctcgcggtcgtccttgtccaccttggtcgagcggaaggaacgcaccgaagatcgggatgtcgccccagccaagggaaacttgtccacgttgctcaccgagttgctgctggtcagcccgctgatcacgaaactttcgccgtcggccagcatcacgctggtgtcggtgcgccggacgcgcagcgccggcaccgccaccccgccgttttggatgccggcgctgtagtccagttcgctgacctccggcgccaccttgagagcaatgcggcggttgttcatcaccgtcggggtgagggtcaggcggatgccgaactccttgtattcgatggtgacgttgtcgttggtgccgttcggcaccgggatcggaaactcgccgccggcgaggaacgacgcgctctgcccgctcatcgccaccaggctcgggcgcgccagggtataggcgaagccgctgccctccagggcattcatgaagctcaaccacttgccgccgccgaagatcaggttgaatcccgagctgccggtgccgaaggtgccgcccaggccgctgccgtcggcattgaccttgatatcgccgaggctgcccggcgcaccgagcacccagaggttgccgccgcggcggacgaacgaggtgctggcctgcttcagcttgctgcggctgacctcgacgaagcggatatcggtctgcacctggttcggcagctcctccacggcgccgacggtgaacgctggagcaccgcgggtatcgacgctaccgcgtccctcgacctccaccaggctgcgcaacggctcgggactgcagccggtccagatcagcaggctggtggagccctgttccttgccggtgaccaggaagccgcgacgatccagcaactgtacgtcggcgatcttcggatcgccgatggccagccgttcgatcggcaccgccaggcgcaggtcacgctgttgtccctggacgacgtcgacccgcggcgcctgcgccagcaactcgatgcagccctgcggcaaagccagtgccggcagcgccaacgccacccccagcagccctcccagccagcgcgacacgcctatcccggtgctccgatgcatatgccggctcccctcaaggcacttcatgggtcatggcgctgccacggtagaccgtga

SEQ ID NO: 6650 - DNA, 933 bp, Pseudomonas aeruginosa
ccccgttggccaccggcacgcgcggagccgcgctgcgcacgctcggcgccgtcggtttgcggcgctccagcagttggtcgagactcagcgccgcgctcggcgcgcccagcgacgcttgcagcagcgcgccttcctgctccctgcggtagagttcttcgtccttgctgcggatggccaggcgcagcgaaccggcctggctcgccagcatcagccgcgccacgccgtcctccggtaccgccagcaccgcggtacgcggcggacgcgggtccttttcctggttcgagcggtcctgtccatcgctgcccacggcgatccgctcgccgtaggtcagtacccggacgccaggcaacaccagttgcgccagcggggtcgattcgccgtcccgctcgtcacgcacgaagagcatcacgtcgacatagtcgccgggcaggacgaagccgccgccgccgaccacgtcgtccacagcgatcgccatcgcccgctcgtccggacggatggtccgggccagcggaccgccgggttcgagggtcgcggcggaaagaatgctgccggccggcaccgcgacccagacccgcttgccgagcaacgcctcgggcctgtcgtagctaccgaccggtgcggtccgcaacagctcgacgctcaggtcgtccttgccgatcaccgccagcgccgggagatcgcgactggccaccagcaccggcttgcgttcgagcttttccagcgaagcgtccaccgtcgccgaagccggcgccacggatggagcgtgcgcgttcgatggcgcgcggccgatggatacgccgaggtatccgagcaacaccgcaccgagcagcagcaggccggccagggccatcagcaccttgctattcatgggcagacccctgctatgcgtccggacaggtcgatgaacggaaaatcaccggcgatcgccgatga

SEQ ID NO: 6651 - DNA, 915 bp, Pseudomonas aeruginosa
cgattaccgacagcgcgaggccgtgcgcacggacacggaaaactacctcggggaaatcggcaccctgaccgccagcaacatccagagctggctggaaggccgcatgcacctggtggaaggcctggcctcgcaactggcgctgctcgaccagcccgacgaggcgaatatcgcaaggcaactggaacagcccgtcttcagccgcaatttcgcgtcggtctatcttggcgaggcggccagcggcaccttcaccatgcgcccctacgacgccatgccggaaggttacgacccacgtacccgcgcctggtacaaggacgcgctggcggccgaccggctgatcgtcaccgaacctttcgtcgatgccggcaccggcgagcagatcctcgccatgtcgctgccggtgcggcacgccggtcaactgctgggcgtcgccgccggcgacatgaagctggagaccctgaccgcgatcctcaattccctgaagttcgacggtgccggctacgccttcctggtcagcgacgccggcaagatcctcctccaccccgactccgggctggtcctgaagaccctcgccgaagcctatcccaaaggcgcaccgaacatcgtccccggggtccacgaggtggaactcgacggtcgcagccagttcgtttccttcaccccggtgaagggactgcccggcgtgacctggtacgtcgccctggtcctcgaccgcgacaccgcctattcgatgctcagcgaattccgcacttcggcgatcgtcgccacgctgatcgcggtggtcggcatcatgcttctcctcggcatgctgatccgcgtactgatgcaaccgctcaccgacatgggccgcgccatgcaggacatcgcccagggcgaaggcgacctgaccaagcgcctgaaggtcaccagcaacgatga

SEQ ID NO: 6652 - DNA, 630 bp, Pseudomonas aeruginosa
attcggtacgttggccaatgccttcaaccgcttcgtcgagcgtatccacgaatcgatccgcgaggtcgccggcaccgctcgccaactgcacgatgtggcgcaactggtggtgaacgcctcgaactcctcgatggccaactccgacgagcagtccaaccgcaccaacagcgtcgcagcagcgatcaacgaactcggcgccgccgcccaggaaatcgcccgcaacgccgccgatgcctcgcaccacgcctccgacgccaaccaccaggccgaggacggcaagcaggtggtcgagcagaccatccgcgcgatgaacgagctttccgagaagatcagcgcctcctgtgccaacatcgaggccctcaacagccgcacggtgaacatcggccagatcctcgaagtgatcaagggcatctccgagcagaccaacctgctcgccctcaacgccgccatcgaagccgcgcgcgccggcgaggccggacgcggcttcgcggtggtcgccgacgaggtgcgcaacctggcccaccgtgcccaggagtcggcccagcagatccagaagatgatcgaggaactgcagatcggcgcccaggaagcggtcagtaccatgaccgagagtcagcgctacagccttga

SEQ ID NO: 6653 - DNA, 429 bp, Pseudomonas aeruginosa
accttcggcgcctcgtgcaccaggcggctggcgtcgagcaggtggatgcgcccgcgcccgtccggctcggggcggaggatgtcttccagttgcagggcaggctcgccgaagaaggcctcggcgccctgctgctccagagtggccaggcggcgcagcagcgcctgcccggaagcgccagtgaacagcgcccggtcctcgccaaggatttccggattgtccttcagatggttgagcagcgccttcaggtccttcaggtcgagcagcagcaggccttcccggtcggccacctggaaggcggcgaacagcgcggcctgctggctatcggtcaactccaggaggttggccagcagcagcgggcccatctcgctgatggtggtgcgcaacgggtggccggtcttcccggcgatgtcccagagcgtggtcgggtag

SEQ ID NO: 6654 - DNA, 189 bp, Pseudomonas aeruginosa
ttcagccacggcatgctggcgatacgttcggcgaccttgccctgcgggttgcccggcgcggcgatgccgcacaggtcgcccttgatgtcggcggcgaacaccgcgacaccggcatcgctgaaggattcggcgaggtgctgcaaggtcaccgtcttgccggtaccggtggcgccggcgatcaatccatga

SEQ ID NO: 6655 - DNA, 1119 bp, Pseudomonas aeruginosa
aaccattcatccgttgcgctaaagcttccggacttgccgccgacagacacggcaagccttgcagttgcgatccaactggggctgttcacgacagcgcgcccgcgcctcccggatgcaagaaaccatgatcaaaagtctcaagttcagccacaagatcctgctcgccgccgcgctggtggtgatcgcgaccttctccctgttcaccctctacaacgactccctgcagcgtgcctcgatccgcgaggacctggaggactacctgcacgaaatgggcgagatcaccgccagcaacgtgcagaactggctgagcgggcgcatcctgctgatcgagaacctggcccagaccctggcccgcgaccacagcccggagaccacccaggccctgctggaacagccgctgctgggctcgaccttcctcttcacctacctggggcagaccgacggcacctacaccgcgcgccccaccagcgacctgccggccgactacgacccgcgccgccgcccctggtacaacgccgccaccagcgccggccagaccaccctcaccgaaccctacatggagccggccatccacgagctggtactgaccatcgccagcccggcgcgccagggcggccagccattcggcgtggtcggcggcgacctcagcctgcagacggtggtgaagatcatcaactcgctggacttcggcggcatgggctacgccttcctggtcagcggcgacggcaagatcctcgtccatccggacaaggaccaggtcatgaagagcctcagcgacgtctacccacgcaacacgccgaagatcggcagcggcttcagcgaggccgagctgcacggcaacacccggatcctcagtttctctccggtcaagggcctgtccggcctggactggtacatcggcatctcggtggacaaggacaaggcctatgccatgctcaccaagctgcgtacctcggcgatcgtcgccgcgctgatcgcggtggtcgccatcgtcctcctcctcggcatgctgatccgcgtactgatgcaaccgctcaccgacatgggccgcgccatgcaggacatcgcccagggcgaaggcgacctgaccaagcgcctgaaggtcaccagcaacgatga

SEQ ID NO: 6656 - DNA, 630 bp, Pseudomonas aeruginosa
attcggtacgttggccaatgccttcaaccgcttcgtcgagcgtatccacgaatcgatccgcgaggtcgccggcaccgctcgccaactgcacgatgtggcgcaactggtggtgaacgcctcgaactcctcgatggccaactccgacgagcagtccaaccgcaccaacagcgtcgccgcggcgatcaacgaactcggcgccgccgcccaggaaatcgcccgcaacgccgccgatgcctcgcaccacgcctccgacgccaaccaccaggccgaagacggcaagcaggtggtcgagcagaccatccgcgcgatgaacgagctttccgagaagatcagcgcctcctgcgccaacatcgaggccctcaacagccgcacggtgaacatcggccagatcctcgaagtgatcaagggcatctccgagcagaccaacctgctcgccctcaacgccgccatcgaagccgcgcgcgccggcgaagccggacgcggcttcgcagtggtcgccgacgaggtgcgcaacctggcccaccgcgcccaggagtcggcccagcagatccagaagatgatcgaggaactgcagatcggcgcccaggaagcggtcagtaccatgaccgagagtcagcgctacagccttga

SEQ ID NO: 6657 - DNA, 1167 bp, Pseudomonas aeruginosa
ccaagatcgactggctggagcgccacctcgccttggaccacgcggcatgagtcgaggctggttactgctgttcggtttgatcggtgcctcgctgattccgctggtgctcggcggcagcgacatgttcccgcgcttgcgcgccttcccgctggacagtctgctgctgatgttcggcatgatcgtggtctgctggttcatcaacggcctgcgcctgcgcctgctgctcgccgggcgtgccggcaagctcgggcaattgcagagcgtcggcatcatcatggccagcgaattcgctttctgcgccactccgggcggcagcggcgggccgttgaccctgatggcgctgctggcccggcgcggcctgcgcccggcacagaccagcgcggtgttcgcggtcgaccagttggccgacctgacgttcttcctctgcgccctcggcgcgatcctgatctatgccctcagccattcgctgagcccgaacatggaatcgagcctgatcttcagcgcggtattcctggtcggcctgttcgtcggcgcggtaatgctgatccgctacctgcaccaggtaatccgcttcaacgggcgggttctggcgcggctcggcgtgtcatcgcgcaagcgcctgcactggggccgcaagatcctgcatttccgcattgccctgcacgacagcctgcgcctgccgaaacgacgcctgctggcggtcttccttctcagcagtacgcactggctgctgcgcttcagcgtgctcgatctgaccctgcgcggcctgggagtggatatccagtgggcctggaccttcctgatccagatggtctcgctcagcgccggacagctctcgctgatccccggcggcgccggcggcaccgagctgacctcggcggccctgctggcccccatgatcggcaagtcgacggcggcggcggccatcgtcatctggcgagcggtgaccttctatttctacctcgtcgccggcggcccggtgttcgccgtgctcgccggacgcccgctgctgaagaagctgatcagcagtcgcgaggcttcttcctgagcgtatcctcggcgtcagcctcgcccgtctcgctggcgctctcctggatacgccgccagagttcggccgcgccgggaaactcggttccgtcctcgtcgccgagggcgtcgatgtcgtaa

SEQ ID NO: 6658 - DNA, 1074 bp, Pseudomonas aeruginosa
cggctggtgcaaccctcgccgagggtcggtggcgggctggcggtgcccgccgacctgggatcgctcatgttcgttcctccgggtgccggccccggccggcattccaggggagccggctcagtcgaacaccaccgtcttgttgccgtgtaccagtacgcggtcttccaggtgatagcgcagtccgcgcgcgagcaccagcttttccacgtccttgcccagccgcaccatgtcttcgacgttgtcgcggtgagtgacccgcaccacgtcctgctcgatgatcggaccggcatccagttcctcggtcacgtaatggctggtcgcgccgatcagcttgaccccgcgcttcgacgcctggtgatacggcttggcgccgatgaaggacggcaggaagctgtggtggatgttgatcacctggtgggcgtacttgcggcacaggtccggcggcaggatctgcatgtagcgagccaggacgatgcagtcggcgccatgttcgtcgatcagccgggaaacttcatcgaaggccggctgcttgtcctgcggatcgacgggaacgtggaaatacgggatgccgtgccactcgaccatgctgcgcaggtcgtcgtggttggcgatcacgcagggaatctcgcagtccagttcgccgctgtgccagcggtgcagcagatcggccaggcaatgggactccttgctggccatcagcaccacgcgcttcttcacctcggaatcggtgatccgccattccatggagaattcgcgggcgatcggggcgaaagcctggcggaagccatccaggtcgaacggcagagagtcggcacggatctcgtggcgcatgaagaaccagccgttatcgttgtcggaatgatggctggcttcggtgatccagccattgtaggtggccaggaagttactcaccttggcaacgatcccgaccccgtcgggacaggcgatcaccagccgaaaagtgcgcatgggtatactccagaaacatcgcgaaaggccgccattctagcggcatggcgggaaaagttcagcctcggcgaaggtctttcgacaggctgttgcgcgagagaataa

SEQ ID NO: 6659 - DNA, 783 bp, Pseudomonas aeruginosa
cattccgctcgcacggatgcccgtttcactgacaaggacagcaccatgaacgacaccagcaatccctacgccacccccgccagcgccctgcaaccgacccaggcggtgccgccggtcatcggcgactacgacttccgcatcggcgacgtgatcagcgaagcctgggccaagatcaagggcgtcaaaggcatcctgatcggcgccttcgtggtctacagcgtggtgatccagaccatcaccttcatcctcaccctgctcttcggcggtatcggcctgatgagcgaggccgatcccatcgccttcgcggtcggccagatgatcgccagcctggtcgccacggcggtgggctacccgttcttcaccggcctgaccatgatcggcatccgccgcgccgccgaccagccggcgaccttcaacgaaatgttcaactacttcggcatgctggtgccgctgctgctcaccggcctgctgatgatgctgatggtctacgtcggcttcttcctgctgatcatccccggtctctacctgagcgtcgcctacatgctcgccctgccgctggtggccgagcgcggcctgacgccctggcaggccctggaaacctcgcgcaaggccatcagccgccactggttcaaggtgttcggcctgctgctggtgctgagcctgctgatgctggtgagcatgatcccgctgttcatcggcctgatctggaccggcccgctgttcgtcgtctccatgggtattctctaccgcaccatcttcggcgttcgcccgctgggcaactga

SEQ ID NO: 6660 - DNA, 558 bp, Pseudomonas aeruginosa
ctttccccgacacggccccccgatgccaccgaacgcagccgcccgcctcgtcgcgcccacctcccggccaggcgccgaggtcctcgacacccactaccacgtggaaacgccggaaggcatcgacctgctcctgcgccccgccggcgtcgtcccccgggccctggcctataccatcgacctctgcatccgcggcctgatcatgctggtgctgatgctcggcctggcgttcctcggcaagctcggcgccggcctcggcctgctgctgaccttcgtcatgacgtggtggtacatggtcctcttcgaggtgctcaaccagggccgctcgcccggcaagcagatgatgggactgcgcgtcgtccacgacgacggcactccggtgggctgggccgcgtcgctgctgcgcaacctgctgcgcttcgccgacatcctgcccttcggctacgccctcggtctgctctgttgcctgaaccatccggccttcaagcgcctgggcgacatcgccgccggcaccctggtggtctaccgcgaacccgaactgagccggcccagcctgcctga

SEQ ID NO: 6661 - DNA, 444 bp, Pseudomonas aeruginosa
ccgcttcgctggcctggctgcccgccccttccgcctatgccgagccggcggccgccaccagcgccggcgaagccgagctgccgcccgagcaggcccgcctgctgcggcagaaactcaacagcgaacaggccggcaagcagatccgggcgatcgtcgacggcgcgccgttcaagaacagcgagaccgttacgggctggcgcttcggcgacaagaccgagaaaaaggacagccgcaaggaggacgaagagcggctcaaggcattcttcgaggccctggccaactgggtgccgttccgtcacgcggcgcaggtcatcgaagtgctgctctgggcgctgctgttcagcgcggtgttcctgctggtctggcgctaccgtgaatggctgcgcctgttcgtcggcaacctgggcttgccgcaacgggcccgccgcgaagcgccgacggtga

SEQ ID NO: 6662 - DNA, 1791 bp, Pseudomonas aeruginosa
cgtcgacgaccacgcgaccgaagcgccgccggaggacaccgccggcgaggaagaagagcccgccgacagcgtgccggactattccgcactgacccgcctgtacctggaaaacgagcgctcgccggcctacatcggcttcgatcccgactaccacctgtacgatccgcagaaccacgcctacgcctgggccaacagcggcgacgccacccacctgttgcagatgcagcacggcaagggcctggtcacggtgctcaccgacgcctggatctggcggaaccgcaacatcgagcagtacgacaacgcctggctgctctggtacctgacccaggacaaccaggtgaccctgctctaccgcgccgaacgcgacagcctcgccaccctgctcgcccgccacttccccgaggccctggcggcagcgctgctgttgttgctcgccggcctgtggcgcgcagggctgcgccagggtcccttgcagccggtggccagccgttcgcgccggcaactggaggaacacctgcgcgccggcgccgacttcctcctccgccagcgcggccacgtcgccttgctgcacggtctgcaacgcgacatcctgcgcagggcgcggcgtcgccaccccggtttcgaacagctcggcgtcgccgagcaatggcagatcctcgggcgcatgacccgcctgccacccagcgccatcagccaggccatgcgcccatatccggcgcagcgcctttccgctgccgacttcacccgccaggtcgcccacctgcaaagcctcaggaatgccctatgagcgaacagacgcccgaacaaccgagcaccgcgcccaacccggcgctccagcgccagcgcgccagccagctggcccaggccctgcgcagcgaactgcagaaagccctgatcggccagggcgcagtgatcgacgacgtgctcaccgcgttgctcgccggcggccacgtgctggtggaaggcgtgccggggctcggcaagaacctgctggtacgcgccctggcgcgctgcttcgacggcggcttcgcgcgcatccagttcacccccgacctgatgcccagcgacgtcaccggccacgccgtatacgacctcgccagcgaaccattcaagctgcgcaaggggccggtgttcaaccacctgctgctggcggacgagatcaaccgcgcgccggccaagacccaggccgccctcctggaagtgatgcaggagcgccaggtcaccctggaaggacgcgccctgccggtgccgcagccgttcatggtgctggcgacgcagaacccgatcgagcaggaaggcacctatccgctgccggaagccgaactcgaccgcttcatgctcaagctgcgcatcgattacccggccgaagccgaggaacagaccctggtgcgccaggtgacccgctccgcgcgcagcgacatgctcgacgtggccaacctgcggccgctgctgaaggacaaggacgttctcgccctgcagcggatcgccagcgacctgccgatcgacgaccaggtcctcgactatgccgtgcgcctggcccgcaccacccgcaactggccgggcctggccctcggcgccggacctcgcgcgtcgatcgccctggtccgttgcggccgggcgcgggcgctgctgcgcggcggcgagttcgtggtgccggacgacatcaagggctgtgccctggcggtcctgcgccatcgggtccggctgtctccggagctggacatcgaggggctgtcggtggaccaggtcctgcaacagttgctcgaccaggtaccggccccccgcgtatga

SEQ ID NO: 6663 - DNA, 861 bp, Pseudomonas aeruginosa
ctgaagggcctgactagactgggatgcccctcgccctggcgccaaggagatgccatgcgcttcgcccgccgtctcgtcctgctcccgttgctgtcgctgctggccgcctgctcgccgaccacgccgctgttcgtcgcccaggtgaccactggcgaagtcgccgaatacaagcagatgaagagcaaccgcatgaccgccgccatcgaggaggaaggcgacctgctgacctacagcgccatggcgatccgcgacaacaggagcgccgaggcggaaaagctctacctcaccggctacgacaatcgccgctacagcgccgaggtgcgcggtatctcgctgtaccagatcggcctgatctacatgagccgctacaacgaccagcgcgacgacgccaaggccaccgactacttccagcgcgtggtccgcgagttccccggcacccacgccgccgagcatgcccaggcgcgcctgctggcaatgcgccagcgggccagggagccggtgcagaagagcgctcgcgaattgctcgccacctggaagccacagcagaacctcgatctctacaagaccagcctcgacccggacatgaccctgctgtcgcgccgcgcggtgctcaaggatcgggtcgacgaagccgccgagctctacctgctggcggtcaacgatccggcgattcctgccggtataaaggaaaaagccctctaccagctcggcctgatgtacctggcgccggacaacccgcacccgaaccgcgacaaggccatcgaatacctgcgtcgccagttgctcgactatcctgaaggcgaattgtcgaacaaggccggccggcacctcgaccaggcgctcaacgtgcaacctcgctga

SEQ ID NO: 6664 - DNA, 984 bp, Pseudomonas aeruginosa
cccagatcaagcgcccgtcgcggcgcctggtctgcaatggcattcccgcccaatgccaggagcgttgccatgaacctgcataacctgctggtggtcgtcgacccgagcagcgacgaacagccggccctttcccgtgcccagtggatcgccgaacgcagcggcgccagcgtcgagttgctgctgtgcgacttcaacccggcgctggacggcgggctgttcttcgacagtcactcgctgcagcgtgcccgcgacctttacctggacgaacgggtcacctggctggagcagctttccatgccgctgcagcaggccggcatccgcactcaggtcgaggcccagtggggcaagccgctggaccggatggtcctgcaacgggtcggcgaaacccggcccgacctggtcctcaagagcacccgcaagcacaacctgctgcgccgcctgctactgggcaacagcgactggcaattgatccgccactgcccgcagccgctctggctggtccatcacgacgcctggcgcggccagcgcctgtgcgcggcgctcgacccgctgcatgccagcgacaagccggccgccctcgatcaccggctgatcgccgccgcccgccagctcgaagccagcctggggctgcgcgccgactacctgcatacccacgcggcgatgccgcgcagcctgctgttcgacgcggaaatgctcgccggttacgagcgtttcgtgctgcaacatgaggaacgtcaccgccaggccttcgacgacctgctggcagcctacccggagatcgccgcggagcgccgccacctgctggccggctatgccgagcaggcgatccccgacttcgtccgggccaacgacatcgacctgctgctgatgggcgcggtcgcccgggggcacctggacaacgcgctgatcgggcagaccgccgaacgcgtcctggaggaggtggaatgcgacctgctggtgctcaaaccgacaaatgacatctga

SEQ ID NO: 6665 - DNA, 456 bp, Pseudomonas aeruginosa
actgctgctggacgacggccgggtggtgatggtggtcgaggaagtcgccgccgacgaactgcgctgccgggtgctgatcggcggcccgctgtccgaccacaagggcatcaaccgccgcggcggcggtctcaccgcgccggcgctgaccgacaaggacaaggccgacatcaagctggccgcggacatggacctggactacgtggccgtttccttcccgcgcgacgccaaggacatggaatacgcccgccgcctgctcaccgaggccggaggcaaggcctggctggtagccaagatcgagcgcgccgaggcggtcgccgacgacgacgcactcgacggcctgattcgtgccagcgacgcggtaatggtggcccgtggcgacctcggcgtggaaatcggcgatgccgagctggtcggcatccagaagaagatcatcctgcacgcccgccgcaacaataa

SEQ ID NO: 6666 - DNA, 3702 bp, Pseudomonas aeruginosa
cttcgccagcctgctgcaaagcgtcgaactggccaccgaagagcccccggggaaataagccgttccatgaagattctcgccatccgcctgaagaacctcgcctccctcgctggcgagcaggaaatcgacttcacccgcgaaccgctgtccagcgccggcctgttcgccatcaccggtccgaccggcgccggcaagagcaccgtgctggacgccctgtgcctggccctgttcggcagcacgccgcggctggaaagcacttcggccagcagcaaggttcccgatggccggaacgagctgtccagcaacgacgaacgcaacctgctgcgccgcggttgcgccagcggctacgccgaagtggatttcgtcggcatcgacggccaccgctatcgcgcccgctgggaaacccggcgctcccgggacaaggcggacggcgccttgcaaaagagccagcagagcctccaggacctggagacccagcaaatgctggcagcgaacaagaaaagcgagttccgcgaacagctggagcagaagctcggcctcaatttcgcccagttcactcgcgccgtgctgctggcccagagcgaattcagcgccttcctcaaggccagcgacaacgaccgcggcgcattgctggagaaactcaccgacaccggcctgtacagccaattgagcaaagccgcctatcagcgcgccagccaggccgacgagcagcgcaagcaactcgagcaacgcctggaaggcagcctgcccctggccgagcaggcccgggccgggctcgaggcggcgctggaatcccacgcccaggcgcgtctccaggagcaacaggcactgcaacgtctggaaggccagcaacaatggttcaccgaggagcagcggctgctgcaatcctgcgagcacgcacaaggtcaactggccgaggccaggcaggcctgggacgccctggcgacggagcgggaaaccctgcaatggctggagcgcctggctccggttcgcggactgatcgaacgcctgaagcaactcgagcaggaactccggcactccgagcagcagcagcggcagcgcaccgagcagcaagccgcgggcgccgagcgcttgcaaggattgcaggcccgcttgcaggaggcgcgcgagcgccaggcccaggccgacaaccatctgcgtcaggcccaggcgccgttgcgcgaggctttccagctggagagcgaggccaggcgcctggagcgaacgctggccgagcgacaggaactccatcggcaatcgaaccagcgccacgcccagcaaagcgacgccgctcggcaactggatatgcagcagcagcgccatgtcgcggaacaggcgcaactgcaggcggcattgcgcgacagccaggctctcgccgcgctcggcgacgcctgggcgacccaccagggccagctcgccgccttcgtgcaacgtcgccagcgcgcgctcgaaagccaggcgcagctccccgagctggaaaaatccctggcccacgccggggaaccgctcgaacgcttgcaggcgcaatggaccgccctccatggcagcgagccggacgacctggcggcacgcctggacgaattgcgccggcagaccgatagcctggaacgacaacaagcgctccacaaggaatggcaacaggccctcgaccaacgcaccggcctggctcgacgcctgggcgaactcgaccagcgtatggtcgagcaggagcaggcattgctcgacctgaaacgacaaggcagccaatgcgccgaggaggtgaaggcggcggagcaggccctgcaggtcacccgcgagttgctccagcgccaacgtctggcccgcagcgccagcgtcgagcaactgcgcgccggcctggtggacggcgaggcctgtccggtctgcggcagccaggagcatccctatcaccattccgagcaactgctcgccgccctcggtgaacacgacgaccaggagcaggtccgcgccgagcagtccctcgagcggctgcgacagaccctggtcggtctgcgcgagggctattccagccagcgggaaagactcaaccagagtcgccaggagcagcaggaactgactggccaactggccgcgctcgatcggcaactggaccaatggacgctgccggaagaactgcgactcctgcagccgtccgcgcagttggagtggctggcacaacgcctggacgacctggcagggcagcgccagcagtgccaacgagacttcgaccggctgatcgcccgccaacgccagacccagcaattgcagcaggaactgcgggccgtcgagacgatcctgcaacagcgccagcaggcgctgacggaacaacggcagcgctacgaacatttgcagcagcaggtcgaggaggacagccagcaattgcgtccattgctctccgacgagcactggcagcgctggcaggcagatccgctgcggactttccaggcactcggcgagtccatcgagcaacgccggcagcaacaggcgcggcttcagcaaatcgaacagcgtctgcaggagctcaagcagcgctgcgatgaatcgagctggcaactgaagcaaagcgacgagcaacgcaacgaagcccgtcaggcagaggaaagggcccaggcggaactcgccgaactgaacggacgcctcggcgctcacctgggccagcacgcctgcgcccaggattggcaactatcgctggaacacgccgcgcaagcggcgcagagtgccgtcgagacgctccaggcgcccctggattcgctgcgcgaggaacaactgcgactcgccgaagccctggaacacctgcagcagcaacggcagcgccaacaggatgagttccagcgccttcaggccgactggcaggcctggcgcgaacgccaggacaacctcgacgacagccgcctcgacgccctgctcggcctttccgaggaacaggcgacgcaatggcgggagcaattgcagcgactgcaagaggagatcacccgccagcagacgctggaagcagagcgccaggcgcaactgctccagcatcgccggcagcggccggaaaccgaccgcgaggcgctggaagacaacctgcggcaacagcgcgaacgcctggccgccagcgaacaggcctacctggagacctacagccagttgcaggccgacaaccagcgccgcgagcagagccaggcgctgcttgccgaactggagcgagcccgcgccgagttccgcagatggggccgcctgaacgaactgatcggttcgtccagcggcgacaagttccgccgcatcgcccagggctacaacctcgacctgctggtgcagcacagcaacgtgcagttgcgccagttggcgcggcgctaccgcctgcagcgcggcggcagcgaactgggcctgctggtggtggacaccgagatgggcgacgaactgcgctcggtgtattcgctctccggcggcgagaccttcctgatttccctggccctggcgctcggcctggcctcgatggcatcgagcaagctgcgcatcgagtcgctgttcatcgacgaaggcttcggcagcctcgacccggaatccctgcaactggcgatggatgccctggacaacctgcaggcccagggacgcaaggtggcggtgatttcccacgtccaggaaatgcacgaacggatcccggtccaggtgcgggtccagcgcgagggcaacggcatgagcagcctgaaggtggtcggctga

SEQ ID NO: 6667 - DNA, 1149 bp, Pseudomonas aeruginosa
gccgaccgcccaggcggcacgtcagaacggcagctcggtctgttcacccggagcatgcggcggctgctcttccctttccggccgcagatgcagcatcagcccgctgagccggcgcaccttgcgccgcactgcttcctcgaacaccccgggcaggctttccaccaggctgaaccagtcgcgggcgcgggtgataccggtgtacaccagctccttggtcagcaccgggttcagcgcgtccggcaggaccagcgcggtatgggcgaactccgaaccctgcgacttgtgcacggtcatggcgaacacggtgtccacctctaccaggcggctcggcaggacgaagcgcacgccgccgctaccgtcgttgcgcgggaaggccacgcgcagcgcaaagcgcaggctgccgtcgtcgttgcgctcgggcaggcgcagggcgatgccgatatcgccgttcatcagccccaggctgtagtcgttgcgcgtcaccagtaccggccgcccctcgtaccagccgtgatcggcctcgatcaggccaaggcgcagcagttccgccgctacccgctggttcagtccttccacgccccatgggccgcggcgcagcgcgcagagcaggcggaaggcgtcgaaagccgtcagtaccgactgcgcccagcgctcccaggcgccatcctccagcgccagtccggcggccgggcggccctcggccaggcgttgcaggtagtgccggtagccgtacggcgtgcccggcgcctgcggatgaccgtcgacgaacagccgggcgaaggctgcatcgcgctccccgcgcaggcgcaggtcgaagaggtcggcgggcggactgtccagcagcgcgcgcgcgtcgccggcctgttgccggttgaccaaccgcgccaggcgcccgatcccgctgctcgcgccgaagcgccgggaatgccgcagcatgacggtctgttgcgccagcggatgcgcctgcgccgaaccttcgcgcaagccctgccaggtttcgccgctgacccgctgcaaccaggcgcgggtctcggcgctgtaccagccctcctcggcatcccggcagagatcgccgagcaccgcgccggcctctaccgaggccaactggtccttgtcgccgagcaggatcaggcgcgcctgcggcggtag

SEQ ID NO: 6668 - DNA, 651 bp, Pseudomonas aeruginosa
cgcatcgagcaggctggccatcatttccaggtcgatcatcgaggcctcatccaccaccagcacgtccagcgccaaagggttgtcccggtggtggcggaagtgccgggtatccggaccgctaccaagcagacggtgcagggtagtgacctcggcggggatcgcctgcaacacgtcttccgccagcggcagggcccggacctgctggccgatggattcggagagacgcgccgcggccttgccggtgggcgccgcgaggcggatgcgcagcggctggccggcggctaccgccggtgcctggagcagaccgagcaggcgcaccacggtggtggtcttgccggtaccgggaccgccggtgatcaggctgaaatagccgcgggccgccagggcacaggccagcttctgccagtcggtgacgcgctggccgtcttccgtaggcgcctgcgcgaacagcgcggccaggcgcggcgccaggtcggcggccaggggcgcctgccgacccaggcgctcgcgcagggccagggcgatctccaactcgtgccgccaataacgacgcaggtagagacgctgggcgcaaagcaccagcggcgaggtcgccgtctcgctcggctcgggatcgcctgggcgctcgtcgaccacctccaccagcggtga

SEQ ID NO: 6669 - DNA, 411 bp, Pseudomonas aeruginosa
gcgaccagcccggccaggctggtttcgccaccgggccagcgcagcggttcggcgagatactgctccagccacaggtcgagcggttcggcccagtccttccagccacgcagatcgcagcgtcgcgcgaccagttcgcggcgccgctgggcatcggcgcgcgccacatcgaagccttcgcggccggcccattcgagcagcccgtggaggaaggtgccgggagccggtccgcgcgggaagcgatgcaggtcgtcgcgcatctcgctggcgtgcgcgaccggcggctgttcggcggaacggccttcttcggggaaggtggcttcctcggcgctgatcggctcctgcgattcgtcgctctccaacacatcgtcatcgtccagcccggcggaggcctgcaattgcaggccggaatag

SEQ ID NO: 6670 - DNA, 435 bp, Pseudomonas aeruginosa
gcccgcgcagcctgctccttgcgccgcgccagctcgatgacccgccctgcagcgccatcctcgtggaaactcgccggcgcgccgctgttgccgtccagctccctccagctgcagatgaagggcagcagcaccaaggggtattccagccccttggacttgtggatggtcaccaccttgatcaggtcggcgtcgctttccaggcggaggatctcttcgctccccggactctgcacctgctcggccagatggcggatcagcgcgtgctcaccgtccagttccaccgccgcgcgctgcagccactcggccaggtgcagcaggttggtcaggctgcgctcgccatcggcatgccgcagcaggcgcgccggcagttcgaagtcggcgagcaggcgccgcagcatcggcaatacgccctgggcctgccaggaccggcgatag

SEQ ID NO: 6671 - DNA, 423 bp, Pseudomonas aeruginosa
cgccagagcaggtcgggcagcggttgcagcaaatggcgcgcggagaactcgccgaacgccgccagcggcaggcgaccctgtcgccgcagtcgctcgacctgggcctgcaactgcgccggcaggccctcggcatcccagtcccgctcgacccagcgcttcatgcgttcggtcagctcgaattgcagcttccagttgtccagcgcgtccagttcgaaaggttcttcgtcgttgccggtcaattgctcgtcgtcgaaacgcaccttgagccgctgctggaagaacgcattcaccgggttggcgaggaactccgccagcgctcgcagccccagtgcgccctccagttcaagcggcggcagggacgcttcggcgtcgggaacggcgatgtcgtcctcgctatggacctcgcgccactcgcgggcgtag

SEQ ID NO: 6672 - DNA, 294 bp, Pseudomonas aeruginosa
cattgtagcggccgtcgcagaaggaaccggccacggcgcccacgccggcgtccaggccgcgctcgcggagccagtcgcagatcggctggcacagccgcaggtaggcggtttcgatacgggtctgctcgttgtcgccgggccccagcgcataggacagggcgatgttcagcacgcccggcgattgcggcaccggctcgccgccggtatcgcgcagcagcaccggccagccgcgttcggcgaccgctgcgctggccggcgcgaatccttccaggcgctccatccggcgcggcatga

SEQ ID NO: 6673 - DNA, 834 bp, Pseudomonas aeruginosa
actccagacaaaccacccgtaggttcggacatgtcgaccaccaccttgctgcgccttcccgatctccaggggcagtctttcgacgtctatttccgctatgacgagttcggcgccgacacccattcgccgccgcacacccacgcctggggccagctcaactatgcagcccatggcgtgatgcagctggagatcgacggccagcgcttcctctcgcctccgcaatacgcggtatggataccaccggagcgggtgcacagctgctacaacagccaggccatcgtctaccgctcgctgtacctttccgccgagctgtcacgacgcctgccggcgacaccctgcaccctggcgatcagcgcgatcctcaaggcgatcctctcggacttcgccgagcgcggggtcaacctgccgacctcggcgcaggacctgcgcctggcccgggtcgtcatggaccagctggaatgcgcccagccccacgacgactacctgccctacggccgtaccccggcgctgcgcgaggtgctcgacgcactgcaggccgagccgggcgacaaccgctcgctggcgcaatgggcgcagcaggtgcacagcaccgagcgaaccctggcccggcactgccagcgcgaactgggcatgaccttcggcgaatggcgccaacgcctgcgcttcctcgcggccatcgaggcgctggaagccggcagggggatccagcagatcgccttcgacctcggctacagcagcccctcggcgttcatctcgatgttccgccggctggccggcaccacaccggaacaataccgcctggccagccgcgcccaggacatgccgatgctgtaa

SEQ ID NO: 6674 - DNA, 1260 bp, Pseudomonas aeruginosa
cccgccgtgcatgcgttgcggctatgctcgcagcagccaccatccggagttcgcatgccaaccgccagccgccatcccgacaccgccctcgcggtgttcctcgccttcctcaagctgggctgcagcgccttcggcgggcccatcgcccacctcggctatttccgcgacgagttcgtccgccgccgcggctggctgagcgaaagcagctacgccgacctggtcgccctctgccagttccttcccggccccgccagcagccaggtcggcatggccctcggcctggcccgcgccggctatcccggcgccctcgccgcctggctcggtttcaccctgccctcggcgttgctactggtgctcttcgctctcggcctgggacgctggggcgcgctgttgcccgagggcgtgctgcatggcctgaagatcgccgcggtggcggtggtggcccaggcggtctggggcatgggacgcagcctgtgcccggatcgcccgcgcctgacgctgatggcgctgtcctgcgcgagcgtgctggcctggcccactgcctggacccaagtcgcggtgatcgccggtgccggcctggccggcctcgccctgttgaaaacggaagcagtggaaggccacgagcggctgccgatcgacattggctaccgcggcgcgctgctgttcctcaccctgttcgccgtgctgctggtctgcctgccgctagccgcgcgcctctggccggaacactggctgcgcctgctcgatgcgttctaccgggctggctcgctggtattcggcggtggccatgtggtgctgccgctgctgcaggcggaagtggtacccaagggctgggtcgacggcgataccttcctcgccggctacgcggccgcccaggcggtaccgggcccgctcttcaccttcgccgcgttcctcggcgcagcctcgggcccggcgccgaacggatggagcggcgcgctgctgtgcctgctggcgatcttcctgccgtcgttcctgctggtcgccggtgccttgccattctgggaacgcctgcgccacgaacgccgggtacgggcaacgctggccggggtcaacgcggcggtggtcggcctgctgctggcggcgctgtaccagccgctctggaccgaaggcatcctgcgcccggccgacttcgccctgctgctcttcgccctgctggccctgctcgcctggaagacgccgccctggcaagtggtgctcgcctgcgccgtgaccggcggcctgatcgccacagccggctag

SEQ ID NO: 6675 - DNA, 1731 bp, Pseudomonas aeruginosa
gcgtccaggctgacctcggcgaggcgctcgctgatcacctcggcctggttctccaactggctggcagcttcgccgaggcgcagggtctgttcctcgctggcgctgaggtcgccgcgcacctgctcgaccgcggcgaacaggctggcgagttggctgcggttgatctcggcgccctgggcgatctcggtaatctggctttccaccccggccgccagttcggcaatgccttccagttgccgaccggtcagctcgacctggccgaccccttcccccaactcttcggaaagctggcggatctgctcgaccacctcgctggtctggcgctggatctcggcgaccatctggccgacttcctcggtggcctcggcggtacgtccggccaggccgcgcacctcttcggcaaccaccgcgaagccgcgcccatgctcgccggcgcgggccgcctcgatggccgcgttgagggccagcaggttggtctggctggcgatgccctggatcaccagggtgacccgctggatgtcctcgctgcgctggttcagcgcctcgatcgcctcgcggctggcgcccatccgctcgctgagccgatgcatgcgctcgatggtcgaggccagcagcacctggccttcgtcgctgccggcgcgcgcccgggtggcggcgtccatggcctggcgcgccagattggaggtggcgcgctcggtgtggatcatcacttcggcgctgccgacgatctgttcggcggcgtcgagctgggattgcagcttctccgccaggcgcttcaccgagaacgccacgccggcggccgacaaggcgttctggctggtgttatgggacaggtcgcgagccagccgggcgatgtcgggctcgccgacggtcgccaccgccgtgcggttgccgggaagcagccagggcaaccagagcagcgccacgccgagcggcagggccaggtacagcggcagccagccatgccgggcgccgaccagcaggagaaccagggccaggctctgcaacaggcagacgaagaggatgcgggaacgagcgggctgcatgagtaaatctccggcctccggggcgttgcgtcatgaccctggggtcggacgggcgacggcggggcttctttatttgacttgtagtccggtttgtagcccgcccccggaagcgccgccatcgttccttagtggtatggccaatggctggcattcgactagcgcaggccgcgacgaaaggcggagaacaccccggacgcgtcggccaggccttgatccatgggggcttcgccgcatttccaggggacgctcgaagaacttccgtcctgccgtccgtcggccgacaccgtatgacaagcccggagcccacgttataattccgcgcccatttacagccggtagcggtcgactagactcccaaccggcgctggccggaccccgcttccgcccagcctggtcgctatcgggcccgctctttttggactcaggaccacccgtgacgaaagacgaattgcgtgccgcgctggcgcgcgaggaacagcgttacaaggacgtgtacggcggcgaagtgacgctttatgccgcccagccggaacccgaccgcaagccctggcgcaaacgcccaaccgttcaggagcaggcgttcgacagagaactgcagaagatcgaagaagagcgtctcaaggccgggcaggaagcagcgaaccccattccatttacctccaaccgacaggagagcgacggataa

SEQ ID NO: 6676 - DNA, 2373 bp, Pseudomonas aeruginosa
tggcctgggtactcaccctgccgacttcgatggcgctgtccgccggcctgttctggctggcctcgcaattcatctgagccgcctcgccggttgaaaaaacgcctgcttgtccgcaggcgtttttttgccgcgctcccaccgacgtcatccgcccgcctcggcgggcgccgccagcggcaagcgaaccacgaacaacgcaccctccccctggttggccgccgtcaggctaccgcccatgttgcgcaccagatcgtggctgaccgagagacccaggccggtacccttgccctccgccttggtggtgaagaagggttcgaatatccgctccagcaggagcggttcgatcccaccgccgttgtcgtgcacgtgcaattcgacccagcccggttcgcggcaagccacctgctccaggcgaacacgccggctggccaggccgggattgccaagcagggcatcgcgggcgttggcgagcaggttgatgatcacctgttccaactggtccgcctgccctcgcaccaccatccgctgcgtcggcgccgggcactccacctcgatggcgtgctgacgcagcccctcgccgagcaggcccagggcgccttcgaaggcggcataggggtcgaacggcagcgcctccagcgccgacttgcggctgaacacgccgaggtggctgaccaggcggtcgacgcgcaggacctgggcatccatgcgctccagtttctcgcccaggtagtcgccgtcgaggccgacgctgttcatccgctggcgcatgttgaagagggtcatgcgcagcacgtgcagcggctgcttcacctcgtgggcgaggccgctgaccatctcccccaggctggccatcttggcgccttgcgccagttgctgctgggcccgacgcaccggcgtgttgtcgcgtcccaccgcctgtacctcgcacaattcgccccgggcgtcgaacaacggtcgctcggcccacaccagccagagaaaacgttgccccggcaggttgaagcgcagttccggcacctcgctggcgccctcccgcggcgaacccagcagacgcgcgcgcaaggcgctggcgtcttccgccgccagccactcgtcgagccggcgaccgaccaggcgctccgggctggtcgcgaggctatcggcgaaggtccggttcacgtaggtcagcaccaggtcggcggtatagcgacagatcagcgccggcgaatcctccaccaggacccggtagcgttcctcgctctcggcgatacgctgtgccgccaggtgctgctcggtcacgtccagccacaggcccaccgcctcgctgggcaggccctgggcatcgcgcagcagcttggcttcgtcgtagagccagtgccagttgccctggccatcggcgaggcgatagcgggtcttcacccggccctcgcaaagcaactcgcggccacgggcgaaaaaggcctccaggtcgtccggatgcacccgttcggcgagcgcctgccaactctgtccctgcaagtcgaggccgagcaggttgctcgcgctttcgctgtagaactccggcaccaggtgcccctgctcgacccgctggacgtagatcaccaccggcgcgctgtcgatcaggctgcgcagccgcgcgtgggccgcctgtgcccgttcctcctggcgccggccttcgctgatgtcgagcagcacgccggacagccccagcgcgctgccgcgccccagcggtcgaccctcgatgcgcagccagcggcgctcgccgcggctatccggctgacgcaggcaaaggtcctgggccagcgcctggccgctgcgcaggctggcacgcaggcgcaggccgagttcgtcggcgtccgccggttgcagcaggccctgcaggtgttccagcggcacccgacgatactcgccggccaaccccaggctgtcgtgcaaggccggcgccagttcgaagagttcctgctccgcccagtaacgccaccagccgccgccgatcatcttcctgcaacagccccagcttgcgcgaactgtcgtgctgctcgtggagttcgcagcggtccgccacctggttcgccagcagttccgcgaggtattgccagtcctgcggcgcgggcccctgggcgagctgctccagcgacatcggccggaccagcaacgcccccaggcggccaccgcgcatcgccgccggcaccaggtagagcgcgtcctcgccgatctgccggagcagcgtcgaggcgccttcgccacggcgtagcaagcgcgcgcccgccccttcgcgcaggtcgtcgtcggcgagttgcagggtcggtcgcagcaaactgtcgctgccaggccgcacatgactggcgaagaccgtgcagaaacccttgccgtcgcccagcagcagggcgatag

SEQ ID NO: 6677 - DNA, 483 bp, Pseudomonas aeruginosa
ggtcggagatgtccatgcccagcagcagcgagcgtcccaggccgtcgagcggctgcatcggctggaaacgacaggtcaatggcgcggcggcatcgctgcgcagcgtcaggtcgagacgctcgccccggcgcaggccggccagcgtcggcgcaccgggggcgcgccgctccagatactcggcgaaaggccgcggctgttcgccaagcccatgggcgcactgcagacgatacgcctgccgcccgccgacccggatcacgcggtcctgttcgtccatctcgaaacacaggtcccaactcctcagcgaagcgctccagagggcggggccttcctgcgaaaagggttccggcctctcggcctcggcggacgacgagcgggaaaattcgaacatgcgaccacctcacagcaacaggttggcactcgccttcagcgtctgcggcaggttgggaatcgcgccgatgccggggaagctcagcacggggatga

SEQ ID NO: 6678 - DNA, 807 bp, Pseudomonas aeruginosa
accccaggtgacctcggaactccgcgaactgctggaaaacagtggctaccgttgcgtaaccagcacccaccgggagtcggcgatcgccagcttccaggccgacccgaacatcggcctggtcatctgcgacctctacctggggcaagacaacggtatccgcctgatcgagagcctcaaggaagtcgccggcaacggcaggttcttcgaatcgatcatcctcaccggtcacgatggccgccaggaagtgatcgaggccatgcgggtcggcgccgccgactactaccagaaaccggtggcgccgcaggaactgctgcatggcctcgaacgcctggagaaccgcctgcacgagcgcgtccgcagccagttgagcctgagccacgtcaaccagcgcctggaatacctcgccgaatcgctgaactcgatctaccgcgacatccacaagatcaagtacgaggtacacggcaacagccagccgagtgccctcaagagcgaagacagccagccgtccgcgccgccggcgtcggtcgcggaaagccaggtgtccccgagcaatccgctgttcggcaagctgtcgccccgccagcaggcggtggcgcggctggtgagcaagggcctgaccaactaccagatcgcctacgaactgggcatcaccgagaacacggtgaagctgtacgtctcccaggtgctgcgcctgatgcatatgcacaaccgcacacagctggcgctggccctgtcgcctgcggcgatgcagcagggcagcggagcggtggtgcactgacaggcgcgatggcccggcggacctgctag

SEQ ID NO: 6679 - DNA, 2469 bp, Pseudomonas aeruginosa
gcacgctggcgctcggcggcggtcgcgctttgccgaaccgggctggcggcccggccgctcgcctggatggccagccaggcgcgggtggcggtctgcggttcggccgtcgctggcgcggcaggacggaccgccggcgtgtccgcggcccaggccgtgccggacaggagcagcaagacgccgaacaggattcgctcgtgcatggttcacctctccggcgccggctcagggcgcctcgttggccatcgcggtatgcatattcgcctccgccggcagttccgccagcgggtcgtcgcttgccggcgccgcgccgggtgtcggtacggcaccccagctgcgcgcccgcgcctcggccgcgcggatgtcccgggcatccagctgcaaacgctcgatcaggcgctgcgcatcttcccggtcgccttgcaggtacagcaggccgagcaggttggtcgccggcagcttgccaccctgctgcaactccagcgcagtgatgaattcgaagcgcgcgccgacacggtcgccgcgcttgagcagggcgacccccaggtcgttgcggaagcggctctcggtcggccgcaggcgcgccgcctcgcgcagctcgaggaccgcccgggcgctgtcgccattgcgcagggcgagcaggccgaggccgtggtgcgcctcgggtgccttgcaggtttccagcagggcctggtactcggccctggcccgcgggtcgccgatccggcgcaggatcagcgccctttcttcgcgcacgtcgagcaaccccggcggcatgctttccaggttggccagggccgcatgcaggcggccctcgcggatcatgtcgcggaccatgttcatctgcagttcctgctcctggccgagctgctgcgaacactcccgtgggccgtcccgccccggcagcgcggcgcaaccgccgagcagggcggcgcacaggccgatgccgatcagtgctttcatcccagtcctcccaaggccttggtgatggcaatgacgcccggaccggcgaggacgatcagcagcgccgggaacagcagcaccatcatcaccaggctcatcttcgccgacagcttgccgatgcgttcctgcaaggtggtcaggcgccggtcttcgaacagttgcttgagcgtcagcagggtgctgcgcgcactgccgccctggcgcaacatctgccgtagcacgccgcagcagtcgttcagcgggtccacctgcaggcgccgggcaagcgcctccagctcttccgccaggtcgatgccgttgtcggcacgggtcagcgccaggtccagctcgcgggccagttgcggggtgatcccgcggccttccaggcagaccacgcgcagcgtctgctccacggtcaggccggcgtcgaagaggatgcggatcagttgcacgaacaggatcatttcgtcggcgatcagcgcccggcgcgctttggcgaagtggcttgagcacctgcttgggcaggaggaaaccgatgccggcggcgaacagcagcggcaccgcgtaggacgcttcgctttcggcgcgcagcagcttgaccagcaagaccaggagaacgaacagcagcggcgtgaggaacaccgagatcaggtacagggtccggtagcgactctcgtgccagccggcctgttgcagcaactggcgggcctcgctgtccatcagttgcaggcgccgcacccagaagctgtcgtccatccgctcggtcatgccggccagccacctggtcgagccgccagggttggccagcgctcccaggcgcctctcgatcaggcgctgctcgcggctgccgttgcgcgcctggagcaacagcaacaaggcaccgccgaccgccatcaggagcgccgcgaaaatcagccactgtgcctgcatggccacctcctagacgctcttgagcatgcgccacagcgcatagcagccgagcagttgcagcccgagcgaggccagcagcaggaaacgcccggtgccgtcggcccacatgttcagcagatagcccgggttgctcgccaggatgtagccgcccagggcgctcggcacgccggccaggacataggcgctgatccgtgtctcgccggtcatcgcgtgcaactgccggctgagcttctcgcgctcgtggatgagcttgacgatgctgtccagcaggtcgctggtattgccgccataacggtggttgaccgagacgcccagggcgaggatgcgcagctcctcaacctcgtagagttcggcgacttcctgcaacgcctccggcaggtggatgccgagaagcacgtggttgcgcgccagggtgaagatgtcgcgcagcggctcctcggcattctccactgcctgcatcagcgcgtcgcccagcgtgcgcccggcgtgcaggctgcgcaccacctggtcgaggaaacgcggcatctgccggatcattcgcttcaggcggcgctggtagagcatgcccagggcgacgcggcaggacagcgccgccagtag

SEQ ID NO: 6680 - DNA, 1782 bp, Pseudomonas aeruginosa
gcgaagccgctgccctccagggcattcatgaagctcaaccacttgccgccgccgaagatcaggttgaatcccgagctgccggtgccgaaggtgccgcccaggccgctgccgtcggcattgaccttgatatcgccgaggctgcccggcgcaccgagcacccagaggttgccgccgcggcggacgaacgaggtgctggcctgcttcagcttgctgcggctgacctcgacgaagcggatatcggtctgcacctggttcggcagctcctccacggcgccgacggtgaacgctggagcaccgcgggtatcgacgctaccgcgtccctcgacctccaccaggctgcgcaacggctcgggactgcagccggtccagatcagcaggctggtggagccctgttccttgccggtgaccaggaagccgcgacgatccagcaactgtacgtcggcgatcttcggatcgccgatggccagccgttcgatcggcaccgccaggcgcaggtcacgctgttgtccctggacgacgtcgacccgcggcgcctgcgccagcaactcgatgcagccctgcggcaaagccagtgccggcagcgccaacgccacccccagcagccctcccagccagcgcgacacgcctatcccggtgctccgatgcatatgccggctcccctcaaggcacttcatgggtcatggcgctgccacggtagaccgtgaccccgttggccaccggcacgcgcggagccgcgctgcgcacgctcggcgccgtcggtttgcggcgctccagcagttggtcgagactcagcgccgcgctcggcgcgcccagcgacgcttgcagcagcgcgccttcctgctccctgcggtagagttcttcgtccttgctgcggatggccaggcgcagcgaaccggcctggctcgccagcatcagccgcgccacgccgtcctccggtaccgccagcaccgcggtacgcggcggacgcgggtccttttcctggttcgagcggtcctgtccatcgctgcccacggcgatccgctcgccgtaggtcagtacccggacgccaggcaacaccagttgcgccagcggggtcgattcgccgtcccgctcgtcacgcacgaagagcatcacgtcgacatagtcgccgggcaggacgaagccgccgccgccgaccacgtcgtccacagcgatcgccatcgcccgctcgtccggacggatggtccgggccagcggaccgccgggttcgagggtcgcggcggaaagaatgctgccggccggcaccgcgacccagacccgcttgccgagcaacgcctcgggcctgtcgtagctaccgaccggtgcggtccgcaacagctcgacgctcaggtcgtccttgccgatcaccgccagcgccgggagatcgcgactggccaccagcaccggcttgcgttcgagcttttccagcgaagcgtccaccgtcgccgaagccggcgccacggatggagcgtgcgcgttcgatggcgcgcggccgatggatacgccgaggtatccgagcaacaccgcaccgagcagcagcaggccggccagggccatcagcaccttgctattcatgggcagacccctgctatgcgtccggacaggtcgatgaacggaaaatcaccggcgatcgccgatgatcggaaaagaaaaacgggcgtctcgctgtccgtgtcatggccatactccgggactggctttccatggcaggtacattggggttatcgactggcgacagtcgttattcaagaaccaaagttcataacttcgaacttgcgacgatag

SEQ ID NO: 6681 - DNA, 1923 bp, Pseudomonas aeruginosa
ggcttttgccaggacgcatcgctcatgcttcgctcgctgtcgtttgccaagaaaatccttctcgccgccgcgctggtggtggttttcgccttcacctgcttcatcctctataacgattaccgacagcgcgaggccgtgcgcacggacacggaaaactacctcggggaaatcggcaccctgaccgccagcaacatccagagctggctggaaggccgcatgcacctggtggaaggcctggcctcgcaactggcgctgctcgaccagcccgacgaggcgaatatcgcaaggcaactggaacagcccgtcttcagccgcaatttcgcgtcggtctatcttggcgaggcggccagcggcaccttcaccatgcgcccctacgacgccatgccggaaggttacgacccacgtacccgcgcctggtacaaggacgcgctggcggccgaccggctgatcgtcaccgaacctttcgtcgatgccggcaccggcgagcagatcctcgccatgtcgctgccggtgcggcacgccggtcaactgctgggcgtcgccgccggcgacatgaagctggagaccctgaccgcgatcctcaattccctgaagttcgacggtgccggctacgccttcctggtcagcgacgccggcaagatcctcctccaccccgactccgggctggtcctgaagaccctcgccgaagcctatcccaaaggcgcaccgaacatcgtccccggggtccacgaggtggaactcgacggtcgcagccagttcgtttccttcaccccggtgaagggactgcccggcgtgacctggtacgtcgccctggtcctcgaccgcgacaccgcctattcgatgctcagcgaattccgcacttcggcgatcgtcgccacgctgatcgcggtggtcggcatcatgcttctcctcggcatgctgatccgcgtactgatgcaaccgctcaccgacatgggccgcgccatgcaggacatcgcccagggcgaaggcgacctgaccaagcgcctgaaggtcaccagcaacgatgaattcggtacgttggccaatgccttcaaccgcttcgtcgagcgtatccacgaatcgatccgcgaggtcgccggcaccgctcgccaactgcacgatgtggcgcaactggtggtgaacgcctcgaactcctcgatggccaactccgacgagcagtccaaccgcaccaacagcgtcgcagcagcgatcaacgaactcggcgccgccgcccaggaaatcgcccgcaacgccgccgatgcctcgcaccacgcctccgacgccaaccaccaggccgaggacggcaagcaggtggtcgagcagaccatccgcgcgatgaacgagctttccgagaagatcagcgcctcctgtgccaacatcgaggccctcaacagccgcacggtgaacatcggccagatcctcgaagtgatcaagggcatctccgagcagaccaacctgctcgccctcaacgccgccatcgaagccgcgcgcgccggcgaggccggacgcggcttcgcggtggtcgccgacgaggtgcgcaacctggcccaccgtgcccaggagtcggcccagcagatccagaagatgatcgaggaactgcagatcggcgcccaggaagcggtcagtaccatgaccgagagtcagcgctacagccttgaaagcgtggagatcgccaaccgtgccggcgaacgcctgggtagcgtgaccagccggatcggcgagatcgacagcatgaaccagtcggtggccactgccaccgaggaacagaccgcggtggtcgactcgctgaacatggacatcaccgagatcaacaccctcaaccaggaaggcgtggagaacctccaggccaccctgcgcgcctgcggcgagctggaaacccaggccgggcgcctgcggcacctggtggacagcttcaagatctga

SEQ ID NO: 6682 - DNA, 606 bp, Pseudomonas aeruginosa
gcccgtccgtcccacaggccggctaaccgcgaagcggttagccggcgatcatccagcccccatgaaaaaggcgcccgcgggcgcctttttcatggcctggcgctcagcgccgcttcttcccgcccatcaacgagccgagcaggccacgcaccagctcccggctcaactggttggccgcctggcgcatggcgctcttcaccgtcgaattggacagcaggctgccgagaatctgcccggccatgccgccgacgccggacgagctttcctgctgagcagtcgcctggccctggacctcgggcttggcgcccgccttgttcgccagcacctcgtaggccgactcgcgatcgatcggctggtcgtagcgacccttcaacggcgaccgctggaccagttcagcgcgctcgctgtcgctcagcgggccgatccgcgaatagggcggcgccaccgcgacgcgctggaccatggccggcgtgcccttttcctccagggtgccgaccaacgcctcgccgatacccagttcggtcagcacccccagggtgtcgaacgccgggttcgggcggaaaccgtcggccaccgcgcgcagcgatttctgctccttggcggtga

SEQ ID NO: 6683 - DNA, 1029 bp, Pseudomonas aeruginosa
attcggagtgctcggcgatgccttcaaccagttcgtcgagcgtatccatcgctcgatccgggaagtcgccgggaccgcgcacaaactgcacgacgtctcgcaactggtggtgaacgcctcgaactcttcgatggccaactccgacgagcagtccaaccgcaccaacagcgtcgccgcggcgatcaacgaactcggcgccgccgcccaggaaatcgcccgcaacgccgccgatgcctcgcaccatgcgtccgacgccaaccaccaggccgaggacggcaaacaggtggtcgagcagaccatccgcgcgatgaacgagctttccgagaagatcagcgcctcctgcgccaacatcgaggccctcaacagccgcacggtgaacatcggccagatcctcgaagtgatcaagggcatctccgagcagaccaacctgctcgccctcaacgccgccatcgaagccgcgcgcgccggcgaggccggacgcggcttcgcagtggtcgccgacgaggtgcgcaacctggcccatcgcgcccaggagtcggcccagcagatccagaagatgatcgaagagctgcaagtcggcgcccgcgaggcggtggccaccatgaccgagagccagcgctacagcctggagagcgtggagatcgccaaccgtgccggcgaaagcctgagcagcgtgacccggcggatcggcgagatcgacgggatgaaccagtcggtggccaccgccaccgaggagcagaccgcggtggtcgactcgctgaacatggacatcaccgagatcaacaccctcaaccaggaaggcgtggagaacctccaggccaccctgcgcgcctgtggcgagctggaaacccaggccgggcgcctgcgccaactggtggacagcttcaagatctgagaccggccggtctcgtcgccgaaccggcggacaaccgcgatgcggttatccgccctgccgacgaaaagcgcccacgggcgctttttttcgttctccaggtcgcattcggtgaaaccattcatccgttgcgctaa

SEQ ID NO: 6684 - DNA, 1992 bp, Pseudomonas aeruginosa
agcttccggacttgccgccgacagacacggcaagccttgcagttgcgatccaactggggctgttcacgacagcgcgcccgcgcctcccggatgcaagaaaccatgatcaaaagtctcaagttcagccacaagatcctgctcgccgccgcgctggtggtgatcgcgaccttctccctgttcaccctctacaacgactccctgcagcgtgcctcgatccgcgaggacctggaggactacctgcacgaaatgggcgagatcaccgccagcaacgtgcagaactggctgagcgggcgcatcctgctgatcgagaacctggcccagaccctggcccgcgaccacagcccggagaccacccaggccctgctggaacagccgctgctgggctcgaccttcctcttcacctacctggggcagaccgacggcacctacaccgcgcgccccaccagcgacctgccggccgactacgacccgcgccgccgcccctggtacaacgccgccaccagcgccggccagaccaccctcaccgaaccctacatggagccggccatccacgagctggtactgaccatcgccagcccggcgcgccagggcggccagccattcggcgtggtcggcggcgacctcagcctgcagacggtggtgaagatcatcaactcgctggacttcggcggcatgggctacgccttcctggtcagcggcgacggcaagatcctcgtccatccggacaaggaccaggtcatgaagagcctcagcgacgtctacccacgcaacacgccgaagatcggcagcggcttcagcgaggccgagctgcacggcaacacccggatcctcagtttctctccggtcaagggcctgtccggcctggactggtacatcggcatctcggtggacaaggacaaggcctatgccatgctcaccaagctgcgtacctcggcgatcgtcgccgcgctgatcgcggtggtcgccatcgtcctcctcctcggcatgctgatccgcgtactgatgcaaccgctcaccgacatgggccgcgccatgcaggacatcgcccagggcgaaggcgacctgaccaagcgcctgaaggtcaccagcaacgatgaattcggtacgttggccaatgccttcaaccgcttcgtcgagcgtatccacgaatcgatccgcgaggtcgccggcaccgctcgccaactgcacgatgtggcgcaactggtggtgaacgcctcgaactcctcgatggccaactccgacgagcagtccaaccgcaccaacagcgtcgccgcggcgatcaacgaactcggcgccgccgcccaggaaatcgcccgcaacgccgccgatgcctcgcaccacgcctccgacgccaaccaccaggccgaagacggcaagcaggtggtcgagcagaccatccgcgcgatgaacgagctttccgagaagatcagcgcctcctgcgccaacatcgaggccctcaacagccgcacggtgaacatcggccagatcctcgaagtgatcaagggcatctccgagcagaccaacctgctcgccctcaacgccgccatcgaagccgcgcgcgccggcgaagccggacgcggcttcgcagtggtcgccgacgaggtgcgcaacctggcccaccgcgcccaggagtcggcccagcagatccagaagatgatcgaggaactgcagatcggcgcccaggaagcggtcagtaccatgaccgagagtcagcgctacagccttgaaagcgtggagatcgccaaccgtgccggcgaacgcctgagcagcgtcaccggacggatcgccgagatcgacgggatgaaccagtcggtggccaccgccaccgaggagcagaccgcggtggtcgattcgctgaacatggacatcaccgagatcaacaccctcaaccaggaaggcgtggagaacctccaggccaccctgcgcgcctgcggcgagctggaaacccaggccgggcgcctgcgccagctggtggacagcttcaagatctga

SEQ ID NO: 6685 - DNA, 1212 bp, Pseudomonas aeruginosa
agctacccacggctcccgcacaccgttcgaacgactgccggtgccggtggtccactgagtggcagaaggaacaagctcaacggaggaaggcccatcgtgcacatcgccgatatgaccatgttctacgcgcctgccagcgggggggtacgcacctatctcgaagccaagcatcgccatctctggcactatcccggcattcgccacagcgtgctggttcccggcgccagctaccgccaggcgaacggcatccacgaggtgccggcgccgccgctgccattcggcaatggctaccgcttccctctccgtcgcggcccctggcgcaaggtgctgcgcaatctgcaaccggacctgatcgaggtcggcgacccctacctcaccgcctgggcggcgctcgacgcgcgacgtcggctggacgtgccggtgatcggcttctaccactccgacctgccgctgctggtgagcaatcgcatgggcgcctggctcggcaccaacgcggacaactacgtcagcaagctgtacggccacttcgaccgggtcctggcccccagtcgggtaatggcggaaaagctgatgcgcctgggcgtcgccgacgtgcatgtacaaccgctgggcgtcgacctcgtcaccttccatccgagcaaccgcgatccggggctgcgccaggaactcggcctggacgaggaaacccgcctgctggtgttcgccgggcgcggttcgcgggaaaagaacctgccggtactgctcgacgccatccagcgcctcggcgacggctatcacctgttgctggtgggttccaacatgccgacccgggttccgcgcaacaccagcgtggtcgaccatttctgcgacagccgcgaagtcgcccgcctgctggcgagcagcgacgcgctgctgcacgccggtgaccaggagaccttcggcctggtcgcactcgaagcgatggccagcggcattccggtggtggcggtgcgcgccggggcactggcggaaatagtcccggagcgttgcggcgtgctctgcgcaccgaacaacggcgacgccatggcctgcgcggtgcgcgaactgttcagccacgacgtcgagctgcgcggccagcgcgcccgccgtcacgtcgagcgccagcatgcctgggacgcggtggtcgccggtctgctcctgcactaccacgcggtactcggcgacagcgaggcgaggttcccgcgctatggctga

SEQ ID NO: 6686 - DNA, 1521 bp, Pseudomonas aeruginosa
cgccccaccaccgcgtactccagggcaatacttcatgcgtcgcatctacacctgggagggagagttctatgccctcgaccacgccgaggccaaggcccgcctggccgccggcatcgagctgttccgccgccgcggatggccgctgcacggtttcgtcgcgccggcctggctgatgagcgccggcacccgccaggcgctcggcgagagcgggctgcgctacaccagcgacccgtccaacctgtatctgcttccccacctgcaaccgatcgaggcccccggcctggtctggagcgcgcgcagtgcctggcgtcgcggcctctcctgggcgctcagcgagcagcgccgccgggcctggcgctcagcgccggtgatccgtctcggactccatccggtcgacatgcgccatcgcttttcccgcgaatactggctgcgtaccctgcgcaccctgctgtccgaggggcgccagccgttgaccaagatcgactggctggagcgccacctcgccttggaccacgcggcatgagtcgaggctggttactgctgttcggtttgatcggtgcctcgctgattccgctggtgctcggcggcagcgacatgttcccgcgcttgcgcgccttcccgctggacagtctgctgctgatgttcggcatgatcgtggtctgctggttcatcaacggcctgcgcctgcgcctgctgctcgccgggcgtgccggcaagctcgggcaattgcagagcgtcggcatcatcatggccagcgaattcgctttctgcgccactccgggcggcagcggcgggccgttgaccctgatggcgctgctggcccggcgcggcctgcgcccggcacagaccagcgcggtgttcgcggtcgaccagttggccgacctgacgttcttcctctgcgccctcggcgcgatcctgatctatgccctcagccattcgctgagcccgaacatggaatcgagcctgatcttcagcgcggtattcctggtcggcctgttcgtcggcgcggtaatgctgatccgctacctgcaccaggtaatccgcttcaacgggcgggttctggcgcggctcggcgtgtcatcgcgcaagcgcctgcactggggccgcaagatcctgcatttccgcattgccctgcacgacagcctgcgcctgccgaaacgacgcctgctggcggtcttccttctcagcagtacgcactggctgctgcgcttcagcgtgctcgatctgaccctgcgcggcctgggagtggatatccagtgggcctggaccttcctgatccagatggtctcgctcagcgccggacagctctcgctgatccccggcggcgccggcggcaccgagctgacctcggcggccctgctggcccccatgatcggcaagtcgacggcggcggcggccatcgtcatctggcgagcggtgaccttctatttctacctcgtcgccggcggcccggtgttcgccgtgctcgccggacgcccgctgctgaagaagctgatcagcagtcgcgaggcttcttcctga

SEQ ID NO: 6687 - DNA, 435 bp, Pseudomonas aeruginosa
ctattattgaatctacttacatgcccgccaccgccactcagcacagacaaggtacctgacatgtccctgatcaacgaatatcgcgccacggaagaagccatcaaggaacttcaggagcgcctgaagtccctggaacaagacgacaaactgaaaaaagaactggaattcgaagagaagctgcgcacgctgatgggcacttaccagaagtccctgcgtgacgtgatttccctgctcgatccggacgccaagatcggcaagagcacccgcaccgccaaggcgcctgccggcaagcgcgcgcgcaaggtcaagcagtacaagaacccgcacaccggcgaagtcatcgagaccaagggcggcaaccacaagactttgaaagagtggaaagcaaagtggggccccgaggccgtcgagagctgggccaccctgctcggctaa

SEQ ID NO: 6688 - DNA, 1137 bp, Pseudomonas aeruginosa
cgctgtcagtttgtccgcccagacggtttgatgctggcgcaacagctcggcttttcgctggcactcctcgagttcgatgccggttcgctggcgatcctcggcgcgcaataccgacagcggcgccaccaccgggcaacggttgacctggatctgcttcagcggcaccggcaactcgccctcggccagttcgtcgcgacgggtatacaggcgcctgcgcaagtcttcggccgacaactccagcagcggcgcgggatcggcgcagaggtcgcagacgatcagagcattgcggttgcgcgggtgccaggccagcggcaggaccaccgagaggaaatggcgctccgcggaaaagcgtccggagacatgcaccagcggctgcagcaggcgcacctggtcgagcaccttgtgcttgctgcgcaactggtagaggtaatcgtacaggcgcggctggcgctgacggatcaggcgggccagggcaatggtggcgcggacatcggaaagcgcgtcgtgggcctgcccatgctccaggccgttcgccgcggtgagcatttccagcttcagcgacagccggccgtccagctgcggccactggatgccctccgggcgcagggcataggcggtacggaccatgtcgatcaggtcccagcggctattgccgccttgccactcgcgggcgtagggatcgaagaagttgcggtacaggctgtagcgcgtcacttcgtcgtcgaagcgcagggagttgtagccggccacgcaggtcgccggctgcgccagctgggcgtgtacccgggtcatgaagtcggcctcggacagcccccgctcggccagccgctggggagtgatgccggtgatcaggcaagccatagggtggggcaggatatcgtcgctgggacggcaatacaggttcatcggctcgccgatctcgttcagcgcctcgtccgtgcggatcccggcgatctgcaacggccggtcgcggcgagggtcgatgccggtggtttcgtagtcgtaccaaaaaatactcgcgttcacggtcattccctttctggcggcaccgggcagtctaccagtgactgccgcgaagctcgcgacccacttcggggatttccaggttttccaacgaactcacggaaagcgccgtag

SEQ ID NO: 6689 - DNA, 915 bp, Pseudomonas aeruginosa
tctggaccggcccgctgttcgtcgtctccatgggtattctctaccgcaccatcttcggcgttcgcccgctgggcaactgaggtgcagaccgggccgtcgcggcggcccggttgcctgatgacgccacgctggctagcatctgactttccccgacacggccccccgatgccaccgaacgcagccgcccgcctcgtcgcgcccacctcccggccaggcgccgaggtcctcgacacccactaccacgtggaaacgccggaaggcatcgacctgctcctgcgccccgccggcgtcgtcccccgggccctggcctataccatcgacctctgcatccgcggcctgatcatgctggtgctgatgctcggcctggcgttcctcggcaagctcggcgccggcctcggcctgctgctgaccttcgtcatgacgtggtggtacatggtcctcttcgaggtgctcaaccagggccgctcgcccggcaagcagatgatgggactgcgcgtcgtccacgacgacggcactccggtgggctgggccgcgtcgctgctgcgcaacctgctgcgcttcgccgacatcctgcccttcggctacgccctcggtctgctctgttgcctgaaccatccggccttcaagcgcctgggcgacatcgccgccggcaccctggtggtctaccgcgaacccgaactgagccggcccagcctgcctgacgtcgagccgcaactgccgcccttccccatgagcctggaagaacagcgcgccttcctcggtttcgccgaacgcggcgcggcgctttcctcggcacgccgcgaggaactggcgggcattctcgccgaaccgctgggcgtcgagccggtacgcgcccaggccgagatcaacggcatcgcccgcggctttctcggcctgcgtcaggagagcgcatga

SEQ ID NO: 6690 - DNA, 801 bp, Pseudomonas aeruginosa
tcgaccagttgcagcaactggcgatgcgcggccaccagcagttctaccggcaccgcagccacctcggcagccgcatcctcggcttcctgctcgccggcctgccgcgcctggtccgcgaggaatggcgcagcatcgccgtggccagcctgctgttctacggcagcgccctggctcatggggctgctggtctatcactttcccgacctgatctacagcgtggtcagcccggacaaggtcagcgagatggagtctatgtacgccccggaaaccacccgcctgggtccgttgggggcacgcgacaccagcgacgactgggaaatgttcggcttctacatcatgaacaacatcggcatcgcctttcagaccttcgccagcggcgtgctgctgggactcggcagcctgttcttcctgctgttcaatggcctgatgatcggttcggtggccggccacctgacgcagatcggctacgtgcagaccttctggccgttcgtcatcggccacggcgcgttcgaactgaccgccatcaccttcgccggcgccgccggcctcaagctcggctgggcgctgctcgcgccaggtcgcctgacccgcggcgaagccctgcggctggccgcccggcgcagcgtgcaactgatcgccggggtgatcgtgctgttgctgctggcggccttcaccgaggcctattggtcttccatcagtcatttcgagccgcgggtgaagtacgcggtcggcgcggtcctctggctgctggtcggcagctacttcctgttcgccggacggagccgccatgcgcctgactga

SEQ ID NO: 6691 - DNA, 1143 bp, Pseudomonas aeruginosa
cgccagcgtggcgatccgcccgcgcagcgcctgggaagcgctcgacctcggcatcctcctggcgcatcgccatgcgcgcctgctgatgggcagctgggcgttgctgaccctgccgctgttcgccgtgctcagcctcctgctgtggcagcatccgaccctggcgatcctgatcttctggtggctcaagccggccttcgaacggctgccgctgtacattctctcgcacgccctgttcggcgatacgccaaccctgaggcaggccctgcgcgcctatcccgccctgctgaggaagcagttgccggccagcctgctgtggcgccgcttcagtccgacgcgcagcttcgacctgccggtcctgcaactggaagggctcgccggggagccccgcagccagcgcctgatcgtattgtcccagcgcaacgccggcggcgcgacctggctgaccgtggtcggcgtgcacctggaaatggcgctctgggccggcttcgccatgcttctctacctgctgatcccggcgcagaacgagatcgactggaactggcagagcctgctcgacccggaagccggcgagtggctctggctggagcacctgtcgaacctgctctacgtcctggtgctggtagtctgggagccgatctacgtggcctgcggcttcaccctctacttgaaccggcgcaccgaactggaggcctgggacatcgagctggtgttccgccgcctgcgccagcgtctggtcggcagcgcctatgtcctgctgctcggcctgaccgcttcgctggcctggctgcccgccccttccgcctatgccgagccggcggccgccaccagcgccggcgaagccgagctgccgcccgagcaggcccgcctgctgcggcagaaactcaacagcgaacaggccggcaagcagatccgggcgatcgtcgacggcgcgccgttcaagaacagcgagaccgttacgggctggcgcttcggcgacaagaccgagaaaaaggacagccgcaaggaggacgaagagcggctcaaggcattcttcgaggccctggccaactgggtgccgttccgtcacgcggcgcaggtcatcgaagtgctgctctgggcgctgctgttcagcgcggtgttcctgctggtctggcgctaccgtga

SEQ ID NO: 6692 - DNA, 1482 bp, Pseudomonas aeruginosa
ctaccgcctgccgttgaagggctcccataccgagggcgaggtcctgcgtctggtcgaaggactggagcaacaacggccgctgctgcactacagccaactgctgaccgcccaatggcaggcgctcgcctacggccaccggctgccggccgacgacgctcgccagcgcctctgcgacggctggcgcagccttttcgccgcgggagccaagccatgatgagccggcgcgcgcgcttcctgctgctggccgtgctcctgctgctggccgggctgctggcgatcttcctggccagccgcctgcaaccctatacggagacgatcgacctcggcccatcgccggaggcccggcgcaatccctacctggccgccgaactgttcctgcgcaagcagggggtcacggtgagccgcgccgacggccttgaggtcctcaaggagctgccgccctccgggcataccctgctcctgctcggcagccgctccggcatgactcccggccaggctcgccgcctgctgcaatggagcgagcagggcgggcatctggtgctgatcgccgaacgcctgtgggacgaggacgagaagaagagcggcgacctgctgctcgacagcctggatatccgccagtacctcaccgaggacttcgacgacagccaggaccgggccagcgaggaaaccgccgacgccgacgccgacgaaggtagcgtcgacgaccacgcgaccgaagcgccgccggaggacaccgccggcgaggaagaagagcccgccgacagcgtgccggactattccgcactgacccgcctgtacctggaaaacgagcgctcgccggcctacatcggcttcgatcccgactaccacctgtacgatccgcagaaccacgcctacgcctgggccaacagcggcgacgccacccacctgttgcagatgcagcacggcaagggcctggtcacggtgctcaccgacgcctggatctggcggaaccgcaacatcgagcagtacgacaacgcctggctgctctggtacctgacccaggacaaccaggtgaccctgctctaccgcgccgaacgcgacagcctcgccaccctgctcgcccgccacttccccgaggccctggcggcagcgctgctgttgttgctcgccggcctgtggcgcgcagggctgcgccagggtcccttgcagccggtggccagccgttcgcgccggcaactggaggaacacctgcgcgccggcgccgacttcctcctccgccagcgcggccacgtcgccttgctgcacggtctgcaacgcgacatcctgcgcagggcgcggcgtcgccaccccggtttcgaacagctcggcgtcgccgagcaatggcagatcctcgggcgcatgacccgcctgccacccagcgccatcagccaggccatgcgcccatatccggcgcagcgcctttccgctgccgacttcacccgccaggtcgcccacctgcaaagcctcaggaatgccctatga

SEQ ID NO: 6693 - DNA, 1707 bp, Pseudomonas aeruginosa
aggacaaggacgttctcgccctgcagcggatcgccagcgacctgccgatcgacgaccaggtcctcgactatgccgtgcgcctggcccgcaccacccgcaactggccgggcctggccctcggcgccggacctcgcgcgtcgatcgccctggtccgttgcggccgggcgcgggcgctgctgcgcggcggcgagttcgtggtgccggacgacatcaagggctgtgccctggcggtcctgcgccatcgggtccggctgtctccggagctggacatcgaggggctgtcggtggaccaggtcctgcaacagttgctcgaccaggtaccggccccccgcgtatgaagccatcgcgcgccctgctggcgctgttcgccgcgctcctgctgctggccatcggcctgggcagcctgtcggcgctcggccagcggttgcctgcgcaactgcatacattctggtgggcggcgctcgccgcgctgctcctgctcggcctgctggacgccctgtgggcgcgccgccaggcggtgccgaagctgagccgccagctcagcggcaacctgccgctggggcgctggagcgaagtgcgtctgcatctgcagcacacctatcggcgtccggttcgcctgaccctgttcgatcacctgccggccggcatggatttcgagtacctgccgcaggaggtcgaactgcgcccgggcgaaagcaccgaggtcggctaccgggtgcggccgctcaaccgcggtcacttcgtgtttccccgctgcgagctggaactgcccagcccgctgcgcctgtggcggcagcgccgctacctggaagcacgcggcgagacccgcgtctacccggacttcgcccgcctctacggcgccgaactgatggcggtcgaccactggctcaaccagatcggcgtacgcggcggccagcgccgcggcctcggcctggagttccaccagttgcgcgaattccgcgacggcgacaccctgcgccagatcgactggaaggccaccgctcgcaaacgcacgccgatcgcccgcgaataccaggacgaacgcgaccagcagatcctcttcctgctcgactgcggccgccgcatgcgcagccaggacggcgacctgtcgcacttcgaccatgccctcaacgccagcctgctgctggcctacgtggccctgcgccagggcgacgcggtgggcgccatgaccttcgccggcgacgaccgccggcatctcccgccgggcaagggcagcgcccagctcggcgcgctgctcaacaccgtctacgacctgcagaccagccagcgtcccgccgatttcccggaagccgtgcaggcggtgctgtcccgccagcggcggcgggccctggtgatcctggtaaccaacctgcgcgacgaggacgacgaagaactgctcggcgcggtgaaacgcctgggccgccagcaccgggtgctggtcgccagcctgcgcgaggaagtgctcgacaccctgcgccacgagccggtcgcccgctacgagcaggcgctcgcctacaccggcaccatcgactacctgaatgcgcgcaacggcctccacgagaagctcgcggcccacggcgtgccagtgctcgatgcgcgtcccagcgaactcgggccggagctgatcagccgctacctgggctggaagcgcgccggcgtgctttgacggatcagaccgactgcggctggcgggggaagctgaagtag

SEQ ID NO: 6694 - DNA, 1611 bp, Pseudomonas aeruginosa
tcgggcagaccgccgaacgcgtcctggaggaggtggaatgcgacctgctggtgctcaaaccgacaaatgacatctgatgcagatagtatgactccgcagtcgccgccgagcctcgccggtggtagcctgcacgccagcgttatccaaggagtcctttgcatgtccgttcgccgcaccaaaatcgtcgccaccctcggcccagccagcaattccccggaagtgctggagcaactgatcctggccgggatcgacgtcgcccgcctcaacttctcccacggcacccccgatgaacaccgcgcccgcgccaggctggtgcgcgaactggcggccaagcacggccgcttcgtcgccctgctcggcgacctgcaaggaccgaagatccgcatcgccaagttcgccaacaagcgcatcgaattgcaggtcggcgacaagttccgcttctccaccagccacgcccgcgacgccggtacccaggaagtggtcggcatcgactacccggacctggtgaaggactgcggggtcggcgatgaactgctgctggacgacggccgggtggtgatggtggtcgaggaagtcgccgccgacgaactgcgctgccgggtgctgatcggcggcccgctgtccgaccacaagggcatcaaccgccgcggcggcggtctcaccgcgccggcgctgaccgacaaggacaaggccgacatcaagctggccgcggacatggacctggactacgtggccgtttccttcccgcgcgacgccaaggacatggaatacgcccgccgcctgctcaccgaggccggaggcaaggcctggctggtagccaagatcgagcgcgccgaggcggtcgccgacgacgacgcactcgacggcctgattcgtgccagcgacgcggtaatggtggcccgtggcgacctcggcgtggaaatcggcgatgccgagctggtcggcatccagaagaagatcatcctgcacgcccgccgcaacaataaagtggtgatcaccgcgacccagatgatggagtcgatgatccacagcccgatgccgacccgcgcggaagtctccgacgtggccaacgccgtgctcgactacaccgacgcggtgatgctctcggcggaaagcgccgccggcgagtacccggtggaagcggtgaaagccatggcccgcgtctgccagggcgccgagaagcacccgaccagccagaaatccagccaccgcctcggccagactttcgaccgctgcgacgagagcatcgccctggcgtcgatgtacacggccaaccacttcccggggatcaaggcgatcatctgcctgaccgaaagcggcttcaccccgctgatcatgtcgcgcatccgctcgtcggtaccgatttacgcctactccccgcaccgcgagactcaggctcgcgtggcgatgttccgcggcgtggaaaccatccccttcgacccggcggcgctgccggcggagaaggtcagccaggccgcggtcgacgagttgctcaagcgcggcgtggtgaccaagggcgactgggtgatcctgaccaagggcgacagctacaccgcccagggcggcaccaacaccatgaaggtgctgcacgtcggcgacctgctggtataa

SEQ ID NO: 6695 - DNA, 1362 bp, Pseudomonas aeruginosa
  unsure (1167),(1327): Identity of nucleotide at the above locations are unknown.
gcgcacgtcgcggcggataacgcccgtggcgttatccgccctacggaccggagccccgctggcccaacgtggtgtagggcgaataaccgctacgcggttatccgccgtttcagccgcatcgcggcgaataacgcctggggcgttatccaccctacggaccggcgctccgctggcccaacctggtgtagggcaatgaaatggactcctccctcctacggcgtcaagcgccagactaatggtgcagccacaagtcccggagggggagtcagcatgaaccttagtcgcattggtctggatctggcaaaacaagtattccaggtgcacggcgttgatcgtcacgagcatgtggtatgtcgtcgccaactcaagcgggcacaggtgcgggatttctttcgccaactgccgccgtgcctggtggcgatggaggcctgcggcagtgcgcactactgggcgcgcgagttgcgggagctgggccacacggtacgcctgatcgcaccgcagttcgtcaaaccctacgtcaagggggacaagcacgatgcacacgacgccgaggcgatctgcgaagccgccagtcgtccgagcatgcgctatgtcccggtgaagagcgcagagcagcaggccgtgcagtcggtgcatcgggtgcgcagtcgtctggtgcgggcccgcacggcgttgtgcaatgaggtgcgtggcttgctgggcgagttcgggctgatcgcgacgcgacgtgggcgagcggcgacgatggccttgctcgaaacggtcacggctaccgaaccggcgcccttgccggccccgatgggcgaactgttgcgtgaattgaaagatgaattgcagacgctggaggcgcgcatcgctcgactggaacgacagattcaggctcacgtacgtggggatgcccgcatccagcgcctgctggcggtggaaggcatcggcccgatcagccccagcgcggtggcggcatccgccggtgatgcacggcaattccccccgggccgccagtttgcggcctggctgggcctaatgccacggcaacactccacgggcgggcagcatcgcttgggcaacatcaacaagcgcgggggatacctacttggcggacctggctcatccatggcgcccgttcaatccttgcgctgttgcgcccacaaaaaccaagccccgccnccccctggttggcaagtctggcggaacggcgttcctgccaatgttctcccccgttggccctggccaacaaaaatgcccgggatcctttggggctttaccccacccggggagaacatgttaccgggccccggttgtagcgttccctgtccccacccgttanttggaaaactccccacccccaaatggcttccttga

SEQ ID NO: 6696 - DNA, 1311 bp, Pseudomonas aeruginosa
gctggcttgccccgccctctccttctgttgcctcatataaggaatgcgagccacggctccgccgctttcgacgagtgttccatgcgcctcatacatacctccgactggcacctgggccagaccctgcacggccaggaccgcgatcatgagcatgcgcgcttcctcgactggctgctgcgccagctggaagagcagcgcgccgatgtcctgctgatcgcgggcgatatcttcgacacgatcaatccaccgctcaaagcccaggagcgcctctacgacttcatcgtcagcgcccatcggcggctgccgcggctggagatcgtgatgatcgcaggcaaccacgactccggcgcgcgcatcgaactgcccgctccgctgatgaaacgactgaacgcccatgccatcggccggatcggctggatagacgaaagcctcgatagcgatcgcctgcttctgcccctgcacgacgcggatggccaggtcgccgcctggtgcctggccctgcccttcctgcgtcccgccgaagtcaccggaggcgggctcggcgacgattacctggccggtatccgccaggtgcacgaacgcctggttgccgccgcgcacgtccgtcgcacgccgggacaggcactggtcgccgtcagccacgcacacatggccggcggctcggtttccgaagactccgagcgaaacctgatcatcggcaacgtcgaagcgctgcccgccagcctgtttccggagcagatcgcctacgtagccctcggtcatctgcacaagccacagaaagtcgccggacaggagcgcattcgctatagcggctcgccgctgccgctgtccttcgccgaagtgaactatcgccaccaggtcctcctcgtcaccctggaaggtgagcgcctgaaggatgtacagagtctcccggtgccacgcgcggtggaactgttgcgcatcggccccgcgcctcttggcgaggtgctcgatcgaatcggcgaactggccgaggccgacctgctgaacgaacagcggccctggctggaagtccgcgtcatgctggatcagccgcaaccggacctgcgccagcaggtcgagagcgccctgctgggcaaggcttgccgtctggtgcgcatcgccagcgagtaccagcgccgcgacgaagagcaggcgccgctgctcgggctcgaccaactcaacccccaggaactgttcagccgcgcctgggaaagcgcctatggctccggcccggatgcgcaggcgctggatgacttcgccagcctgctgcaaagcgtcgaactggccaccgaagagcccccggggaaataa

SEQ ID NO: 6697 - DNA, 579 bp, Pseudomonas aeruginosa
agaacctcgcctccctcgctggcgagcaggaaatcgacttcacccgcgaaccgctgtccagcgccggcctgttcgccatcaccggtccgaccggcgccggcaagagcaccgtgctggacgccctgtgcctggccctgttcggcagcacgccgcggctggaaagcacttcggccagcagcaaggttcccgatggccggaacgagctgtccagcaacgacgaacgcaacctgctgcgccgcggttgcgccagcggctacgccgaagtggatttcgtcggcatcgacggccaccgctatcgcgcccgctgggaaacccggcgctcccgggacaaggcggacggcgccttgcaaaagagccagcagagcctccaggacctggagacccagcaaatgctggcagcgaacaagaaaagcgagttccgcgaacagctggagcagaagctcggcctcaatttcgcccagttcactcgcgccgtgctgctggcccagagcgaattcagcgccttcctcaaggccagcgacaacgaccgcggcgcattgctggagaaactcaccgacaccggcctgtacagccaattga

SEQ ID NO: 6698 - DNA, 717 bp, Pseudomonas aeruginosa
agcaactcgagcaggaactccggcactccgagcagcagcagcggcagcgcaccgagcagcaagccgcgggcgccgagcgcttgcaaggattgcaggcccgcttgcaggaggcgcgcgagcgccaggcccaggccgacaaccatctgcgtcaggcccaggcgccgttgcgcgaggctttccagctggagagcgaggccaggcgcctggagcgaacgctggccgagcgacaggaactccatcggcaatcgaaccagcgccacgcccagcaaagcgacgccgctcggcaactggatatgcagcagcagcgccatgtcgcggaacaggcgcaactgcaggcggcattgcgcgacagccaggctctcgccgcgctcggcgacgcctgggcgacccaccagggccagctcgccgccttcgtgcaacgtcgccagcgcgcgctcgaaagccaggcgcagctccccgagctggaaaaatccctggcccacgccggggaaccgctcgaacgcttgcaggcgcaatggaccgccctccatggcagcgagccggacgacctggcggcacgcctggacgaattgcgccggcagaccgatagcctggaacgacaacaagcgctccacaaggaatggcaacaggccctcgaccaacgcaccggcctggctcgacgcctgggcgaactcgaccagcgtatggtcgagcaggagcaggcattgctcgacctga

SEQ ID NO: 6699 - DNA, 483 bp, Pseudomonas aeruginosa
aggtggtcggctgagccgaccgcccaggcggcacgtcagaacggcagctcggtctgttcacccggagcatgcggcggctgctcttccctttccggccgcagatgcagcatcagcccgctgagccggcgcaccttgcgccgcactgcttcctcgaacaccccgggcaggctttccaccaggctgaaccagtcgcgggcgcgggtgataccggtgtacaccagctccttggtcagcaccgggttcagcgcgtccggcaggaccagcgcggtatgggcgaactccgaaccctgcgacttgtgcacggtcatggcgaacacggtgtccacctctaccaggcggctcggcaggacgaagcgcacgccgccgctaccgtcgttgcgcgggaaggccacgcgcagcgcaaagcgcaggctgccgtcgtcgttgcgctcgggcaggcgcagggcgatgccgatatcgccgttcatcagccccaggctgtag

SEQ ID NO: 6700 - DNA, 762 bp, Pseudomonas aeruginosa
ccgtcgacgaacagccgggcgaaggctgcatcgcgctccccgcgcaggcgcaggtcgaagaggtcggcgggcggactgtccagcagcgcgcgcgcgtcgccggcctgttgccggttgaccaaccgcgccaggcgcccgatcccgctgctcgcgccgaagcgccgggaatgccgcagcatgacggtctgttgcgccagcggatgcgcctgcgccgaaccttcgcgcaagccctgccaggtttcgccgctgacccgctgcaaccaggcgcgggtctcggcgctgtaccagccctcctcggcatcccggcagagatcgccgagcaccgcgccggcctctaccgaggccaactggtccttgtcgccgagcaggatcaggcgcgcctgcggcggtagcgcatcgagcaggctggccatcatttccaggtcgatcatcgaggcctcatccaccaccagcacgtccagcgccaaagggttgtcccggtggtggcggaagtgccgggtatccggaccgctaccaagcagacggtgcagggtagtgacctcggcggggatcgcctgcaacacgtcttccgccagcggcagggcccggacctgctggccgatggattcggagagacgcgccgcggccttgccggtgggcgccgcgaggcggatgcgcagcggctggccggcggctaccgccggtgcctggagcagaccgagcaggcgcaccacggtggtggtcttgccggtaccgggaccgccggtgatcaggctgaaatag

SEQ ID NO: 6701 - DNA, 657 bp, Pseudomonas aeruginosa
ccagggcgacccgcagcagcgcatcggcgccggggtcggcgcaggcacgcagccaatgcagcaggtcggcggcttcctggctgtcgaacaccgagtcgcggtcggacaggtagacgctggccagtcgtcgcgccgccaacgcgctgcggatcgcctcggcctcggcgcgaccgcggacgaggatggcaatatccgccgggcgcaacgcccgccagccgccctgctcgtcggcgaagccggcgcggcccaggtcggccaggctcagccagcggcggatggcgctggcgctgcgctcggccatttcctggcgatacgccgcggagccgagcacgccggcttcgacatcaaggttccagaacgtcatcgctggcgcctcggcaccgtcgatcaacaaacgttcggcgcgcccctgggcgtccaccgcatggaacggcaccgggttttccagcccctcgcgggcgaaacggaaggcgccgcgcggatgctcttcggcgaaggcgaagcagcggttggcggccgccaccatggcggcggtcgagcggaagttcttgccaagggtgtaatgccgcccgcgagtggcctcgcgggcgcgcaggtaggtatggatgtcggcaccgcggaaggcgtagatcgcctgcttggggtcgccgatcatga

SEQ ID NO: 6702 - DNA, 411 bp, Pseudomonas aeruginosa
gcaactgcaggcgcgccaggcgcccggaagcgtcgcgacgcaagccgccgagccagtcctccagctccagcccggacggatggcgatggcgcaactcctgctgctgctcgaccgcctccggccagcgctcgatttcctggcggtagcgccagagcaggtcgggcagcggttgcagcaaatggcgcgcggagaactcgccgaacgccgccagcggcaggcgaccctgtcgccgcagtcgctcgacctgggcctgcaactgcgccggcaggccctcggcatcccagtcccgctcgacccagcgcttcatgcgttcggtcagctcgaattgcagcttccagttgtccagcgcgtccagttcgaaaggttcttcgtcgttgccggtcaattgctcgtcgtcgaaacgcaccttga

SEQ ID NO: 6703 - DNA, 447 bp, Pseudomonas aeruginosa
acggctgcagcggatgctcctgggtcagggcacgcagcagcgcctcgccgtcgccgtccgggtccagacgccagccggccgccaggtgatcgcgcaactggccgatcagcaccgagggcggccgctcgccattgtcgcggatactccgccccacccagctcacgtagagctgctcgcgcgccgagagcagcgcctcgagcagcaggtagcggtcgtcctcgcgccgcgagcggtcgccggggcggtagtcgttgcgcatcaggtcgaaatccagcggcgactgctggcgggggtagtcgccatcgttcatgccaagcaggcagaccagccggaacgggatcgcgcgcatcggcatcaacgtgcagaaactcaccgcgccagccaggaagcgctggttcaggccgccctggtccaggccgccgagccaggcctcgcgtatcacgctga

SEQ ID NO: 6704 - DNA, 483 bp, Pseudomonas aeruginosa
gcaaggcctgcaggcgctcgccccactgcgccggggtggccggttcggccagctcggcgtaggccacctcgaggcgctccagcagcacagccagcgggcctgccagggcggcgtccaggccaccgacctcatcgtagggctggatgccttgcagggccgcgccttcgccgaccgcgtagccgagcagcatgcgccgcagaccgaagcgccaactgttgccctccagtcccgctggcaggccgagacgctcgcgctgcgcggcatccagcccccagcgcacgccggcgccttcgatccagcggtgcagggtcgccaggtcggcctcgtcgacgccgaaacgccggcgcaatgccgggacgtccagcaggtcgaggatctcgctcacggcgaaacggctgtcgggcagtttcagcaggtgctccagggcgatcagcagcggctcgcgaccgcgctgtccctggtcggccagggtatagggaatga

SEQ ID NO: 6705 - DNA, 447 bp, Pseudomonas aeruginosa
agaacagggccatccggctcggcccgagacgggcgacaccgtgcatccaggccagcgcggcgacgatcgaggcgaacagcgcggcgtacagcaccagcggcaggttggcggcgttcaggccggtgcgcggcgacagcaggtacagcggcagcagggcgaggatcgccaccagcacctgcaggtagagcagttgcatggccggcagcttcaggctccatttcttcagcagcacgctgtacaccgcataggccagggtggcgacgatcatcatcgcgtcgccgagattcactccatgctccagcaaagcgccgagatggccctgggagatcaccagcaccacgccggccagcgacaccagcgcgccgagcagcgccccggcgttcagccggtgggccaggatgctgctggccaggcccagcgacatcaggggcatcagcgacaggatga

SEQ ID NO: 6706 - DNA, 456 bp, Pseudomonas aeruginosa
tgcagctggagatcgacggccagcgcttcctctcgcctccgcaatacgcggtatggataccaccggagcgggtgcacagctgctacaacagccaggccatcgtctaccgctcgctgtacctttccgccgagctgtcacgacgcctgccggcgacaccctgcaccctggcgatcagcgcgatcctcaaggcgatcctctcggacttcgccgagcgcggggtcaacctgccgacctcggcgcaggacctgcgcctggcccgggtcgtcatggaccagctggaatgcgcccagccccacgacgactacctgccctacggccgtaccccggcgctgcgcgaggtgctcgacgcactgcaggccgagccgggcgacaaccgctcgctggcgcaatgggcgcagcaggtgcacagcaccgagcgaaccctggcccggcactgccagcgcgaactgggcatga

SEQ ID NO: 6707 - DNA, 396 bp, Pseudomonas aeruginosa
ccttcggcgaatggcgccaacgcctgcgcttcctcgcggccatcgaggcgctggaagccggcagggggatccagcagatcgccttcgacctcggctacagcagcccctcggcgttcatctcgatgttccgccggctggccggcaccacaccggaacaataccgcctggccagccgcgcccaggacatgccgatgctgtaacccgccgtgcatgcgttgcggctatgctcgcagcagccaccatccggagttcgcatgccaaccgccagccgccatcccgacaccgccctcgcggtgttcctcgccttcctcaagctgggctgcagcgccttcggcgggcccatcgcccacctcggctatttccgcgacgagttcgtccgccgccgcggctggctga

SEQ ID NO: 6708 - DNA, 270 bp, Pseudomonas aeruginosa
tctggctttccaccccggccgccagttcggcaatgccttccagttgccgaccggtcagctcgacctggccgaccccttcccccaactcttcggaaagctggcggatctgctcgaccacctcgctggtctggcgctggatctcggcgaccatctggccgacttcctcggtggcctcggcggtacgtccggccaggccgcgcacctcttcggcaaccaccgcgaagccgcgcccatgctcgccggcgcgggccgcctcgatggccgcgttga

SEQ ID NO: 6709 - DNA, 1806 bp, Pseudomonas aeruginosa
cgctttatgccgcccagccggaacccgaccgcaagccctggcgcaaacgcccaaccgttcaggagcaggcgttcgacagagaactgcagaagatcgaagaagagcgtctcaaggccgggcaggaagcagcgaaccccattccatttacctccaaccgacaggagagcgacggataacgaagcgtttcaatctgtttcgtttttcccgcaaagcccgatgcgacggggcgttgcccgcgacaatggcaaccttccggagttccagacggataaaaacgcatctggcataatcgccgccccgtctctgaccggtttctcacatgttcgatcttttcagcgggctcgatgcctgggtgggtatcagcctggtgctggccctggccttcgtcctcaccttcgagttcatcaacggcttccacgacactgccaacgcggtggccaccgtcatctacaccaaagcgatgtccccctaccgggcggtgatgctctccggtgtgttcaacttcctcggcgtgctgctcggcggtgtcggcgtagcctacgccatcgttcacctgctgccggtggagctgctgatcaacgtgaacaccggccatggcctggcgatggtcttctccctgctcgccgccgccatcgcctggaacctcggcacctggtacttcggcatcccggcctccagctcgcacaccctgatcggctcgatcctcggcgtcggcctggccaatgcgctgatcaccgacgtgccgctggccgaagggatcaactggcagaaggcgatcgacatcggcctgtcgctgatcttctcgccgctggccggcttcatggtcgccgcgttggtcctgctcggactgaaatggtggcgtccgctgtcgaagatgcacaagaccccggaaacccgtcgcgaactcgacgagaagaagcacccgccgttctggaaccgcctggtgctggtgctttccgccatggcggtaagcttcgtccatggctccaacgacggccagaagggtatcggcctgatcatgctggtactgatcggcatcgtcccggccaagttcgtcctcgacctgaacagcaccacctaccagatcgagcgcacccgcgacgccgccctgcacctcagtcagttataccagcgccataccgataccctcggcgacatgctggccctgggcaagagcaatggcagcgagatgccgcagttctaccgctgcgatccgaaacagaccgagccgaccatcaacgcgctgctccgcgacttgcgcggcgtgcccagctacaacgacctggacgccgacgagcgcgtgcaggtgcgtcgctacctgctgtgcctggacgacaccgcgaagaaggtcggcaagctgtccgacctgccggcgcgggagaaggccgacctggagaagctacgcaaggacctgaccgcgaccaccgaatacgcgccgttctgggtcatcatcgcggtggccctggctctcggcatcggcaccatggtcggctggaagcgcgtagtgctcaccgtcggcgagaagatcggcaagcagggcatgacctacgcccagggcatgagcgcgcagatcaccgccgccgccgccatcggcatggccaacatctacagcctgccggtgtccaccacccacgtgctgtcctccggcgtggccgggaccatggtggcgaacaagagcggcctgcacggcggcaccgtgcgcaacatcctgatggcctgggtactcaccctgccgacttcgatggcgctgtccgccggcctgttctggctggcctcgcaattcatctgagccgcctcgccggttga

SEQ ID NO: 6710 - DNA, 471 bp, Pseudomonas aeruginosa
aaaaacgcctgcttgtccgcaggcgtttttttgccgcgctcccaccgacgtcatccgcccgcctcggcgggcgccgccagcggcaagcgaaccacgaacaacgcaccctccccctggttggccgccgtcaggctaccgcccatgttgcgcaccagatcgtggctgaccgagagacccaggccggtacccttgccctccgccttggtggtgaagaagggttcgaatatccgctccagcaggagcggttcgatcccaccgccgttgtcgtgcacgtgcaattcgacccagcccggttcgcggcaagccacctgctccaggcgaacacgccggctggccaggccgggattgccaagcagggcatcgcgggcgttggcgagcaggttgatgatcacctgttccaactggtccgcctgccctcgcaccaccatccgctgcgtcggcgccgggcactccacctcgatggcgtgctga

SEQ ID NO: 6711 - DNA, 1218 bp, Pseudomonas aeruginosa
caagcgcgcgcccgccccttcgcgcaggtcgtcgtcggcgagttgcagggtcggtcgcagcaaactgtcgctgccaggccgcacatgactggcgaagaccgtgcagaaacccttgccgtcgcccagcagcagggcgatagcctgcatctggaacgcgccggagagcgattcgagaatctcctggaccgcctccgccaggtgtccgtgggagacatggcgcagacgcgaaaggatcagcttgcccaggctcaggctctgcaactggtgctgctggttgtcggactgccagttgaggtcggagatgtccatgcccagcagcagcgagcgtcccaggccgtcgagcggctgcatcggctggaaacgacaggtcaatggcgcggcggcatcgctgcgcagcgtcaggtcgagacgctcgccccggcgcaggccggccagcgtcggcgcaccgggggcgcgccgctccagatactcggcgaaaggccgcggctgttcgccaagcccatgggcgcactgcagacgatacgcctgccgcccgccgacccggatcacgcggtcctgttcgtccatctcgaaacacaggtcccaactcctcagcgaagcgctccagagggcggggccttcctgcgaaaagggttccggcctctcggcctcggcggacgacgagcgggaaaattcgaacatgcgaccacctcacagcaacaggttggcactcgccttcagcgtctgcggcaggttgggaatcgcgccgatgccggggaagctcagcacggggatgatcgccttgcccggatcgccgtacgggtactgcacgcagacctcgatccgcgacgtggcgctgacgtagtcggcgtactggccattgccggcacagggctggaggttcgcccgccaggccgccggcatccagtccaggcgcgcgagcaactcgtccctggcacgggcttcggcgaggctctcgtagcccgcatcggagggatcgacagcgatcgccgcacgggcccccacggcagcggcatcgttgaacgactgcaacatgagcaaaggaatgctgtagctgatcagaccgtagaccagcgcgaaaaacagcaggaagatcgctgtgaattcgatggcgacggcgccgtgctggcgtcgccgggaagcttttccgagcatgagctgacatccccgatccgcatccttaatactagtcgtcattcgctccgccaacgttactga

SEQ ID NO: 6712 - DNA, 525 bp, Pseudomonas aeruginosa
aaaggtattaatccagatgtcgaaaaaaggctgaagaacaggatggagcaattagcactggccttgtgggcaagcgtttgcggatatcaggacatcaaacgtttgcgcgtctccaactggcttatcctgggcggatttcttatttcctttgtttatttatatgtgaaagagtcaagcctgaccggtgctacggttaatatggcaatgaccgcactttttataggcgtctgcctcagccttcccggctaccttctcggcaggctcggcgctgccgacgtcaagtacctggccgcactggggctggccagcgacccacttacggtgctctatagcctggccttcggctgcctgctgtgcatcgcgctattcatcctcgtaaagttattcaaacgttcggtagaaaagtccgcaatgaatgaagaagttcgccttcgaagggcaccgtcaaaaaacaagtcattcccttttatattcgccatgagcgccggccttttggcacatctgattatcagtaaaattatctga

SEQ ID NO: 6713 - DNA, 858 bp, Pseudomonas aeruginosa
aaacaaaataagcaaatggagcgtatgaccatggacaaaccggcctcgcggcatttcagcgtcttgatcatcgatgatgaaccccaggtgacctcggaactccgcgaactgctggaaaacagtggctaccgttgcgtaaccagcacccaccgggagtcggcgatcgccagcttccaggccgacccgaacatcggcctggtcatctgcgacctctacctggggcaagacaacggtatccgcctgatcgagagcctcaaggaagtcgccggcaacggcaggttcttcgaatcgatcatcctcaccggtcacgatggccgccaggaagtgatcgaggccatgcgggtcggcgccgccgactactaccagaaaccggtggcgccgcaggaactgctgcatggcctcgaacgcctggagaaccgcctgcacgagcgcgtccgcagccagttgagcctgagccacgtcaaccagcgcctggaatacctcgccgaatcgctgaactcgatctaccgcgacatccacaagatcaagtacgaggtacacggcaacagccagccgagtgccctcaagagcgaagacagccagccgtccgcgccgccggcgtcggtcgcggaaagccaggtgtccccgagcaatccgctgttcggcaagctgtcgccccgccagcaggcggtggcgcggctggtgagcaagggcctgaccaactaccagatcgcctacgaactgggcatcaccgagaacacggtgaagctgtacgtctcccaggtgctgcgcctgatgcatatgcacaaccgcacacagctggcgctggccctgtcgcctgcggcgatgcagcagggcagcggagcggtggtgcactga

SEQ ID NO: 6714 - DNA, 1329 bp, Pseudomonas aeruginosa
gcatcgcgctggccttggcgaaagacgtcgcctgggcagaactctggtcgccgcacaaggctccctgggaggcactctccagcgccgccacgtccgccactcgctgcaggttgcgctgctccaggtagagccgcccggtatccaccaccagcaacaggcagatcaaggccagcagcagggtggtcgccgccaggatgccgatcgccccgcgctgtcttgcaggccatccgttcatgccctgcccctccgccaggaaccgtcagttcttgctctcgccgaagccgcgatcttccagcaggtactcgggaatctcgtgctcatagcttttcaggtagcgctggtaggcacgctggcgctcggcggcggtcgcgctttgccgaaccgggctggcggcccggccgctcgcctggatggccagccaggcgcgggtggcggtctgcggttcggccgtcgctggcgcggcaggacggaccgccggcgtgtccgcggcccaggccgtgccggacaggagcagcaagacgccgaacaggattcgctcgtgcatggttcacctctccggcgccggctcagggcgcctcgttggccatcgcggtatgcatattcgcctccgccggcagttccgccagcgggtcgtcgcttgccggcgccgcgccgggtgtcggtacggcaccccagctgcgcgcccgcgcctcggccgcgcggatgtcccgggcatccagctgcaaacgctcgatcaggcgctgcgcatcttcccggtcgccttgcaggtacagcaggccgagcaggttggtcgccggcagcttgccaccctgctgcaactccagcgcagtgatgaattcgaagcgcgcgccgacacggtcgccgcgcttgagcagggcgacccccaggtcgttgcggaagcggctctcggtcggccgcaggcgcgccgcctcgcgcagctcgaggaccgcccgggcgctgtcgccattgcgcagggcgagcaggccgaggccgtggtgcgcctcgggtgccttgcaggtttccagcagggcctggtactcggccctggcccgcgggtcgccgatccggcgcaggatcagcgccctttcttcgcgcacgtcgagcaaccccggcggcatgctttccaggttggccagggccgcatgcaggcggccctcgcggatcatgtcgcggaccatgttcatctgcagttcctgctcctggccgagctgctgcgaacactcccgtgggccgtcccgccccggcagcgcggcgcaaccgccgagcagggcggcgcacaggccgatgccgatcagtgctttcatcccagtcctcccaaggccttggtga

SEQ ID NO: 6715 - DNA, 300 bp, Pseudomonas aeruginosa
ttgttgcaaaacgccatcatcggcctagcctcagcgtggaggcagggctctgtctcggtgattgccgcgttcgaggagcaaacaagaatgaagaacctgaccctgttcgtgtattgcaaagttcgcgcattcctggcggacgaagaaggggcaaacgccatcgaatacgcggttatcgccggtttgatcgcggtggctctgattgccgtattgagtcccacggacagcggtatcgtcggcggtctgaaagccttcttcgacggcgtcggcaccaaagtcggcggactggctccggactga

SEQ ID NO: 6716 - DNA, 1911 bp, Pseudomonas aeruginosa
acatggacatcaccgagatcaacaccctcaaccaggaaggcgtggagaacctccaggccaccctgcgcgcctgcggcgagctggaaacccaggccgggcgcctgcggcacctggtggacagcttcaagatctgagcccgtccgtcccacaggccggctaaccgcgaagcggttagccggcgatcatccagcccccatgaaaaaggcgcccgcgggcgcctttttcatggcctggcgctcagcgccgcttcttcccgcccatcaacgagccgagcaggccacgcaccagctcccggctcaactggttggccgcctggcgcatggcgctcttcaccgtcgaattggacagcaggctgccgagaatctgcccggccatgccgccgacgccggacgagctttcctgctgagcagtcgcctggccctggacctcgggcttggcgcccgccttgttcgccagcacctcgtaggccgactcgcgatcgatcggctggtcgtagcgacccttcaacggcgaccgctggaccagttcagcgcgctcgctgtcgctcagcgggccgatccgcgaatagggcggcgccaccgcgacgcgctggaccatggccggcgtgcccttttcctccagggtgccgaccaacgcctcgccgatacccagttcggtcagcacccccagggtgtcgaacgccgggttcgggcggaaaccgtcggccaccgcgcgcagcgatttctgctccttggcggtgaaggcgcgcaggccatgctggatacgcaggccgagctgggccaggacatcgtccggcaggtcgcccggcgactgggtgacgaagtacaccccgacgcctttcgagcggatcagccggaccacctgttccaggcggtcgcgcaaggctttcggcgtgccgttgaacagcaggtgggcctcgtcgaagaacagtgccagcaccggcttgtcggcatcgccgcgctccggcagttgctcgaacagctcggccaacagccagagcaggaaagtcgcgtagaccttcggcgcctcgtgcaccaggcggctggcgtcgagcaggtggatgcgcccgcgcccgtccggctcggggcggaggatgtcttccagttgcagggcaggctcgccgaagaaggcctcggcgccctgctgctccagagtggccaggcggcgcagcagcgcctgcccggaagcgccagtgaacagcgcccggtcctcgccaaggatttccggattgtccttcagatggttgagcagcgccttcaggtccttcaggtcgagcagcagcaggccttcccggtcggccacctggaaggcggcgaacagcgcggcctgctggctatcggtcaactccaggaggttggccagcagcagcgggcccatctcgctgatggtggtgcgcaacgggtggccggtcttcccggcgatgtcccagagcgtggtcgggtaggccttcggctggtagttcagccacggcatgctggcgatacgttcggcgaccttgccctgcgggttgcccggcgcggcgatgccgcacaggtcgcccttgatgtcggcggcgaacaccgcgacaccggcatcgctgaaggattcggcgaggtgctgcaaggtcaccgtcttgccggtaccggtggcgccggcgatcaatccatgacggttggccaggcgccaggcctgtcctaccggctggccatcggggccagcgccgatcaacaactcattcgcttgcgacatccattcatcctcgggactaaagctccggcacgctgtgccgacagtaagggaaagcccttgtgcaacggggcttccagcggaacccgcgtaccaatatgcgcgggttcccgcgaagggcgtcgggccagcgcatcgacccgatctggccgtccagcttcagcgaagaccttcgggccttgctga

SEQ ID NO: 6717 - DNA, 2106 bp, Pseudomonas aeruginosa
gacaggaaaaatcgccatcgtatccgtatcacgcattcttcggagccacccagggaaccgtggcttcgtggcacaaggccgtgcctgggtcgacggactacccacccgcgcgacccgcccgacgctgcaaggcgtacggaaagcccctgcgcccgcggaacggtcgcaggggtctggtcaaagactggcgctacatactcctggacgcaatacaacatgatcaaaagtctgaagttcagccacaagatcctcctcgcggcctccctcgtggtgttcgccgctttcgcactgttcaccctctacaacgattacctgcagcgcaacgcgatccgcgaggacctcgaaagctacctgcgggaaatgggtgacgtgacttccagcaacattcagaactggctcggcggccgtctgctgctggtcgagcagaccgcccagaccctggcccgcgaccacagcccggaaaccgtcagcgccctgctcgaacagccggccctgacctcgaccttcagcttcacctacctcggccagcaggacggcgtcttcaccatgcgtccggacagcccgatgccggccggctacgatccgcgcagccggccctggtacaaggacgccgtggcggccggcggcctgaccctgaccgaaccctacgtcgacgccgccacccaggaattgatcatcaccgcggcgacaccggtgaaggccgctggcaacaccctcggcgtggtaggcggcgacctcagcctgaagaccctggtgcagatcatcaattcgctggacttcagcggcatgggctacgccttcctggtcagcggcgacggcaagatcctggtgcacccggacaaagagcaggtgatgaagaccctgagcgaggtctacccgcagaacacgccgaagatcgccaccggtttcagcgaggccgaattgcacgggcatacccgcatcctcgcctttacccctatcaagggcctgccttcggtgacctggtacctggcgctgtccatcgacaaggacaaggcctacgccatgctcagcaagttccgcgtctcggccatcgccgccgcgctgatctccatcgtcgccatcctggtcctgctcggcctgctgatccgcctgctgatgcagccgctgcacctgatgggccgtgccatgcaggacatcgcccagggcgagggcgacctgaccaagcgcctcgccgtgaccagccgcgatgaattcggagtgctcggcgatgccttcaaccagttcgtcgagcgtatccatcgctcgatccgggaagtcgccgggaccgcgcacaaactgcacgacgtctcgcaactggtggtgaacgcctcgaactcttcgatggccaactccgacgagcagtccaaccgcaccaacagcgtcgccgcggcgatcaacgaactcggcgccgccgcccaggaaatcgcccgcaacgccgccgatgcctcgcaccatgcgtccgacgccaaccaccaggccgaggacggcaaacaggtggtcgagcagaccatccgcgcgatgaacgagctttccgagaagatcagcgcctcctgcgccaacatcgaggccctcaacagccgcacggtgaacatcggccagatcctcgaagtgatcaagggcatctccgagcagaccaacctgctcgccctcaacgccgccatcgaagccgcgcgcgccggcgaggccggacgcggcttcgcagtggtcgccgacgaggtgcgcaacctggcccatcgcgcccaggagtcggcccagcagatccagaagatgatcgaagagctgcaagtcggcgcccgcgaggcggtggccaccatgaccgagagccagcgctacagcctggagagcgtggagatcgccaaccgtgccggcgaaagcctgagcagcgtgacccggcggatcggcgagatcgacgggatgaaccagtcggtggccaccgccaccgaggagcagaccgcggtggtcgactcgctgaacatggacatcaccgagatcaacaccctcaaccaggaaggcgtggagaacctccaggccaccctgcgcgcctgtggcgagctggaaacccaggccgggcgcctgcgccaactggtggacagcttcaagatctga

SEQ ID NO: 6718 - DNA, 972 bp, Pseudomonas aeruginosa
tcccggagcgttgcggcgtgctctgcgcaccgaacaacggcgacgccatggcctgcgcggtgcgcgaactgttcagccacgacgtcgagctgcgcggccagcgcgcccgccgtcacgtcgagcgccagcatgcctgggacgcggtggtcgccggtctgctcctgcactaccacgcggtactcggcgacagcgaggcgaggttcccgcgctatggctgaacgcagcctgctgctggtgttgcacgacgtggccccggaaacctggccggactaccggcccttcgtcgaggccgtggacgcgctcggtgaggtccccatgacctggctggtagtgcccgacttccaccatcgcaacccgctggaagccgacgaaaagttctgcaaactgctctcgcggcgggtaacccggggtgacgaactggctctccacggcttctatcactacgatgacgccccaccaccgcgtactccagggcaatacttcatgcgtcgcatctacacctgggagggagagttctatgccctcgaccacgccgaggccaaggcccgcctggccgccggcatcgagctgttccgccgccgcggatggccgctgcacggtttcgtcgcgccggcctggctgatgagcgccggcacccgccaggcgctcggcgagagcgggctgcgctacaccagcgacccgtccaacctgtatctgcttccccacctgcaaccgatcgaggcccccggcctggtctggagcgcgcgcagtgcctggcgtcgcggcctctcctgggcgctcagcgagcagcgccgccgggcctggcgctcagcgccggtgatccgtctcggactccatccggtcgacatgcgccatcgcttttcccgcgaatactggctgcgtaccctgcgcaccctgctgtccgaggggcgccagccgttgaccaagatcgactggctggagcgccacctcgccttggaccacgcggcatga

SEQ ID NO: 6719 - DNA, 567 bp, Pseudomonas aeruginosa
gcctggaagaacagcgcgccttcctcggtttcgccgaacgcggcgcggcgctttcctcggcacgccgcgaggaactggcgggcattctcgccgaaccgctgggcgtcgagccggtacgcgcccaggccgagatcaacggcatcgcccgcggctttctcggcctgcgtcaggagagcgcatgaaacagagcctcttcgaacagcgccaccaggccgcctggcaacgcttcgacaaacgcctcgccttcctcgagaaaggcaagaagctggaaggctccagcgacgacttcgccgccgattaccggcgcctctgccagcaactggcgctggcccaggagcgcggctacagcagtcacctgatcgaccagttgcagcaactggcgatgcgcggccaccagcagttctaccggcaccgcagccacctcggcagccgcatcctcggcttcctgctcgccggcctgccgcgcctggtccgcgaggaatggcgcagcatcgccgtggccagcctgctgttctacggcagcgccctggctcatggggctgctggtctatcactttcccgacctga

SEQ ID NO: 6720 - DNA, 1641 bp, Pseudomonas aeruginosa
agtacgcggtcggcgcggtcctctggctgctggtcggcagctacttcctgttcgccggacggagccgccatgcgcctgactgacgccagcgtggcgatccgcccgcgcagcgcctgggaagcgctcgacctcggcatcctcctggcgcatcgccatgcgcgcctgctgatgggcagctgggcgttgctgaccctgccgctgttcgccgtgctcagcctcctgctgtggcagcatccgaccctggcgatcctgatcttctggtggctcaagccggccttcgaacggctgccgctgtacattctctcgcacgccctgttcggcgatacgccaaccctgaggcaggccctgcgcgcctatcccgccctgctgaggaagcagttgccggccagcctgctgtggcgccgcttcagtccgacgcgcagcttcgacctgccggtcctgcaactggaagggctcgccggggagccccgcagccagcgcctgatcgtattgtcccagcgcaacgccggcggcgcgacctggctgaccgtggtcggcgtgcacctggaaatggcgctctgggccggcttcgccatgcttctctacctgctgatcccggcgcagaacgagatcgactggaactggcagagcctgctcgacccggaagccggcgagtggctctggctggagcacctgtcgaacctgctctacgtcctggtgctggtagtctgggagccgatctacgtggcctgcggcttcaccctctacttgaaccggcgcaccgaactggaggcctgggacatcgagctggtgttccgccgcctgcgccagcgtctggtcggcagcgcctatgtcctgctgctcggcctgaccgcttcgctggcctggctgcccgccccttccgcctatgccgagccggcggccgccaccagcgccggcgaagccgagctgccgcccgagcaggcccgcctgctgcggcagaaactcaacagcgaacaggccggcaagcagatccgggcgatcgtcgacggcgcgccgttcaagaacagcgagaccgttacgggctggcgcttcggcgacaagaccgagaaaaaggacagccgcaaggaggacgaagagcggctcaaggcattcttcgaggccctggccaactgggtgccgttccgtcacgcggcgcaggtcatcgaagtgctgctctgggcgctgctgttcagcgcggtgttcctgctggtctggcgctaccgtgaatggctgcgcctgttcgtcggcaacctgggcttgccgcaacgggcccgccgcgaagcgccgacggtgatgttcggcctcgatctcagtccggaaagcctgcccgacgacatcgccggcaacgccgaacggctctggaacgagaaaccacgggaagccctcggcctgctctaccgcgggctgctcagccgactgctgcatgactaccgcctgccgttgaagggctcccataccgagggcgaggtcctgcgtctggtcgaaggactggagcaacaacggccgctgctgcactacagccaactgctgaccgcccaatggcaggcgctcgcctacggccaccggctgccggccgacgacgctcgccagcgcctctgcgacggctggcgcagccttttcgccgcgggagccaagccatga

SEQ ID NO: 6721 - DNA, 2451 bp, Pseudomonas aeruginosa
cccgcctgccacccagcgccatcagccaggccatgcgcccatatccggcgcagcgcctttccgctgccgacttcacccgccaggtcgcccacctgcaaagcctcaggaatgccctatgagcgaacagacgcccgaacaaccgagcaccgcgcccaacccggcgctccagcgccagcgcgccagccagctggcccaggccctgcgcagcgaactgcagaaagccctgatcggccagggcgcagtgatcgacgacgtgctcaccgcgttgctcgccggcggccacgtgctggtggaaggcgtgccggggctcggcaagaacctgctggtacgcgccctggcgcgctgcttcgacggcggcttcgcgcgcatccagttcacccccgacctgatgcccagcgacgtcaccggccacgccgtatacgacctcgccagcgaaccattcaagctgcgcaaggggccggtgttcaaccacctgctgctggcggacgagatcaaccgcgcgccggccaagacccaggccgccctcctggaagtgatgcaggagcgccaggtcaccctggaaggacgcgccctgccggtgccgcagccgttcatggtgctggcgacgcagaacccgatcgagcaggaaggcacctatccgctgccggaagccgaactcgaccgcttcatgctcaagctgcgcatcgattacccggccgaagccgaggaacagaccctggtgcgccaggtgacccgctccgcgcgcagcgacatgctcgacgtggccaacctgcggccgctgctgaaggacaaggacgttctcgccctgcagcggatcgccagcgacctgccgatcgacgaccaggtcctcgactatgccgtgcgcctggcccgcaccacccgcaactggccgggcctggccctcggcgccggacctcgcgcgtcgatcgccctggtccgttgcggccgggcgcgggcgctgctgcgcggcggcgagttcgtggtgccggacgacatcaagggctgtgccctggcggtcctgcgccatcgggtccggctgtctccggagctggacatcgaggggctgtcggtggaccaggtcctgcaacagttgctcgaccaggtaccggccccccgcgtatgaagccatcgcgcgccctgctggcgctgttcgccgcgctcctgctgctggccatcggcctgggcagcctgtcggcgctcggccagcggttgcctgcgcaactgcatacattctggtgggcggcgctcgccgcgctgctcctgctcggcctgctggacgccctgtgggcgcgccgccaggcggtgccgaagctgagccgccagctcagcggcaacctgccgctggggcgctggagcgaagtgcgtctgcatctgcagcacacctatcggcgtccggttcgcctgaccctgttcgatcacctgccggccggcatggatttcgagtacctgccgcaggaggtcgaactgcgcccgggcgaaagcaccgaggtcggctaccgggtgcggccgctcaaccgcggtcacttcgtgtttccccgctgcgagctggaactgcccagcccgctgcgcctgtggcggcagcgccgctacctggaagcacgcggcgagacccgcgtctacccggacttcgcccgcctctacggcgccgaactgatggcggtcgaccactggctcaaccagatcggcgtacgcggcggccagcgccgcggcctcggcctggagttccaccagttgcgcgaattccgcgacggcgacaccctgcgccagatcgactggaaggccaccgctcgcaaacgcacgccgatcgcccgcgaataccaggacgaacgcgaccagcagatcctcttcctgctcgactgcggccgccgcatgcgcagccaggacggcgacctgtcgcacttcgaccatgccctcaacgccagcctgctgctggcctacgtggccctgcgccagggcgacgcggtgggcgccatgaccttcgccggcgacgaccgccggcatctcccgccgggcaagggcagcgcccagctcggcgcgctgctcaacaccgtctacgacctgcagaccagccagcgtcccgccgatttcccggaagccgtgcaggcggtgctgtcccgccagcggcggcgggccctggtgatcctggtaaccaacctgcgcgacgaggacgacgaagaactgctcggcgcggtgaaacgcctgggccgccagcaccgggtgctggtcgccagcctgcgcgaggaagtgctcgacaccctgcgccacgagccggtcgcccgctacgagcaggcgctcgcctacaccggcaccatcgactacctgaatgcgcgcaacggcctccacgagaagctcgcggcccacggcgtgccagtgctcgatgcgcgtcccagcgaactcgggccggagctgatcagccgctacctgggctggaagcgcgccggcgtgctttga

SEQ ID NO: 6722 - DNA, 780 bp, Pseudomonas aeruginosa
actgggatgcccctcgccctggcgccaaggagatgccatgcgcttcgcccgccgtctcgtcctgctcccgttgctgtcgctgctggccgcctgctcgccgaccacgccgctgttcgtcgcccaggtgaccactggcgaagtcgccgaatacaagcagatgaagagcaaccgcatgaccgccgccatcgaggaggaaggcgacctgctgacctacagcgccatggcgatccgcgacaacaggagcgccgaggcggaaaagctctacctcaccggctacgacaatcgccgctacagcgccgaggtgcgcggtatctcgctgtaccagatcggcctgatctacatgagccgctacaacgaccagcgcgacgacgccaaggccaccgactacttccagcgcgtggtccgcgagttccccggcacccacgccgccgagcatgcccaggcgcgcctgctggcaatgcgccagcgggccagggagccggtgcagaagagcgctcgcgaattgctcgccacctggaagccacagcagaacctcgatctctacaagaccagcctcgacccggacatgaccctgctgtcgcgccgcgcggtgctcaaggatcgggtcgacgaagccgccgagctctacctgctggcggtcaacgatccggcgattcctgccggtataaaggaaaaagccctctaccagctcggcctgatgtacctggcgccggacaacccgcacccgaaccgcgacaaggccatcgaatacctgcgtcgccagttgctcgactatcctga

SEQ ID NO: 6723 - DNA, 645 bp, Pseudomonas aeruginosa
cctgctggtggtcgtcgacccgagcagcgacgaacagccggccctttcccgtgcccagtggatcgccgaacgcagcggcgccagcgtcgagttgctgctgtgcgacttcaacccggcgctggacggcgggctgttcttcgacagtcactcgctgcagcgtgcccgcgacctttacctggacgaacgggtcacctggctggagcagctttccatgccgctgcagcaggccggcatccgcactcaggtcgaggcccagtggggcaagccgctggaccggatggtcctgcaacgggtcggcgaaacccggcccgacctggtcctcaagagcacccgcaagcacaacctgctgcgccgcctgctactgggcaacagcgactggcaattgatccgccactgcccgcagccgctctggctggtccatcacgacgcctggcgcggccagcgcctgtgcgcggcgctcgacccgctgcatgccagcgacaagccggccgccctcgatcaccggctgatcgccgccgcccgccagctcgaagccagcctggggctgcgcgccgactacctgcatacccacgcggcgatgccgcgcagcctgctgttcgacgcggaaatgctcgccggttacgagcgtttcgtgctgcaacatga

SEQ ID NO: 6724 - DNA, 867 bp, Pseudomonas aeruginosa
ggagcgcgcataggacgacgcgcgctgagaagcgcaacgatccggacagcgaacaatcgcgcaagcggctacagcacgatgcagaggtacgacgacgcgagtcacgcgccagaacgcacagatcgcacaagggcacgaggagcccgccgatacgaacgacgacagcgagcgcgtctcagacaggacgagcggcgaggacaacaacgacggcgcgaggtcagctctgagcaccgtgcgagagccatgccgctcgagcatcagtacgcccgctgtcatgtttcagcagaaaggaccacacgacggatggagcgccgcaacgagagaagaggcagtacacagacacggcgacgcaggccaagacacggcacacgacgatggcgcagacagcgacgacgtccacacggccgggacacgaggcgacgaggcactcccgccgtcgaagaccacgaagcgacgcagaacacccagatgacgtatggcagaggcgacgaagagaagcaggcgcgcggggaggcgaggcctcataggagcgcggaggacggggggcaaacgcaaccggaggccgacgaatccgagagagcccagggccagcggcggacaggagcagcagaagggaccccgcgtcgtccgggcgcgcaaacagggcgcaggaccgatacggacggaggcggcacgcgacacggggcgcggtgcgcgaggaggctagccgcacagggattgcgcgcgagcccatgctcccgcacgagtaccaagcgaccgcgcacccgcaggctccaagagggccgaggcgaaggacgagcacgcgcgaatcaaccgcggcggttacccgagaaaccgacgtccgcacgcggccccaggagcgactga

SEQ ID NO: 6725 - DNA, 309 bp, Pseudomonas aeruginosa
gtgtccggcttgaacgggccttccacgctcacgccgatgtactcggcctgtttcggggtcagttgggtgaccacgccgccgaagcccttgaccatctccagggccacttcctcgtcgagcttcttcggcagcacttcgacgctcaggcgcttggccttctcggcggccggcaggtcggcgtacttctgctcgaacaggtggatctgcgccagcacctggttggcgaaggaaccgtccatgatccggctcggatggccggtggcgttgcccaggttgaccaggcggccttcggcgagaaggatcaggtag

SEQ ID NO: 6726 - DNA, 648 bp, Pseudomonas aeruginosa
ccgatcaccagggcctgcttgcccgacagcaggtggtcggtgccgcgcttgatggcgtcgttgaggctatggcggcagccgtacttgttgtcgttcttgctcttggtcaccgagtcgttgacgttgatcgccgggactttcagggcgccgttcttgagcatgtcgagcaggcggtggaccccggtggtggtctcttcggtgatgccgtggatgcgctcgagcatctgcgggtatttcttgtgcaggatctcggtcaggtcaccgccgtcgtccagcaccatgttggcgtcccacggctggccgtccttgaggatggtctgctcgatgcaccattcgtactcttcctcggtctcgcccttccaggcgaacaccgggatgccggcggcggcgatggcggcggcggcctggtcctgggtggagaagatgttgcagctcgaccagcggacttcggcgcccagcgcgaccagggtctcgatcagcacgccggtctggatggtcatgtggatgcaaccgaggatcttcgcgcctttcagcggctgctggccggcatacttgcggcgcaggcccatcagtgcgggcatttccgattcggcgatgatcagctcgcggcggccccaggcggccagggtgatgtcggcgaccttgtag

SEQ ID NO: 6727 - DNA, 2118 bp, Pseudomonas aeruginosa
ggaacccaccgaactgcccgccctcaccgtcagcgccggcgccgccggggaaaccccgccggccctcgatctcgacgacagcgccggcggcggctcgcgcctgggcctgagcctgcgcgagactcccggctcggtaagcgtggccaaccgtgccagcttcgagcggcgcggcctgcgcagcacccaggacatcgccaacagcctgcccggcgtgaacgcctcggcgccgcccggcttcggcggcttcgtcacctaccgcggcttcagctcgaaccaggtcaaccagttgttcaacggcattccggtgcaatacagcagcgccatgcgtccgctggacgactggatcgtcgaccgcgtcgagctggtcggcggtccgtcctccttcctcaacggcgccggtgccgtcggcggctcgctggactacatcagcaagctcgccgaccgctacggcgatttcatggaaggccgggtgcgctacggcagctacgacgattcggaagtcgccttcggcttcaaccaggccctgggcatcggccccgagccgaagcacttcgtgcgcctggacgtcagccgcagcggcggcaacggctacgtcgaccgcaattcgcgcgaatcgtggaacgtcgctttctccctgctcagcgacctgaccccggacctttcccacaccctggccctggagtaccaggacgagcaggaagacagcccctactggggcacgccggtgctcaatccctacgccggcgagctgaagatcgacaagagccgtcgccgcgagaactacaatgtcgccgatggccgctacgaacagcgcgtgcgctggctgcgctcgatcctcgaataccgggtcagcgacagcacgcgctggcgcaacaccttctaccactacgacgccgagcgcgattaccgcaacctcgagacctaccgctacaacgccgacaacagcggggtggtgcgctccaacgcattcctccagcgccacgaccagcagctcaacggcaaccgcttcgagctacagcacagccagccgctgttcggactggccagcgactgggcgctgggcttcgactacagcatcaacaagcagacgcgcttcccgagtaccgcctccgggccgttcggtacggtcgatccggccagtttcgagccgggccacttctacgacctgccgggcatgcgtcccggccaccggaaggaccgcagcaacgaggtgcgcaccagcgcgttgttcgccgagaaccgcctgggcctgaccgacgagctgtcgctggtcaccgggctgcgctacgaccacctcgacctcgacgtgcgcaaccatcgggtacccgacaaggacaatcccgcacacttcgaacggcgctgggacgtggtcaccgggcgcgccgggctggtctaccagttcactccgcacgccgacgtctacctgcaatacagtaccgccgccgacccgccgggcggggtgctgaccagcgccagcttcggccaggtccgcgactacgacctgtccaccggcgaccagtgggagctgggcagcaagttcgatttcctcgacggtcgcggcagcgccaccctggccgcctaccgcatcgtccgccgggacttctcggtggccgacccgaacaaccccaacctcagcgtgccggtgggccagcagacctccaggggcatcgaggccgccgcctccctgcggatcaccccgaagctgctggccgagggcaatttcgcctgggtcgacgcgcagtacgacgagttcaccgagaacgtcggcggcgtcgccgtctcgcgcaagggcaagacgccgccgaacgtgccggagcgggtcggcaacctgtggctgacctacgacttcgacccggcctggcagggcggggtggacgcgcgctacgtatcctcggtgtacgccaacaacgccaacacctggcacgtgccgtcctatacggtctacgggactttcctcagctaccggctggacgagcgcacgcggatcaccgggcgcgtgcgcaacctcaccgacgaggtctacgcgcgcttcgtgcagagcacgccgctgtactacgtcggcgacccgcgcaccttcgagctgagcgtgcagacgcgcttctgaggagtcgtcgatga

SEQ ID NO: 6728 - DNA, 1941 bp, Pseudomonas aeruginosa
gagagaatgccctcctgggggaaggcgacgatctgcaggtcgacccagggcgccacttcgccgcgcacctcgagcatggccttgagcgcggtgagggtcgggtcggagacgtcgacgtggctgcgcacgtgctgcacgccgttggcgatctgccatttcagggtctgccaggcgcgctgcttgacgtcctcgtggctgagcagggccttgcgctgggcccagcgctcgatgccttcgaacagcgtgccggagcggttccactccggctggccggcggtctgggtggtgtcgagatggatgtgcggctcgatgaacggcggcacggcaagaccgccggcgccgtccaggcgctcgccggcgtcgtcggcggcctgttccatcggcaccagggcggcgatacggccatcggcgacgcgcagttgccagagaccttcgcggccgcgcaggcgcaggttgtcaatcagcatggaggacctcttctggtttgttcgggctgcggctcagcaggggattgagcagcaggtaggcgatggcggcgccgagcaccgcgttgaccggcactatccccggcagccagtggccggcggcggtgccgcaggcgacggcgaggatcgccgcccagttgatcgcctggatgtccgcgcaggggtgctggcggtagcgccggcggcgactcaggtagtcggcgatgatcaccccgccgatgggcgggatggcggcggagaggaaggtcagccagccgacgaagtggttgtacagccagagcgcggcgagggtgccgagggcgccgttgagcatcgccaggaagcggctggagaggccggtgatgttggcgaagccgaggccggaggcatacagcgcgttgtcgttggtggtccagatgttcaggccgaggaccaggatcgccgggatcagcaggccctgggcgatcatcacgtcggagatgtccgacttgcccaccgccgccgcgccggccgcgccgaagatgaacatcagcgagttgccgaggaagaacgccaccaggcacaccaccacggcggtacgcgcgctgcggccgaagcggacgaagtcggcggtgagggtgccggcgctgacgaacgagccgaccaccagggcgatcgcggtcgagaggctcagcggcgcgctcggcgtcacctgctgcagcgccgccaggccgccggcgtcgcgcaccgcgagccataccgagtagctgccgagaacgacgatcgccgggaccgcgatggccgacagcagggtcagaccggcgatgccgaagaacaccgtgagggtcatcagcgctccggaaaccaggatcagcaggttgacgtcgaggccggtggccttggccaccgggtatttggggcgaacatcgctacgccgacgccgaaccagccgacctgggtgccgccgagcaacgccgagggcagccaggagcccttgctgccgaacggagtaatgcgccagcaggtgggtggaaaggccggtgcgcgcgccgatgaagccgaggatcgcggtgtacaggccgagcatcaggttgcccagcagcacggcgaggaagaagtcgtcgtagctcaggccggtgccgagggtgccgccggtccacatgctggcggaaaagaaggtcaggccgagcatcaccacgctcagggccagcgcgctcttgcgcgctgccagcgggaccggttgctggctgtagttgctgtctgcggacatgcgcgagtctccgtggggcgccggccgtccgggagcgtcggccgggccgcggcgaatggtagtcgaaggcgggtcgatccgacagacgccgttgcgcgtcgtcggaccgcagcggcacgcaggaagcgtgccggcgcgcggcagggcggcgtccgccggggatgcgggcgccgccctgcgttcaggaggcttcgcggtaggggttgcgcggatcctgggtccagttga

SEQ ID NO: 6729 - DNA, 1623 bp, Pseudomonas aeruginosa
acaggtcggccatcacgcagcctccacgttgagcatgagttgggcgtggatcgcttccgccgccagtttgccgtgctgcaccgcctgcacggtgaggtcctcgccgagcgccacgcagtcgccgccggcgtagatgccggggatgctggtgcgcatctgtccgtcgacctggatgcgctcgccgtcgcgccgcagttgcgctgccagcggatcgcccaggctggcgccttcgaaggcctggccgatggccttgaagatggcgtcggcggccagttcgaagtgctcgccggtgtcgcccaggcgaccgttctccaggcgcgtgcgggcgaagcgcatgccgcgcacccggccatgctcgtcgagcagtacccgttccggtcgggcccaggtcagcaggcgcacctggctggccttggcgatctcttgctcatggccggtggcgcccatttcctcgaagccacggcggtagaccaggttgacgtcgcgggcgccgagccggctcatctgcaccgccatgtcgatggcggtgttgccggcgccgatgacgatgcaacggtcggcgacgggcaggtcgagcaggtcgtcgctctgccgcagctcgcggatgtagtcggtggcggcgagcaggccgggggcgtcctcgtcttccaggccgaggcgcttgctggcggccaggccgatgccgaggaacaccgcgtcgtactcgtcgtgcagggcgccgagcgccaggttgtcgccgagacgctggccgtggcgcagttcgataccgccgatctgcaggaggaattccacttcgcgccgggcgaagtcgtccaccagcttgtagcgggcgatgccgtactcgttgaggccgccggccttggcgcgggcctcgaagagcaccacgtcgtggccgtgcatggccaggcggtgggcgcaggacagcccggccggcccggcgccgaccacggcgatgcgcttgccggtggccggcgagcgcttgaacggatgttcgccgaagccggcgtggtcgagggcgtagcgttgcaactggccgatcagcaccggtgcgcattcctgggcgttgttgcgtacgcaggcccgctggcagaggatttccgtggggcagacgcgggcgcagctgccgccgaggatgttcgccgagaggatcttctgcgccgcgccctggacattctcctgggcgatgctgcggatgaacccggggatgtcgatctcggtcgggcaggcgttgacgcagggcgcgtcgtagcagtacaggcagcgggcgctttccagggcggcctggcgggcgttgagcggcggcgcgaggtcggcgaagcgctcggcgagcgtgtccgcgccggcgtccggacgggggaggtggttcagggaatcgatcacggttgtagcctctcttcaggtttcttctcggggcagtcaacggcaatacggcaccgtccggcctctacgggccggtccggtattgcgggaaggatcagcgctcgacggcgaccgggcgctggcgttcggcgcggcggccgagcacttcgtacaccgacgggtaggccgggcgctccacgtagcgtccggcgccgggttcggcgcgcaggtcgcctgcggcccagagcagcttgccctggctga

SEQ ID NO: 6730 - DNA, 996 bp, Pseudomonas aeruginosa
cgcagcgatccgcgcctccgccctcccgtttggggacctcggtacaggcaggctgagaactcccccttttattcccggccgtcgcgctcctgcagttcgacgaccaggcgccagccctcgccatcctccgaccactgccagcgcccctgcaaggggcgggtcgagaccaggctcaacagcagcgcctttccctcctcgcggacgcgccagcgcaacggctggcccagccatcgcccgtctccctgctgcgccgcgccccgggcgacgatgcgcaacgtcagggcaccctccacccgtgccgccgtaaccgcagcctggcgatcgaagcgcaggaccaggccctgctcgctctccccgaccgccagcagttgcggcgcagacgtcggcagcgaagcgggaccgaacaacctgccgagcatcagcccgaacaacaacccggcaagcaccagcgcaccccagactttccagcgctggcgccgcagatcgtcgatggcggaggtagaatgccgcccgttatctgctccggagccctgcatgttccacgtcatcctgtttcaaccggagatacctccgaataccggcaacattatcaggctctgcgccaacgccggatgcagtctgcacctgatcgagccgctcggtttcgaactggacgacaagcgcttgcgccgtgccggcctcgactaccacgaatacgccagcgtacgccgctacccggatctgcagagctgcctcgaggccctcggccagccacgcctgttcgccttcaccaccaaggggtcgcgggccttccacgaagtggcctaccagcgcgacgatgccttcctcttcggcccggaaagccgcggactgccggaggacgtgcgcaacgccctgccaaccgatcggcgcctgcgcctgccgatgcgcgaaggctgccgtagcctgaacctgtccaacacggtggcggtgaccgtctacgaagcctggcgccagctcggcttcgccatggactga

SEQ ID NO: 6731 - DNA, 825 bp, Pseudomonas aeruginosa
gcagcagcgcctcctcgccatccaggcccgcgcggcctaccagagtggacgcgaggaatacctgaagctgctactgaaccaggaacacccggaaaaattcagccgcaccctcacctactacgactacatcaacaaagcccgtctcgaacagctcgccagcttcaacgaaaccctccgccagttggccaacgtcgagcaggacatctctgcgcagaaagccgaacaactgagcaagcaaggcgagctggacagccgccgcgaggcgctggcagcgacccgcaaggagcgccagcaagccctggccaagctgaacagcgactaccgcgaacgcgaccagaagctcaagtcccgccaacaggaccaggccgagctggccaaggtactgcggaccatcgaggaaaccctggcccgccaggcccgcgaagccgccgccgcggcggagcgcgagcgccagcgcgcgctggccgccgaacgcgagcgtgcgcgccagcagcaggccgcccccggacgagtcaccagcccgccgcgcgaacctgcgccgggcccgctggtctcaagcactggcgcggtctacggcggcgcgttcggctcggcccgcggcaagctgccgtggccggtgaatggccgcgtcgtggcgcgcttcggcagccagcgcggcgacgatccgcgggcgaaatgggacggcgtactgatttcggcgagcgccggcagcaccgtccgcgcggtgcacggcggacgcgtggtattcgccgactggttgcgcggagccggcctgttggtcatcctcgaccacggtggcggctacctcagcctttatggccataa

SEQ ID NO: 6732 - DNA, 192 bp, Pseudomonas aeruginosa
cccaggagcggagcagcttcgagggcttcaaggaagccgacctgcaggggccacctggccaacggcaacggcggcgccgaccgccccaccggcaagcgtgccgcgccgagcgagcgcccgcaggattccgactaccagctcagccaggcccttagcctgctgaaaggcctgagcgtcacccgcggcaactga

SEQ ID NO: 6733 - DNA, 714 bp, Pseudomonas aeruginosa
acgtggtcatcgatgacctcgggcagaactgggcaggggaccgcggggttctcgacctgccccccgggcgtaaccctggcgatcatcccgggaaaccccgcatgccgccgaactggcccgcgaggcgcaccagcgcgggcgcacggtgatcctgcacatgccgatggacccggccggcggtccatacgcctggcggccggagctgacccaggaagagcgtgcgcggcggctggacgcggcgctggccaaggtgccgtttgtgcaaggcctgaacaaccacgagggcagccgcatgaccgcggtgcgcccggcgatggcctggctcgccgaggaactccagcgtcgcggcctgtacctggtagacagccgcaccagcgccgccaccgtggccgccagcgaggcgcagcggatcggcctggcgagcgtctcgcgcgatgtgttcctcgacaacgaagccacaccggaagcggtctccgcacaactgcaggccggcgtcgccctggcccgcaagcagggttcggcgttgctcatcggccacccgcacaaggccaccctcgacgtgctggcgcgggagctgccgaagctgcgcgcccagggcatcgagctggtaccgccgcagatgctcatcggcgagcgcggcaaccgcaacgtcaacccacgccaggcgccgcactgaagccgggtttaccggcgtcgcggcagcggttaaggtga

SEQ ID NO: 6734 - DNA, 1515 bp, Pseudomonas aeruginosa
cgtcctcgtcattcctgcacggacgcaccgatggcccgcccttcccctcccatgcccctgctcgccgccgccctgctggtcgcaggcgcgattcccctcggtttcatctggatcctcaccagcgccaagttcgagataggcggcgccagccccggcgagagcaccgtcggcaaggtcgagaacatcgaccagcgcgccatggagcaattctgcaccggcgtgcgggcgacgcccgccggcacctggctggtaggccggcgcgaggtcggccgcgacgagcaggctctgcccgagggcgtcatcgacctggacctggtggcggccgcccagcccagggaaaaagagtccgacccccacctcttcaacttcctcaacggcatgctgctatccggcggcgatccggaaaccacctatgtctcgcgcctgggcgcggacggcgtgttccacgaagtggcgcggctcggcgagaccgcctgcctggaagtcacgccggacggttccagcgtcttcctgctcaccggcctgcggcgcccgggcaaggacaacggtcagcgcgagcagacagtggtgctgcgcagcgacgaccagggcaagagctggcggcggctcgaggaaggcttcatggccgaggcgaatcgactgggctgggctctcgcaccgcgcttccacggcaaggatgaagtctgggtctggggtgatttcgaatacggcggtgccgatggcggccggggaacccggcccagccggggcgggctgttctattcgcccgaccgcggcgccagtgtcgagtcgatcgccacctccgcgccgctgctggtggacctcgcctacgcccgcgagttggcgccgaacggcgtcaactggggcgactacaacggcaagcacgggcagatcaaggcacacgtcgcccaactgaacgcggagcgcgccgcgatctgggtaagccagaccttccgatatggcccacccgaggggcgctacctgaccagctcgatattggtcaccacccaggccgaactgcgccgcgagggcggacgctggcagatgggcgcgatccggcgcaccgacggcgtggccgtcgagcgcctggaacagaacatggacggtcgggtgatcgcagtgctcgaccacccggacgaatcgcgctcgctgatcgccgagctcgatcgcgacgcgctcgaatggaagatcaccggcaagctgcccagcccgttctggcccctgccgtccagttccgggctgcgcgagttctacatgggcaggaatgtgctgctggccaacaccatgagccactacgaagtgccgctgtggctgtatcccgacgaggagccggcgagcgtctccgccaacgcggtgtactactcggacgactggggttcatcctggcgccgcctggacatcgccggctacctcggcgtgctcggcttcgacgaggcgcacgaccgggtgttctgggcccgcggcaactggtacgacagccgcgacctcggcgtccaggcctacgacctgaactga

SEQ ID NO: 6735 - DNA, 423 bp, Pseudomonas aeruginosa
aagcgcgcctggtcgggaatctcgtgccacaacgggtgctccaccgcctggctcacctggttccagcccatgtgcggcaccttcaggtgctcgccggcttcgtgcaggtccttgccgaagaagcgcacctggccggggaacagaccgatgcagtcgaccccgtcgttctcctcggtgcgctccagcaatgcctgcatgccgacgcagatgccgaggaacgggcggtcctggctgacctcgcggaccagggcgtcgaagcccaggcggcggatctcggccatgcagtcgcggatcgcgccaaccccggggaacaccacccggtcggcctcgcggatcaccgccgcgtcgctgctaaccagcacccggccggcaccgacgtgctcaagggccttggccaccgagtgcaggttgcccatgccgtag

SEQ ID NO: 6736 - DNA, 1182 bp, Pseudomonas aeruginosa
ccacacctccagtcgcaattccgaagtgatccacgccggcctctactacccgcccggctcgctcaaggccgatctctgcctggaaggccgcgaacgcctgtacgcctggtgcgcccgccacggcgtcggccaccggcgcatcggcaagctgctggtggcggtggaggaaaacgagcgcgagaggctccaggccctggcggccaacgcacgcgcctgcggggtcgacgacctgatgccgctggacggcaccacgctgcgcgcgctggagccccaggtccgcggggtcgccgccctgctctcgccgagcacgggaatcatcgacagccacgcctacctgcaatcgctgcaggccgtcgccgaacgccacggcgcacaactggcgctggacacccgggtcgaccgcctggagcgccacgccggcggctggcgcgccgaaggacagagcgtcggcgaagcgttccggttgcgcgcgggctgggtggtcaatgccggcggcctgttcgcccaggcgctggcgcaacgcaccgaaggcctcgatccgcgcctggtgccggcgctgcacctgtgccaggggcgctatttctcctacagcggccgctcgccgttccgccacctggtctacccgatgcccgaggcgcgcaccgccgggctcggcatccacgccaccctcgacctcggcggccagttgcgcttcggtcccgacgtgaattacgtggacaacctcgactaccgcgtcgacgaatccctccgccccgccttcgcccaggccatctcgcgctacttccccggcatcgatcctcggcgcctggccgccggctacgccggcatccggcccaagctcggcgggccgggggaacccgccgccgacttcatcatccaaacccctgccgaacacggcctgcccggcctggtcaacctgttcggcatcgagtcgcccggcctccccgccagcctggcgctcgccgaacgggtcgcccgcgcactctgagacgaggtttcgccgcgcgcagggtcggcctggcaaaacggcgttgttatactcgcccgcacattcaccgctgccagcacaaaggattcgtccatgaaagcattcggcaaggtcctggggctgttcttcctgggactcttactgctcgtcgtggccctgggcttcgccctgacccacctgttcgatcccaatga

SEQ ID NO: 6737 - DNA, 1197 bp, Pseudomonas aeruginosa
ctacaaggacgaaatccgccagatcgcccgcgacaaggccaacctggagctggacctgaagggcgacatcggctggagcctgttcccctggctgggcctggagctgcacgacaccagcatcgccagcgccgccacgccgaccaagccgttcgccgacctgcagatgctcggcctgtcggtgcgggtcctgccgctgctgcgcaaggacgtgcagatgagcgcgatccgcgtcgaaggcctgagcctggacctggtccgcgacaagcagggcaagggcaactgggaaaacatcggcaagccggcccagccccaggccccggccgctccttccgccaccccgccggcagcggacggcaagggcgcccaggcgcaggcaccggagcaggcgccgcagaacgacagcccgcgcaccccgatcaagctcgacatcgacagcctcaatgtcaacaacgcccgcgtcacctacaccgacgaagccagcggcaagcagtacaacgtcgagggcatcgagctgagcaccggcgccattcgcgaaggcagcagcattccgctgaagctcaacgcctacctcggcaccaaccagccggtggtacgggtcaagaccgagctgaccggcaacctgcgcttcgacaccgcgctcaggcgctaccaactggaagacgccaggctctccggcgaagcctcgggcgagccgctgcaaggcaagaccgccaccttctccgcccagggccagttgctgctcgaccagtcggcgcagatcgccgagtggaacggcctgaagctgagcgtcaaccagttgcgcgccctcggcgaactgaaggcccgcgagctggacaaggacaccaagttcagcggcggcctgtcgatcgcgccgatgaacctgcgcgagttcctcgccggcatcggtgtgaccctgccggccatggccgatgccaacaccctcggcaagttcgagctgaacacccgcctggccggcagccgcaacagcctgaatctcgaagacctcaagctgggtctggacgacaccgccttcagcggccgcttcggcatcgccgatttcgccaggcaatcgctgcgcgcccagctcaagggcgacaagctcgacctcgaccgctacctgccggccaaggccaagcaagcccaggatgccgccagcgccacgcgcaaggcggaagtcgacgccaccgtggccagtga

SEQ ID NO: 6738 - DNA, 558 bp, Pseudomonas aeruginosa
cgcccagggcaacacgccgctaccggaaaaaccgaccaggcaggcctggagcgacgcgccgctactgcccatcgcgaccctgcgcaagctcgacctggacgtggcgctgaacttcggccggctgaccgtcgagaagctgccgatcgacgacgccagcctgaagctgcgcggccagggcggcgtaatcagcctcgacgacatgcgcggcgggctgtacaacggccgcttcaacgccaaggccaacctcgatgtacgccaggacagcgccgtgctgaccgccaccaaacacatcgccaacgtgccggtggagcgcctgctcgaagcccagggcaagaaaccgccggtgaaggggctgctcgacctcgacgccgacatccgcaccagcggcaacagcgagaaatcctggatcgaccatctcaacggcaacgcacgcttcagcctgatcaacggcgtgctgcccgacgccaacctggagcaacagctctgccagggcatcgctaccctcaaccgcaaggcccttgccggtactcacggcggcaaggacacgcctttccgtga

SEQ ID NO: 6739 - DNA, 1413 bp, Pseudomonas aeruginosa
cctgaaagtggccattcccggcctggcggtcagcggccacggcgatatcgacctgcgcgtgctgggcatggactatcgcatcggcgtggagatccagggcgacaagagcgacatgccggacccggcctgccaggtcaaccagcgctacgccggcatcgaatggccgctgctctgccgcggcccgctggaactcggcgccaaggcctgccgcctggacaaggaaggcatgggcaaggtcgccgcgaaactggccggcaatcgcctcaacgaaaaactcgaagagaagctcggcgacaaggtcagtccggagctgaaagacgcactcaaagggctgttcaaccgcaaatgacacctgaaggcttcaacggcgcggtcctcgactggtacgaccgtcacggtcgcaaggatctgccctggcagcagggcatcaccccctaccgggtgtgggtctcggaaatcatgctgcagcagacccaggtcagcaccgtgctcggttacttcgaccgtttcatggcagcgttgcccgacgtcgaggcactggccgcggcggccgaggacgaagtcctgcacctgtggaccgggctcggctactacagccgtgcgcgcaacctgcacaagaccgcgcagatcgtggtcgagcggcatgcgggggagttcccccgcgacgtcgagcaactcgccgaactgcccggcatcggccgctccaccgctggagccatcgccagcctgtcgatgggcctgcgcgcaccgatcctcgacggcaacgtcaagcgcgtactggcgcgctacctggcgcaggacggctatcccggcgaaccgaaggtggccagggcgctgtgggaagccgccgaacgcttcaccccgcacgcacgggtcaaccactacacccaggcgatgatggacctcggcgccaccctctgcacgcgcagcaagcccagttgcctgctttgcccgctggtctccggctgccgcgcgcacctgctcggccgcgaagccgattatccgcagcccaagccgcgcaaggcgttgccgcagaagcgcacgctgatgccgatcctggccaaccgcgacggcgccatactgctctaccggcggccttccagcggactctggggcgggctctggagcctccccgaactggacgacctcgacggcctcgaaccgctcgccgcgcgccattccctggccctcggcgagcgccgcgaactgagcggcctgacccataccttcagtcatttccagctcgccatcgagccctggctggtggcggtggaaggcgctccgcgcgccgtggccgagggcgactggctctggtataacctcgccaccccgccgcgcctgggcctcgccgctccggtgaagaagctgctcaagcgcgcagaacaggaactcggacgcggcacggccgcgtga

SEQ ID NO: 6740 - DNA, 765 bp, Pseudomonas aeruginosa
acggcctgggcaggtcctctcggtgttccagaaccggcgcttcgacagcgacttcctcgccgtggaggccgccctgcaggccggcagcatcggcccggtgcgctacttcgagtcggccatcgagcgcttccgtccgcaggtccgcgaccgctggcgcgaacacgacctgcccggctccgggctgtggttcgacctcggcccgcacctgctcgaccaggcactgtgcctgttcggcgtaccgcagcgtgtgcacggacacctgcgccggctgcgcgagggcgcgctgaccgacgactggttcgaggtcctgctcgattatccgcactgccaggtagcgctgcgcgccagcatgctcgccgccaatccggcgccacgcttcaatgtgcacggcgaccacggcagcctgctcaaggccggcgccgacatccaggaagcgcaactgctccagggactgcaccccggttccgccggctggggccgcgatcccgacctgctgcagcacatcgatggccagggcctgcgccagtcgctggtcaccccggcaggcgaccagagccgctactaccaggcgctggccgccgccatccgcggccagtcgcgcaacccggtgtcggcgcaacaggcctgcgcgctgatggccctgctggagttggcacgacgctccgccgaggaaggccggagcctgccggtggagctgcgcgacgaggaacgccaggcctggaactgaggcccggcagtccggcggaaaccgcgaggggatcgtaa

SEQ ID NO: 6741 - DNA, 1299 bp, Pseudomonas aeruginosa
ttgcgccccgttgcccaggtagctcagttggtagagcaggggattgaaaatccccgtgtcggcggttcgattccgtccctgggcaccaataatttcaaggacttagcgcaacgcttggttcagtcccacgctccagtggtacagtttcggtgcagtaccggcactttgctactggagatgatgatggcatcagtcaaaaaaaccccctacggcacctggaaagccctcatccgcaagcaaggatggcctacggcttccaagacctttcgcgtcaaacgtgatgccgaagactgggctcgcgccactgaggacgagatggtccgcggcgtatatctgcgtcgctccccttccgagaagacaactctagagaaagccctggggcgctatctggaggaagtcaccccgaccaagaaagcctccacgcaaaaagccgaacaaaccaaggccgctgcgctcatccgccacctcggcaagtattccctagccgccctctctgccgatgtaatcgccgagtaccgcgacaagcgcctgaaggaaaccgtccgcacgaaatacaaggaaggcagcgacgttgccgtaagaaccgtcagcgccaacaccgtccgtctcgagttggccctactcagcaacctcttcacggtggccattcaagagtggcgcatcgggctcccccaaaatcccgtattgaatatccgcaaaccaagccctggggagggacgcgaccgacgactcaccccggacgaagagcggaagctgttccaggccgtgaacgcctaccacaatccaatgctcggatggatcgtcaggatcgccgtggagaccggcatgcgctcttcagagatcacctcgctacgtaggcatcaggtagaccttaaaaagcgcgtggtgaagctcctagacacgaaaaacggggagagccgaaccgtccccctgactcaagcagcgacccaggcctttaaggaggccctggagaaccccatacgccccatcgataccaacctcattttcttcggcgaaccaggcaaggacgaaaagagaaagccctatgtcttctcgaaagtctggaatggaatgaaaaagcggctcggcatggcagatttccggttccatgaccttaggcatgaagccgtgagcaggctcgtagaaagcggccagctcactgatcagcaagttgcagcaatcagcgggcacaagtcgatgcaaacgctcaaacgttacacacaccttcgagcaaaagacttggtcaaagcactagataacatcgaccagtcgcgccagggtgcaaggcctagcgcctga

SEQ ID NO: 6742 - DNA, 222 bp, Pseudomonas aeruginosa
gtcatcgtaacggcattcatttggagcaacctttgtaatatctcgacaggtgctcaaatgctctcgatagccaagcagtacgtcaacaagcgcaaaattaagtggcttttatcccattcggggtttcccatgagaaaagacctattaaaccccgaggaaaatttcgtcacaccgaaatcgctcggggttagcccaataaaatacatcgcaaaccccgaatag

SEQ ID NO: 6743 - DNA, 198 bp, Pseudomonas aeruginosa
acctgcgaccaactgagcttcagaaacagaaggcagaatatcaaggtgccgggttccgtccataaggaagcccacagcgcaagctccggcccagcgcgcatctaccccaaattccacaccaggcaagctgaagcctttctgaaacccacggaaacggggcgaaagctcaatctccttcttcgtggactgagcgactaa

SEQ ID NO: 6744 - DNA, 546 bp, Pseudomonas aeruginosa
cctgcacaagcgctacggcgacctcgaagtgctcaagggcatctccctcaccgcccgcgacggcgacgtgatctccatcctcggatcgtccggctcgggcaaatccaccttcctgcgctgcatcaacctgctggagaacccgcaccagggccagatcctggtctccggcgaagagctgcgcctgaagaagagcaagaacggcgacctggtcgccgccgacagccagcagatcaaccggctgcgcagcgaactcggtttcgtcttccagaatttcaacctgtggccgcacatgagcatcctcgacaacgtgatcgaggcgccacgtcgcgtactgggcaagagcaaggccgaagcgatcgagatcgccgagggcctgctggccaaggtcggcatcgccgacaagcgccacagctatcccgcgcaactttccggcggccagcagcagcgcgcggccatcgcccggaccctggccatgcaacccaaggtgatcctgttcgacgagcccacctcggcgctcgacccggaaatggtacaggaagtgcttaa

SEQ ID NO: 6745 - DNA, 960 bp, Pseudomonas aeruginosa
cgtgatccgtgcgctcgccgaagagggccggaccatgctgctggtcacccacgaaatgagcttcgcccgccaggtttccagcgaggtggtattcctccaccagggcctggtagaagagcagggaacgccgcaacaggttttcgaaaacccccagtcggcgcgctgcaaacagttcatgtccagccaccgctaacggagcaacaccgcatgaagaactataagaagatcctgctggccgccgctgcaaccctggccttcgccctcgacgccagcgccgccgacaagctgcgcatcggcaccgaaggcgcctacccgcccttcaacggcatcgatgccagcggccaggcggtcggcttcgacctcgacatcggcaaggcgctgtgcgccaagatgaagaccgagtgcgaggtggtgacctccgactgggacggcatcatcccggcgttgaacgccaagaagttcgacttcatcgtcgcgtccatgtcgatcaccgacgagcgcaagcaggcagtcgacttcaccgatccctactacaccaacaagctgcagttcgtcgcgccgaagagcgtcgacttcaagaccgacaaggactccctgaagggcaaggtgatcggcgcccagcgcgccaccatcgccggcacctggctggaagacaacatggccgacgtggtcaccatcaagctctacgacacccaggagaacgcctacctcgacctctcctcggggcgcctggacggcgtgctggccgacaagttcgtgcagtacgactggctgaagagcgacgccggcaaggagttcgagttcaagggcgaaccggtgttcgacaacgacaagatcggtatcgccgtgcgcaagggcgacccgctgcgcgagaagctcaacgccgcgctgaaggaaatcgtcgccgacggtacctacaagaagatcaacgacaagtacttccccttcagcatctattga

SEQ ID NO: 6746 - DNA, 1446 bp, Pseudomonas aeruginosa
tgccaagccaggccaccgccgggcgcgtcccggcggtggccgccttcaggcctgacttctcatgattctcgacctgcatgggttcggcgaccaactgctcgccggtacctggatgaccctcaagctgtcgctggcggcggtctgcgtggggctgttgctcggcctcctcggcgccatcgcgaagacttcgaagtacgcggccctgcgcttcctcggcggcacctacaccaccatcgtccgtggcgtgccggaaacgctctgggtactgatgatctatttcggcacggtgagcggcctgaacgccctcggcgaccttttcggcaagccggacctggcactctcgccgttcgccgccggcaccctggccctcggcctgtgcttcggcgcctacgccaccgaggtgttccgcggcgcgctgttgtccattccgcgcggccatcgcgaggccggccaggcgctcggcctgtcgcccggacggatcttctggcgcatcgtcctgccgcagatctggcgggtcgccctgcccggcctcggcaacctgtacctgatcctgctgaaggacaccgcgctggtgtcgctgatcaccctcgacgagatcatgcgcaaggcgcaggtcgcctccaacgcgaccaaggaacccttcaccttctacatgaccgcggccgccatctacctgagcctcacggtcgtcatcatggtcgccctgcacttcctcgaacgtcgcgccggccgtggtttcgtgaggaacgagctatgagcgagtgggagctgatcctcaagtggatgccgaagatgctccagggcgcggcgctgaccctggagctgctggcgatcgcggtggtcgccgggctcgccctggccctgccgctgggcatcgcccgcgcctcgcggcactggtacgtgcgcgcggtgccgtacgcctacatcttcttcttccgcggcacgccgctgctgctgcaactgttcatcgtctactacggcctggcgcagttcgaggaagtgcgcaagagcgccttctggccctacctgcgcgatccgtactggtgcgcgctgctgaccatgaccctgcacaccgccgcctatatcgccgagatcctccgcggcgcgatccactcggtgccggtcggcgaggtggaggccgcccgcgccctcggcatgtcgcggcgccaggcgctctggcacatcatcctgccgcgcgcggtgcgcatcggcctgccggcctacagcaacgaagtgatcctgatgctcaaggccagcgcggtggtctacaccgtgaccctgttcgacatcatgggcatggcccggaccatcatcgcccgcacctacgaatcgatgctgttcttctgcctggccggcgcgctgtacctggtgatcaccatcgtgctgacgcggatcttccgcctgatcgaacgctggttgcgggtcgacgccacccagggccgctga

SEQ ID NO: 6747 - DNA, 1677 bp, Pseudomonas aeruginosa
acagcgatcccccatgggtcactacagcgcttccgactttcccttcaagggctccattggccagctcatcggcgtcagtgccgcgaccaaggaccgcatcctcgagaagcacctcgccgcgctggacataaccgccgcccagttcaaggtgctgatcttcgtcggtctcaaccgtgccaacagtccggtcgaactgtgtcgcgagctgtcggtggacagcggctcgatgactcgcatgctggcgcgcctggagaaaaaagggctgctgctgcgtggtcgctgtcccgaagaccgccgttgcctgcgcctggatctcagcgaagcgggacggaaggtccaggagcagcttccgcttatcgcctcggcggcgatgaacgagctggtcgcctgcctgagcacggaagaattgcagacgctgacccatctgctgaccaaggttctgctacacgccggctgcccgcgggccagcctgcaggagtcctgatccatgccgttccctcttctccatccctggccgcagcgattggcgctggcctcggcgatagtgctggccgccggctgcgtcacttccgaaggcctggaaccgaacgcccgactgcaaccggcaggcgccctccaggcgggcaggagcctggacggcgtagccctttcgccagcggcctggccgcgccaggactggtggaccgggctcggcgaccggcagctcgaccaactgatcggcgaagccctgcaaggcacccccgacctgcagatcgccgaggcgcgtgcgcgccaggcggcggcaacggcccaggcgcaagatgccgcgcgccagccgacgctggacgccaaggccagctactccggcatccgcgcgccgaccagcgtggccccggcaccgctcggcggccgctattcggcgatcaagtacctgtcgctcggcttcaactacgacttcgacctctggggcggcgagcgcgccgcctgggaagccgccctcggccaggccaatgccgcccggatcgacagccaggccgcgcgcatcggcctctcggcgagcatcgcccgcgcctacagcgacctcgcccacgcctttaccgtgcgcgatctcgccgaggaagaactgaagcgctcgcagcgcatgaccgagctgagccagaagcgcatgagcgccgggctcgacagcaaggtccagctgcaacagacgcagacccagctggccaccgcccgccagcagctcagcgccgccgagcaggacatcgccagcgcccgcatcgccctcgccgtgctgctgggcaaggggcccgatcgcggtctcgaactgcagcgcccgcaaccgctgaacccggccagcctgagcctgccctcggtactcccggcggaactgctcggccgccgcgccgacatcgttgccgcgcgctggcgggtcgaggcggcgcgccgcaacatcgactcggcgaagaccgagttctatcccaacctcaatctcggcgcgatggccggcctcgccgccctgcacaccagcgacgtgttgcaggcgccgagccgcttcttccaggtggcgccggcgatctccctgccgatcttcgacggtggccgccgccgcgccaacctggccgaacgcgacgccgactacgacctggccgtcggccagtacaacaagacgctggtccaggccctcggcgaggtcagcgataa

SEQ ID NO: 6748 - DNA, 1488 bp, Pseudomonas aeruginosa
cctcggcaagttgcgctccctggagcagcaggtgatcgaccagcgccaggcccgcgatatcgccaggtccaacttcgacctggccatgcgtcgctacggcgaaggcgtcggcagctacctcgacgccctcagcgtgcaacagcaactgctggtcgccgaacgccagctggccagcctggagagccagcagatcgatctttccgtccagctggtccaggccctgggcggcggtttccaacccgattcccgctccgctgcgctcgctaccgcgaaagcgccggcagaatgaacgaggcacccaccatgactaccgccaacagcgaaacccccgccggcaacccgaagcgcaagcgctggttgctgatcctgctcgccgtgatcgttctcgccaccctggccagcgtggcctgggagttcttctacggccgctggcacgaggacaccgacgacgcctacatcaacggcaacgtggtacagatcaccccgcagatcgtcggcaccgtggtcagcatcggcgccgacgacggcgacctggtgcgcaagggccaggaactggtcaggttcgatcccagcgacgccgacatcgccctccaacgcgccgaggccaacctggcccacaccgtgcgccaggtgcgcgggctgttcagcaacgtcgacggctatcgcgccgaggtcgccacccgcaaggtcgcgctggccaaggccgaggccgactacaagcggcgcaagaacctcgcagacgacggcgccatttcccaggaggaactggcccacgcccgcgacgccctggacagcgcgaaagcctcgctgaccagctcggaacagcagttgaacaccaatcgcgcgctggtcgacgacacccagatcacctcccatccggacgtcaaggccgccgccgcgcaactgcgccaggcctacctggacgacgcccgctcgaccatcgtcgcgccggtcaccggctacgtcgccaagcgcagcgtacaggtcggccagcgcgtgcaaccgggcaatgcgctgatggccgtggtcccgctggaccagatctggatcgacgccaacttcaaggaaacccagctcaagcacatgcgtatcggccagccggtggaaatccgctccgacctctacggcagcgacgtgcgctacagcggcaccgtcgacagcctcggcgtgggcaccggcagcgcgttctccctgctgccggcgcagaacgccaccggcaactggatcaagatcgtccagcgggtgccggtgcgcatccatattgatccgcaagaattgcagaagcatccgctgcgcatcggcctgtcgatggacgtcaaggtcgacctgcatgaccagagcggcccggccctggcccagcaaccaccgcgcgaagcgctgttctccaccgatgtctaccagcagcaactggcctcggccgacaagctgatcgaacgcctgatcgaagccaacctcgccgaagaccacggcaagaccgcccagcgttga

SEQ ID NO: 6749 - DNA, 1485 bp, Pseudomonas aeruginosa
cctcggggtgagttcggaacagggcacctgggtgatcacctcgttcgccgtgagcaacgccatcgccctgccgctgaccggctggctggcccggcgggtcggcgaggtgcgcctgttcatcgccgccgcgctgctgttcgtactcgcctcgttcctctgcggcatcgcccagtcgatgccttctctggtcggcttccgcgccttgcagggcttcgtcgccgggccgctgtatccgatcacccagaccctgctgatctccatctacccaccggcgaagcgcggcatggccctggccctgctggcgatggtcacggtggtggcgccgatcgccgggccgatcctcggcggctggatcaccgacgactacagctggccgtggatcttcttcatcaacgtgccggtcggcctgttcgccgccttcgtcgtctaccagcaactgaaggcacgcccggtggtgatcaagaaggcgccgatggactacgtcggcctgatcgccctggtgatcggcgtcggcgccctgcagatcgtcctcgacaagggcaacgacctggactggttcgagtcgaacttcatcgtcggcggcgcgctgatcgcggcgatcgccctggccttcttcatcatctgggaattcaccgaccgccatccgatcgtcaacctgcgcctgttcgcccaccgcaacttcgccgccggcaccctggcgctggtgctgggctatgccgcgttcttcggcatcaacctgctgctcccgcaatggctacagacccagatgggctacaccgccacctgggccgggctggccgccgcgccaatcggcatcctcccggtgttcctctcgccgctggtcggccgctacgccaaccatttcgacctgcgcatgctcgccggcctgtcgttcctggcgatggccatcacctgcttcatgcgcgccaacttcaccaccgaggtcgactaccagcacatcgccatcgtgcagttgatcatggggctcggcgtggcgttcttcttcatgccgatcctgagcatcctgctctccgacctgccccccgaccagatcgccgatggctccggcctggccaccttcctgcgcaccctcggcggcagcttcgccgcctcgctgaccacctggatctggaaccgccgcgccacccaacaccacgcctacctcagcgaaaacatcagcctctacgacccggccacccacgaaaccctcgcccagctcggcggcaacacccaggcgaacgcggcgctgctcgaccggatggtgcagagccaggcctacatgatgtccaccatcgactacttcaccatgctcggctggctgttcctcgccctgctggtgatcatctggctggcccgcccgccgttcggcgccaagcccggcgcggccgcctccgggcactgaggacgaacggcattcgggcaggaaaatcagtggtttactcctggcggcggctggctataatgtcgccctcttcgccggtatag

SEQ ID NO: 6750 - DNA, 1380 bp, Pseudomonas aeruginosa
ccagcgctaataagggtacttttaaggatacctaccaattcgacattggaaagtacccttatggctcgcacaacggctccccttaccgacagcgcctgccgcactgcaaaggctcgcgaacgtgagtacaagctttttgacggcgatggcctttacctgctcgtgaagcccaacggtcgcaaaggctggcggctcaggtacgtgaagcccgatggtcgcgagggcctgacctcactcggcaattacccggtggtcgggctggctgacgctcgccacaagcgcttcgagctcaaacagcagctcgccaacggcattgaccccatccaatccaagcagcaggccaaggtgcaagccgtaatcaatggccgtaccttcgaaagcgttgcgctcgattggtatgccgggatggtgcccaaatgggcgccgggccacgccaagactgtactcagccggttgaagactcatgtattccctttgctcggtgccagagcaatcgttgagttggacacccacgacctcatgcagccactggaagccgtgacgaagcgcggcaccatcgacgtggcgctcaggatcaagaactacctacaaagcatcatgcgcgaagccaaacggctgcggctgatcacggcgaacccagcccacgacctcgatgggtcgatcaaaacaccacgggtgacacatcgacccgcactacccttatcgcggttgcctgagctacaggcgcgtatcgacggctacaaaggtcgcccgctcacgcgcctcacggtgatgctgtctttgcatgtattcgtacgctccagtgagctgcgtttcgcccgctggaatgagttcgacctcaagagaggtatctgggagatacccgacactcgcccagccctcgacggcgtgcctttttccacaaggggtacaaagatggccggggatattcacgttgtacccttatcgccacaggcagtggccttgcttgagcagattcacgcgatcaccggcaagttcgacctggtgttcgcgggggatgccaaaccgtggaaaccgatgtccgaaaacacggtgaatgccgctctcaggacgatgggctacgacaccaaggtggatatctgcggacacggcttccgagccatggcgtgcagtgcgctggtcgagtccgggctttggtcggagacggctatcgagcggcagatgagccacaaggaacgcaacaacgtgcgcgccgcctacacccacaaggccgagttcctcgaagagcgccggatgatcatgacctggtggagccggtttctggaggcaaaccgcgaggaccatgtgaccccgcacgagtttgccaagcagacgggcgagaacgtcacccgccttcgcagtgccaagaaaaccgagtag

SEQ ID NO: 6751 - DNA, 1062 bp, Pseudomonas aeruginosa
ctcatgacgattctcgtgaccggcagcgccggcttcatcggcgccaatttcgtgctcgactggctggccctgcatgacgagccggtggtcagcctcgacaagctcacctacgccggcaaccggcagaacctcgccagcctcgacggcgacgcccggcacaccttcgttgccggcgatatcggcgatagccaactggtagcccgcctgctcgccgagcaccagccgcgggcgatcctcaacttcgccgcggaatcccatgtggaccgctcgatccacggccccgaggacttcatccagaccaacatcgtcggcaccttccgcctgctggaagaagtgcgcgcctactggggcgcgctggagccggaagcgaaggcggcattccgcttcctccacgtctccaccgacgaagtctatggctcgctggcaccgagcgatccggccttcaccgagaacaaccgctacgagccgaacagtccctactcggcgtccaaggcggcctccgaccacctggtgcgggcctatcaccacacctacgggctgccggtgctgaccaccaactgctcgaacaactacggcccgtaccacttcccggaaaagctcatcccactggtgatccacaacgccctggccggcaagccgctgccgatctacggcgacggccagcagatccgagactggctctacgtcaaggaccattgcagcgccatccgccgggtcctcgaagccgggcaactgggcgagacctacaatgtcggcggctggaacgaaaaggccaacctcgacgtggtcgagaccctctgcgccatcctcgaccaggagcagccgcgcgccgacggccgcagctatcgcgagcagatcaccttcgtcaaggatcgtccgggccatgatcgccgctacgccatcgatgccacgcgcctggagcgcgagctgggctggaagccggcggaaaccttcgagaccggcatccgcaagaccgtgcgctggtacctggacaaccaggactgggtggccaacgtaaccagcggtgcctaccgcgagtgggtgggtaagcagtacgcatga

SEQ ID NO: 6752 - DNA, 1443 bp, Pseudomonas aeruginosa
gcgagcagggaccactatgaaacgcaagggcatcatcctcgccggaggctcgggcacccgcctgcacccggcaacgctggccatctccaagcagttgctgccggtgtacgacaagccgatgatctactacccgctcagtaccctgatgctggcgggcatccgcgagatactgatcatctcgaccccacaggacaccccacgcttccagcagttgctgggcgacggttcgaactggggcctggacctgcaatatgccgtgcaaccgtcgccggacggcctggcccaggccttcctgatcggcgagtcgttcatcggcaacgacctcagcgcgctggtcctgggcgacaacctctattacggccacgacttccacgagttgctcggcagcgcttcgcagcgccagaccggcgccagcgtcttcgcctaccacgtgctggacccggagcgctacggcgtggtcgagttcgaccagggcggcaaggccatcagcctggaagagaagccactggagccgaagtcgaactacgcggtcaccggcctgtatttctacgaccagcaggtggtggacatcgccagggacctgaagccttcgccgcgcggcgagctggagatcaccgacgtcaaccgcgcctatctggagcgcggccagctcagcgtggagatcatgggccgcggctacgcctggctggataccggcacccacgattcgctgctcgaggccggccagttcatcgccaccctggagaaccgccagggtctcaaggtggcctgcccggaagagatcgcctaccggcagaagtggatcgacgccgcgcaactggaaaaactcgccgcgccgctggccaagaacggctacggccaatacctcaagcgcctgctgaccgagaccgtgtactgatgaaagcgacccgcctggcaattcccgacgtcatcctcttcgaaccccgggtgttcggcgacgatcgcggattcttcttcgaaagctacaaccagcgcgccttcgaggaagcctgcggtcatccggtcagcttcgtccaggacaaccattcgcgttccgcccgtggcgtcctccgcggcctgcactaccagatccggcaagcccagggaaaactggtgcgcgccactctcggcgaggtattcgacgtggccgtcgacctgcgtcgcggctcgccgaccttcggccagtgggtaggcgaacgcctgagcgcggagaacaagcgccagatgtggattccggccggcttcgcgcacggcttcgtggtgctcagcgaatacgccgagttcctctacaagaccaccgacttctgggcgccggaacacgaacgctgcatcctctggaacgatcccgagctgaagatcgactggccgctgcaggatgcccccctgctttcggagaaggaccgccagggcaaggcattcgccgacgccgactgcttcccctga

SEQ ID NO: 6753 - DNA, 564 bp, Pseudomonas aeruginosa
ccctgcgcgacaacggcccggggttttccgaggacgccctggcccacgcccacgaaccctttttcaccaccaagaccaccgccaaagggctcggcctcggcctggccatctgcgataacctattgcgcgccctcggcggccgcctggaaatgggcaaccatctcgaaggcggcgccgtggtgcgcctgcacttgctgccgggagttcccggcgtcgccgccatgccccaggaggaaacccgcgcatgagtcccttcgcgccattcgatgcccagacccaggtcctgctgatcgacgacgatccgcacctgcgccaggccctgcgccagacgctcgacctcgccgggctcaaggtcgcgaccctggacgacgcgcgccagttggataccgcgcagtgcaaggactggcccggggtggtggtcagcgacatccgcatgcccggcatcgatggcatggaactgctccgccaattgcacgaacaggacgccgacctgccggtgatcctgatcaccggccacggcgacgtgccgctggcggtccaggccatgcgcggcggcgcctatga

SEQ ID NO: 6754 - DNA, 777 bp, Pseudomonas aeruginosa
cggaccgttcgtcgcgatcaacgccggcgccctcgccgaatcggtggtggaaagcgaactgttcggtcacgaggccggcgccttcaccggcgcgcagaagcgccgcatcggcaagttcgagtacgccaatggcggcaccctgttcctcgacgagatcgagagcatgagcctggacgtgcaggtcaagctgttgcgcctgctacaggaacgggtagtcgagcggctcggctccaaccagttgatcccgctggatatccgcatcatcgcggcaaccaaggaagacctgcgccaggccgccgaccagggccgcttccgcgccgacctctattaccgcctcaacgtcgccagcctgcgcattccaccgctgcgcgagcgcggcgaagacatcccgctgctgttccgccatttcgccgaagccggcgccatgcgtcatggcctgacgccacgcgaactggacgccggccagtcggcgcggctgctggcctacgactggccgggcaacgtgcgcgaattgcagaacgccgccgagcgcttcgccctgggtctcggcctgagcctggacgacggagtcctgcccgacgccgccgacgagccgcacaacctcagcgccaaggtcgaggccttcgagcgctcgctgatcgctgccgaactggaacgcccgcacaattcgctgcgcagcgtcgccgaggccctcggtatcccgcgcaagaccctgcacgacaagctgcgcaagcacggcctgccgttcaacacgcctggcgaaaatccgccagatga

SEQ ID NO: 6755 - DNA, 1191 bp, Pseudomonas aeruginosa
acttcccttgttcggccacgccgagaggacacccgtcctcttcataaaagacagacaagaacaaagaggaagtctcatgctcaagcacaccgcgaaggcgctcgtctgcgcactttccctgaccgtcgccggaatcgtccaggcggccgacccgatcgtcatcaagttctcccacgtcgtcgccgagcacacgcccaagggccagggcgcgctgctgttcaagaaactggtggaggaacgcctgccgggcaaggtcaaggtggaggtctacccgaactcgtcgctgttcggcgacggcaaggagatggaagccctgctgctgggcgacgtgcagatcatcgcgccgtcgctggccaagttcgagcagtacaccaagaaattgcagatcttcgacctgccgttcctgttcgacaacatccaggcggtcgaccgcttccagcagagcccgcagggcaaggagctgctgacctcgatgcaggacaagggcatcactggcctcggctactggcacaacgggatgaagcagttgtccgccaacaagcccctgcgcgagccgaaggacgcccgcggcctgaagttccgcgtgcaggcctccaaggtgctcgaggaacagttcaaggcggtgcgcgccaacccgcgcaagatgagcttcgccgaggtctatcagggcctgcagaccggcgtggtcaacggtaccgagaacccctggtcgaacatctactcgcagaagatgcacgaagtgcagaagtacatcaccgagtccgaccacggcgtgctggactacatggtgatcaccaacaccaagttctggaacggcctgccggaagacgtgcgcggcgtgctggccaagaccatggacgaggtcaccgtggaggtgaacaagcaggccgaggcgctcaaccagggcgacaagcagcgcatcgtcgaggccaagaccagcgagatcatcgaactcactcccgaacagcgggccgaatggcgcaaggccatgcagccggtgtggaagaagttcgaaggcgagatcggcgccgacctgatcaaggccgccgaagccgccaaccaggcccaataagaagagggaaagcccatgcacgcgctcgcgcgcgtctgggcgcgcctggaggaaggcctgatcgccttcctcctcgccgccatgacgctggttaccttcgtttatgtagtcctcaataa

SEQ ID NO: 6756 - DNA, 1509 bp, Pseudomonas aeruginosa
ctgggtgaagaccctgttcatcgccggcatcggcgccgaggacctcgaccacttcggcatccgccaatggcacatcggcctgatcgtgccggtcggcttcgccctggtgttcatccgtttcgccgagatcctcgtgcgcatcctgcgcaaccgccagaccggactgggactggccgacgaggctgccgacgcgctgaagctgaccgagcacgaggagcccaaggcatgaccattctgttcctcttcctgctgctcttcctgctgatgttcatcggcgtgccgatcgccgtctccctgggtctctccggcgcactgacgatcctcctgttcagcccggactcggtacgctcgctggcgatcaagctgttcgagacctccgagcactacaccctgctggcgatcccgttcttcctgctctccggcgcgttcatgaccaccggtggcgtggcgcggcgcctgatcgacttcgccaacgcctgcgtcggacacatccgtggcggcctggcgatcgccgcggtgctcgcctgcatgctcttcgccgcgctatccggctcgtctccggcaacggtggcggcagtgggttcgatcgccatcgccggcatggtccgctcgggttatccacaggcgttcggcgccgggatcgtctgcaacgccggcaccctcggcatcctcatcccgccatcgatcgtgatggtggtctacgccgccgccaccgagacctcggtgggcaagctgttcatcgccggcgtggttccggggctgctgctgggactgatcctgatggtggtgatctacatcgtcgcccgggtcaagaagctgcccgccatgccaagggtcagtctgcgcgaatggctggccagcgcgcgcaaggcgctgtgggggctgctgctgatggtgatcatcctcggcggcatctattccggcgccttcacccccaccgaggccgccgccgtcgccgcggtgtactcggcctttgtcgcactgttcgtctaccgcgacatgcgcctgagcgaatgcccgaaggtgctgctggagtccggcaagctgaccatcatgctgatgttcatcatcgccaacgccatgctcttcgcccacgtgctgaccaccgagcagataccgcagagcatcgccagttgggtcacggaactgggactttcgccatggatgttcctgctggtggtgaacatcgtgctgctgatcgccggcaacttcatggagccttcggcgatcatcctgatcctggcgccgatcttcttccccatcgccatggagctgggcatcgatccgatccacctcggcatcatcatggtggtgaacatggagatcggcctgatcacgccgccggtcgggctcaacctgttcgtcacctcggcggtcaccggcatgccgctgggcgcgaccatccgcgcagcgctgccgtggctgatgatcctgctggtgttcctgatcatcgtgacctacatcccggcggtatccctggcattgccgaactggctggggatgagctga

SEQ ID NO: 6757 - DNA, 1500 bp, Pseudomonas aeruginosa
ccgctgccgcctaatgtcttcactctcaattcctatagggagattccgaaaatgtcccaagaatccagccaaaaactccgactaggagcgctaacggctctggttgtcggctcgatgatcggagggggcatcttctccctcccgcaaaacatggcagccagcgccgatgtcggcgccgtgctgatcggatgggcgatcaccgccgtcggcatgctcaccctcgctttcgtcttccagaccctcgccaaccgcaagcccgaactcgacggcggcgtgtacgcctacgccaaggccggcttcggcgactacatgggtttctcctcggcctggggctactggatcagcgcctggctgggcaacgtcggctacttcgtcctgttgttcagcaccctcggctacttcttcccgatcttcggcaagggcgacaccgtcgcggcgatcgtctgcgcctcggtcctgctctgggccctgcacttcctggtgctgcgcgggatcaaggaggcggcgttcatcaacaccgtcaccaccgtggccaaggtcgtgccgctgttcctgttcatcctgatctgcctgttcgccttcaagctggacatcttcaccgccgacatctggggcaagagcaacccggacctgggcagcgtgatgaaccaggtgcgcaacatgatgctggtcaccgtctgggtgttcatcggcatcgagggcgcgagcatcttctcctcccgcgcggaaaaacgttccgacgtcggcaaggccaccgtgatcggcttcatcaccgtcctgctcctgctggtgctggtcaacgtgctgtccatgggcgtgatgacccagccggaactggccaagctgcagaacccgtcgatggcgctggtactcgagcatgtggtcggccactggggcgccgtgctgatcagcgtcggcctgctgatctcgctgctgggcgcgctgctctcctgggtgctgctgtgcgccgagatcatgttcgccgccgccaaggaccacaccatgccggagttcctgcgccgcgagaacgccaaccaggtgccggccaacgccctgtggctgaccaacatctgcgtacaggtgttcctggtggtggtgttcttcacctcgggcgacccggacggcatggacccgtacaccaagatgctgctcctggccacctcgatgatcctgatcccgtacttctggtccgccgcctatggcctgctgctgaccctgaagggcgagacctacgagaacgatgcccgcgaacgcagcaaggacctggtcatcgccggcatcgccgtggcctacgcggtctggctgctctacgccgggggcctgaagtacctgctgctgtccgccctgctgtatgcgcccggcgcgatccttttcgccaaggccaagcacgaggtcggccagccgatcttcaccggaatcgaaaaactgatcttcgccgcagtcgtcattggcgccctggtggctgcctacggcctctacgacggtttcctcaccctctga

SEQ ID NO: 6758 - DNA, 1278 bp, Pseudomonas aeruginosa
ttactccactggagacgtgaaatgagcacggaaaaaaccaaacttggcgtccactccgaagccggcaaactgcgcaaagtgatggtctgctcgcccggactcgcccaccagcgcctgaccccgagcaactgcgacgagttgctgttcgacgacgtgatctgggtgaaccaggccaagcgcgaccacttcgacttcgtcaccaagatgcgcgagcgcggcatcgacgtcctcgagatgcacaatctgctgaccgagaccatccagaacccggaagcgctgaagtggatcctcgatcgccagatcaccgccgacagcgtcggcctgggcctgaccagcgagctgcgctcctggctggagagcctggagccgcgcaagctggccgagtacctgatcggcggcgtcgccgctgacgacctgcccgccagcgaaggcgccgacatcctcaagatgtaccgcgagtacctgggccattccagcttcctgctgccgccgttgccgaacacccagttcacccgtgacaccacgtgctggatctacggcggcgtgaccctgaacccgatgtactggccggcgcgacgacaggaaaccctgctgaccaccgccatctacaagttccatcccgagttcgccaacgccgaattcgagatctggtacggcgacccggacaaggaccacggctcctcgaccctggaaggcggcgacgtgatgccgatcggcaacggcgtggtcctgatcggcatgggcgagcgctcctcgcgccaggccatcggtcaggtcgcccagtcgctgttcgccaagggcgccgccgagcgggtgatcgtcgccggcctgccgaagtcccgcgccgcgatgcacctggacaccgtgttcagcttctgcgaccgcgacctggtcacggtcttcccggaagtggtcaaggaaatcgtgcccttcagcctgcgccccgatccgagcagcccctacggcatgaacatccgccgcgaggagaaaaccttcctcgaagtggtcgccgaatccctcggcctgaagaaactgcgcgtggtcgagaccggcggcaacagcttcgccgccgagcgcgagcaatgggacgacggtaacaacgtggtctgcctggagccgggcgtggtggtcggctacgaccgcaacacctacaccaacaccctgctgcgcaaggccggcgtcgaggtcatcaccatcagcgccagcgaactgggtcgcggtcgcggcggcggccactgcatgacctgcccgatcatccgcgacccgatcgactactga

SEQ ID NO: 6759 - DNA, 1104 bp, Pseudomonas aeruginosa
cggtgcccggcttcagccagccgctggtatacaagaaggacgcgcgtttcagtgacatgctcgactgagcgccaccacaacggaaaaggcccggctagaccgggccttttcgtttcagtgcagcgcgcgcgccagttggatcagctcgctgcgccactcggcagcgcgcggcagggccaggaaggagccgttgaggtagtcctcgcgcggctcgtaggtgaatggcgcgccatgcaggtcgagcacctcgccgccggcgccctccagcacaccctgggcggcggccgtgtcccattgcgaggttggcgtcaggcgcggatagcagtcggcagcgccctcggcgagcaggcagaacttcagcgaactgccgatgctggctcgccgcaggtcgccgaagcgctcgctcaagccatccagcaggcgctcctgggccgggctgccatggcgcttgctggccaccacggtgaaggcctcctcgggctccaggcgcacactgatcggttgcacgcggccatcggcctcctcgcgccaggcaccgagaccggcgccaccgtagtagcagcggccgctcaccggcacgccgaccaggccgaacagcacccggccatcctcgaccagggccacgttgacggtgaactcctcgctaccggagatgaactccttggtgccgtccagcgggtccaccagccaccagcgccgccagtggccgcgctcgctcagcggtatctcgcaatcctcttcggaaagcaccggaatgtccggcgccagcgcccgcaatcccgcctccaatatatggtgcgcggccaggtcggcggcagtcaccggcgattcgtcggccttcgagcgcaccgccacgtcggcgcgccagtgcggcaggatcgcctcgccggcgcgccgcaccagcgccaccaattcgccccaaggcaccggcctcatgcctggtactcgccgcgctgggtgagcaggtcgcgcaccaggtacagcgcggccagggcgcggccttcgctgaactgggcgtgctgggccaggctcgacagttcgcgcaggctgatgcgatcgacgcccatcggttccggctcgtcgcccggcaggcgctcctcgtag

SEQ ID NO: 6760 - DNA, 993 bp, Pseudomonas aeruginosa
ccaagtctagactgcaaaaaccggcgaaatatccccaggctccttcgtcaccccataacactgcgcccattcgcgttaagattcggcgacacccccgccacggaagcgccgatggacatcaagcaactgaaattcctctgcgccctcgacgaaacccgccacttcggccaggccgccgcgcgctgccacgtcacccagccgaccctgtccatgcgcctgcgcagcctggaggaagaactcggcctggaactggtgcgacgcagccagcgcttcgaaggcttcaccgaggccggcgagcgcgtactggcctgggcacgcagcctgctggcggcccaggaagggctgtacgcggaagccgccgcctgccgcgggcaactggtcgggaccctgcgcctgggcgtggtgccgctggccagcttcgacccgatgcgcctggtccagcacatggccgggcgccacccggagttgcgtttccagctctattccctgagttcggaacaggtactcgaaggcctggcgcgcaaccagttcgatctcggcgtctcttatctggaccgtctggaccgcagccatttcgagggcatcgaactggcggagacccgcatgggcctgctccatcaccccagccatttcccgctcgacgccgcgctgctgaactgggaagcgctggctggcctgccgctaggcctgctctcggcgggcatgcacttccgccaatccatcgaccacaacttccgcagccgcgggttgagccccatcgcgcgcctggaaaccgactcggtacagcaactgctgcaggcggtgcagcgcggcttgtgctgcgcgatcatgccgctaggcagcgaagtcgacggcgagttgcgcctgatccccatcgaggacgcccataccctggcagcgctcggtctgatcatccgcagcggacagccgcgctcggcgctggccgaagcctgtttcgaggaagcccggaactggttggcgccgcagtcttga

SEQ ID NO: 6761 - DNA, 858 bp, Pseudomonas aeruginosa
aacgatagggcccagcccatgccttgccagcctgcatgcccggtatccgcggatacctgggcgccttccgccgttcccgacgattaccgctacgccgacctgcacctgccgcagcaggtcggccaggcctcccttgccgccgagtgtgccgtggcgatcagctacaacggactgaaccaggcggtgatgatggcctcgcccgaggacatggaggatttcgtccgcggtttcagcctcagcagcggcttcgtggagtccatcgacgacatctatgaaatccgcgtcagcggccagggcgaatccctccacgccgaggtcgaaatcagcagccgcgcgttctggaacctcaagcgccaacgccggcaactggccggcacttccggctgcggcctgtgcggcgtcgaagccctggagcaggccctgccgcaactgccggaacggtcgccgcaggcgctgcctcccgccgcccatctcggcgccctgcgccagcgtatcgagcaggcccagcgactggcgcgccatagcggcgccctgcatgccgcgctgtatttcgacgggcatggcgagctgcgcctgtgtcgcgaggacatcggccgccacaacgccctcgacaagctgatcggcgccctgcaccgccaaggcctcgacgccgcgcgcggtttcgccgtggtcaccagccgctgcagcctggagcttatccacaaggccgtacgtgccgggatcggcaccctggtcagcctctccgcccccaccgccctgaccgtgcaatgggcgcgccgccaccaactgaacctgatccaccagccccatcacaacgccccgcgggtctacagcccggcgccggccgcaaccgagtga

SEQ ID NO: 6762 - DNA, 315 bp, Pseudomonas aeruginosa
cgagccggtattcgaccacgccttcatcgccgagcacaccgacggcctcgaggcctacctggccgaactggatgccaccccctgggaacacctggagcgccagtccgggctgggcctggcggaaatcgagcaggctgcgcggatgtaccggcgggcgaacagggtcatcgtctgctgggcgatgggcatcacccagcaccaccattcggtggcgatcatccaggaaatcgtcaacctgcaactcctgcgcggcaacctgggccgcccgggcgccggtctctgcccggtccgcggccacagcaacgtgcagggtga

SEQ ID NO: 6763 - DNA, 1164 bp, Pseudomonas aeruginosa
ccagtacaacaccaccatctacggcctggacgatcgctatcgcggagtgaagggccagcgcgaagtggtattcgccaacgaggcggatatccgccgcctgggctaccagccgggcgacaaggtcgacctggtctcgctgtggagcgatggcatcgaacgccgggtacgccgcttcaccctgctcgccttcgacatcccggccggccaggcagccgcctactacccggaaaccaatcccctggtgccgctggagagcgtcggcgtcggcagccatacgccgacttcgaagttcatcgcggtacgcctggaaaaggccacgggcgacgggcgcattatctgaagcccacgaaaaacgccgcctcctgcaacaggaggcggcgtcttaaggaaaagtcgatgaaaggccttgaaggcaggccgttcgtcggcgttagaatggccagcatcccgccagcaaaaataccgatttcgaccctgaaatcgcgcttcacattcggtctacgaccgcctctacttaagaaagttccccatacaaaacaagcacttggaatatttcgaatttgctctaccaatcgtcggctggcgcttgtcagcggtttgggccaaccccagcatcgcagccgtcatccccacagagagaaactctctatgaagtattcctcgatactcctgttgtccctgagtctggtcggtagtaccgccttcgcaggcgacgacacccgcgcggccatcggcggcgccttgggcggggtgttgggttcggtcgtcggcgatgcggtcggcggcagcactggcgccgcgatcggtagtggcatcggtggcgctgcgggcggtgcagtcggcgccggacgcggcaacaagaccgaagcggcgatcggcggcggcctcggtgccgcaggcggcaacgtcatcggccggcagatcggtggcagcaccggtggcctgatcggcgcggccctcggcggcgccggcggcggcgcgctgggcaaccattatggcgacggcaaccgccgctacgacgacgatgacgactaccgcgaccgtcgctactaccgccgcgccggctatcgcgatggctattaccggcatgacaacggccatcactatggccagtacaagaagtggaagcgccacaagcatcatcgtcgctactacgacgactga

SEQ ID NO: 6764 - DNA, 732 bp, Pseudomonas aeruginosa
atgaaatggtgtggagggatggtcacagaacattgctccagcgtcgagactgcaaacgttcaatcagaaatgtcccatccagcgcttcctgttcgcctcacgccatgtcatggattgtcgcaccgggctcgctttgctagcgtgccggacatcaattccatccgagatttccagatgcgcccgtcgttcgccagttggggcctgcttgccctcctgctcctgcaaggcccgttgctccaggcccagccgctgtcaccggctctccagcaactgttgagcctgagcagccagcgtttgcaactagccgatcaggtagcccagagcaaggcccagtcgggcaaggcggtacaggacagcccgcgggaagaacaacagttgcagatgctcgccggacaagccgggagccacggggtcggcgccgagcaggtgcgcctgctgttcgccgcgcagatcgaggcgaacaagctggtccagtaccgcctgctcagccggccgctaccggacgctggccaggcggtcgacctggagcgcatccgcagccgcctcaatcagctcaacctggagctgctgcgcggctacgccccggcgctcgccgaactgcgcgtcgacgactgccggccgaggctcaaccaggcgctgcaacggcaggtacgcgtcgatcgcctggacgagctgcacgccatcgccctgtcacgggcggcgggcgatctctgtcactgggccgagctctga

SEQ ID NO: 6765 - DNA, 1359 bp, Pseudomonas aeruginosa
tccatctcagcgcacctcctgcaggtcggcgaaggctccgccctcggcggccaggcgctcgaccagggacgccggcttccagcgcgcgccgtggcgctgttcgaggaaacgcaagcgttgcagcagctcggccgcgccgaggcgatcggcccaggccatgggaccgccctccgcggcggggaagccgtagccgttcaggtagacagtgtcgatgtcggcactacgggcggcgataccctcgtcgaggatcttcgcgccctcgttgaccagcgccagcaggcaacgctcgaggatttcctcgtcggcgaaatcgcgccgcgggtagcccagcgtctcggcaacccggagcaccagggcatccacctcggtatcgtgctccgcctggcggctgcccggcgcgtagcggtagtagccggcaccgctcttctggccgaagcggcccatctcgcaaaggcggttgtccacctgcacggccggctggtcctggccgaccccggccaactcgcgggcgcgccactccaggtcgataccgaccacgtcgtacatgcggaacggccccatggcgaaaccgaacgcctggagagcccggtccacctggtacggcagagcgccttccagcagcatcaggcgggcctcggtggcgtagggttcgagcatgcggttgccgatgaagccgtggcagttgccggccaccacgctgaccttgcccatccgctcgcccagcgccagggccgcctccagcaccgccggcgcggtctgcgcgccgcgcacgatctccagcagccgcatgatgtgcgccgggctgaagaagtgcaggccgagcacctgacccggacgcgcggtgaccgcggcgatggcgtcgatgtccaggtaggaggtattgctggccagcaccgcggagggcttcagcgccgcgtccagctcgcggaagatcgattgcttgagttccaggttctcgtagaccgcctcgatcaccaggtccgcctcgcgcatcgcggcgaggtgctggaccggcgtgatgcgggcgcggcgcgcggccgcttcctcttcgccgatgcgcccctggcgcacgttgtgcgcgtaggtgtcggccacggcgccgagcgcctggttgagcatctgcgggttgctgtccagccactgcacgtcgagaccggcgttggccaggcacatgacgataccgcgacccatggtgccggcgccgatcaccgcggcctggcggaaggaaaagttctggctcatggtcttgtcctcgttgtaacgagcgcaggaggaacggtggacgaaacctggggcagtccgaccgcacaaaaagcgaccactaccttaggggaaggtcgtactatttttgaaatttag

SEQ ID NO: 6766 - DNA, 306 bp, Pseudomonas aeruginosa
ccgcacagggattgcgcgcgagcccatgctcccgcacgagtaccaagcgaccgcgcacccgcaggctccaagagggccgaggcgaaggacgagcacgcgcgaatcaaccgcggcggttacccgagaaaccgacgtccgcacgcggccccaggagcgactgagccagcgcgacccggtgtcgacggccggagggggccacgacaaggccctcagcgtgcgggcgaggacggagcgccgggggcggcgtacagccattggagccgccacggatcggagcacgaccgcgcccacgcgcgaagcgactga

SEQ ID NO: 6767 - DNA, 2856 bp, Pseudomonas aeruginosa
aactcccaagtcacccctgatacgccgctcgtcgccgtgcgtcgtgtcctcgggctgcggcgatgcaccgcagcgcagaagcgcggggaatttgcgggtcaggatgctagagtgcgcggtcatgagaatcgctcccaactcccgctcgccgctgctgcagtggctgagcttcgccctctgtgcctgcgtgctggtcaacgcgctggcttgcggcgtcctgcacctgcaggcgctgggagtgggcagcgacaaggggcagaaggccagcgtcgggctgttctgcgtcgccggtgccagccaatggctatccctggatcccgacgacgggtccgccggcgatccggcaccggtcaatccccagttgccgatgagctgcccgatgtgcagcgctctggtgctgttcgtcgcgctcggggtgatctggtcctggcgcttgcaacggcgacgccaggcgcgtttccgcccgcccgccacgcgcgagccggtgccgccccgatacgtctggccgccggccaacccgcgcgcttcccccgcctgatcctgaacgcccgccgcgccgggcatttgcatccgtcgcccgtcctgcctcgtccgcgcagcgctcgccgctgtccatccgggcgaggcgggcgtgcccaccatgccttgcttcaggatcgctcgatgaaaaagcactccacggcccgccgcgtcctcgcgctgggtctcaacctcaccctggccggcgttccggccttgctctgggccgatgaggaacccaccgaactgcccgccctcaccgtcagcgccggcgccgccggggaaaccccgccggccctcgatctcgacgacagcgccggcggcggctcgcgcctgggcctgagcctgcgcgagactcccggctcggtaagcgtggccaaccgtgccagcttcgagcggcgcggcctgcgcagcacccaggacatcgccaacagcctgcccggcgtgaacgcctcggcgccgcccggcttcggcggcttcgtcacctaccgcggcttcagctcgaaccaggtcaaccagttgttcaacggcattccggtgcaatacagcagcgccatgcgtccgctggacgactggatcgtcgaccgcgtcgagctggtcggcggtccgtcctccttcctcaacggcgccggtgccgtcggcggctcgctggactacatcagcaagctcgccgaccgctacggcgatttcatggaaggccgggtgcgctacggcagctacgacgattcggaagtcgccttcggcttcaaccaggccctgggcatcggccccgagccgaagcacttcgtgcgcctggacgtcagccgcagcggcggcaacggctacgtcgaccgcaattcgcgcgaatcgtggaacgtcgctttctccctgctcagcgacctgaccccggacctttcccacaccctggccctggagtaccaggacgagcaggaagacagcccctactggggcacgccggtgctcaatccctacgccggcgagctgaagatcgacaagagccgtcgccgcgagaactacaatgtcgccgatggccgctacgaacagcgcgtgcgctggctgcgctcgatcctcgaataccgggtcagcgacagcacgcgctggcgcaacaccttctaccactacgacgccgagcgcgattaccgcaacctcgagacctaccgctacaacgccgacaacagcggggtggtgcgctccaacgcattcctccagcgccacgaccagcagctcaacggcaaccgcttcgagctacagcacagccagccgctgttcggactggccagcgactgggcgctgggcttcgactacagcatcaacaagcagacgcgcttcccgagtaccgcctccgggccgttcggtacggtcgatccggccagtttcgagccgggccacttctacgacctgccgggcatgcgtcccggccaccggaaggaccgcagcaacgaggtgcgcaccagcgcgttgttcgccgagaaccgcctgggcctgaccgacgagctgtcgctggtcaccgggctgcgctacgaccacctcgacctcgacgtgcgcaaccatcgggtacccgacaaggacaatcccgcacacttcgaacggcgctgggacgtggtcaccgggcgcgccgggctggtctaccagttcactccgcacgccgacgtctacctgcaatacagtaccgccgccgacccgccgggcggggtgctgaccagcgccagcttcggccaggtccgcgactacgacctgtccaccggcgaccagtgggagctgggcagcaagttcgatttcctcgacggtcgcggcagcgccaccctggccgcctaccgcatcgtccgccgggacttctcggtggccgacccgaacaaccccaacctcagcgtgccggtgggccagcagacctccaggggcatcgaggccgccgcctccctgcggatcaccccgaagctgctggccgagggcaatttcgcctgggtcgacgcgcagtacgacgagttcaccgagaacgtcggcggcgtcgccgtctcgcgcaagggcaagacgccgccgaacgtgccggagcgggtcggcaacctgtggctgacctacgacttcgacccggcctggcagggcggggtggacgcgcgctacgtatcctcggtgtacgccaacaacgccaacacctggcacgtgccgtcctatacggtctacgggactttcctcagctaccggctggacgagcgcacgcggatcaccgggcgcgtgcgcaacctcaccgacgaggtctacgcgcgcttcgtgcagagcacgccgctgtactacgtcggcgacccgcgcaccttcgagctgagcgtgcagacgcgcttctga

SEQ ID NO: 6768 - DNA, 1593 bp, Pseudomonas aeruginosa
ttgctgtctgcggacatgcgcgagtctccgtggggcgccggccgtccgggagcgtcggccgggccgcggcgaatggtagtcgaaggcgggtcgatccgacagacgccgttgcgcgtcgtcggaccgcagcggcacgcaggaagcgtgccggcgcgcggcagggcggcgtccgccggggatgcgggcgccgccctgcgttcaggaggcttcgcggtaggggttgcgcggatcctgggtccagttgagatagggcttgccggtgtcctgcggcaccatttcgatgcagttctccaccggacaggtgatctggcacaggttgcagcccacgcactcggcgtcgatcacttcgtagcggtgcgtaccgtcggcccggggcaggctggcgatggcctggtgcgaggtgtcctcgcaggcgatatggcagcggccgcaaccgatgcaggcgtcctggtcgatgcgggcgatcacctggtagttgatgtccaggtacttccagtcggtggtattgcccaccgcgccgccgctgaaatcggacagccgctggtagccatggctgtccatccagcgcgcgagaccgtcctgcatgtcctcgacgatacggaagccgtgcagcatcgccgccgtgcatacctgcaccgcgccgcagccgagcgcgacgaattccgctgcgtcgcgccaactgccgataccgccgatgccacagatcggcaggccgcgggtctgcgggtcgcgggcgatctcggcgaccatgttcagggcgattggcttcaccgccgagccgcagtagccgccgtgggtgctctgggtgccgaccacgggcagggcgaccatgcgctccaggtcgacgctggtgatcgagttgatggtgttgatcagcgacaccgcgtcggcgccgccgcgatgggcggcgcgcgccgactggcggatgtcggtgatgttgggggtgagcttgacgatcaccggcagcgagcagtgggtcttgcaccagcgggtgaccatctccacgtactccggtacctggcctaccgccgcgcccatgccgcgctcgggcatgccgtggggacaaccgaagttcagctcgatgccgtcggcgccggtggcttccaccagcggcaggatgtatttccacgactcctcgacgcagggcaccatcagcgacacgatcagcgcgcggtccggccagtccttcttcacctgggcgatctcgcgcagattgatctccagcgagcggtcggtgatcagctcgatgttgttgatcccctgcacctggcggttcggtccgaagtgcgcggaataacgcgacgacacgttgaccgccgcggggtcttcgccgagggtcttccagaccaccccgccccagcccgcctggtaggcgcggaccacgttgtaggccttgtcggtgggcggcgcggaggccagccagaaggggttgggcgacttgatgccggcgaattcgatagacaggtcggccatcacgcagcctccacgttgagcatgagttgggcgtggatcgcttccgccgccagtttgccgtgctgcaccgcctgcacggtgaggtcctcgccgagcgccacgcagtcgccgccggcgtag

SEQ ID NO: 6769 - DNA, 1782 bp, Pseudomonas aeruginosa
cagtacaggcagcgggcgctttccagggcggcctggcgggcgttgagcggcggcgcgaggtcggcgaagcgctcggcgagcgtgtccgcgccggcgtccggacgggggaggtggttcagggaatcgatcacggttgtagcctctcttcaggtttcttctcggggcagtcaacggcaatacggcaccgtccggcctctacgggccggtccggtattgcgggaaggatcagcgctcgacggcgaccgggcgctggcgttcggcgcggcggccgagcacttcgtacaccgacgggtaggccgggcgctccacgtagcgtccggcgccgggttcggcgcgcaggtcgcctgcggcccagagcagcttgccctggctgatggtgtggctgggaatgccgcgcacggtgcgaccttcgaagatgttgaaatcgacccgctggtgatgggtggcggccgagagggtgcggctgccctgcgggtcccagagcaccaggtcggcatccgcgccgacgcggatcgcgcccttgcgcgggaacaggttgaagatcttcgcggtgttggtggaggtcagcgcgacgaactcgtgcatcgacaggcgcccgctgttgaccccggcgtcccacagcagcgccatgcggtcctcgatgccggccgtgccattgggaatcttgctgaagtcgtcgcggcccatggccttctgctcggcgcagaagcagcagtggtcggtggcggtggtatgcaggttgccggactgcaggccgcgccacagcgcttcctggtgttcgacgggacggaacggcgggctcatcacgtatccggccgcggtggcccagtccgggtggcggtagacgctgtcgtcgagcagcaggtgcccggccagcacctcgccgtagaccggctggcccttggcgcgggcataggcgatctcgtccagcgcctcgcggctggaaatatgcaccaggtacagcggcgtacccagcgtctcggcgatgcggatggcgcggctggcggcctcgccctcgacttgcggcggacgcgacagaggatgcgcctcggggccggtgaggccctgggcgaggagtttctgctgcaggtggaagaccagttcgccgttctccgcgtgcaccgtcggcaccgcgcccagctccaggcagcgctcgaagctggccaccagggtatcgtcggcggccatgatggcgttcttgtaggccatgaagtgcttgaagctgttcaccccgtgctgtgccaccagctcgcccatttcccgggcgacctcgtcgctccaccaggtgatggcgacgtggaagccgtagtccgcagcggatttctgcgcccagccgcgccaggtgtggaaggcctccagcagcgactgtcgcgggttggggatgacgaagtcgatgatcgaggtggtccctccggccagcccggccgcggtgccgctgaagaagtcctcgctggccaccgtgcccatgaagggcaactgcatgtgggtatgggggtcgatgccgcccggcatcaggtactggccaccgccgtcgaggacgtcgcagccggagggggtttcgaggttctcgccgatggcctggatgaggccgttggcacagagcacgtcggctcgataactctcttcgtgagtaaccacggtggcgccacggatcaacagggacatgccgtctttcctcgcaggctgaccggtcgttgccggttcttgaaattgttttttcgccatgcgccgaggacttttataatcctgtcagcgctgacaggattcgaatctagatgctga

SEQ ID NO: 6770 - DNA, 1530 bp, Pseudomonas aeruginosa
cccgatgagcgaataactaaaagaattctggagaggcccatgcaacagagcagatcggaagtgaccgagcgcgacggcttggtcgagctgtccgccggcagcgacgtactcgacagcccccgctacaaccacgacatcgccccgacccgggtggaacagcgtacctggaacaggtggcacatcaccgcgctgtggatcggcatgtccatttgcgtgcccacctacaccctcggcggcgtcctcaccgcctacttcggcctcagcgtcggcgaagcgctgctggcgatcctgctggccaacctggtggtgctgatcccgctgaccctcaatgccttcgccggcacccgctacggcattcccttcccggtgctgctgcgcgcttcgttcggcatcatcggctccaacgtgccatgcctgatccgcgccgtggtcgcgtgcggctggttcggcatccagacgctgttcggcgggctggcgatccatctcttcctcggttcgatctttcccgcctggaaagccctcggcggtaccggcgaggtgatcggtttcctcctgttctgggggctgaacctgtgggtggtgctgcgcggcgcggagtcgatcaaatggctggagacactctcggcaccgctgctggtgctggtcggcctcggcctgctggtgtgggcgctgccgcacatatcggtcagcgaactgctggcgcagccgccgaagcgcccggaaggcgccagcgtcaccggctacttcatggccgggctgacggcgatggtcggcttctgggccacgctgtcgctgaacatccccgacttcagccgctatgcgcgtagccagaaggaccagatactcgggcagatcttcggcctgccgctgaccatgttcctgttcgccgccctcggcgtggtgatgaccgccgcctcggcttcgctggtgggcgagacggtttccgacccggtcagcctgatcgggcacatccccagccccggctgggtggcggtggcgatggcgttgatcatcgtcgccaccctctcgaccaacaccgcggcgaacatcgtctcgccgaccaacgacttccagaacatcgcaccgaaactcatcggccgcacccgcgccgtctggctcaccggtttcatcggcctggcgctgatggcccacgagttgctgaagaagctcggctggatcgtttccgacctcagcctggaaagcgtctactccaactggctgctcggctactccagcctgctcgggccgatcgcggggatcatggtggtggactacttcctggtgcgcaggcaacgcctcgacctcgccggactctaccgcgacgacgtctacccggcctggaactggcccggcttcgccgccttcgcggtgccggtggcgctgaccgtcatggccctcggcaaccgccagttccactggttctacgactacggctggttcaccggctcgctgctcggcggcgcgctctactacggcctctgcggccgccgtgcgcggagcccggcggcattggccaaaccgctgccctga

SEQ ID NO: 6771 - DNA, 903 bp, Pseudomonas aeruginosa
gcccagccaggccgcaaactggcggcccgtgcggaattgccgtgcatcaccggcggatgccgccaccgcgctggcgctgatcgggccgatgccttccaccgccagcaggcgctggatgcgggcatcgccacgtacgtgagcctgaatctgtcgctccagtcgagcgatgcgcgcctccagcgtctgcaattcatctttcaattcacgcaacagctcgcccatcggggccggcaagggcgccggttcggtagccgtgaccgtttcgagcaaggccatcgtcgccgctcgcccacgtcgcgtcgcgatcagcccgaactcgcccagcaagccacgcacctcattgcacaacgccgtgcgggcccgcaccagacgactgcgcacccgatgcaccgactgcacggcctgctgctctgcgctcttcaccgggacatagcgcatgctcggacgactggcggcttcgcagatcgcctcggcgtcgtgtgcatcgtgcttgtcccccttgacgtagggtttgacgaactgcggtgcgatcaggcgtaccgtgtggcccagctcccgcaactcgcgcgcccagtagtgcgcactgccgcaggcctccatcgccaccaggcacggcggcagttggcgaaagaaatcccgcacctgtgcccgcttgagttggcgacgacataccacatgctcgtgacgatcaacgccgtgcacctggaatacttgttttgccagatccagaccaatgcgactaaggttcatgctgactccccctccgggacttgtggctgcaccattagtctggcgcttgacgccgtaggagggaggagtccatttcattgccctaccgtccgcagcacagccccagcctcggcagggcgcccgcccggcaccaccggtcaaaccatggcgtag

SEQ ID NO: 6772 - DNA, 336 bp, Pseudomonas aeruginosa
gaactcccctcttttatgcccggcggtagcgcagcgatccgcgcctccgccctcccgtttggggacctcggtacaggcaggctgagaactcccccttttattcccggccgtcgcgctcctgcagttcgacgaccaggcgccagccctcgccatcctccgaccactgccagcgcccctgcaaggggcgggtcgagaccaggctcaacagcagcgcctttccctcctcgcggacgcgccagcgcaacggctggcccagccatcgcccgtctccctgctgcgccgcgccccgggcgacgatgcgcaacgtcagggcaccctccacccgtgccgccgtaa

SEQ ID NO: 6773 - DNA, 495 bp, Pseudomonas aeruginosa
ccgtctacgaagcctggcgccagctcggcttcgccatggactgagccggccgacaggcatgaaaaagcccgcgcaaggcgggcttcttcgcaagcgctgggcttactggaccgacggcgtcgggatctcgccggaggcctgcatgcgggcgatttcctgggcgtagagggcgtcgaagttcaccggcgacagcatcagcgccgggaacgaaccgcgtaccaccaggttgtccagggcttcgcgagcgtacgggaagaggatgttcgggcagaacgcgccaagggtatggctcatgctcgacggatcgaggttcttgatcaggaagatgccggcctgctgcacttcggcgatgaaggcagtggtgtcctcgccgttcttcacggtcaccgatacggtcaggaccacttcgtaaaagtcgccgtccagctgcttctggcgagtgttcaggtccaggctgatggacgggttccattcctggcggaagatttccggtga

SEQ ID NO: 6774 - DNA, 741 bp, Pseudomonas aeruginosa
gttcccccgcgaacgagccccgcagctggcaggtttcgtcatgctgacccagtacgcggcgagcatcccggcgccctgcgccttcccgccggagccgctgaccaacgtcctcggcgagtacctggccaagcatggcaagacccagctgcgcatcgccgagaccgagaagtacgcccatgtgaccttcttcttctccggcggccgcgaggaaccctacgagggcgaggagcgcatcctgatcccctcgccgaaggtcgccacctacgacctgcaacccgagatgagcgcgccggaagtcaccgaccgtatcgtcgaggccatcgagcaacagcgctacgacgtgatcgtggtcaactacgccaacggcgacatggtcggccacaccggggtgttcgaggccgcggtcaaggccgtggagtgcctggacacctgcatgggccgtatcgtcgaggcgctggacaaggtcggcggcgaagccctgatcaccgccgaccacggcaatgtcgagcagatggaagacgagtccaccggccaggcgcacaccgcgcacacctgcgaaccggtgcccttcgtctacgtcggcaagcgcaagctgagcatccgcgaaggcggcgtgctggccgacgtggcgccgaccatgctgaccctcatggggctggagcagccggcggaaatgaccggtcgcagcatcgtcaccctcggctgatccgcgaacgacgaactcccgcgcagggcggataa

SEQ ID NO: 6775 - DNA, 2463 bp, Pseudomonas aeruginosa
cgggccgggcgccgcgccctgtttccacgacgccaccttccccgctttaacgctgccgatcggccgacaggcctggccacgcggcgtcgagacgtgtgccgcggttttcattttccgcgtctcccccctgcctcccgctacgtcgccgaggcccgtgctagccttgcccgcgctgtcttttccatctgccctacaaggatttccgccgatgtggttcctcctcgccacctcgctcctcgccctgtccttccagcgcctgctggccctcgtcttgctgctcgcgacctgctgcctcgccttctacgacggggttctcgctccgcctgcggtcgccgccctggctgcactgggcgtcctcgccctgttgcgccggcgcctggcggcacgccgcgcctgggccctgggcctggagctgctgctggtcgccggcgcggtgggcctgttcctgcacctgctacccggcttcgccaaccccaggatcctggacaaggcggtggtcggcccgcagagcctgccgttcaccatgtacttcaacttcgacaaggcactggtgccgttcctgctactggcctgcctgccgagcctgttccgcgacgaagcccgcgctcccggccgcccctggtactggctgctgctcgtggcggcggtgccggcgctgcttctgctggctgtcggcgtcggcctgctgcggccggaactccacgcgccggcctggctctggcagttcatcctggccaacctgttcttcgtttcccttgccgaggaagcgctgttccgcggctacctgcagcaacgcctgggccaatggctgggcccctggcccgccctggcgctggcctcggcgctgttcggcctggcgcacttcgccggcggcccgctgctgatgctgttcgccggcctcgccgggctgatctacgggttggcctggctgtggagcggccgcctgtgggtggcgacgctgttccacttcgggctgaacctgacgcatctgctgctgttcacctacccgctctacagacccgcctgatgcccgtggccttcgtcgtcgacgacatccgccgctgccatccggctgaaatacgtggaagcgccccacagcgcgcggtgcggggcgttttttttaacggcggccacgggcatactaggccggtccaattcccaggtgcccgccaccccatgctccgcctccttcctctcctgctatccctcgcctgtctcgctccggccttcgccgacgagcgcgccgacacccaacgccagctggaacagacgcagaaggacatcggcgagctgaagaagctgctggacggcatccagcaggaaaagagcggcgtgcagaagcagctgaagtccaccgagaccgagatgggcgacctggaaaaacagatcaaggccctgcaggacgagctggacaagagcgaagccgagctgaaacggctggatggggagaaaaaaaaactccaggacgcgcgcattgagcagcagcgcctcctcgccatccaggcccgcgcggcctaccagagtggacgcgaggaatacctgaagctgctactgaaccaggaacacccggaaaaattcagccgcaccctcacctactacgactacatcaacaaagcccgtctcgaacagctcgccagcttcaacgaaaccctccgccagttggccaacgtcgagcaggacatctctgcgcagaaagccgaacaactgagcaagcaaggcgagctggacagccgccgcgaggcgctggcagcgacccgcaaggagcgccagcaagccctggccaagctgaacagcgactaccgcgaacgcgaccagaagctcaagtcccgccaacaggaccaggccgagctggccaaggtactgcggaccatcgaggaaaccctggcccgccaggcccgcgaagccgccgccgcggcggagcgcgagcgccagcgcgcgctggccgccgaacgcgagcgtgcgcgccagcagcaggccgcccccggacgagtcaccagcccgccgcgcgaacctgcgccgggcccgctggtctcaagcactggcgcggtctacggcggcgcgttcggctcggcccgcggcaagctgccgtggccggtgaatggccgcgtcgtggcgcgcttcggcagccagcgcggcgacgatccgcgggcgaaatgggacggcgtactgatttcggcgagcgccggcagcaccgtccgcgcggtgcacggcggacgcgtggtattcgccgactggttgcgcggagccggcctgttggtcatcctcgaccacggtggcggctacctcagcctttatggccataatcaaagcctgctgaaagacgccggcgacaccgtgaaggccggagacccgatcgccaccgttggaaccagcggcggccagagtagcccggccgtgtacttcgccattcgccatcagggccgcccggcggaccctattacctggtgccgcgcacagggatag

SEQ ID NO: 6776 - DNA, 603 bp, Pseudomonas aeruginosa
ccctggcgatcatcccgggaaaccccgcatgccgccgaactggcccgcgaggcgcaccagcgcgggcgcacggtgatcctgcacatgccgatggacccggccggcggtccatacgcctggcggccggagctgacccaggaagagcgtgcgcggcggctggacgcggcgctggccaaggtgccgtttgtgcaaggcctgaacaaccacgagggcagccgcatgaccgcggtgcgcccggcgatggcctggctcgccgaggaactccagcgtcgcggcctgtacctggtagacagccgcaccagcgccgccaccgtggccgccagcgaggcgcagcggatcggcctggcgagcgtctcgcgcgatgtgttcctcgacaacgaagccacaccggaagcggtctccgcacaactgcaggccggcgtcgccctggcccgcaagcagggttcggcgttgctcatcggccacccgcacaaggccaccctcgacgtgctggcgcgggagctgccgaagctgcgcgcccagggcatcgagctggtaccgccgcagatgctcatcggcgagcgcggcaaccgcaacgtcaacccacgccaggcgccgcactga

SEQ ID NO: 6777 - DNA, 663 bp, Pseudomonas aeruginosa
gccggcgcgaggtcggccgcgacgagcaggctctgcccgagggcgtcatcgacctggacctggtggcggccgcccagcccagggaaaaagagtccgacccccacctcttcaacttcctcaacggcatgctgctatccggcggcgatccggaaaccacctatgtctcgcgcctgggcgcggacggcgtgttccacgaagtggcgcggctcggcgagaccgcctgcctggaagtcacgccggacggttccagcgtcttcctgctcaccggcctgcggcgcccgggcaaggacaacggtcagcgcgagcagacagtggtgctgcgcagcgacgaccagggcaagagctggcggcggctcgaggaaggcttcatggccgaggcgaatcgactgggctgggctctcgcaccgcgcttccacggcaaggatgaagtctgggtctggggtgatttcgaatacggcggtgccgatggcggccggggaacccggcccagccggggcgggctgttctattcgcccgaccgcggcgccagtgtcgagtcgatcgccacctccgcgccgctgctggtggacctcgcctacgcccgcgagttggcgccgaacggcgtcaactggggcgactacaacggcaagcacgggcagatcaaggcacacgtcgcccaactga

SEQ ID NO: 6778 - DNA, 1284 bp, Pseudomonas aeruginosa
cgccaggtcggcctcgaaaccgttcttgccgaggaactcggcgatggcatcgcccttgtaggcgccgatccggtatttcttcgcctcgtccaggctgcccagggtgatcgggctgtcgcccttggccagcagcacccagtcgtccgggccgatcggaccgacccacttgaacttgtcctcgcgctcggccaggcgggcggtgacgaacaccccgtagccgggcttctccagcgccagcttgtagatgcggtcccaggggaaacgcagggtcaggctgtacttgatgccggcgcgcttgaacatctcgcggacgatatccacggcgatgccgtcgatgttgtcttcctgggcgaagttcttgccgttgatcgccatgttgtacggcgggaagttctccgtgagcaggaccatgctgtagtcgggatcggtttcggcgcgcgcgccgccgaccagcagcagggttgcgagcagcgcgaagagcaggcttctttgcattgttgtcatcctgtcaggggcctggagcgaggcagaataaccagcgccgcgccgccaggccagccttttgccagcatcgccggcgaggcgtcagtagcgctcgcggatctgcttcaacaagccttcgctgcgcagcgcgtcgaccgccgtttgcaacttctgcaccagctcgtccggggtgtccttgttcagcgccaggaacagctcggcggtatggaaacgctggaccaccttcacctccttgaggccctcgcgctgggcgacgtagcgcccgctcggatcggcggtgacccagagatcgatctgcccgctggccagcttgtcgacgttctcgttgtcgcgcagcgccagttgcacctgcaggccgcggtcgaccaggtgctggctgatggcgtcgttcttgtagccgccgatccggtagcgcgcggcgtcttccaggctgttcaggtggatgctgctgtcgccgcgggccatcagtacccagtcgttgaccgccagcgggccgacccacttgaacttgtcctcgcgctccggcgtacgggcggtggaaaacacgccatagccgggctcgctcagcgcctgctggtagacccggtcccaggggaagcgcaggatcagctggcactcgatctgcgcgcgctcgcaggcggcgcgcacggtatcggtgctgatgccgctgatgccatcgtccttggcgtagttgccgccgttcaccgccatgttgaacggcaccaggttctcggtcagcaggaccagggtttcggcgcgcgccagggcgctagcgcatag

SEQ ID NO: 6779 - DNA, 882 bp, Pseudomonas aeruginosa
ctgtacctgaaagaaagccgcgcgagtgtcgactcgcgctcaggaatggctagccgatcaccggccctgtgcgctgcggcgcaacgcgcctcagcgcaccacgataccgcggctggccaggtaggccttggcttccggcacggtgtactcgccgaagtggaagatgctcgccgcgagcaccgcgtcggccttgccctcgaggatgccggcggccaggtgctccaggttgccgacgccgccggaagcgatcaccggcacgttcaccgcctcgctgatggcgcgggtcacgcccaggtcgtaaccgctcttcacgccgtcctggtccatgctggtcaggagaatctcgccagcgcccaggtcttccatcttcttcgcccagagcacggcatccagcccggtgggcttgcgcccgccatgggtgaagatttcccagcgcggcgcctcgcccggggcggaaaccttcttcgcgtcgatggcgaccacgatgcactgcgagccgaagcggtcggcggcctcaccgacgaactcggggttgaacaccgcggcggtgttgatcgagaccttgtccgcgccggcattcaacaggttgcggatgtcctgcacgctgcgtacgccgccgcccacggtcagcggaatgaacacctggctagccatgcgctcgacggtatgcagggtggtgtcgcgcccgtcgacgctggcggtgatatcgaggaaggtgatctcgtcggcaccctgctcgtcgtagcggcgagcgatctcgaccgggtcgccggcgtcgcggatgttctcgaacttgacgcccttgaccactcggccgttgtccacgtcgaggcaggggatgatgcgttttgccagtgccatgcggttcgcctcaggccttga

SEQ ID NO: 6780 - DNA, 702 bp, Pseudomonas aeruginosa
ccagcacccggccggcaccgacgtgctcaagggccttggccaccgagtgcaggttgcccatgccgtagtcgatcacggctaccgtctgcatcacaggcaccctttggtcgacggcatctgcccggccatccgctcgtccagctcgatggccatgcgcagcgcgcggccgaaggccttgaacacggtctcgatctggtggtgggtgttgtgcccgcgcaggttgtcgatgtgcagggtcacctgggcgtggttgacgaagccctggaagaattccatgaacaggtcgacgtcgaagccgccgacgctggcacgggtaaagggaacgtgcatctgcaggccgggccgcccggagaagtcgatgaccacccgcgacagcgcctcgtcgaggggcacgtaggcgtggccgtagcggcggatgcccttcttgtcgccgatggccttggcgaaggcctggccgagggtgatgccgatgtcctcgacggtgtggtgatcgtcgatatgcaggtcgcccttgcactcgatgtccaggtcgatcaggccgtggcgggcgatctggtccatcatgtggtcaaggaagggaaccccggtatcgaaccgggccttgccggtcccatccaggtcgatggagaccttgatctgggtctccagggtgtcgcgcgcgacggatgccttgcgttcggccatcaccagctccacagctaa

SEQ ID NO: 6781 - DNA, 1899 bp, Pseudomonas aeruginosa
gagggccagcattataggcaggcccgggctggcgctgccagccgcgaccgtcggcgcgaatcgccccacgggcggcgggccaggccttacactgcgctcctttcttcccgccgcggagagccgcatgcccgtgatcgtcgaaaccctcgcccaacccagcgcccaggatcgcctggacctggcgaagatctacgccgacgcgccggactggctgttcgccccgcatgccgacggcgcggcgctggtcgcggccgggctggccgccggcgagctgatcgccgggcgcttcaacgaccgcctgctgggtgccgccctgctgcggcgcggcgacgacgcctggcagctgtcgcacctttgcgtgcgcggcatcacccgcggccgcggggtcggccgacgcctcctcgacgaggcccggcgcctggctgccgaagccggcaagccgctgcgcctggtcgccccggacgggcacctggaggcccgtgccctcgcggcacgccacgggctgccgctggacagcctctgatatgctcggtggcggtccccgccacggagcttcgccatgtccttttcctccgccgaacgcgccgccctgcttgccctcaagggggtcggcccgaccgtgctgcaacgcctggagcagatgggcctggacagcttcgtccggctgcgcgactgcgacgccgcgagtatcctcgcccagggcgcggccctgaccggctccagttgctggaagaacagcccgcaggcgcgggcagcgatcatcgccgtgctgcagcgcgcagccagcgacgcatgaacgacgtcgacgtactggtagtcggcgccggcgccctcggcctggcctgcgccgcgcgcctggccgaagccggccacggcgtactggtggcggagcgcgaacggctggtcggtagccacacctccagtcgcaattccgaagtgatccacgccggcctctactacccgcccggctcgctcaaggccgatctctgcctggaaggccgcgaacgcctgtacgcctggtgcgcccgccacggcgtcggccaccggcgcatcggcaagctgctggtggcggtggaggaaaacgagcgcgagaggctccaggccctggcggccaacgcacgcgcctgcggggtcgacgacctgatgccgctggacggcaccacgctgcgcgcgctggagccccaggtccgcggggtcgccgccctgctctcgccgagcacgggaatcatcgacagccacgcctacctgcaatcgctgcaggccgtcgccgaacgccacggcgcacaactggcgctggacacccgggtcgaccgcctggagcgccacgccggcggctggcgcgccgaaggacagagcgtcggcgaagcgttccggttgcgcgcgggctgggtggtcaatgccggcggcctgttcgcccaggcgctggcgcaacgcaccgaaggcctcgatccgcgcctggtgccggcgctgcacctgtgccaggggcgctatttctcctacagcggccgctcgccgttccgccacctggtctacccgatgcccgaggcgcgcaccgccgggctcggcatccacgccaccctcgacctcggcggccagttgcgcttcggtcccgacgtgaattacgtggacaacctcgactaccgcgtcgacgaatccctccgccccgccttcgcccaggccatctcgcgctacttccccggcatcgatcctcggcgcctggccgccggctacgccggcatccggcccaagctcggcgggccgggggaacccgccgccgacttcatcatccaaacccctgccgaacacggcctgcccggcctggtcaacctgttcggcatcgagtcgcccggcctccccgccagcctggcgctcgccgaacgggtcgcccgcgcactctga

SEQ ID NO: 6782 - DNA, 2346 bp, Pseudomonas aeruginosa
gacgaggtttcgccgcgcgcagggtcggcctggcaaaacggcgttgttatactcgcccgcacattcaccgctgccagcacaaaggattcgtccatgaaagcattcggcaaggtcctggggctgttcttcctgggactcttactgctcgtcgtggccctgggcttcgccctgacccacctgttcgatcccaatgactacaaggacgaaatccgccagatcgcccgcgacaaggccaacctggagctggacctgaagggcgacatcggctggagcctgttcccctggctgggcctggagctgcacgacaccagcatcgccagcgccgccacgccgaccaagccgttcgccgacctgcagatgctcggcctgtcggtgcgggtcctgccgctgctgcgcaaggacgtgcagatgagcgcgatccgcgtcgaaggcctgagcctggacctggtccgcgacaagcagggcaagggcaactgggaaaacatcggcaagccggcccagccccaggccccggccgctccttccgccaccccgccggcagcggacggcaagggcgcccaggcgcaggcaccggagcaggcgccgcagaacgacagcccgcgcaccccgatcaagctcgacatcgacagcctcaatgtcaacaacgcccgcgtcacctacaccgacgaagccagcggcaagcagtacaacgtcgagggcatcgagctgagcaccggcgccattcgcgaaggcagcagcattccgctgaagctcaacgcctacctcggcaccaaccagccggtggtacgggtcaagaccgagctgaccggcaacctgcgcttcgacaccgcgctcaggcgctaccaactggaagacgccaggctctccggcgaagcctcgggcgagccgctgcaaggcaagaccgccaccttctccgcccagggccagttgctgctcgaccagtcggcgcagatcgccgagtggaacggcctgaagctgagcgtcaaccagttgcgcgccctcggcgaactgaaggcccgcgagctggacaaggacaccaagttcagcggcggcctgtcgatcgcgccgatgaacctgcgcgagttcctcgccggcatcggtgtgaccctgccggccatggccgatgccaacaccctcggcaagttcgagctgaacacccgcctggccggcagccgcaacagcctgaatctcgaagacctcaagctgggtctggacgacaccgccttcagcggccgcttcggcatcgccgatttcgccaggcaatcgctgcgcgcccagctcaagggcgacaagctcgacctcgaccgctacctgccggccaaggccaagcaagcccaggatgccgccagcgccacgcgcaaggcggaagtcgacgccaccgtggccagtgacgcccagggcaacacgccgctaccggaaaaaccgaccaggcaggcctggagcgacgcgccgctactgcccatcgcgaccctgcgcaagctcgacctggacgtggcgctgaacttcggccggctgaccgtcgagaagctgccgatcgacgacgccagcctgaagctgcgcggccagggcggcgtaatcagcctcgacgacatgcgcggcgggctgtacaacggccgcttcaacgccaaggccaacctcgatgtacgccaggacagcgccgtgctgaccgccaccaaacacatcgccaacgtgccggtggagcgcctgctcgaagcccagggcaagaaaccgccggtgaaggggctgctcgacctcgacgccgacatccgcaccagcggcaacagcgagaaatcctggatcgaccatctcaacggcaacgcacgcttcagcctgatcaacggcgtgctgcccgacgccaacctggagcaacagctctgccagggcatcgctaccctcaaccgcaaggcccttgccggtactcacggcggcaaggacacgcctttccgtgagctcaagggcagcctgaacttcaccaacggcgtggccagcaaccctgacctgaaagtggccattcccggcctggcggtcagcggccacggcgatatcgacctgcgcgtgctgggcatggactatcgcatcggcgtggagatccagggcgacaagagcgacatgccggacccggcctgccaggtcaaccagcgctacgccggcatcgaatggccgctgctctgccgcggcccgctggaactcggcgccaaggcctgccgcctggacaaggaaggcatgggcaaggtcgccgcgaaactggccggcaatcgcctcaacgaaaaactcgaagagaagctcggcgacaaggtcagtccggagctgaaagacgcactcaaagggctgttcaaccgcaaatga

SEQ ID NO: 6783 - DNA, 549 bp, Pseudomonas aeruginosa
cacctgaaggcttcaacggcgcggtcctcgactggtacgaccgtcacggtcgcaaggatctgccctggcagcagggcatcaccccctaccgggtgtgggtctcggaaatcatgctgcagcagacccaggtcagcaccgtgctcggttacttcgaccgtttcatggcagcgttgcccgacgtcgaggcactggccgcggcggccgaggacgaagtcctgcacctgtggaccgggctcggctactacagccgtgcgcgcaacctgcacaagaccgcgcagatcgtggtcgagcggcatgcgggggagttcccccgcgacgtcgagcaactcgccgaactgcccggcatcggccgctccaccgctggagccatcgccagcctgtcgatgggcctgcgcgcaccgatcctcgacggcaacgtcaagcgcgtactggcgcgctacctggcgcaggacggctatcccggcgaaccgaaggtggccagggcgctgtgggaagccgccgaacgcttcaccccgcacgcacgggtcaaccactacacccaggcgatga

SEQ ID NO: 6784 - DNA, 369 bp, Pseudomonas aeruginosa
agaagctgctcaagcgcgcagaacaggaactcggacgcggcacggccgcgtgaatgccgggcccgcgggcccggcggcaactgcaggagaacgaccatgagccgcaccgtgatgtgccgcaagtaccacgaagagctgcccggcctcgaccgcccgccgtatcctggcgcgaagggcgaggacatctacaacaacgtgtcgcgcaaggcctgggacgagtggcagaagcaccagaccatgctgatcaacgagcgtcgcctgaacatgatgaacgccgaggaccgcaagttcctccagcaggagatggacaagttcctctccggcgaggactacgccaaggccgacggctacgtgccgccatccgcctga

SEQ ID NO: 6785 - DNA, 1110 bp, Pseudomonas aeruginosa
cccccaccccgcccgacggaggccgccatgaccccatccctctctggcctgcctccgatccgcaccgcgctgatcggctacggcttcgccggcaagaccttccacgccccgctgatccgcgcggtaccggcgttgtgcctggagcacgtggtctcccgcgaccctgggcgggtgcacgccgacctgcccgaagcccgggtcagcgccgatccggatgaggccatcgaggccgccgacatcgacctggtggtcatcgcctcgcccaatgccacccacgccagcctcgccgaacgggccttgcgcgccggcaagcacgtggtggtggacaagccgttcaccgtcaccctggccgaagcccggcgcctcgccgacctcgcccgtgaacggcctgggcaggtcctctcggtgttccagaaccggcgcttcgacagcgacttcctcgccgtggaggccgccctgcaggccggcagcatcggcccggtgcgctacttcgagtcggccatcgagcgcttccgtccgcaggtccgcgaccgctggcgcgaacacgacctgcccggctccgggctgtggttcgacctcggcccgcacctgctcgaccaggcactgtgcctgttcggcgtaccgcagcgtgtgcacggacacctgcgccggctgcgcgagggcgcgctgaccgacgactggttcgaggtcctgctcgattatccgcactgccaggtagcgctgcgcgccagcatgctcgccgccaatccggcgccacgcttcaatgtgcacggcgaccacggcagcctgctcaaggccggcgccgacatccaggaagcgcaactgctccagggactgcaccccggttccgccggctggggccgcgatcccgacctgctgcagcacatcgatggccagggcctgcgccagtcgctggtcaccccggcaggcgaccagagccgctactaccaggcgctggccgccgccatccgcggccagtcgcgcaacccggtgtcggcgcaacaggcctgcgcgctgatggccctgctggagttggcacgacgctccgccgaggaaggccggagcctgccggtggagctgcgcgacgaggaacgccaggcctggaactga

SEQ ID NO: 6786 - DNA, 369 bp, Pseudomonas aeruginosa
atgagcgcctccagcatcgaagcgctggccagcgcctgggcacaggtcgccagggaagccgccttgccagccgagtacgagggcacggcaacaccggaggcgcatcgagccagcgagctgatccaagagcggattcgtgagcacattgttgcgagcaatgacatgcgcctgttcggcctattgcacctgctaggtcaagcatcgctgcgcatggagcaagtgctgtggccggaagattacgagcgcatgatccgtgaggtggaggaaaccctgcaggaagccgatgcccccaacgccaaatatttcacgcatgaagaagctatacaggctatgcagaaacgcatcgacaagcctcagcactccgagtag

SEQ ID NO: 6787 - DNA, 258 bp, Pseudomonas aeruginosa
ctccgacagccacgcacgttgctggggattacctcggctaccaagctcgatcctaagagcgcctgcatcctctcgaatagctacgactacagcatcgccaacaatggacctggcactcagcaccaaaggcaaccagccccggccggcataaatgcgcacgtcgggagacaggatgaaatccccgaggtcttcccgggtgatgtagtagcactgccgcatctagcatctcctttctctcgattgctcagcataagctga

SEQ ID NO: 6788 - DNA, 369 bp, Pseudomonas aeruginosa
atactctcaccgcctcattcatggagactttcaatgtcatcctccgaatatcaagttggactatctgcaggttacgcacactctcgcgcagcccaagcatcatacgaagccgcaattaatgaatggcgcttgcattcagagaacctgaaacatcaagtgaacgccttgaatgaacgcatcgaaattatgcaaggccactttgaagcgaataactatgttttgcttttgttgttggaagagttaagaaagacctcacctaactctccactactggtaaagggaaacagagactcgcttcgtcagaaggcctttgatagatatctggaagatcgcggatatgaggggccaagttcacgcccccggaggtaa

SEQ ID NO: 6789 - DNA, 918 bp, Pseudomonas aeruginosa
actaggcggaccttgtccggacccccgatcgatgctgaagaaaagcttcaactccctgctcaccacctggctcgccggcctgctggtgatgctgccgctggtactcaccctagccttgctggcctgggtggtcagcttgctgaaccgcttcgtcggtccatccagcctgatcggtcgcggcttcgccgccataggccagccgctcgccggcgattcgccactggcctacctgctcggtaccgcgctactgctggtagccatctacctgcttggcctcggcgtacagctaggcctgaagcggccgctggccaacctgttcgacctgaccctgcggcgcaccccgctgatcggcaacctgtacaacctggccgaccgtttcgtcggcctgctggacaagaagcaggacgccgacatcgccgcgatgagtccggtgtggtgtttcttcggcggcgacggcgccgccgtgctggcgctgatgcccaaccccgaagcggtggaactggacggccgcgcgcactacgcgatcctggtgccgaccgcgccgatcccggtgggcggcggcctgctctacgttccggtggaatgggtgaaaccggcacagatcggcatggacaccttcaccagcatctatgtgtcgatgggcatcaccccaccgccgccgctggccgccgccaaggtgctggcggagccgcgcgcggagcagccgccggcggctccataggcggtcccgcatgcccgggaacggggcgcgcaccgacctccaggctctgcttcaggtcagggttcgccaggagttttcttcgaaagccgacagttttgttcctacgcgacagcgcactgcagcgatgcgacaagatgccgccaaccccgctccagaggcacgccgcctgcttggctccggttgaagcgctgtgctag

SEQ ID NO: 6790 - DNA, 825 bp, Pseudomonas aeruginosa
cttgccttcgccaggaaggcccttccaatccgaataacaagaggaaaatccatggccgaggccacccccgcactggaaatccgtaacctgcacaagcgctacggcgacctcgaagtgctcaagggcatctccctcaccgcccgcgacggcgacgtgatctccatcctcggatcgtccggctcgggcaaatccaccttcctgcgctgcatcaacctgctggagaacccgcaccagggccagatcctggtctccggcgaagagctgcgcctgaagaagagcaagaacggcgacctggtcgccgccgacagccagcagatcaaccggctgcgcagcgaactcggtttcgtcttccagaatttcaacctgtggccgcacatgagcatcctcgacaacgtgatcgaggcgccacgtcgcgtactgggcaagagcaaggccgaagcgatcgagatcgccgagggcctgctggccaaggtcggcatcgccgacaagcgccacagctatcccgcgcaactttccggcggccagcagcagcgcgcggccatcgcccggaccctggccatgcaacccaaggtgatcctgttcgacgagcccacctcggcgctcgacccggaaatggtacaggaagtgcttaacgtgatccgtgcgctcgccgaagagggccggaccatgctgctggtcacccacgaaatgagcttcgcccgccaggtttccagcgaggtggtattcctccaccagggcctggtagaagagcagggaacgccgcaacaggttttcgaaaacccccagtcggcgcgctgcaaacagttcatgtccagccaccgctaa

SEQ ID NO: 6791 - DNA, 702 bp, Pseudomonas aeruginosa
cttctcatgattctcgacctgcatgggttcggcgaccaactgctcgccggtacctggatgaccctcaagctgtcgctggcggcggtctgcgtggggctgttgctcggcctcctcggcgccatcgcgaagacttcgaagtacgcggccctgcgcttcctcggcggcacctacaccaccatcgtccgtggcgtgccggaaacgctctgggtactgatgatctatttcggcacggtgagcggcctgaacgccctcggcgaccttttcggcaagccggacctggcactctcgccgttcgccgccggcaccctggccctcggcctgtgcttcggcgcctacgccaccgaggtgttccgcggcgcgctgttgtccattccgcgcggccatcgcgaggccggccaggcgctcggcctgtcgcccggacggatcttctggcgcatcgtcctgccgcagatctggcgggtcgccctgcccggcctcggcaacctgtacctgatcctgctgaaggacaccgcgctggtgtcgctgatcaccctcgacgagatcatgcgcaaggcgcaggtcgcctccaacgcgaccaaggaacccttcaccttctacatgaccgcggccgccatctacctgagcctcacggtcgtcatcatggtcgccctgcacttcctcgaacgtcgcgccggccgtggtttcgtgaggaacgagctatga

SEQ ID NO: 6792 - DNA, 882 bp, Pseudomonas aeruginosa
tcgaacgctggttgcgggtcgacgccacccagggccgctgagcgggtgctttccgatgcctgcggggcggctataatcgccgccccgttttcccgctgccgctcgcatcgtgtccgaaaccttcccgttcctcactggcgacgccctgtcgcagcgcttcctcgcgctggacgcgttcctcctcgaacaccagcggctctggcgaccccgcccgttcagcgaaccgaccctggcgtgggaagccgaacacgccgagctggcgtcctggctgcgcgggcgcagcctcgaacaggccgacgcggagcacaaccagcccacccgcctggccgcgcccgcgccttatccgcagctcgccgcccaagccgcggcgctgggcgcggtcggcgaactgccattggcggaacgcccgcaggcaccgaaccgcttcaacgtcgacgtaccgggacgcaagtggcagcagatcggcctgttcgccgggcgcctgcagttcgcccggccggtcgtccactggctcgactggtgctccggcaagggccatctgggccgcctgctggcccatgcggggcaaccgctgacctgcctcgaacacgatcccgcgctggtcgccgacggacagcgcctgagcgaccgcctggggctctccgcccaccacctccgccaggatgtgctggccgcggactgcgccgagcgcctgcttcccgggcatacgccagtggccctgcacgcttgcggcgaactacacctgcgcctgctgcgcctggccagccaggccggctgtcgccaactggcggtggcgccatgctgctacaaccgcattccggggcctttctaccagccactctcgcaagcagcaggccgatcgctgctcgcgctatcgcttga

SEQ ID NO: 6793 - DNA, 528 bp, Pseudomonas aeruginosa
tcgctgcctaggcagtattattttgaaacactttccctgcctagacagcgatcccccatgggtcactacagcgcttccgactttcccttcaagggctccattggccagctcatcggcgtcagtgccgcgaccaaggaccgcatcctcgagaagcacctcgccgcgctggacataaccgccgcccagttcaaggtgctgatcttcgtcggtctcaaccgtgccaacagtccggtcgaactgtgtcgcgagctgtcggtggacagcggctcgatgactcgcatgctggcgcgcctggagaaaaaagggctgctgctgcgtggtcgctgtcccgaagaccgccgttgcctgcgcctggatctcagcgaagcgggacggaaggtccaggagcagcttccgcttatcgcctcggcggcgatgaacgagctggtcgcctgcctgagcacggaagaattgcagacgctgacccatctgctgaccaaggttctgctacacgccggctgcccgcgggccagcctgcaggagtcctga

SEQ ID NO: 6794 - DNA, 1482 bp, Pseudomonas aeruginosa
tccatgccgttccctcttctccatccctggccgcagcgattggcgctggcctcggcgatagtgctggccgccggctgcgtcacttccgaaggcctggaaccgaacgcccgactgcaaccggcaggcgccctccaggcgggcaggagcctggacggcgtagccctttcgccagcggcctggccgcgccaggactggtggaccgggctcggcgaccggcagctcgaccaactgatcggcgaagccctgcaaggcacccccgacctgcagatcgccgaggcgcgtgcgcgccaggcggcggcaacggcccaggcgcaagatgccgcgcgccagccgacgctggacgccaaggccagctactccggcatccgcgcgccgaccagcgtggccccggcaccgctcggcggccgctattcggcgatcaagtacctgtcgctcggcttcaactacgacttcgacctctggggcggcgagcgcgccgcctgggaagccgccctcggccaggccaatgccgcccggatcgacagccaggccgcgcgcatcggcctctcggcgagcatcgcccgcgcctacagcgacctcgcccacgcctttaccgtgcgcgatctcgccgaggaagaactgaagcgctcgcagcgcatgaccgagctgagccagaagcgcatgagcgccgggctcgacagcaaggtccagctgcaacagacgcagacccagctggccaccgcccgccagcagctcagcgccgccgagcaggacatcgccagcgcccgcatcgccctcgccgtgctgctgggcaaggggcccgatcgcggtctcgaactgcagcgcccgcaaccgctgaacccggccagcctgagcctgccctcggtactcccggcggaactgctcggccgccgcgccgacatcgttgccgcgcgctggcgggtcgaggcggcgcgccgcaacatcgactcggcgaagaccgagttctatcccaacctcaatctcggcgcgatggccggcctcgccgccctgcacaccagcgacgtgttgcaggcgccgagccgcttcttccaggtggcgccggcgatctccctgccgatcttcgacggtggccgccgccgcgccaacctggccgaacgcgacgccgactacgacctggccgtcggccagtacaacaagacgctggtccaggccctcggcgaggtcagcgataacctcggcaagttgcgctccctggagcagcaggtgatcgaccagcgccaggcccgcgatatcgccaggtccaacttcgacctggccatgcgtcgctacggcgaaggcgtcggcagctacctcgacgccctcagcgtgcaacagcaactgctggtcgccgaacgccagctggccagcctggagagccagcagatcgatctttccgtccagctggtccaggccctgggcggcggtttccaacccgattcccgctccgctgcgctcgctaccgcgaaagcgccggcagaatga

SEQ ID NO: 6795 - DNA, 432 bp, Pseudomonas aeruginosa
tcgttctcgccaccctggccagcgtggcctgggagttcttctacggccgctggcacgaggacaccgacgacgcctacatcaacggcaacgtggtacagatcaccccgcagatcgtcggcaccgtggtcagcatcggcgccgacgacggcgacctggtgcgcaagggccaggaactggtcaggttcgatcccagcgacgccgacatcgccctccaacgcgccgaggccaacctggcccacaccgtgcgccaggtgcgcgggctgttcagcaacgtcgacggctatcgcgccgaggtcgccacccgcaaggtcgcgctggccaaggccgaggccgactacaagcggcgcaagaacctcgcagacgacggcgccatttcccaggaggaactggcccacgcccgcgacgccctggacagcgcgaaagcctcgctga

SEQ ID NO: 6796 - DNA, 411 bp, Pseudomonas aeruginosa
tggccgtggtcccgctggaccagatctggatcgacgccaacttcaaggaaacccagctcaagcacatgcgtatcggccagccggtggaaatccgctccgacctctacggcagcgacgtgcgctacagcggcaccgtcgacagcctcggcgtgggcaccggcagcgcgttctccctgctgccggcgcagaacgccaccggcaactggatcaagatcgtccagcgggtgccggtgcgcatccatattgatccgcaagaattgcagaagcatccgctgcgcatcggcctgtcgatggacgtcaaggtcgacctgcatgaccagagcggcccggccctggcccagcaaccaccgcgcgaagcgctgttctccaccgatgtctaccagcagcaactggcctcggccgacaagctga

SEQ ID NO: 6797 - DNA, 1587 bp, Pseudomonas aeruginosa
tcgaagccaacctcgccgaagaccacggcaagaccgcccagcgttgagcccgccagcatgagcgaaagcagcagcttctccccgcccagcctggtgatggcgaccatcggcctgtccctggcgactttcatgcaggtgctcgacaccaccatcgccaacgtcgccctgccgaccatctccggtaacctcggggtgagttcggaacagggcacctgggtgatcacctcgttcgccgtgagcaacgccatcgccctgccgctgaccggctggctggcccggcgggtcggcgaggtgcgcctgttcatcgccgccgcgctgctgttcgtactcgcctcgttcctctgcggcatcgcccagtcgatgccttctctggtcggcttccgcgccttgcagggcttcgtcgccgggccgctgtatccgatcacccagaccctgctgatctccatctacccaccggcgaagcgcggcatggccctggccctgctggcgatggtcacggtggtggcgccgatcgccgggccgatcctcggcggctggatcaccgacgactacagctggccgtggatcttcttcatcaacgtgccggtcggcctgttcgccgccttcgtcgtctaccagcaactgaaggcacgcccggtggtgatcaagaaggcgccgatggactacgtcggcctgatcgccctggtgatcggcgtcggcgccctgcagatcgtcctcgacaagggcaacgacctggactggttcgagtcgaacttcatcgtcggcggcgcgctgatcgcggcgatcgccctggccttcttcatcatctgggaattcaccgaccgccatccgatcgtcaacctgcgcctgttcgcccaccgcaacttcgccgccggcaccctggcgctggtgctgggctatgccgcgttcttcggcatcaacctgctgctcccgcaatggctacagacccagatgggctacaccgccacctgggccgggctggccgccgcgccaatcggcatcctcccggtgttcctctcgccgctggtcggccgctacgccaaccatttcgacctgcgcatgctcgccggcctgtcgttcctggcgatggccatcacctgcttcatgcgcgccaacttcaccaccgaggtcgactaccagcacatcgccatcgtgcagttgatcatggggctcggcgtggcgttcttcttcatgccgatcctgagcatcctgctctccgacctgccccccgaccagatcgccgatggctccggcctggccaccttcctgcgcaccctcggcggcagcttcgccgcctcgctgaccacctggatctggaaccgccgcgccacccaacaccacgcctacctcagcgaaaacatcagcctctacgacccggccacccacgaaaccctcgcccagctcggcggcaacacccaggcgaacgcggcgctgctcgaccggatggtgcagagccaggcctacatgatgtccaccatcgactacttcaccatgctcggctggctgttcctcgccctgctggtgatcatctggctggcccgcccgccgttcggcgccaagcccggcgcggccgcctccgggcactga

SEQ ID NO: 6798 - DNA, 285 bp, Pseudomonas aeruginosa
tgctgtctttgcatgtattcgtacgctccagtgagctgcgtttcgcccgctggaatgagttcgacctcaagagaggtatctgggagatacccgacactcgcccagccctcgacggcgtgcctttttccacaaggggtacaaagatggccggggatattcacgttgtacccttatcgccacaggcagtggccttgcttgagcagattcacgcgatcaccggcaagttcgacctggtgttcgcgggggatgccaaaccgtggaaaccgatgtccgaaaacacggtga

SEQ ID NO: 6799 - DNA, 1056 bp, Pseudomonas aeruginosa
tccctgataacactcaacattcttggcgggatgacgtggggcgaggatcggagagcggacgatgaggtgaccgacatggcattggtgggtaggcatgacggccgtaattttgggtacggcagacaattgagctacgcagggccgcaggcactgaaggacatgttcggcggcggtcattacggcacggtcaaggcgcacactgatcggtggcaggcattcgtgaagtggtgccgctccgaacaggggcccggtatcaatgatgcgcggcagattgatcggaaggtgctgtccgattatgcggcgcatctgcgcgaggtggttaggcgcggtgacctcgctatcagcaccgcacaaaatcggctatccagcgttaacaggaccatggcagcgcttcgcggtgatcagtacgtgaagttgcccagcccgagcaaggcgttgggtatgcagcgcaccggggttcgccactcggtacctcagggccaagaccgcgaacaggttaagcagatcgttgatgctctttgcgaccaacaacaactacgggccgccgcgatcgttctgctggcgcgagccaccggcatgcgcctgcgtgaggccgttttggctgacctgccacggttaaatcgtgaggctcgagacattggcaagatcaacattcaggatggcaccaaaggcggccgagctggcgcctcagcgccacgatggattgcggtggaccaccatattcaagacgcacttgggtttgcacggcaggtgtcgcctgcgagtagccgcaacctgattgcgccagatgaaagctatctgaatgtcctgcaggaaatcatccgcccagcgcgagacgtcctgcatgcatacaacctcaaaggcttccatgagctacgagcggcgtacgcatgtgagcgctatgagcaaatcacccaacaccgcgcgcctatcaacggcagtcaatgttgccaggtagataggaatcttgaccgtgaggcccgaaggcaaatcagctatgagctggggcacggtcgcattgacgtagttgccgcgtacattggaggtcggtcatga

SEQ ID NO: 6800 - DNA, 405 bp, Pseudomonas aeruginosa
tccacaacgccctggccggcaagccgctgccgatctacggcgacggccagcagatccgagactggctctacgtcaaggaccattgcagcgccatccgccgggtcctcgaagccgggcaactgggcgagacctacaatgtcggcggctggaacgaaaaggccaacctcgacgtggtcgagaccctctgcgccatcctcgaccaggagcagccgcgcgccgacggccgcagctatcgcgagcagatcaccttcgtcaaggatcgtccgggccatgatcgccgctacgccatcgatgccacgcgcctggagcgcgagctgggctggaagccggcggaaaccttcgagaccggcatccgcaagaccgtgcgctggtacctggacaaccaggactgggtggccaacgtaa

SEQ ID NO: 6801 - DNA, 1695 bp, Pseudomonas aeruginosa
ccgtcggcgcgccgatctcgccgaccccgaaggcctggcgcgactggttcgcgccgagcggccgcagttcatcgtcaacgccggtgcctacaccgcggtggacaaggccgagagcgatgccgacaacgcccgcctgatcaatgcccgcgccgtcgcggtactggccgaggaggccgcgggctgcggcgcctggctggtgcattactccaccgactacgtgttcgacggcgcgggcagcgtgcctttcgccgaggacgcgccgaccggcccgctgagcgtctacgggcagaccaagctggaaggcgagcaggccatccgcgccagcggctgccgccacctgatcttccgcaccagctgggtctacgccgcgcgcggcggaaacttcgccaagaccatgctgcgcctggccgggcaacgcgacgaactcaaggtcgtggccgaccagttcggcgcgcccaccagcgccgagctgatcgccgacgtcaccgcccaggccctgcagcgcctgcgctgggatgtcgagctggcagcacgggccagcggcacctaccacctggtcgccagcggcgagacgtcctggcacctctatgcgcgcttcgtcatcgaacaggcgctggagcggggctgggagttgcaggcgacgccgcagcgggtcctgccgatcgccaccgaggactacccggtgccggcgaagcgtccggccaattcgcgcctcgacaaccgcaagctgcaacaggtcttcggcctggtactgccagactggcgctaccatgccggacgcatgatccaggaactgagcgagcagggaccactatgaaacgcaagggcatcatcctcgccggaggctcgggcacccgcctgcacccggcaacgctggccatctccaagcagttgctgccggtgtacgacaagccgatgatctactacccgctcagtaccctgatgctggcgggcatccgcgagatactgatcatctcgaccccacaggacaccccacgcttccagcagttgctgggcgacggttcgaactggggcctggacctgcaatatgccgtgcaaccgtcgccggacggcctggcccaggccttcctgatcggcgagtcgttcatcggcaacgacctcagcgcgctggtcctgggcgacaacctctattacggccacgacttccacgagttgctcggcagcgcttcgcagcgccagaccggcgccagcgtcttcgcctaccacgtgctggacccggagcgctacggcgtggtcgagttcgaccagggcggcaaggccatcagcctggaagagaagccactggagccgaagtcgaactacgcggtcaccggcctgtatttctacgaccagcaggtggtggacatcgccagggacctgaagccttcgccgcgcggcgagctggagatcaccgacgtcaaccgcgcctatctggagcgcggccagctcagcgtggagatcatgggccgcggctacgcctggctggataccggcacccacgattcgctgctcgaggccggccagttcatcgccaccctggagaaccgccagggtctcaaggtggcctgcccggaagagatcgcctaccggcagaagtggatcgacgccgcgcaactggaaaaactcgccgcgccgctggccaagaacggctacggccaatacctcaagcgcctgctgaccgagaccgtgtactga

SEQ ID NO: 6802 - DNA, 1857 bp, Pseudomonas aeruginosa
agatcgactggccgctgcaggatgcccccctgctttcggagaaggaccgccagggcaaggcattcgccgacgccgactgcttcccctgaacggcagggagcgaccggactcggcgcaaggcgtgataatttagggcatcccgtccgggatgccccggatactcgcagccacggcaggttcgttcgtcttgaaagcctatttccatcgctggcgctcgctggtcatcctcgccctgcttctcgcgccgctgctctggcccctgcaatatttcgccgagcgctactacagcgagcagttggccgagcagaaccgccagacgctcgacctctacgtcgccaacctgctcggcacgctgcgccgctacgaagaactgccgcagatcctcggcggcctgccggtgctgcgccaggccctgcaacaacctggcgacccgctgctgcagaagatcgccaacgaggcgctggccgacatccgccgacgcaccggcgccgacgtgatctacctgctgcaaccggacggcactacccaggtcgcctccaactgggcccaggcggacagtttcgtccaccgcaacttcgccttccgcccctattatcgcgaggccatgcagggccgcctggcgcgcttcttcggcctgggcaccacctcgatcaagcgcggctactacttcgccagtgcggtgaaggaaggctcgcggatcatcggcgtgctggtggtgaaggtcgatctcgaacacatcgaacggctctggggcaattccccggagcaactgctggtgatagacaactacggcgtggtgatcctctcctcccgcgaggattggcgcttccatgccagtcggccgctgagcgcggcggagcgcgacgagatccacgccaacatcccctacccggtgcaggacccgaagcccctgcgcctgcagcagagcgcctggctcagccagagccggacgctaccggaaaccggctggacggtgagcatctacgccccccgcaccctcatcgaacggccggtgcgcagcgtcctgctgatcggcggcgcgaccctgctcgccctgctcctgctgcttaccctgctgaccctcagccgccgtcactacctggaccgcatcgctctcgaggccgaggccaagcgccagttggaagagcgcgtactggaacgcacccgcgagctggagaacgccaacgcgcagttgcagcaggaagtccacgaacgcgagcaggcccagcgcgagctgatgcgcgcccaggacgaagtggtccaggccggcaagctcacggccctcggcaccatgtcggcgagcatcagccacgaactcaaccagccgctggcggcgatccgcagctacgccgacaacgcccgggtgctgctcgaccaccagcgcaccgaggacgcccgcggcaatctcgagcagatcagcgacctcaccacccgcatggcctcgatcatcgcccacctcaaggcctatgcccgcggtgcgcgccgggcgccggagaacgtgcagttgcagccggcgatcgaggacgccctgtcgatggtggccagccggcggcgggcgatgaacgtcgaactgctgcgcgacgtgccggacgccccgctgtgggtccaggccggcgagacccgcttgcggcagatcctcggcaacctgctcaccaatgccctcgacgcgctcgccgagaaagctccgccgcggcgcctgtgggtaatcgccagccaggaccagcacggcgtgaccctgaccctgcgcgacaacggcccggggttttccgaggacgccctggcccacgcccacgaaccctttttcaccaccaagaccaccgccaaagggctcggcctcggcctggccatctgcgataa

SEQ ID NO: 6803 - DNA, 1515 bp, Pseudomonas aeruginosa
cctattgcgcgccctcggcggccgcctggaaatgggcaaccatctcgaaggcggcgccgtggtgcgcctgcacttgctgccgggagttcccggcgtcgccgccatgccccaggaggaaacccgcgcatgagtcccttcgcgccattcgatgcccagacccaggtcctgctgatcgacgacgatccgcacctgcgccaggccctgcgccagacgctcgacctcgccgggctcaaggtcgcgaccctggacgacgcgcgccagttggataccgcgcagtgcaaggactggcccggggtggtggtcagcgacatccgcatgcccggcatcgatggcatggaactgctccgccaattgcacgaacaggacgccgacctgccggtgatcctgatcaccggccacggcgacgtgccgctggcggtccaggccatgcgcggcggcgcctatgacttcctggaaaagcccttccccagcgacgccctgctcgacagcgtgcgccgcgccctggaggtgcgccggctggtcctggagaaccgcaccctgcgcctggccctggccgaacgccacgagctgcatgggcgcctgatcggacgctcggccggcatgcagcgcctgcgcgagcaggtcggctcgctggcggcgatccaggccgacgtgctggtccttggcgaaaccggcgccggcaaggaggtggtcgcgcgggccctgcatgacctgtcgagccgacgtgacggaccgttcgtcgcgatcaacgccggcgccctcgccgaatcggtggtggaaagcgaactgttcggtcacgaggccggcgccttcaccggcgcgcagaagcgccgcatcggcaagttcgagtacgccaatggcggcaccctgttcctcgacgagatcgagagcatgagcctggacgtgcaggtcaagctgttgcgcctgctacaggaacgggtagtcgagcggctcggctccaaccagttgatcccgctggatatccgcatcatcgcggcaaccaaggaagacctgcgccaggccgccgaccagggccgcttccgcgccgacctctattaccgcctcaacgtcgccagcctgcgcattccaccgctgcgcgagcgcggcgaagacatcccgctgctgttccgccatttcgccgaagccggcgccatgcgtcatggcctgacgccacgcgaactggacgccggccagtcggcgcggctgctggcctacgactggccgggcaacgtgcgcgaattgcagaacgccgccgagcgcttcgccctgggtctcggcctgagcctggacgacggagtcctgcccgacgccgccgacgagccgcacaacctcagcgccaaggtcgaggccttcgagcgctcgctgatcgctgccgaactggaacgcccgcacaattcgctgcgcagcgtcgccgaggccctcggtatcccgcgcaagaccctgcacgacaagctgcgcaagcacggcctgccgttcaacacgcctggcgaaaatccgccagatgatggcgaatga

SEQ ID NO: 6804 - DNA, 1236 bp, Pseudomonas aeruginosa
atggcggattaccgccaaccgttcgccatccgcgcccgcagcatctcccctgcgtacccttgcccgactggcacagggcttgctcacggcttcccgagcgttccaacaagcagaagaccaggcgcttttccgattcacgcagcatctgccgctgcgctgcctagacttcccttgttcggccacgccgagaggacacccgtcctcttcataaaagacagacaagaacaaagaggaagtctcatgctcaagcacaccgcgaaggcgctcgtctgcgcactttccctgaccgtcgccggaatcgtccaggcggccgacccgatcgtcatcaagttctcccacgtcgtcgccgagcacacgcccaagggccagggcgcgctgctgttcaagaaactggtggaggaacgcctgccgggcaaggtcaaggtggaggtctacccgaactcgtcgctgttcggcgacggcaaggagatggaagccctgctgctgggcgacgtgcagatcatcgcgccgtcgctggccaagttcgagcagtacaccaagaaattgcagatcttcgacctgccgttcctgttcgacaacatccaggcggtcgaccgcttccagcagagcccgcagggcaaggagctgctgacctcgatgcaggacaagggcatcactggcctcggctactggcacaacgggatgaagcagttgtccgccaacaagcccctgcgcgagccgaaggacgcccgcggcctgaagttccgcgtgcaggcctccaaggtgctcgaggaacagttcaaggcggtgcgcgccaacccgcgcaagatgagcttcgccgaggtctatcagggcctgcagaccggcgtggtcaacggtaccgagaacccctggtcgaacatctactcgcagaagatgcacgaagtgcagaagtacatcaccgagtccgaccacggcgtgctggactacatggtgatcaccaacaccaagttctggaacggcctgccggaagacgtgcgcggcgtgctggccaagaccatggacgaggtcaccgtggaggtgaacaagcaggccgaggcgctcaaccagggcgacaagcagcgcatcgtcgaggccaagaccagcgagatcatcgaactcactcccgaacagcgggccgaatggcgcaaggccatgcagccggtgtggaagaagttcgaaggcgagatcggcgccgacctgatcaaggccgccgaagccgccaaccaggcccaataa

SEQ ID NO: 6805 - DNA, 648 bp, Pseudomonas aeruginosa
gaagagggaaagcccatgcacgcgctcgcgcgcgtctgggcgcgcctggaggaaggcctgatcgccttcctcctcgccgccatgacgctggttaccttcgtttatgtagtcctcaataacctctatacgctgctctacgatctcgccgatctctgggagggcggcaacgagacgctgctcgccatcggcgatggggtcctcaccctggcccaggagatgacctggagcaacgccctgaccaaggccctgttcgcctggctgatcttcctcggcatcgcctacggcgtacgcaccgccgggcacctcggcgtggacgtgctggtgaagctggcctcgcgaccggtacagcgcgtgctcggcgtgatcgcctgcctggcctgcctcggctacgccggcctgctctgcgtggccagctatgactgggtgaagaccctgttcatcgccggcatcggcgccgaggacctcgaccacttcggcatccgccaatggcacatcggcctgatcgtgccggtcggcttcgccctggtgttcatccgtttcgccgagatcctcgtgcgcatcctgcgcaaccgccagaccggactgggactggccgacgaggctgccgacgcgctgaagctgaccgagcacgaggagcccaaggcatga

SEQ ID NO: 6806 - DNA, 1125 bp, Pseudomonas aeruginosa
cctgcccgatcatccgcgacccgatcgactactgacagacaacccgctctcgagctgaacggcggcgtccccagggagggcgccgcccaccgacttcccacaaggagatcaatcatggctttcaacatgcacaaccgtaacctgctcagcctgatgcaccacagcacccgcgagctgcgttacctgctcgacctgtcccgcgacctcaagcgcgccaagtacaccggcaccgagcagcagcacctgaagcgcaagaacattgccctgatcttcgagaaaacctccactcgcacccgctgcgccttcgaggtggccgcctacgaccagggcgccaacgtcacctacatcgacccgaactcctcgcagatcggccacaaggagagcatgaaggacaccgcgcgggttctcggccggatgtacgacgccatcgagtaccgcggcttcaagcaggaaatcgtcgaggaactcgcgaagttcgccggcgttccggtgttcaacggcctgaccgacgaataccacccgacccagatgctcgccgacgtgctgaccatgcgcgagcacagcgacaagccgctgcacgacatcagctacgcctacctgggcgacgcgcgcaacaacatgggtaactccctgctgctgatcggcgccaagctcggcatggacgtacgcatcgccgcgccgaaggcgctctggccgcacgacgagttcgtcgcccagtgcaagaagttcgccgaggaaagcggcgccaagctgaccctcaccgaggatccgaaggaagccgtgaagggcgtggacttcgtccacaccgacgtctgggtatcgatgggcgagccggtggaagcctggggcgagcggatcaaggaactgctgccctaccaggtcaacatggagatcatgaaggccaccggcaacccgcgggccaagttcatgcactgcctgccggcgttccacaacagcgagaccaaggtcggcaagcagatcgccgagcagtatccgaacctggccaacggcatcgaggtgaccgaggacgtcttcgagtcgccctacaacatcgccttcgagcaggccgagaaccgcatgcataccatcaaggcgatcctcgtctcgaccctcgccgacatctga

SEQ ID NO: 6807 - DNA, 993 bp, Pseudomonas aeruginosa
ccgcgctcctgcgccccggcccacgcggccgggcgcagccgccttccggaggtaaccgatatgcgtatcgtcgtcgcattgggcggtaatgccctgctacgccgtggcgaacccatgaccgcggacaaccagcgggaaaacgtgcggatcgccgccgaacagatcgccaaggtggcgcccggcaacgagctggtgatcgcccacggcaacggcccccaggtcggcctgctggccctccagggtgccgcctacgacaaggtctcgccctacccgctggacgtcctcggcgcggaaaccgagggcatgatcggctacatgatcgaacaggaaatgggcaacctgctgccgttcgaagtgccgttcgctaccatcctcacccaggtcgaggtggacggtaaggatccggcgttccagaacccgaccaagccgatcggcccggtctactccagggaagaagccgagcgcctggccgccgagaagggctggagcatcgccccggacggcgacaagttccgccgcgtggtgcccagcccgcggccgaagcggatcttcgagatccgcccggtgaagtggctgctggagaaaggcaccatcgtcatctgcgctggcggcggcggtatcccgaccatgtacgacgaggccgggaagaagctcagcggcgtcgaggcggtgatcgacaaggacctctgctcctcgctgctggcccaggagctggtggccgacatcctgatcatcgccaccgacgtcgacgcggcctacgtcgactggggcaagccgacccagaaggccatcgcccaggcccacccggacgaactggagcgcctcggcttcgccgccggctccatgggaccgaaggtccaggccgccatcgagttcgcccgcgccaccggcaaggacgcggtgatcggttcgctcgcggacatcgtcgcgatcaccgagggcaaggcgggaacgcgagtcagcacgcgcaaggcgggcatcgagtaccgctga

SEQ ID NO: 6808 - DNA, 1836 bp, Pseudomonas aeruginosa
ttccttccaccacggcttccgtcgcatggtcatcgaatcgatggacccgcaggcgcgccaggaaaccctagccggcctggcggtcatgatgaaactggtcaaggccgaaggcggccgctacctggccgaagacggcacgccgctgtccccggaggacatcgagcggcgctacgccgaacgcatcttcgcctctaccctggtgcggcgcatcgaaccgcagtacctcgacccggatgccgtccactggcacaaggtcctcgagctgtcccctgccgaaggccagacgctgaccttcaaggcctcgcccaagcaactgcccgagccgctgccggccaactggtcgatcgctcccgcggaggacggcgaggtactggtgagcatccacgagcgctgcgagttcaaggtcgacagctaccgtgcgctgacggtgaagtccgctggccagctgcccaccggtttcgaaccaggcgagctgtacaactcgcgcttccacccgcgcggcctgcagatgtcggtggtcgccgcgaccgacgcgatccgctccaccggcatcgactggaagaccatcgtcgacaacgtccagcccgacgagatcgcggtgttctccggcagcatcatgagccagctcgacgacaacggtttcggcggcctgatgcaatcccgcctgaagggccaccgggtctcggccaagcaactgccgctgggcttcaacagcatgcccaccgatttcatcaatgcctacgtgctcggcagcgtcggcatgaccggcagcatcacaggcgcctgcgccaccttcctctacaacctgcagaagggtatcgacgtcatcaccagcggccaggcccgggtggtcatcgtcggcaacagcgaggcgccgatcctgccggagtgcatcgagggctacagtgccatgggcgcactggccaccgaagaaggcctgcgcctgatcgaaggccgcgacgacgtggacttccgccgcgccagccggccgttcggcgagaactgcggcttcaccctggccgagtccagccaatacgtagtgctgatggacgacgaactggccctgcgcctgggcgcggatatccacggcgcggtaaccgacgtgttcatcaacgccgacggtttcaagaagtccatctccgcccccggcccgggcaactacctgacggtagccaaggcggtggccagcgcggtgcagatcgtcggcctggacaccgtgcgccacgccagcttcgtccacgcccacggctccagcacgccggccaaccgggtcaccgaatcggaaatcctcgaccgcgtggccagcgccttcggcatcgacggctggccggtcaccgcggtgaaggcctacgtcggccactccctggccaccgccagcgccgatcaactgatttccgccctgggcaccttcaagtacggcatcctccctgggatcaagaccatcgacaaggtcgccgacgacgtccaccagcagcgcctgagcatctccaatcgcgacatgcgccaggacaagccgctggaggtgtgcttcatcaactccaagggcttcggcggcaacaacgccagcggcgtggtgctgtcgccgcgaatcgccgagaagatgctgcgcaagcgccatggccaagcggccttcgccgcctacgtcgagaagcgcgagcagacccgcgccaccgcccgcgcctacgaccagcgcgcgctgcagggcgacctggagatcatctacaacttcggccaggacctgatcgacgaacatgccatcgaggtcagcgccgaacaggtgacggtgcccggcttcagccagccgctggtatacaagaaggacgcgcgtttcagtga

SEQ ID NO: 6809 - DNA, 402 bp, Pseudomonas aeruginosa
cagcggccgctcaccggcacgccgaccaggccgaacagcacccggccatcctcgaccagggccacgttgacggtgaactcctcgctaccggagatgaactccttggtgccgtccagcgggtccaccagccaccagcgccgccagtggccgcgctcgctcagcggtatctcgcaatcctcttcggaaagcaccggaatgtccggcgccagcgcccgcaatcccgcctccaatatatggtgcgcggccaggtcggcggcagtcaccggcgattcgtcggccttcgagcgcaccgccacgtcggcgcgccagtgcggcaggatcgcctcgccggcgcgccgcaccagcgccaccaattcgccccaaggcaccggcctcatgcctggtactcgccgcgctgggtga

SEQ ID NO: 6810 - DNA, 783 bp, Pseudomonas aeruginosa
ctccttggcgaagccggcgggttatcataccccggcttttccgattatccctgtcggagattgatgggaagcgacagatttccgcatcgatcgcgacgaaccgcgacaagagccgccatgcccaccctgccctggtccgccatcgacaccgtgctgctcgacatggacggcaccctgctcgacctgcacttcgacaaccacttctggctggaacacctgccccagcgctatgccgaacgcaacggcctgagtcgcaccgaagccgacgccgtgctcgagccgctgttccgcgaacacgccggccagctcaactggtactgcctggatttctggagccgggaactggacctgtcgatccgcgaactcaagcacgaggtggcgcacctgatctcgctgcgtccgcacgccgataccttcctcgccgccctgcgccgggccggcaagcgcgtggcgctgatcaccaacgcgcaccgcgactcgctgtcgctgaagctggaacggatcgaactggcgccctatttcgaccgactgatcagctcccacgactacggctacccgaaggaggacgcgcgcttctggagcgccctgcaagccgatttcggcttcgacccgcagcgcagcctgttcatcgacgacagcctgccgatcctgcgcagcgcccgcgcctatggtgtcgcccacctgttggcggtacgccacccggacagccgtggccaggtccgggacaccgaggagttcgccgcccaggaggactaccggcggctgctcgaaggactgccgtag

SEQ ID NO: 6811 - DNA, 429 bp, Pseudomonas aeruginosa
tggcctcgcccgaggacatggaggatttcgtccgcggtttcagcctcagcagcggcttcgtggagtccatcgacgacatctatgaaatccgcgtcagcggccagggcgaatccctccacgccgaggtcgaaatcagcagccgcgcgttctggaacctcaagcgccaacgccggcaactggccggcacttccggctgcggcctgtgcggcgtcgaagccctggagcaggccctgccgcaactgccggaacggtcgccgcaggcgctgcctcccgccgcccatctcggcgccctgcgccagcgtatcgagcaggcccagcgactggcgcgccatagcggcgccctgcatgccgcgctgtatttcgacgggcatggcgagctgcgcctgtgtcgcgaggacatcggccgccacaacgccctcgacaagctga

SEQ ID NO: 6812 - DNA, 2391 bp, Pseudomonas aeruginosa
tccaccagccccatcacaacgccccgcgggtctacagcccggcgccggccgcaaccgagtgagtccgccatgagcctgcaacctctccaaccccgctacaagccctatgccggcgccgccgccggctggggcgcgctgcgcagcgtggcgcacttctggctggacagcaaacagccgttcaagaacctccgcgccctgctcaagaccaaccagaacggcggtttcgactgccccggctgcgcctggggcgactcgccggaagacggccgggtgaagttctgcgagaacggtgccaaggcagtcaactgggaagccaccaagcgccgcgtcgacgcggcgttcttcgcccgctacagcgtcagcgccctgcgcgaacagagcgactactggctggaataccagggccgcctcaccggaccgatgcgctacgacccgctcagcgaccactaccagccgatcacctgggacgccgccttcgccctggtcgccgagcacctgcgacgcctggatagccccgaccaggcggagttctatacctccgggcgggccagcaacgaggcggcctacctctaccagttgttcgtccgcgcgttcggcacaaacaacttccccgactgctcgaacatgtgccacgaagccagcggcgtggcactgggccgcagcgtcggggtcggcaagggcagcgtgaccttcggcgacttcgaacacgccgacgcgatcttcatccttgggcagaaccccggcaccaaccacccgcgcatgctcgagccgctgcgcgaggcagtgaagcgcggtgcccaggtggtctgcttcaaccctctcaaggagcgcggcctggagcgcttccagcatccgcagaacgcgctggaaatgctgactaacgggtcctcgccgctgaacaccgcgttcttccgtccggcactgggcggcgacatggcggcgatccgcgggatcgccaagttcctcctcgcctgggagcgcgaagcccaggccgagggtagcgagccggtattcgaccacgccttcatcgccgagcacaccgacggcctcgaggcctacctggccgaactggatgccaccccctgggaacacctggagcgccagtccgggctgggcctggcggaaatcgagcaggctgcgcggatgtaccggcgggcgaacagggtcatcgtctgctgggcgatgggcatcacccagcaccaccattcggtggcgatcatccaggaaatcgtcaacctgcaactcctgcgcggcaacctgggccgcccgggcgccggtctctgcccggtccgcggccacagcaacgtgcagggtgaccgcaccatgggcatcaacgagcggccgccggcggcgctgctcgacgcactggaacggcgcttcggcttcgaagtgccacgccacaatgggcacaacgccgtcgaggcgatcgccgcgatgctcgccggcaagtcgaaggtcttcatcggcctgggcggcaatttcgcccaggccaccccggacagtccgcgcacccacgccgccctggcgtcatgcgacctgaccgtgcacatcagcaccaagctcaaccgcagccacctgaccaccggccgcgacgcactgatcctgccctgcctggggcgcaccgacatcgaccgccaggccggaggcccgcaggcggtcacggtggaagactcgttcagcatgatccacgcatcctacgggcaactggagccgctctcgcagcagatgcgttcggagccggcgatcatcgccggcatcgccaaggcaaccctgggcaaccatccggtggactgggacgcgctgatcgccaactacgagcgcatccgcgagctgatcgccgacaccatccccggtttcgccgacttcaaccgccgcgtccgccatcccggtggcttctacctcggcaactccgccggcgaacgacgctggaacaccgccagcggcaaggccaacttcgtcgccaacccgctgccccgcgacctgttgccggcacaggtgcgcgacagcggcctcgaacccgacctgatcctgcagaccctgcgctcccatgaccagtacaacaccaccatctacggcctggacgatcgctatcgcggagtgaagggccagcgcgaagtggtattcgccaacgaggcggatatccgccgcctgggctaccagccgggcgacaaggtcgacctggtctcgctgtggagcgatggcatcgaacgccgggtacgccgcttcaccctgctcgccttcgacatcccggccggccaggcagccgcctactacccggaaaccaatcccctggtgccgctggagagcgtcggcgtcggcagccatacgccgacttcgaagttcatcgcggtacgcctggaaaaggccacgggcgacgggcgcattatctga

SEQ ID NO: 6813 - DNA, 933 bp, Pseudomonas aeruginosa
ctctcgatcgcatgcaccatcgcgtcgataccggtcgccgcggtgaccgccggcggcaagccgagggtcaggtcggcgtcgagcagcgccaggtcgggcagcaagtggggcgagaccacgcccaccttggtggtctcgccggtggtgacgatggcgatcggcgtcacctcggagccggtcccggcggtggtcggcacctggatcagcggcaggcgcggcccgcgtgcgttgccgaccccgaagacctcgccgagcccctgccctgcttctgggtgggcgagcagcgcgaccagcttggctacgtccatggagctgccgccgccgaaaccgaccaccagctcggcagccatgccccgcgcccgcccgagcgcggcctcgaccaccgactcgggcggatcggcgagcacctggtcgtacacctcgacggccaggcccaggcgcgggaagccgggcaggatcgcatccagcaagccgagccgggtgatccccgggtcggtcacgatcaacacgcggcgcgcccttcgctcgcggcagagttccgccaggcggatggcggagccggcctcgcagaggatctgcgcggtagtggcgaaactgaaagcttgcatatcggtctccttgggcgagacgcccgtcagaacgagaaatgctcctcgggcagggccatcaggcagtcggcgccaccgagcaaggcttcgcggtgcatgctcgcccgcggcaggatgcgccgcaggtagaaatcggcgctgcgcagcttggcccgatagaaatcgccctcgccggagccgccgtccagcgcttcctgggctcgcgccgcggcttgcaaccagagggccgcgagcaatacgtaggcgctgtactggaggaagtccaccgaagtggcgccgatctcctggggatcgcgggcgcaggcctcgagtacctggccggtga

SEQ ID NO: 6814 - DNA, 963 bp, Pseudomonas aeruginosa
gggaaggtcgtactatttttgaaatttagtcttgtgatagctggaattcaggcagtgaatatccaaaccttcgacctcaacctgctacgcgtccttgacgcgctgctgcgcgaacgcaacgtctcgcgcgcggcggagcgcctggcgctgagccagccggcagtaagcaatgcgctgaaccgcctgcgcgagctgctcgacgacccgctgctggtccgcgccggtcgtgcgatgcagccgacgccccgggcgctggcgctggaagcgccgatccgcgcggcgctgcggcagatcgaacagagcctgggcgacggcgagggcttcgatccggggcgcagccggcagcgcttcaccgtagcggtgaccgactacgtcgaactgatctgcatgcccgccctgatgcgccgcctgagtgagcgggcgccgggaatctccatcgccatccagcacctgaccccgaccttgccggccgaggcgctggacaaaggcgaactggacctggtgctaggccgcttcgaaaacgtcccggcgcgcttccagcgccgccattgggccagcgagaccctgcaactggtcgcccggcgtcagcacccgctgctggcgcaggctcccgacctggccaccttcctggagctgcagcacctgtgggtgcacggcgggcagaccaaggggatggtcgaccagtggctgggcagccaggggctcaagcggcaagtggcctacaccacgccgaactacctgcaggcagcgcacatcgccgcgtacagcgacctggtcggcgtcctgccgcgacaactggcgcactacttcgaacgattgctgcccctgcaatcgttcgacctgccgttcgacctcggcccgttccacctggaactggtgtttctggcccagcgcgaacgcgacatcgccctgcaatggctggtcgaacagatccgccaggtcggggccgccggaccggactag

SEQ ID NO: 6815 - DNA, 1485 bp, Pseudomonas aeruginosa
cgcgcgcaggtgaagagggggacgtccagcggaacagggggacgccgagacgcctgccccgtggtccgcttagtagcgataggtgtccggcttgaacgggccttccacgctcacgccgatgtactcggcctgtttcggggtcagttgggtgaccacgccgccgaagcccttgaccatctccagggccacttcctcgtcgagcttcttcggcagcacttcgacgctcaggcgcttggccttctcggcggccggcaggtcggcgtacttctgctcgaacaggtggatctgcgccagcacctggttggcgaaggaaccgtccatgatccggctcggatggccggtggcgttgcccaggttgaccaggcggccttcggcgagaaggatcaggtagtcgtcgttgtgcgcgtcgaaaccgtccttgccggtgcggtggatcttgtgcacctgcggcttgacctcttcccaggcccagttcttgcgcatgaaggcggtgtcgatctcgttgtcgaagtggccgatgttgcagaccaccgcgcgcttcttcagcgccttgagcatgttggcgtcgcagacgttgacgttgccggtggtggtgacgatcaggtcgatcttgcccagcagcgcggcgtcgatgctggcctcggtgccgtcgttgatgccgttcttgtacggcgagacgacttcgaagccgtccatgcaggcctgcatggcgcagatcgggtcgacttccgcgaccttgacgatcatgccttcctggcgcagcgactgcgaggagcccttgcccacgtcgccgtagccgatcaccagggcctgcttgcccgacagcaggtggtcggtgccgcgcttgatggcgtcgttgaggctatggcggcagccgtacttgttgtcgttcttgctcttggtcaccgagtcgttgacgttgatcgccgggactttcagggcgccgttcttgagcatgtcgagcaggcggtggaccccggtggtggtctcttcggtgatgccgtggatgcgctcgagcatctgcgggtatttcttgtgcaggatctcggtcaggtcaccgccgtcgtccagcaccatgttggcgtcccacggctggccgtccttgaggatggtctgctcgatgcaccattcgtactcttcctcggtctcgcccttccaggcgaacaccgggatgccggcggcggcgatggcggcggcggcctggtcctgggtggagaagatgttgcagctcgaccagcggacttcggcgcccagcgcgaccagggtctcgatcagcacgccggtctggatggtcatgtggatgcaaccgaggatcttcgcgcctttcagcggctgctggccggcatacttgcggcgcaggcccatcagtgcgggcatttccgattcggcgatgatcagctcgcggcggccccaggcggccagggtgatgtcggcgaccttgtagtcggtgaaaccggcgggcgtcatgacagcgctcatgcgtaa

SEQ ID NO: 6816 - DNA, 717 bp, Pseudomonas aeruginosa
ctctccattcgttgtctgcgaatgggcgccgttggtgcgttgacagaccggcgaggccggcctgagagcgcgctccgttcgagcctgacaggcctaggcctgctgcagcgcccctcgaacggaaggcgggagcgacccgaagggccgcctgagcgggcgattatagcggcgccatatgaaactcccaagtcacccctgatacgccgctcgtcgccgtgcgtcgtgtcctcgggctgcggcgatgcaccgcagcgcagaagcgcggggaatttgcgggtcaggatgctagagtgcgcggtcatgagaatcgctcccaactcccgctcgccgctgctgcagtggctgagcttcgccctctgtgcctgcgtgctggtcaacgcgctggcttgcggcgtcctgcacctgcaggcgctgggagtgggcagcgacaaggggcagaaggccagcgtcgggctgttctgcgtcgccggtgccagccaatggctatccctggatcccgacgacgggtccgccggcgatccggcaccggtcaatccccagttgccgatgagctgcccgatgtgcagcgctctggtgctgttcgtcgcgctcggggtgatctggtcctggcgcttgcaacggcgacgccaggcgcgtttccgcccgcccgccacgcgcgagccggtgccgccccgatacgtctggccgccggccaacccgcgcgcttcccccgcctga

SEQ ID NO: 6817 - DNA, 435 bp, Pseudomonas aeruginosa
acgcctcggcgccgcccggcttcggcggcttcgtcacctaccgcggcttcagctcgaaccaggtcaaccagttgttcaacggcattccggtgcaatacagcagcgccatgcgtccgctggacgactggatcgtcgaccgcgtcgagctggtcggcggtccgtcctccttcctcaacggcgccggtgccgtcggcggctcgctggactacatcagcaagctcgccgaccgctacggcgatttcatggaaggccgggtgcgctacggcagctacgacgattcggaagtcgccttcggcttcaaccaggccctgggcatcggccccgagccgaagcacttcgtgcgcctggacgtcagccgcagcggcggcaacggctacgtcgaccgcaattcgcgcgaatcgtggaacgtcgctttctccctgctcagcgacctga

SEQ ID NO: 6818 - DNA, 501 bp, Pseudomonas aeruginosa
agatcgacaagagccgtcgccgcgagaactacaatgtcgccgatggccgctacgaacagcgcgtgcgctggctgcgctcgatcctcgaataccgggtcagcgacagcacgcgctggcgcaacaccttctaccactacgacgccgagcgcgattaccgcaacctcgagacctaccgctacaacgccgacaacagcggggtggtgcgctccaacgcattcctccagcgccacgaccagcagctcaacggcaaccgcttcgagctacagcacagccagccgctgttcggactggccagcgactgggcgctgggcttcgactacagcatcaacaagcagacgcgcttcccgagtaccgcctccgggccgttcggtacggtcgatccggccagtttcgagccgggccacttctacgacctgccgggcatgcgtcccggccaccggaaggaccgcagcaacgaggtgcgcaccagcgcgttgttcgccgagaaccgcctgggcctga

SEQ ID NO: 6819 - DNA, 1509 bp, Pseudomonas aeruginosa
gcgtgcagacgcgcttctgaggagtcgtcgatgaaacgctacctgtacctgtggcaccgctggctgggcatcggctgctgcctgctgatggtgctctggttcgtctccggcatggtcatgctgtatgtcggctatcccaagctgactccgctggaacgcctggcccacctgcccgagctggacggctgcgaggcctgcgtaccgctgcggacggccctcgccggcggcgatggaaagaccccgcggagcatccggctggccagcgtaggaggcctgccgacctacctgctggatgacgccgacggacgcacgcgtgcgctggcggcgcgcgacggccgaccgctggcggtggacgcggacagggtgctggcttcggcccgtgctttcagcggcgaagtaccgatgcagttgcaagggcggatcgaggaagacgcctggacccatacccgcaacctcgatccgcaccggccgctatggcgggtgcagaccgcggacgagcagggccggctgctctacctgtcctcgcagaccggcgaggtggtacgcgacgccagccgccgggagcgcgcctggaactggctcggcgcctggctgcactggctctatccgctgcgcggcggctggttcgacgggcagtgggcgaacctggtgatcggcctgtcgctgctggcgaccctggcgaccgtcctcggcatcctcgtcggcctgctccgctggcgcttccgcaagccttatcgcagcggctcgcgctcgccctatgcgggcggtttccagcgctggcaccacctcgccggcctgctcttcggcgcgctggtgctgagctggatcttcagcgggctgatgtcgatgaatccgtggaacctgttcggccgcggtacgccgctcgacctcgcggcctaccagggcggtagctgggaccgggcgctgcccgccggactggaggcggacgctgtcctgcggcgcttgcgtgccgccgggttgcgggtgcgcgagctggagtggcgggcgctcgacggcgagccctatgcgctcgggcgcagcgccagcggcaacagcctgctgctgacggcggatggcgaaatcctccgcgagctacccgcggatcgcctactggcggcggctcgcgcgctgctgccgggcgtgccgatgcaggccgaacgattggaacgctacgacttctattactacccgcgcgaagaacacagcatgatgggctacctggaacggcgcctgccggtctggcgcctgcgtttcgacgatccccggcatacctgggtgcacctggatccctacagcggcgcggtggttggcgtgctcgacgacggtcggcgcggcagccgctggctgttttccctgttgcatagctgggactggctgccgctgctgacccggcgtccgctgtgggacctgtggatgctcggtttcagcctcggcggcctggtggtctgcgccagcggctgctggatcggctggcgtcgcctgcgcggccgccgtccgaagcgtcgctga

SEQ ID NO: 6820 - DNA, 642 bp, Pseudomonas aeruginosa
attcgcagtaatggatcgcacatgggcacacacaagatcgagatccgccgccgcaacgtcgagaagattctcctggccgccgaaaaagtcttcgccgaaaaaggctacgccggcacctccatgggcaacatcgccgaagaagccgaactgccgcgctccaacctgcactactacttcagcaccaaggacgagctgtaccgcgacgtcctcctcggcctgctcgaggtctggaagcaggacgccctctgcttcgagatgttcgatgacccaagggtggtattgaccagctatatccgcgcgaagatgaaccactcgcgtacccgcccgcatggctccaaggtctgggccaacgaaatcatgcatggcgcgccgctgctcggcgccaccctcgacgacagcctctacgaatgggccaagatgaaggaggcgaagatccgccagtgggtcgaggaaaagcgcatcctgtcgatcgaaccgagcagcctgctctacatgatctgggcctccacccagcactacgccgacttcggctaccaggtcgaggtgctcaacggccaccagccgctcagcgacatgcagttcgaaagggcggtacagacggtgaccagcgtggtcctgcgcggaatcggattggagccctga

SEQ ID NO: 6821 - DNA, 1356 bp, Pseudomonas aeruginosa
gcagcggagccttcgctagaaggctccggcgaaggctcagctggcgcgggtgaagtccaccgcttccgcctgttcgaggaacaccgtggtctgcgccgggaccgtctcggcgagcagccgtccgccgcggatcgagtagcgcaccgggacctgccggcgcaccgcgtcgaagccgtcgcgggccggcagcaccagcaggttggccggatggccgacctcgatgccgtattcccgcaggccgagggtgcgggcgctgttgcgggtgatcaggtcgaggccgccgtcgatctcgtcgtagcccatcatctgcgtcacgtgcaggcccatgtgcagcacctgcagcatgttcgcggtgcccagcgggtaccaggggtcgaacacgtcgtcgtggccgaagcaggtgttgatcccggcaccgagcagttccttgacccgggtgatgccgcggcgcttcgggtagtcgtcgaagcgaccctgcaggtggatgttcaccagcgggttggcgacgaagttgattcccgacagtttcagcaggcggaacagccgcgaggtgtaggcgccgttgtaggagtgcatcgccgtggtgtggctggcggtgacccgtgcgccgaggccgtcgcgatgggcgagcatggccagggtctcgaggaagcgcgactgctcgtcgtcgatctcgtcgcaatgcacgtccaccggcaggtcgtagcgcttggccaggtcgatggccttgtgcagcgactcgacgcccagctcgcgggtgaattcgaaatgcgggatcgcccccaccacgtcggctcccaggcgcagcgactcctccagcagttccaggccgttggggtaggagagaatgccctcctgggggaaggcgacgatctgcaggtcgacccagggcgccacttcgccgcgcacctcgagcatggccttgagcgcggtgagggtcgggtcggagacgtcgacgtggctgcgcacgtgctgcacgccgttggcgatctgccatttcagggtctgccaggcgcgctgcttgacgtcctcgtggctgagcagggccttgcgctgggcccagcgctcgatgccttcgaacagcgtgccggagcggttccactccggctggccggcggtctgggtggtgtcgagatggatgtgcggctcgatgaacggcggcacggcaagaccgccggcgccgtccaggcgctcgccggcgtcgtcggcggcctgttccatcggcaccagggcggcgatacggccatcggcgacgcgcagttgccagagaccttcgcggccgcgcaggcgcaggttgtcaatcagcatggaggacctcttctggtttgttcgggctgcggctcagcaggggattga

SEQ ID NO: 6822 - DNA, 1488 bp, Pseudomonas aeruginosa
ccgtcatggccctcggcaaccgccagttccactggttctacgactacggctggttcaccggctcgctgctcggcggcgcgctctactacggcctctgcggccgccgtgcgcggagcccggcggcattggccaaaccgctgccctgatgggcatacaggcggccggcgagccgccgacacctactccaagcctgaggagacgacaatgagcactgcccggaacgtcctgcaatccacccagcgacacatcgatggccagcgcctctggcaatcgctgatggatctcgcccgcctcggcgccaccgccaagggtggggtctgccgcctggccctgagcgatctcgaccgccaggcccgcgatctcttcgtgcaatggtgcgaagcggccggctgcacggtcagcgtcgatcgggtcggcaacatcttcgcccgtcgtcccgggcgtaacccggacttgcccccggtgatgaccggtagccacatcgacacccagcccaccggtggcaagttcgacggctgcttcggggtgatggccggcctcgaggtgatccgcaccctcaacgacctcggggtggaaaccgaggcgccgctggaggtggtggtgtggaccaacgaggaaggctcgcgcttcgcgccctgcatgatgggctcgggcgtattcgccgggaagttcaccctggaggagaccctggccaagcgcgatgccgacggtgtcagcgtaggcgaggcgctggacgccatcggctacgcgggagcgcgcgattgtctcggacatccggtgggcgcctatttcgaggcgcacatcgaacaggggccgatcctcgaggacgaggagaagaccatcggcgtggtgctcggcgcgctcgggcagaaatggttcgacctgtccctgcgcggcgtcgaggcacacgccgggccaacgccgatgcacctgcgcaaggatgccctggtcggtgccgcggcggtggtcgaggcggtcaatcgcgcggccctcggccatcagccgcatgcttgcggcacggtcggctgcctgcacgcctatcccggttcgcgcaacgtgatacccggcgaagtgaagatgaccctggacttccgccatctgcaaccggagcgcctggactcgatgatcgccgaagtccgccaggtgatcgccgctacctgcgagaagcatggcttgcaatacgagctggtgccgaccgccgatttcccgccgctgtacttcgaccagggatgcgtcggcgcggtgcgcgaggcggcgcaggcgctgggcatgccgcagatggacatcgtcagcggcgccggccacgacgcgatcttcctcgccgaactcggtccggcggggatgatcttcgtgccctgcgagaacggcatcagccacaacgagatcgagaacgccagccccgacgacctggccgccggctgcgcggtgctgttgcgggccatgctcaaggcctccgaggcgatcgccggcggccgcctggcggcctga

SEQ ID NO: 6823 - DNA, 189 bp, Pseudomonas aeruginosa
aggtcgtcgcagccgccgacatgggtctcgccgatccagatctgcggcacggtggtcgatcccgccttgcgtgccagctcggcgcgcagttcgggcttgccgtcgcaggcgatctcctggaagtccacgcccttgcgttgcagcaactgcttggcgcggatgcagtacggacaccaggcggtggtgtag

SEQ ID NO: 6824 - DNA, 1590 bp, Pseudomonas aeruginosa
atttggtcagtttctgaaccccgcggaaatagagccggacatatgactgccacgcccaaacccctggtcctgatcatcctggacggcttcggccacagcgaaagccctgactacaacgccatctacgccgcgaagaagccggtctgggatcgcctcctggcaacccagccgcacggcctgatctcaggctccggcatggacgtcggcctgcccgacggccagatgggcaattccgaggtcggccacatgaacctcggcgcaggccgcgtggtgtaccaggacttcacccgcgtcaccaaggccatccgcgacggcgaattcttcgaaaacccggtgatcgccgcggcggtcgacaaggccgtcgccgccgacaaggcggtgcacatcctcggcctgctctccccgggcggcgtacacagccatgaagaccacctggtggcaatggcgcagatggccgccaagcgcggcgccggcaagatctacctgcatgccttcctggatggccgcgataccccgccgaaaagcgcgcagccgtcgctggagcgtctcgacgccaccttcgccgggctcggcaagggccgcatcgcctcgatcatcggccgctatttcgcgatggaccgcgacaaccgctgggaccgcgtccaggccgcctatgaactgattgtcgacggcaaggccgagttcaccgccgactcctcggtggcagccctcgaggccgcctacgcccgcggcgagagcgacgaattcgtcaaggccaccgcggtggtcccggccggcgccgaagcggtgcgggtcgaggatggcgacgcggtgatcttcatgaacttccgcgccgaccgcgcccgcgagctgagccgcgccttcgtcgagccggcattcaatgagttcccccgcgaacgagccccgcagctggcaggtttcgtcatgctgacccagtacgcggcgagcatcccggcgccctgcgccttcccgccggagccgctgaccaacgtcctcggcgagtacctggccaagcatggcaagacccagctgcgcatcgccgagaccgagaagtacgcccatgtgaccttcttcttctccggcggccgcgaggaaccctacgagggcgaggagcgcatcctgatcccctcgccgaaggtcgccacctacgacctgcaacccgagatgagcgcgccggaagtcaccgaccgtatcgtcgaggccatcgagcaacagcgctacgacgtgatcgtggtcaactacgccaacggcgacatggtcggccacaccggggtgttcgaggccgcggtcaaggccgtggagtgcctggacacctgcatgggccgtatcgtcgaggcgctggacaaggtcggcggcgaagccctgatcaccgccgaccacggcaatgtcgagcagatggaagacgagtccaccggccaggcgcacaccgcgcacacctgcgaaccggtgcccttcgtctacgtcggcaagcgcaagctgagcatccgcgaaggcggcgtgctggccgacgtggcgccgaccatgctgaccctcatggggctggagcagccggcggaaatgaccggtcgcagcatcgtcaccctcggctga

SEQ ID NO: 6825 - DNA, 1131 bp, Pseudomonas aeruginosa
tccgcgaacgacgaactcccgcgcagggcggataaccgcgtcgcggttatccgccgcttctgcaggccatcggcggagaacgcctgcgacgttatccgccgtagcgggccgggcgccgcgccctgtttccacgacgccaccttccccgctttaacgctgccgatcggccgacaggcctggccacgcggcgtcgagacgtgtgccgcggttttcattttccgcgtctcccccctgcctcccgctacgtcgccgaggcccgtgctagccttgcccgcgctgtcttttccatctgccctacaaggatttccgccgatgtggttcctcctcgccacctcgctcctcgccctgtccttccagcgcctgctggccctcgtcttgctgctcgcgacctgctgcctcgccttctacgacggggttctcgctccgcctgcggtcgccgccctggctgcactgggcgtcctcgccctgttgcgccggcgcctggcggcacgccgcgcctgggccctgggcctggagctgctgctggtcgccggcgcggtgggcctgttcctgcacctgctacccggcttcgccaaccccaggatcctggacaaggcggtggtcggcccgcagagcctgccgttcaccatgtacttcaacttcgacaaggcactggtgccgttcctgctactggcctgcctgccgagcctgttccgcgacgaagcccgcgctcccggccgcccctggtactggctgctgctcgtggcggcggtgccggcgctgcttctgctggctgtcggcgtcggcctgctgcggccggaactccacgcgccggcctggctctggcagttcatcctggccaacctgttcttcgtttcccttgccgaggaagcgctgttccgcggctacctgcagcaacgcctgggccaatggctgggcccctggcccgccctggcgctggcctcggcgctgttcggcctggcgcacttcgccggcggcccgctgctgatgctgttcgccggcctcgccgggctgatctacgggttggcctggctgtggagcggccgcctgtgggtggcgacgctgttccacttcgggctgaacctgacgcatctgctgctgttcacctacccgctctacagacccgcctga

SEQ ID NO: 6826 - DNA, 1284 bp, Pseudomonas aeruginosa
gagctgaacatgctgcattgcttccgtcccaccaccctggcgctggccctgctgctcggcgcgggcgcggcccagggtgccgacgccccggccgacgccgcgccattggccaacggtagcagtgccccgctgcccctggacgagctgcgtacgttcgccgaggttctcgaccgggtgaaggccgcctatgtcgagccagtggacgacaagaccctgctggagaacgccatcaagggcatgctcagcaacctcgacccgcactccgcctacctcggcccggaggacttcgccgagctgcaggaaagcaccagcggcgagttcggcggcctgggcatcgaggtcggcagcgaagacggcttcatcaaggtggtctcgccgatcgacgacacccccgcggcccgcgccggcatccagcccggcgacctgatcgtgcagatcgacggcaagccgaccaagggccagtcgatgaccgaagcggtcgacagcatgcgcggcaaggccggctccccgatcaccctgaccatcgtccgcgatggcggcagaccgttcgacgtcgaactcaagcgcgccatcatcaaggtcaagagtgtcaagagccaggtcctcgaacccggctacgcctacctgcgcatcacccagttccaggtcaacaccggcgaggaagtggtcaaggcgctgaaccagctgcgcaaggacaacaagggccgtctcaagggcctggtcctggacctgcgcaacaaccccggcggcgtgctgcagtccgccgtcgaggtagccgacgccttcctcaccaagggcctgatcgtctacaccaagggccgcatcgccaactccgagctgcgcttcagcgccgacccggccgatcccagcgacaaggttccgctggtggtgctgatcaacggtggcagcgcctcggcggcggaaatcgtcgccggtgccctgcaggaccagaagcgcgcgatcctgatgggcaccgacagcttcggcaagggctcggtgcagaccgtgctgccgctgaacaacgaccgcgccctgaagctcaccaccgcgctctactacacccccaacgggcgctccatccaggcccagggcatcgttccggacatcgaagtcggacgcgccaaggtgacccaggagcggagcagcttcgagggcttcaaggaagccgacctgcaggggccacctggccaacggcaacggcggcgccgaccgccccaccggcaagcgtgccgcgccgagcgagcgcccgcaggattccgactaccagctcagccaggcccttag

SEQ ID NO: 6827 - DNA, 1032 bp, Pseudomonas aeruginosa
acagccgcaccagcgccgccaccgtggccgccagcgaggcgcagcggatcggcctggcgagcgtctcgcgcgatgtgttcctcgacaacgaagccacaccggaagcggtctccgcacaactgcaggccggcgtcgccctggcccgcaagcagggttcggcgttgctcatcggccacccgcacaaggccaccctcgacgtgctggcgcgggagctgccgaagctgcgcgcccagggcatcgagctggtaccgccgcagatgctcatcggcgagcgcggcaaccgcaacgtcaacccacgccaggcgccgcactgaagccgggtttaccggcgtcgcggcagcggttaaggtgacgtcctcgtcattcctgcacggacgcaccgatggcccgcccttcccctcccatgcccctgctcgccgccgccctgctggtcgcaggcgcgattcccctcggtttcatctggatcctcaccagcgccaagttcgagataggcggcgccagccccggcgagagcaccgtcggcaaggtcgagaacatcgaccagcgcgccatggagcaattctgcaccggcgtgcgggcgacgcccgccggcacctggctggtaggccggcgcgaggtcggccgcgacgagcaggctctgcccgagggcgtcatcgacctggacctggtggcggccgcccagcccagggaaaaagagtccgacccccacctcttcaacttcctcaacggcatgctgctatccggcggcgatccggaaaccacctatgtctcgcgcctgggcgcggacggcgtgttccacgaagtggcgcggctcggcgagaccgcctgcctggaagtcacgccggacggttccagcgtcttcctgctcaccggcctgcggcgcccgggcaaggacaacggtcagcgcgagcagacagtggtgctgcgcagcgacgaccagggcaagagctggcggcggctcgaggaaggcttcatggccgaggcgaatcgactgggctgggctctcgcaccgcgcttccacggcaaggatga

SEQ ID NO: 6828 - DNA, 444 bp, Pseudomonas aeruginosa
ccgctcttcacgccgtcctggtccatgctggtcaggagaatctcgccagcgcccaggtcttccatcttcttcgcccagagcacggcatccagcccggtgggcttgcgcccgccatgggtgaagatttcccagcgcggcgcctcgcccggggcggaaaccttcttcgcgtcgatggcgaccacgatgcactgcgagccgaagcggtcggcggcctcaccgacgaactcggggttgaacaccgcggcggtgttgatcgagaccttgtccgcgccggcattcaacaggttgcggatgtcctgcacgctgcgtacgccgccgcccacggtcagcggaatgaacacctggctagccatgcgctcgacggtatgcagggtggtgtcgcgcccgtcgacgctggcggtgatatcgaggaaggtgatctcgtcggcaccctgctcgtcgtag

SEQ ID NO: 6829 - DNA, 1251 bp, Pseudomonas aeruginosa
accctgttcaagtctgtattcggtggacaggcgcgcggaaactcaactcttttccagcgcccagacatcgctctcgatgctttcgaaccgttccttcaggtacgactgcacgtcgaggatggccttgttgtagaagtacggggcgaactcgcgggcgaagaaatcgagcagttcctcggcttcgaaggaacccagctccagttcgaagcggtcctccatgaagcgcttgatcgccagtaccgcgtcctgagtctgcgcggcgtccagctggaggatcggcgtattgctcttcgccctggccatgacctaccagcgcccgtcccaggccacgaagttctgcagcagttgcaggccgtgggtatggctcttttccgggtggaactgcacggcgaaacgcgagccttcggccagcgcggcggcgaaatcgacgccgtagtgcccgtgccccaccacctggcgcgggttaccggcctcgatgtaatagctgtgcacgaagtagaagcgcgcctggtcgggaatctcgtgccacaacgggtgctccaccgcctggctcacctggttccagcccatgtgcggcaccttcaggtgctcgccggcttcgtgcaggtccttgccgaagaagcgcacctggccggggaacagaccgatgcagtcgaccccgtcgttctcctcggtgcgctccagcaatgcctgcatgccgacgcagatgccgaggaacgggcggtcctggctgacctcgcggaccagggcgtcgaagcccaggcggcggatctcggccatgcagtcgcggatcgcgccaaccccggggaacaccacccggtcggcctcgcggatcaccgccgcgtcgctgctaaccagcacccggccggcaccgacgtgctcaagggccttggccaccgagtgcaggttgcccatgccgtagtcgatcacggctaccgtctgcatcacaggcaccctttggtcgacggcatctgcccggccatccgctcgtccagctcgatggccatgcgcagcgcgcggccgaaggccttgaacacggtctcgatctggtggtgggtgttgtgcccgcgcaggttgtcgatgtgcagggtcacctgggcgtggttgacgaagccctggaagaattccatgaacaggtcgacgtcgaagccgccgacgctggcacgggtaaagggaacgtgcatctgcaggccgggccgcccggagaagtcgatgaccacccgcgacagcgcctcgtcgaggggcacgtag

SEQ ID NO: 6830 - DNA, 753 bp, Pseudomonas aeruginosa
tcgtcgatatgcaggtcgcccttgcactcgatgtccaggtcgatcaggccgtggcgggcgatctggtccatcatgtggtcaaggaagggaaccccggtatcgaaccgggccttgccggtcccatccaggtcgatggagaccttgatctgggtctccagggtgtcgcgcgcgacggatgccttgcgttcggccatcaccagctccacagctaacactgcacgtaattataagagggccagcattataggcaggcccgggctggcgctgccagccgcgaccgtcggcgcgaatcgccccacgggcggcgggccaggccttacactgcgctcctttcttcccgccgcggagagccgcatgcccgtgatcgtcgaaaccctcgcccaacccagcgcccaggatcgcctggacctggcgaagatctacgccgacgcgccggactggctgttcgccccgcatgccgacggcgcggcgctggtcgcggccgggctggccgccggcgagctgatcgccgggcgcttcaacgaccgcctgctgggtgccgccctgctgcggcgcggcgacgacgcctggcagctgtcgcacctttgcgtgcgcggcatcacccgcggccgcggggtcggccgacgcctcctcgacgaggcccggcgcctggctgccgaagccggcaagccgctgcgcctggtcgccccggacgggcacctggaggcccgtgccctcgcggcacgccacgggctgccgctggacagcctctga

SEQ ID NO: 6831 - DNA, 273 bp, Pseudomonas aeruginosa
tatgctcggtggcggtccccgccacggagcttcgccatgtccttttcctccgccgaacgcgccgccctgcttgccctcaagggggtcggcccgaccgtgctgcaacgcctggagcagatgggcctggacagcttcgtccggctgcgcgactgcgacgccgcgagtatcctcgcccagggcgcggccctgaccggctccagttgctggaagaacagcccgcaggcgcgggcagcgatcatcgccgtgctgcagcgcgcagccagcgacgcatga

SEQ ID NO: 6832 - DNA, 963 bp, Pseudomonas aeruginosa
aggcttcaacggcgcggtcctcgactggtacgaccgtcacggtcgcaaggatctgccctggcagcagggcatcaccccctaccgggtgtgggtctcggaaatcatgctgcagcagacccaggtcagcaccgtgctcggttacttcgaccgtttcatggcagcgttgcccgacgtcgaggcactggccgcggcggccgaggacgaagtcctgcacctgtggaccgggctcggctactacagccgtgcgcgcaacctgcacaagaccgcgcagatcgtggtcgagcggcatgcgggggagttcccccgcgacgtcgagcaactcgccgaactgcccggcatcggccgctccaccgctggagccatcgccagcctgtcgatgggcctgcgcgcaccgatcctcgacggcaacgtcaagcgcgtactggcgcgctacctggcgcaggacggctatcccggcgaaccgaaggtggccagggcgctgtgggaagccgccgaacgcttcaccccgcacgcacgggtcaaccactacacccaggcgatgatggacctcggcgccaccctctgcacgcgcagcaagcccagttgcctgctttgcccgctggtctccggctgccgcgcgcacctgctcggccgcgaagccgattatccgcagcccaagccgcgcaaggcgttgccgcagaagcgcacgctgatgccgatcctggccaaccgcgacggcgccatactgctctaccggcggccttccagcggactctggggcgggctctggagcctccccgaactggacgacctcgacggcctcgaaccgctcgccgcgcgccattccctggccctcggcgagcgccgcgaactgagcggcctgacccataccttcagtcatttccagctcgccatcgagccctggctggtggcggtggaaggcgctccgcgcgccgtggccgagggcgactggctctggtataa

SEQ ID NO: 6833 - DNA, 555 bp, Pseudomonas aeruginosa
tccgcgcggtaccggcgttgtgcctggagcacgtggtctcccgcgaccctgggcgggtgcacgccgacctgcccgaagcccgggtcagcgccgatccggatgaggccatcgaggccgccgacatcgacctggtggtcatcgcctcgcccaatgccacccacgccagcctcgccgaacgggccttgcgcgccggcaagcacgtggtggtggacaagccgttcaccgtcaccctggccgaagcccggcgcctcgccgacctcgcccgtgaacggcctgggcaggtcctctcggtgttccagaaccggcgcttcgacagcgacttcctcgccgtggaggccgccctgcaggccggcagcatcggcccggtgcgctacttcgagtcggccatcgagcgcttccgtccgcaggtccgcgaccgctggcgcgaacacgacctgcccggctccgggctgtggttcgacctcggcccgcacctgctcgaccaggcactgtgcctgttcggcgtaccgcagcgtgtgcacggacacctgcgccggctgcgcgagggcgcgctga

SEQ ID NO: 6834 - DNA, 468 bp, Pseudomonas aeruginosa
cgcctgactcaagcccgcctccggcatccctgccggcgctggtggccaggccccgggcaaaaagccgcccggcgcctggcgcggcatccatgcctcaccagctcgattgaagttccgaatgttcgtggaggcaaccaaaccatgagccgcagtcgtcgcaagacgcccattgttgggcacacgacctgtcgcagcgagagcgaggacaagaagctctggcatcaacgctggcgaacccgcgagcgtacagcactggccggcgcgtcgacggaagtcctgagcgcccatctgaccctgcgggaaaaccaggtcagtaacgtctggtcgatgggcaaggatggccgctcgtactggcccatcaagcaccagatcgctacggcggagcgcatcgccaaccgtaagggacgcaatccgcaggagcgcgccagcctgaaaaagcgcctgctgcgcaagtggatgagtaaatga

SEQ ID NO: 6835 - DNA, 450 bp, Pseudomonas aeruginosa
tttcaaacgaggtgctctatgaacgacaaatcgaagtcccacaaaccaaccgccaaaggccagcccctgttacaggaagctggtagcggacgctttgtgacgctcgcttttgccggcgacccctcgcaactcaagcaagctgccaaacctgcgcacggcactgtttgggtgaagtccttccgactcgcgcgcggcgtggctaaggtcaagcaggtttccaaccgtgctgacaagttgtcgatggctgcaatgcagaagcagatccaagagctgcagcagcagatgcaagttctgatcgagcacgaatccgagcgcatccaggaagcggttgtcgtcgacctggtggatctcgaaggcctcaccgtgctcaattcagctgttgctcgcgacctggtcgataaccctccggcgccgaacgccaagctccaggctctactcgcgctgcgataa

SEQ ID NO: 6836 - DNA, 528 bp, Pseudomonas aeruginosa
ggcctggaggacatggatttcatcaccgaaccttacaatcgctctgtagaccgcaagtcctttgactgcggtctacaccctgccctgaacacatacattgcccagcaggccagccaggacgagaagcgcaatgtctcgcggacgttcatgctgatcgaggacggccagctaatcggctactacacccttgccaatgcgtctgtcgtcgagtccgacctgagcgaagagcagatgaaaaagatgccccgctacccgatgccggcagtattgctcagccgccttgctgtggacaaaagccagcagggcaaaggagtcggtaagcgcctcatgagcgacttcttccggcgcgtatatgtgatctccaagcactctggggtagccttcgtggtggtcgacgccaaggatgatgacgcagcgcggtactacaagagcctggatttcgttgaaacgaacaccagccctcttcgcctggccctatcgaccggcaccctcattcaaggctacaaagcactggagacctcagactga

SEQ ID NO: 6837 - DNA, 237 bp, Pseudomonas aeruginosa
cttccgtctgacagtattttcgagaggacactgtcctttatgcctctcaacaatactcaatattccgattacctcttcaattacttcagcttgatatctaaggccatttatatcgccagcacgctgggccacgccttgactccgcaacgcttcctgaagctgagcgcgacaacagtaaattgtggcggccactcttctccgatatgtcgacttacttttggtcgcgcagattgctga

SEQ ID NO: 6838 - DNA, 486 bp, Pseudomonas aeruginosa
gcgatgaaaatcatccccaggaacatcacggcgccaccgaacacggacatcatgctgcccagcacgtcctcggtttcgcctccttccacattcccacccgagtggatggtacccacgatggagccgaacacttcttccaggaagtcaacggaagtgtcgcccggcggcggggtgaactggctcattccgcccgaggattcagcgtgggctgctcccccgaagaatgcggccaggaataggcaaagcagcagcgtttttttcatctggctgctctccgctgtgcaggcggtaaaaccaagggggtggaaagagcgtcatgaacgtacagcagggcatacggaatgccggcgagcgcataaagatggctctcaccggacaaatactgctgcacagctaaaagggccagtacggcagttatggggaacacccaccagcctggtaacccaccccaaacgcggtgttggcctagtgggactcccaagttag

SEQ ID NO: 6839 - DNA, 819 bp, Pseudomonas aeruginosa
acgcgactcgcacagcctacaaggaatgacgaatcgccgcggcggatctttcgcccatcccggcgaacggccgagcgtgagccaggcagtgccgatagactaggcggaccttgtccggacccccgatcgatgctgaagaaaagcttcaactccctgctcaccacctggctcgccggcctgctggtgatgctgccgctggtactcaccctagccttgctggcctgggtggtcagcttgctgaaccgcttcgtcggtccatccagcctgatcggtcgcggcttcgccgccataggccagccgctcgccggcgattcgccactggcctacctgctcggtaccgcgctactgctggtagccatctacctgcttggcctcggcgtacagctaggcctgaagcggccgctggccaacctgttcgacctgaccctgcggcgcaccccgctgatcggcaacctgtacaacctggccgaccgtttcgtcggcctgctggacaagaagcaggacgccgacatcgccgcgatgagtccggtgtggtgtttcttcggcggcgacggcgccgccgtgctggcgctgatgcccaaccccgaagcggtggaactggacggccgcgcgcactacgcgatcctggtgccgaccgcgccgatcccggtgggcggcggcctgctctacgttccggtggaatgggtgaaaccggcacagatcggcatggacaccttcaccagcatctatgtgtcgatgggcatcaccccaccgccgccgctggccgccgccaaggtgctggcggagccgcgcgcggagcagccgccggcggctccatag

SEQ ID NO: 6840 - DNA, 804 bp, Pseudomonas aeruginosa
gaagatcctgctggccgccgctgcaaccctggccttcgccctcgacgccagcgccgccgacaagctgcgcatcggcaccgaaggcgcctacccgcccttcaacggcatcgatgccagcggccaggcggtcggcttcgacctcgacatcggcaaggcgctgtgcgccaagatgaagaccgagtgcgaggtggtgacctccgactgggacggcatcatcccggcgttgaacgccaagaagttcgacttcatcgtcgcgtccatgtcgatcaccgacgagcgcaagcaggcagtcgacttcaccgatccctactacaccaacaagctgcagttcgtcgcgccgaagagcgtcgacttcaagaccgacaaggactccctgaagggcaaggtgatcggcgcccagcgcgccaccatcgccggcacctggctggaagacaacatggccgacgtggtcaccatcaagctctacgacacccaggagaacgcctacctcgacctctcctcggggcgcctggacggcgtgctggccgacaagttcgtgcagtacgactggctgaagagcgacgccggcaaggagttcgagttcaagggcgaaccggtgttcgacaacgacaagatcggtatcgccgtgcgcaagggcgacccgctgcgcgagaagctcaacgccgcgctgaaggaaatcgtcgccgacggtacctacaagaagatcaacgacaagtacttccccttcagcatctattgatgccaagccaggccaccgccgggcgcgtcccggcggtggccgccttcaggcctgacttctcatga

SEQ ID NO: 6841 - DNA, 738 bp, Pseudomonas aeruginosa
ggaacgagctatgagcgagtgggagctgatcctcaagtggatgccgaagatgctccagggcgcggcgctgaccctggagctgctggcgatcgcggtggtcgccgggctcgccctggccctgccgctgggcatcgcccgcgcctcgcggcactggtacgtgcgcgcggtgccgtacgcctacatcttcttcttccgcggcacgccgctgctgctgcaactgttcatcgtctactacggcctggcgcagttcgaggaagtgcgcaagagcgccttctggccctacctgcgcgatccgtactggtgcgcgctgctgaccatgaccctgcacaccgccgcctatatcgccgagatcctccgcggcgcgatccactcggtgccggtcggcgaggtggaggccgcccgcgccctcggcatgtcgcggcgccaggcgctctggcacatcatcctgccgcgcgcggtgcgcatcggcctgccggcctacagcaacgaagtgatcctgatgctcaaggccagcgcggtggtctacaccgtgaccctgttcgacatcatgggcatggcccggaccatcatcgcccgcacctacgaatcgatgctgttcttctgcctggccggcgcgctgtacctggtgatcaccatcgtgctgacgcggatcttccgcctgatcgaacgctggttgcgggtcgacgccacccagggccgctgagcgggtgctttccgatgcctgcggggcggctataa

SEQ ID NO: 6842 - DNA, 1254 bp, Pseudomonas aeruginosa
tcgccgccccgttttcccgctgccgctcgcatcgtgtccgaaaccttcccgttcctcactggcgacgccctgtcgcagcgcttcctcgcgctggacgcgttcctcctcgaacaccagcggctctggcgaccccgcccgttcagcgaaccgaccctggcgtgggaagccgaacacgccgagctggcgtcctggctgcgcgggcgcagcctcgaacaggccgacgcggagcacaaccagcccacccgcctggccgcgcccgcgccttatccgcagctcgccgcccaagccgcggcgctgggcgcggtcggcgaactgccattggcggaacgcccgcaggcaccgaaccgcttcaacgtcgacgtaccgggacgcaagtggcagcagatcggcctgttcgccgggcgcctgcagttcgcccggccggtcgtccactggctcgactggtgctccggcaagggccatctgggccgcctgctggcccatgcggggcaaccgctgacctgcctcgaacacgatcccgcgctggtcgccgacggacagcgcctgagcgaccgcctggggctctccgcccaccacctccgccaggatgtgctggccgcggactgcgccgagcgcctgcttcccgggcatacgccagtggccctgcacgcttgcggcgaactacacctgcgcctgctgcgcctggccagccaggccggctgtcgccaactggcggtggcgccatgctgctacaaccgcattccggggcctttctaccagccactctcgcaagcagcaggccgatcgctgctcgcgctatcgcttgacgacctgcgcctgcccctgagcgagacagtcaccgccagccaacgggtccgtcgccagcgcgaccagtcgatggcccggcgcctgggtttcgacctgctgcagcgcgagctacgcggaatcgaccagtacctcagcgtgccttcccttccggtggcctggctggaacgtccatacgccgactactgtcgcgaactcgccgccctcaagggacttcccgaaccggccgcgcgcgactggcaggcgctggaagcggccggctggaagcgcctggcgatggttcgcaacctggaactggtgcgcgccctgttccgccgcccgctggaactctggctgctgctggaccgttgcctgtatctggtcgaacagggctatagcgtccgcctgggcgagttctgtccgacctccctgtctccgcgaaacctgctgatccttgcggagcgcagctga

SEQ ID NO: 6843 - DNA, 1230 bp, Pseudomonas aeruginosa
tcgaccagcgccaggcccgcgatatcgccaggtccaacttcgacctggccatgcgtcgctacggcgaaggcgtcggcagctacctcgacgccctcagcgtgcaacagcaactgctggtcgccgaacgccagctggccagcctggagagccagcagatcgatctttccgtccagctggtccaggccctgggcggcggtttccaacccgattcccgctccgctgcgctcgctaccgcgaaagcgccggcagaatgaacgaggcacccaccatgactaccgccaacagcgaaacccccgccggcaacccgaagcgcaagcgctggttgctgatcctgctcgccgtgatcgttctcgccaccctggccagcgtggcctgggagttcttctacggccgctggcacgaggacaccgacgacgcctacatcaacggcaacgtggtacagatcaccccgcagatcgtcggcaccgtggtcagcatcggcgccgacgacggcgacctggtgcgcaagggccaggaactggtcaggttcgatcccagcgacgccgacatcgccctccaacgcgccgaggccaacctggcccacaccgtgcgccaggtgcgcgggctgttcagcaacgtcgacggctatcgcgccgaggtcgccacccgcaaggtcgcgctggccaaggccgaggccgactacaagcggcgcaagaacctcgcagacgacggcgccatttcccaggaggaactggcccacgcccgcgacgccctggacagcgcgaaagcctcgctgaccagctcggaacagcagttgaacaccaatcgcgcgctggtcgacgacacccagatcacctcccatccggacgtcaaggccgccgccgcgcaactgcgccaggcctacctggacgacgcccgctcgaccatcgtcgcgccggtcaccggctacgtcgccaagcgcagcgtacaggtcggccagcgcgtgcaaccgggcaatgcgctgatggccgtggtcccgctggaccagatctggatcgacgccaacttcaaggaaacccagctcaagcacatgcgtatcggccagccggtggaaatccgctccgacctctacggcagcgacgtgcgctacagcggcaccgtcgacagcctcggcgtgggcaccggcagcgcgttctccctgctgccggcgcagaacgccaccggcaactggatcaagatcgtccagcgggtgccggtgcgcatccatattga

SEQ ID NO: 6844 - DNA, 258 bp, Pseudomonas aeruginosa
gtcccgggttcgactcctggtgccggcaccattcaaggttccatagaaagctttcaaaatctctggaacccccgaaaaacccgccttctggcgggttttttcgttttggcgttccgtcggattccgagggtagccagcgctaataagggtacttttaaggatacctaccaattcgacattggaaagtacccttatggctcgcacaacggctccccttaccgacagcgcctgccgcactgcaaaggctcgcgaacgtga

SEQ ID NO: 6845 - DNA, 3354 bp, Pseudomonas aeruginosa
ctgacaaatcaattgcccacatcaaaactttggtggctgctcatgtttgataacgatactgtagaacttattaacagagctcccgaattggatgggctagaccttgctgagctaccaaaacaactgactgaggcctacgcttcgatagtatctgctcgtatttgtttacgtgaaggaacggaacagtcaggattacctgacgacttgatagaaataatcaagcaaatgacacgtctcgctttctccctcgaagcaatagtctccgcttccgaagatgcagaaaaccggatggccgcagcattcgtcgccggctccgctcatcacgtaatattgcttgctcaagagttaatgccaaaaaacattaaatctagcacattgagtgcatacggagtctcccctgaagtttctgcaaccttgctattcctgattgcagaggcaagctctgacgctgccgaaacagcaaagaaaattatcgtgagcggcgaagactctattgaggcatctgtacttaaagcaatttatcatttggcgaacggaagtctattaaaaatacttgctacgcgcgtcccgagcccagacaaatttcaaagcactgacagcctagggcaggctgttgagtcactgtactatatgctattgcatgggatccgggcgctggcggcatcattgctagggtctactgacgagcatgatttattagaccatgactcaaaaattatttttaatcgagtaaagggattatgcgtcgatgaaattgatgagttagtcggtctgggagatcacccagtccacaacgtatttcccggcccgctacatttagcatccctattggcgatggtcgccgaccatcttattccatccagcattataaatacagaccctcccaaaggtatagatgcagcaaaatggtttgatatgaagcaaagcatagcttcagccaggccgtatctatggagaaatcatcggcaggcgatatcttcaggttatctagaaacagggatgtcttctgtaataagtttccctactggagctggaaaatctacgctttccgagctgaagattgcgacagctctactacgcaacatgaaagtggtatttttggcgccaacactttcattggtagaccagacgactagggcgttagctaatacattcccaaatgcagaggttcatcgagaaattctagatgagttattatttgatctggagaatgactcactcccagcaatttcggtcatgacacctgaaagatgcttagcgatgctgagctttaaccctgacatattttcaagtgtagggttattagtatttgacgagtgccatttactgcacccaagggatgcggatcacagccggcgctcgatagactcaatgctttgcctactaaactttacatcggtagcacctaaagctgatttgcttttactatcggcaatgatgaagaattcagaagagattgcagattgggtgtctgagctaactagcagaccctgcttaccattggcgctaacatggaagcccacccgtcaagtaagaggatgcgtagtttacgctggcgatgaaatcaccaaactcaagcaacgcttaaaactcgtgcgatcccaggtaaaaaatgtaaatgcgcctgccccactcaaacgagaattgcttgtacagccatttggcttcttctgtttaaatcagacatggcactcggcgagccgtaaagattacgcattaataccagtacttagcgagactgttaatttatcaacaggtaccgcttcagaaggaaacaactggtatttaacacccaatgggaatcaagtatccgcaacgattgccacctccacggccaggcaaaaaatcaaaactttgatcttcacacaaactataccactcgccaatagcgcagctaaaaaaatctcagatgacctcgaatcatcaaactgcatcctgacagacgaagagttgcaccttttccagacggtagtcgatgagtttgggggggaggagcatgtctatatcaaagtttcgcaagaaggtcgactactatcctctagtacatgccatcatggacttttgctttctatggagcgacatttgcacgaatcgctattcaaacgaacagatggcttgaatgttttagtggcgacatcgactctagcacagggaatgaacctcccaagtgaagtggtaattattagtggtgatagtagatttgatcaagaagccgatgctatgcaacgcttggaggctcacgaacttttaaatgcagcgggacgtgccggcagagccggcgacagttcctatggatttgtattagtagtgcctagcaaagttgtccattttgataacaacactagccagatccataaccactggatggacttaagatcgatattttctcaaagcgatcaatgtttggttatcgatgaccctctcacgtcaattctcgaccaaatacacagcggcgcactacctctccctaacttgccaagctatttcttaagcaggttaccggtcgattatggcgaagaccaagaaggacgaaactcattagctcgcgcgacgatagaacgctctttctctgctttccgagcaagaaaaaaaggtgatcaagaatgggtaaaatcaagaatagaatcggcaatattgtcaagaaattcgaatatagacacctcacaacccgccacttgggttgatcgcctagcagcagcatcaggtatatcgacagcgatcattcgagagcttggcgaaccgctttctaataacattaatcactcggctaccacagacgcttggtatcaatggtttcgcgactggctaaagcgccgccccgccctaatcccaactctgataagaaaggagaccttggaagtatttttgggcagcgactataagaagcttaaggatgacgcctcaagaggtacgcatgcctgtgacataatatttccattattggagctttggatgaccggtcatacgctagctagtatggaggaatcgactggcactccgattaatagagttggcaggtgtgaattcgctagagagtttgttttgaggatcgtccctgaactttcttatatatttggtcttcctaatcagattttcaatgcaatcacagtcgatagaggcgaggataccgagtcacctgtcggccttaactgcttagccttgtgtgttaaggaaggcttaaacagcgtagaaaaagtcgctcttcgcgaagtaagcaagaagcgcttagccagaagagaattacatcgtaagtatcaaaaaatcgagagctatgcgggcatacttaaagaaggtgaaaactttggcgacgtagtgaaccgtattactcaggccctagccttcgtgaatttctaa

SEQ ID NO: 6846 - DNA, 918 bp, Pseudomonas aeruginosa
gcagtacgcatgaaccggatccttctcctcggcgccaacggccaggtcggctgggagctgcagcgcgccctggcgccgctgggcgaactgctggtctgtgaccgtcggcgcgccgatctcgccgaccccgaaggcctggcgcgactggttcgcgccgagcggccgcagttcatcgtcaacgccggtgcctacaccgcggtggacaaggccgagagcgatgccgacaacgcccgcctgatcaatgcccgcgccgtcgcggtactggccgaggaggccgcgggctgcggcgcctggctggtgcattactccaccgactacgtgttcgacggcgcgggcagcgtgcctttcgccgaggacgcgccgaccggcccgctgagcgtctacgggcagaccaagctggaaggcgagcaggccatccgcgccagcggctgccgccacctgatcttccgcaccagctgggtctacgccgcgcgcggcggaaacttcgccaagaccatgctgcgcctggccgggcaacgcgacgaactcaaggtcgtggccgaccagttcggcgcgcccaccagcgccgagctgatcgccgacgtcaccgcccaggccctgcagcgcctgcgctgggatgtcgagctggcagcacgggccagcggcacctaccacctggtcgccagcggcgagacgtcctggcacctctatgcgcgcttcgtcatcgaacaggcgctggagcggggctgggagttgcaggcgacgccgcagcgggtcctgccgatcgccaccgaggactacccggtgccggcgaagcgtccggccaattcgcgcctcgacaaccgcaagctgcaacaggtcttcggcctggtactgccagactggcgctaccatgccggacgcatgatccaggaactgagcgagcagggaccactatga

SEQ ID NO: 6847 - DNA, 1854 bp, Pseudomonas aeruginosa
ggcatcccgtccgggatgccccggatactcgcagccacggcaggttcgttcgtcttgaaagcctatttccatcgctggcgctcgctggtcatcctcgccctgcttctcgcgccgctgctctggcccctgcaatatttcgccgagcgctactacagcgagcagttggccgagcagaaccgccagacgctcgacctctacgtcgccaacctgctcggcacgctgcgccgctacgaagaactgccgcagatcctcggcggcctgccggtgctgcgccaggccctgcaacaacctggcgacccgctgctgcagaagatcgccaacgaggcgctggccgacatccgccgacgcaccggcgccgacgtgatctacctgctgcaaccggacggcactacccaggtcgcctccaactgggcccaggcggacagtttcgtccaccgcaacttcgccttccgcccctattatcgcgaggccatgcagggccgcctggcgcgcttcttcggcctgggcaccacctcgatcaagcgcggctactacttcgccagtgcggtgaaggaaggctcgcggatcatcggcgtgctggtggtgaaggtcgatctcgaacacatcgaacggctctggggcaattccccggagcaactgctggtgatagacaactacggcgtggtgatcctctcctcccgcgaggattggcgcttccatgccagtcggccgctgagcgcggcggagcgcgacgagatccacgccaacatcccctacccggtgcaggacccgaagcccctgcgcctgcagcagagcgcctggctcagccagagccggacgctaccggaaaccggctggacggtgagcatctacgccccccgcaccctcatcgaacggccggtgcgcagcgtcctgctgatcggcggcgcgaccctgctcgccctgctcctgctgcttaccctgctgaccctcagccgccgtcactacctggaccgcatcgctctcgaggccgaggccaagcgccagttggaagagcgcgtactggaacgcacccgcgagctggagaacgccaacgcgcagttgcagcaggaagtccacgaacgcgagcaggcccagcgcgagctgatgcgcgcccaggacgaagtggtccaggccggcaagctcacggccctcggcaccatgtcggcgagcatcagccacgaactcaaccagccgctggcggcgatccgcagctacgccgacaacgcccgggtgctgctcgaccaccagcgcaccgaggacgcccgcggcaatctcgagcagatcagcgacctcaccacccgcatggcctcgatcatcgcccacctcaaggcctatgcccgcggtgcgcgccgggcgccggagaacgtgcagttgcagccggcgatcgaggacgccctgtcgatggtggccagccggcggcgggcgatgaacgtcgaactgctgcgcgacgtgccggacgccccgctgtgggtccaggccggcgagacccgcttgcggcagatcctcggcaacctgctcaccaatgccctcgacgcgctcgccgagaaagctccgccgcggcgcctgtgggtaatcgccagccaggaccagcacggcgtgaccctgaccctgcgcgacaacggcccggggttttccgaggacgccctggcccacgcccacgaaccctttttcaccaccaagaccaccgccaaagggctcggcctcggcctggccatctgcgataacctattgcgcgccctcggcggccgcctggaaatgggcaaccatctcgaaggcggcgccgtggtgcgcctgcacttgctgccgggagttcccggcgtcgccgccatgccccaggaggaaacccgcgcatga

SEQ ID NO: 6848 - DNA, 312 bp, Pseudomonas aeruginosa
tcggacgctcggccggcatgcagcgcctgcgcgagcaggtcggctcgctggcggcgatccaggccgacgtgctggtccttggcgaaaccggcgccggcaaggaggtggtcgcgcgggccctgcatgacctgtcgagccgacgtgacggaccgttcgtcgcgatcaacgccggcgccctcgccgaatcggtggtggaaagcgaactgttcggtcacgaggccggcgccttcaccggcgcgcagaagcgccgcatcggcaagttcgagtacgccaatggcggcaccctgttcctcgacgagatcgagagcatga

SEQ ID NO: 6849 - DNA, 1317 bp, Pseudomonas aeruginosa
ccgagcacgaggagcccaaggcatgaccattctgttcctcttcctgctgctcttcctgctgatgttcatcggcgtgccgatcgccgtctccctgggtctctccggcgcactgacgatcctcctgttcagcccggactcggtacgctcgctggcgatcaagctgttcgagacctccgagcactacaccctgctggcgatcccgttcttcctgctctccggcgcgttcatgaccaccggtggcgtggcgcggcgcctgatcgacttcgccaacgcctgcgtcggacacatccgtggcggcctggcgatcgccgcggtgctcgcctgcatgctcttcgccgcgctatccggctcgtctccggcaacggtggcggcagtgggttcgatcgccatcgccggcatggtccgctcgggttatccacaggcgttcggcgccgggatcgtctgcaacgccggcaccctcggcatcctcatcccgccatcgatcgtgatggtggtctacgccgccgccaccgagacctcggtgggcaagctgttcatcgccggcgtggttccggggctgctgctgggactgatcctgatggtggtgatctacatcgtcgcccgggtcaagaagctgcccgccatgccaagggtcagtctgcgcgaatggctggccagcgcgcgcaaggcgctgtgggggctgctgctgatggtgatcatcctcggcggcatctattccggcgccttcacccccaccgaggccgccgccgtcgccgcggtgtactcggcctttgtcgcactgttcgtctaccgcgacatgcgcctgagcgaatgcccgaaggtgctgctggagtccggcaagctgaccatcatgctgatgttcatcatcgccaacgccatgctcttcgcccacgtgctgaccaccgagcagataccgcagagcatcgccagttgggtcacggaactgggactttcgccatggatgttcctgctggtggtgaacatcgtgctgctgatcgccggcaacttcatggagccttcggcgatcatcctgatcctggcgccgatcttcttccccatcgccatggagctgggcatcgatccgatccacctcggcatcatcatggtggtgaacatggagatcggcctgatcacgccgccggtcgggctcaacctgttcgtcacctcggcggtcaccggcatgccgctgggcgcgaccatccgcgcagcgctgccgtggctgatgatcctgctggtgttcctgatcatcgtgacctacatcccggcggtatccctggcattgccgaactggctggggatgagctgacggaacggtaa

SEQ ID NO: 6850 - DNA, 1482 bp, Pseudomonas aeruginosa
ggagattccgaaaatgtcccaagaatccagccaaaaactccgactaggagcgctaacggctctggttgtcggctcgatgatcggagggggcatcttctccctcccgcaaaacatggcagccagcgccgatgtcggcgccgtgctgatcggatgggcgatcaccgccgtcggcatgctcaccctcgctttcgtcttccagaccctcgccaaccgcaagcccgaactcgacggcggcgtgtacgcctacgccaaggccggcttcggcgactacatgggtttctcctcggcctggggctactggatcagcgcctggctgggcaacgtcggctacttcgtcctgttgttcagcaccctcggctacttcttcccgatcttcggcaagggcgacaccgtcgcggcgatcgtctgcgcctcggtcctgctctgggccctgcacttcctggtgctgcgcgggatcaaggaggcggcgttcatcaacaccgtcaccaccgtggccaaggtcgtgccgctgttcctgttcatcctgatctgcctgttcgccttcaagctggacatcttcaccgccgacatctggggcaagagcaacccggacctgggcagcgtgatgaaccaggtgcgcaacatgatgctggtcaccgtctgggtgttcatcggcatcgagggcgcgagcatcttctcctcccgcgcggaaaaacgttccgacgtcggcaaggccaccgtgatcggcttcatcaccgtcctgctcctgctggtgctggtcaacgtgctgtccatgggcgtgatgacccagccggaactggccaagctgcagaacccgtcgatggcgctggtactcgagcatgtggtcggccactggggcgccgtgctgatcagcgtcggcctgctgatctcgctgctgggcgcgctgctctcctgggtgctgctgtgcgccgagatcatgttcgccgccgccaaggaccacaccatgccggagttcctgcgccgcgagaacgccaaccaggtgccggccaacgccctgtggctgaccaacatctgcgtacaggtgttcctggtggtggtgttcttcacctcgggcgacccggacggcatggacccgtacaccaagatgctgctcctggccacctcgatgatcctgatcccgtacttctggtccgccgcctatggcctgctgctgaccctgaagggcgagacctacgagaacgatgcccgcgaacgcagcaaggacctggtcatcgccggcatcgccgtggcctacgcggtctggctgctctacgccgggggcctgaagtacctgctgctgtccgccctgctgtatgcgcccggcgcgatccttttcgccaaggccaagcacgaggtcggccagccgatcttcaccggaatcgaaaaactgatcttcgccgcagtcgtcattggcgccctggtggctgcctacggcctctacgacggtttcctcaccctctgattactccactggagacgtga

SEQ ID NO: 6851 - DNA, 1908 bp, Pseudomonas aeruginosa
gtgatgtctcgactaccggtcattgttggtttcggtggctacaacgcagcaggccgtagttccttccaccacggcttccgtcgcatggtcatcgaatcgatggacccgcaggcgcgccaggaaaccctagccggcctggcggtcatgatgaaactggtcaaggccgaaggcggccgctacctggccgaagacggcacgccgctgtccccggaggacatcgagcggcgctacgccgaacgcatcttcgcctctaccctggtgcggcgcatcgaaccgcagtacctcgacccggatgccgtccactggcacaaggtcctcgagctgtcccctgccgaaggccagacgctgaccttcaaggcctcgcccaagcaactgcccgagccgctgccggccaactggtcgatcgctcccgcggaggacggcgaggtactggtgagcatccacgagcgctgcgagttcaaggtcgacagctaccgtgcgctgacggtgaagtccgctggccagctgcccaccggtttcgaaccaggcgagctgtacaactcgcgcttccacccgcgcggcctgcagatgtcggtggtcgccgcgaccgacgcgatccgctccaccggcatcgactggaagaccatcgtcgacaacgtccagcccgacgagatcgcggtgttctccggcagcatcatgagccagctcgacgacaacggtttcggcggcctgatgcaatcccgcctgaagggccaccgggtctcggccaagcaactgccgctgggcttcaacagcatgcccaccgatttcatcaatgcctacgtgctcggcagcgtcggcatgaccggcagcatcacaggcgcctgcgccaccttcctctacaacctgcagaagggtatcgacgtcatcaccagcggccaggcccgggtggtcatcgtcggcaacagcgaggcgccgatcctgccggagtgcatcgagggctacagtgccatgggcgcactggccaccgaagaaggcctgcgcctgatcgaaggccgcgacgacgtggacttccgccgcgccagccggccgttcggcgagaactgcggcttcaccctggccgagtccagccaatacgtagtgctgatggacgacgaactggccctgcgcctgggcgcggatatccacggcgcggtaaccgacgtgttcatcaacgccgacggtttcaagaagtccatctccgcccccggcccgggcaactacctgacggtagccaaggcggtggccagcgcggtgcagatcgtcggcctggacaccgtgcgccacgccagcttcgtccacgcccacggctccagcacgccggccaaccgggtcaccgaatcggaaatcctcgaccgcgtggccagcgccttcggcatcgacggctggccggtcaccgcggtgaaggcctacgtcggccactccctggccaccgccagcgccgatcaactgatttccgccctgggcaccttcaagtacggcatcctccctgggatcaagaccatcgacaaggtcgccgacgacgtccaccagcagcgcctgagcatctccaatcgcgacatgcgccaggacaagccgctggaggtgtgcttcatcaactccaagggcttcggcggcaacaacgccagcggcgtggtgctgtcgccgcgaatcgccgagaagatgctgcgcaagcgccatggccaagcggccttcgccgcctacgtcgagaagcgcgagcagacccgcgccaccgcccgcgcctacgaccagcgcgcgctgcagggcgacctggagatcatctacaacttcggccaggacctgatcgacgaacatgccatcgaggtcagcgccgaacaggtgacggtgcccggcttcagccagccgctggtatacaagaaggacgcgcgtttcagtgacatgctcgactga

SEQ ID NO: 6852 - DNA, 915 bp, Pseudomonas aeruginosa
actccttggtgccgtccagcgggtccaccagccaccagcgccgccagtggccgcgctcgctcagcggtatctcgcaatcctcttcggaaagcaccggaatgtccggcgccagcgcccgcaatcccgcctccaatatatggtgcgcggccaggtcggcggcagtcaccggcgattcgtcggccttcgagcgcaccgccacgtcggcgcgccagtgcggcaggatcgcctcgccggcgcgccgcaccagcgccaccaattcgccccaaggcaccggcctcatgcctggtactcgccgcgctgggtgagcaggtcgcgcaccaggtacagcgcggccagggcgcggccttcgctgaactgggcgtgctgggccaggctcgacagttcgcgcaggctgatgcgatcgacgcccatcggttccggctcgtcgcccggcaggcgctcctcgtagagatcgcgcgccagcaccacctggatgcgctggctcatgtagcccggcgacagcgacagttcggtgatgtgctccagttgccgggccccgtagcccgcctcctccttgagttcgcggttggccgccgcgaggatgtcctcgcccggctcgaccaggcccttgggcagcgacaactggtattcgtcgaccccggcgcaatattcctccaccagcaccgcgtgctcggcatcgagcatggccaccaccatcaccgcaccgtagccctggcccttgccgaccagacgctcgtaggtgcgctcgacgccattgctgaagcgcagttgcaactcctcgacagcgaacagtcggctcttcgcgacgatctcgctggcgagtacggtgggtttctgacgcatgtggataactccttggcgaagccggcgggttatcataccccggcttttccgattatccctgtcggagattga

SEQ ID NO: 6853 - DNA, 1443 bp, Pseudomonas aeruginosa
gcgttggcattgccgtattcggccttggcgatggcgctcagggtgtcgcctttcttcacggtgacgaagcgcgcctccggagcggcctgggccacggtgatcttgtcttccaccgaggagacgccggcgacgttgcccagcgccagcaggatcttctctttctcctcctggctgaccacctcgcccgaggcgatgaccttgtcgccttccaccgaaacctggatgttcgggttgcccaggccgaccttggcgacgtgctccttcagcgactcggccgcctgtgcctcatgccccgtcagcgtatcccacagcttttcaccggcttccttcacgaacgcgaaaatacccatctttggttctccctttacggttacggttgcaagcggccggcgcaatcccgatccgcgactagccaagtctagactgcaaaaaccggcgaaatatccccaggctccttcgtcaccccataacactgcgcccattcgcgttaagattcggcgacacccccgccacggaagcgccgatggacatcaagcaactgaaattcctctgcgccctcgacgaaacccgccacttcggccaggccgccgcgcgctgccacgtcacccagccgaccctgtccatgcgcctgcgcagcctggaggaagaactcggcctggaactggtgcgacgcagccagcgcttcgaaggcttcaccgaggccggcgagcgcgtactggcctgggcacgcagcctgctggcggcccaggaagggctgtacgcggaagccgccgcctgccgcgggcaactggtcgggaccctgcgcctgggcgtggtgccgctggccagcttcgacccgatgcgcctggtccagcacatggccgggcgccacccggagttgcgtttccagctctattccctgagttcggaacaggtactcgaaggcctggcgcgcaaccagttcgatctcggcgtctcttatctggaccgtctggaccgcagccatttcgagggcatcgaactggcggagacccgcatgggcctgctccatcaccccagccatttcccgctcgacgccgcgctgctgaactgggaagcgctggctggcctgccgctaggcctgctctcggcgggcatgcacttccgccaatccatcgaccacaacttccgcagccgcgggttgagccccatcgcgcgcctggaaaccgactcggtacagcaactgctgcaggcggtgcagcgcggcttgtgctgcgcgatcatgccgctaggcagcgaagtcgacggcgagttgcgcctgatccccatcgaggacgcccataccctggcagcgctcggtctgatcatccgcagcggacagccgcgctcggcgctggccgaagcctgtttcgaggaagcccggaactggttggcgccgcagtcttgatagatcacgtcgatcagcgcatcggcacaaccgattag

SEQ ID NO: 6854 - DNA, 414 bp, Pseudomonas aeruginosa
agttctgcgagaacggtgccaaggcagtcaactgggaagccaccaagcgccgcgtcgacgcggcgttcttcgcccgctacagcgtcagcgccctgcgcgaacagagcgactactggctggaataccagggccgcctcaccggaccgatgcgctacgacccgctcagcgaccactaccagccgatcacctgggacgccgccttcgccctggtcgccgagcacctgcgacgcctggatagccccgaccaggcggagttctatacctccgggcgggccagcaacgaggcggcctacctctaccagttgttcgtccgcgcgttcggcacaaacaacttccccgactgctcgaacatgtgccacgaagccagcggcgtggcactgggccgcagcgtcggggtcggcaagggcagcgtga

SEQ ID NO: 6855 - DNA, 642 bp, Pseudomonas aeruginosa
acaccgcgttcttccgtccggcactgggcggcgacatggcggcgatccgcgggatcgccaagttcctcctcgcctgggagcgcgaagcccaggccgagggtagcgagccggtattcgaccacgccttcatcgccgagcacaccgacggcctcgaggcctacctggccgaactggatgccaccccctgggaacacctggagcgccagtccgggctgggcctggcggaaatcgagcaggctgcgcggatgtaccggcgggcgaacagggtcatcgtctgctgggcgatgggcatcacccagcaccaccattcggtggcgatcatccaggaaatcgtcaacctgcaactcctgcgcggcaacctgggccgcccgggcgccggtctctgcccggtccgcggccacagcaacgtgcagggtgaccgcaccatgggcatcaacgagcggccgccggcggcgctgctcgacgcactggaacggcgcttcggcttcgaagtgccacgccacaatgggcacaacgccgtcgaggcgatcgccgcgatgctcgccggcaagtcgaaggtcttcatcggcctgggcggcaatttcgcccaggccaccccggacagtccgcgcacccacgccgccctggcgtcatgcgacctga

SEQ ID NO: 6856 - DNA, 426 bp, Pseudomonas aeruginosa
aacgatgaggcacgcacgatgcgtaaatctctcctggtaatcgcgttcggcctgctgagcgcacaagccgcgctcgccggcgattccaccaagaccgcggtgggcggcggcgtaggcggtgccctgggcaacgtcgtgggcggcgccatcggcggtagcaccggtgcggccataggcgccggcctgggtggcgcggccggcggcgcgatgaccgccaaggacgggcgcaagaccgaagccgccctgggtggcgggctcggcgcggccggcggttcggtgatcggcaacaagctgggcggcagcaccggcgcgaccataggtgcaggcctcggcggcgcagcgggtggcgcggtcggtaacaacctgggcaaggacaacgacagcggtcaccgcggcaagaaacaccgcaagcacaagcatcgttga

SEQ ID NO: 6857 - DNA, 615 bp, Pseudomonas aeruginosa
cgtgccggacatcaattccatccgagatttccagatgcgcccgtcgttcgccagttggggcctgcttgccctcctgctcctgcaaggcccgttgctccaggcccagccgctgtcaccggctctccagcaactgttgagcctgagcagccagcgtttgcaactagccgatcaggtagcccagagcaaggcccagtcgggcaaggcggtacaggacagcccgcgggaagaacaacagttgcagatgctcgccggacaagccgggagccacggggtcggcgccgagcaggtgcgcctgctgttcgccgcgcagatcgaggcgaacaagctggtccagtaccgcctgctcagccggccgctaccggacgctggccaggcggtcgacctggagcgcatccgcagccgcctcaatcagctcaacctggagctgctgcgcggctacgccccggcgctcgccgaactgcgcgtcgacgactgccggccgaggctcaaccaggcgctgcaacggcaggtacgcgtcgatcgcctggacgagctgcacgccatcgccctgtcacgggcggcgggcgatctctgtcactgggccgagctctgaagcgcggccagcgcatcgcgtag

SEQ ID NO: 6858 - DNA, 1386 bp, Pseudomonas aeruginosa
aagcttgcatatcggtctccttgggcgagacgcccgtcagaacgagaaatgctcctcgggcagggccatcaggcagtcggcgccaccgagcaaggcttcgcggtgcatgctcgcccgcggcaggatgcgccgcaggtagaaatcggcgctgcgcagcttggcccgatagaaatcgccctcgccggagccgccgtccagcgcttcctgggctcgcgccgcggcttgcaaccagagggccgcgagcaatacgtaggcgctgtactggaggaagtccaccgaagtggcgccgatctcctggggatcgcgggcgcaggcctcgagtacctggccggtgagctgccgccactcctccaggcgttgcagcaccggctcagccagtggcgccagcgcagcacgcccttgcagcgcctcgctggccaccgccagttcgccttgcagcgccagcagttcgccgccctggtcgccgagcagcttgcggcggaccagatcgagcgcctggatgccattggtgccttcgtatatctgggtgatgcgactgtcgcgcatcaattgctccatgccccattcgcggatgaaaccgtgaccgccatagacctgtacgccgaggctggcgacttcctggccgacatcggtaaggaaggccttgacgatggggatcagcagcgctgcacggcgcgtcgccgcgcgccggccgtcagcatccggatggccgtgttccaggtcgagctggcgtgcgcagcaggacgccagcatgcggcagccttcgaccagggtcttctgggtcagcagcatgcgccgcacgtcggggtgcacgatgatcgggtcggcgaccttgtccggtgcctgcgggccgaccagggcgcgcgactgcaggcgttcgcgggcgtagccgagggcgccctggaaggcccgttcggcgatacccaggccctgcaggccgacctggaagcgcgcgtcgttcatcatcgtgaacatgcaggccaggccctggttcgcctggcccagcagccagcctctggcgccgtcgaagttcatcacgcaggtggaggcgcccttgatccccatcttgtgctcgatggcgccgcaccccaggctgttgcgctcgcccagggagccatcgggattggcgacgaacttcggcaccaggaacagactgatgcccttcaccccggccggcgcgtccgccaggcgcgccagcaccaggtggacgatgttctcggtgaggtcctgctcgccaccgctgatgaagatcttgctgccgctgatcgcgtagctgccgtcggcctgcgcctcggcgcgggtgcgcaggagggcgaggtcggtgccggcctggggttcggtcaggcacatggtgccggcccattcgccgctcaccagcttgcctag

SEQ ID NO: 6859 - DNA, 405 bp, Pseudomonas aeruginosa
ccagcgccagcaggcaacgctcgaggatttcctcgtcggcgaaatcgcgccgcgggtagcccagcgtctcggcaacccggagcaccagggcatccacctcggtatcgtgctccgcctggcggctgcccggcgcgtagcggtagtagccggcaccgctcttctggccgaagcggcccatctcgcaaaggcggttgtccacctgcacggccggctggtcctggccgaccccggccaactcgcgggcgcgccactccaggtcgataccgaccacgtcgtacatgcggaacggccccatggcgaaaccgaacgcctggagagcccggtccacctggtacggcagagcgccttccagcagcatcaggcgggcctcggtggcgtagggttcgagcatgcggttgccgatga

SEQ ID NO: 6860 - DNA, 1320 bp, Pseudomonas aeruginosa
ggtagtggtcgctttttgtgcggtcggactgccccaggtttcgtccaccgttcctcctgcgctcgttacaacgaggacaagaccatgagccagaacttttccttccgccaggccgcggtgatcggcgccggcaccatgggtcgcggtatcgtcatgtgcctggccaacgccggtctcgacgtgcagtggctggacagcaacccgcagatgctcaaccaggcgctcggcgccgtggccgacacctacgcgcacaacgtgcgccaggggcgcatcggcgaagaggaagcggccgcgcgccgcgcccgcatcacgccggtccagcacctcgccgcgatgcgcgaggcggacctggtgatcgaggcggtctacgagaacctggaactcaagcaatcgatcttccgcgagctggacgcggcgctgaagccctccgcggtgctggccagcaatacctcctacctggacatcgacgccatcgccgcggtcaccgcgcgtccgggtcaggtgctcggcctgcacttcttcagcccggcgcacatcatgcggctgctggagatcgtgcgcggcgcgcagaccgcgccggcggtgctggaggcggccctggcgctgggcgagcggatgggcaaggtcagcgtggtggccggcaactgccacggcttcatcggcaaccgcatgctcgaaccctacgccaccgaggcccgcctgatgctgctggaaggcgctctgccgtaccaggtggaccgggctctccaggcgttcggtttcgccatggggccgttccgcatgtacgacgtggtcggtatcgacctggagtggcgcgcccgcgagttggccggggtcggccaggaccagccggccgtgcaggtggacaaccgcctttgcgagatgggccgcttcggccagaagagcggtgccggctactaccgctacgcgccgggcagccgccaggcggagcacgataccgaggtggatgccctggtgctccgggttgccgagacgctgggctacccgcggcgcgatttcgccgacgaggaaatcctcgagcgttgcctgctggcgctggtcaacgagggcgcgaagatcctcgacgagggtatcgccgcccgtagtgccgacatcgacactgtctacctgaacggctacggcttccccgccgcggagggcggtcccatggcctgggccgatcgcctcggcgcggccgagctgctgcaacgcttgcgtttcctcgaacagcgccacggcgcgcgctggaagccggcgtccctggtcgagcgcctggccgccgagggcggagccttcgccgacctgcaggaggtgcgctga

SEQ ID NO: 6861 - DNA, 1524 bp, Pseudomonas aeruginosa
gccggtgctgcaacgcctggaggagtggcggcagctcaccggccaggtactcgaggcctgcgcccgcgatccccaggagatcggcgccacttcggtggacttcctccagtacagcgcctacgtattgctcgcggccctctggttgcaagccgcggcgcgagcccaggaagcgctggacggcggctccggcgagggcgatttctatcgggccaagctgcgcagcgccgatttctacctgcggcgcatcctgccgcgggcgagcatgcaccgcgaagccttgctcggtggcgccgactgcctgatggccctgcccgaggagcatttctcgttctgacgggcgtctcgcccaaggagaccgatatgcaagctttcagtttcgccactaccgcgcagatcctctgcgaggccggctccgccatccgcctggcggaactctgccgcgagcgaagggcgcgccgcgtgttgatcgtgaccgacccggggatcacccggctcggcttgctggatgcgatcctgcccggcttcccgcgcctgggcctggccgtcgaggtgtacgaccaggtgctcgccgatccgcccgagtcggtggtcgaggccgcgctcgggcgggcgcggggcatggctgccgagctggtggtcggtttcggcggcggcagctccatggacgtagccaagctggtcgcgctgctcgcccacccagaagcagggcaggggctcggcgaggtcttcggggtcggcaacgcacgcgggccgcgcctgccgctgatccaggtgccgaccaccgccgggaccggctccgaggtgacgccgatcgccatcgtcaccaccggcgagaccaccaaggtgggcgtggtctcgccccacttgctgcccgacctggcgctgctcgacgccgacctgaccctcggcttgccgccggcggtcaccgcggcgaccggtatcgacgcgatggtgcatgcgatcgagagctataccagcaaactgaagaagaacccgctgtccgacctgctggcgcgggaggcgttgcgcctgctggcggccaacctggaacgcgcggtaggcgacggcggcgaccgcgaggcgcgccaggccatgctgctgggcgcctgcctggccgggcaggccttcgccaatgcgccggtggcggcggtgcatgccctggcctatccgctgggagggcatttccacattccccacggcctgagcaatgcgctggtgctaccggaggtgatccgtttcaacgctcccgctgccgctggactctatgccgagctggcgccgctgctgctgggcgaccgcttgcgtccgggcgatcgcgacgcgcttaccgtgcagctgatcgacgaactggcccagctcagtccgcgcaacggcctgccgagccgcttgcgcgacgccggggtggacgaggcgatgctgccgcgcctggccgccgacgcgatgctccagcagcgtctgctggtcaacaacccgcgcgaggtcggcgaggcggatgccctggcgatctatcgcgcggcatactga

SEQ ID NO: 6862 - DNA, 552 bp, Pseudomonas aeruginosa
aaagtaaaagccccgcgttcgcggggcttttacacatcagcttcggcaagcatgccgatcaacgatgcttgtgcttgcggtgtttcttgccgcggtgaccgctgtcgttgtccttgcccaggttgttaccgaccgcgccacccgctgcgccgccgaggcctgcacctatggtcgcgccggtgctgccgcccagcttgttgccgatcaccgaaccgccggccgcgccgagcccgccacccagggcggcttcggtcttgcgcccgtccttggcggtcatcgcgccgccggccgcgccacccaggccggcgcctatggccgcaccggtgctaccgccgatggcgccgcccacgacgttgcccagggcaccgcctacgccgccgcccaccgcggtcttggtggaatcgccggcgagcgcggcttgtgcgctcagcaggccgaacgcgattaccaggagagatttacgcatcgtgcgtgcctcatcgtttcaatcgggagggaaatacggtcgttcgcacaaaggccggaccatccggcccggcctttgcctcgtag

SEQ ID NO: 6863 - DNA, 666 bp, Pseudomonas aeruginosa
ggagcggcgggttcagtcgtcgtagtagcgacgatgatgcttgtggcgcttccacttcttgtactggccatagtgatggccgttgtcatgccggtaatagccatcgcgatagccggcgcggcggtagtagcgacggtcgcggtagtcgtcatcgtcgtcgtagcggcggttgccgtcgccataatggttgcccagcgcgccgccgccggcgccgccgagggccgcgccgatcaggccaccggtgctgccaccgatctgccggccgatgacgttgccgcctgcggcaccgaggccgccgccgatcgccgcttcggtcttgttgccgcgtccggcgccgactgcaccgcccgcagcgccaccgatgccactaccgatcgcggcgccagtgctgccgccgaccgcatcgccgacgaccgaacccaacaccccgcccaaggcgccgccgatggccgcgcgggtgtcgtcgcctgcgaaggcggtactaccgaccagactcagggacaacaggagtatcgaggaatacttcatagagagtttctctctgtggggatgacggctgcgatgctggggttggcccaaaccgctgacaagcgccagccgacgattggtagagcaaattcgaaatattccaagtgcttgttttgtatggggaactttcttaagtag

SEQ ID NO: 6864 - DNA, 486 bp, Pseudomonas aeruginosa
gcctcgaggccgtcggtgtgctcggcgatgaaggcgtggtcgaataccggctcgctaccctcggcctgggcttcgcgctcccaggcgaggaggaacttggcgatcccgcggatcgccgccatgtcgccgcccagtgccggacggaagaacgcggtgttcagcggcgaggacccgttagtcagcatttccagcgcgttctgcggatgctggaagcgctccaggccgcgctccttgagagggttgaagcagaccacctgggcaccgcgcttcactgcctcgcgcagcggctcgagcatgcgcgggtggttggtgccggggttctgcccaaggatgaagatcgcgtcggcgtgttcgaagtcgccgaaggtcacgctgcccttgccgaccccgacgctgcggcccagtgccacgccgctggcttcgtggcacatgttcgagcagtcggggaagttgtttgtgccgaacgcgcggacgaacaactggtag

SEQ ID NO: 6865 - DNA, 912 bp, Pseudomonas aeruginosa
cggggttggagaggttgcaggctcatggcggactcactcggttgcggccggcgccgggctgtagacccgcggggcgttgtgatggggctggtggatcaggttcagttggtggcggcgcgcccattgcacggtcagggcggtgggggcggagaggctgaccagggtgccgatcccggcacgtacggccttgtggataagctccaggctgcagcggctggtgaccacggcgaaaccgcgcgcggcgtcgaggccttggcggtgcagggcgccgatcagcttgtcgagggcgttgtggcggccgatgtcctcgcgacacaggcgcagctcgccatgcccgtcgaaatacagcgcggcatgcagggcgccgctatggcgcgccagtcgctgggcctgctcgatacgctggcgcagggcgccgagatgggcggcgggaggcagcgcctgcggcgaccgttccggcagttgcggcagggcctgctccagggcttcgacgccgcacaggccgcagccggaagtgccggccagttgccggcgttggcgcttgaggttccagaacgcgcggctgctgatttcgacctcggcgtggagggattcgccctggccgctgacgcggatttcatagatgtcgtcgatggactccacgaagccgctgctgaggctgaaaccgcggacgaaatcctccatgtcctcgggcgaggccatcatcaccgcctggttcagtccgttgtagctgatcgccacggcacactcggcggcaagggaggcctggccgacctgctgcggcaggtgcaggtcggcgtagcggtaatcgtcgggaacggcggaaggcgcccaggtatccgcggataccgggcatgcaggctggcaaggcatgggctgggccctatcgttctaggtgtggcaccagcctag

SEQ ID NO: 6866 - DNA, 606 bp, Pseudomonas aeruginosa
cggcaggccagccagcgcttcccagttcagcagcgcggcgtcgagcgggaaatggctggggtgatggagcaggcccatgcgggtctccgccagttcgatgccctcgaaatggctgcggtccagacggtccagataagagacgccgagatcgaactggttgcgcgccaggccttcgagtacctgttccgaactcagggaatagagctggaaacgcaactccgggtggcgcccggccatgtgctggaccaggcgcatcgggtcgaagctggccagcggcaccacgcccaggcgcagggtcccgaccagttgcccgcggcaggcggcggcttccgcgtacagcccttcctgggccgccagcaggctgcgtgcccaggccagtacgcgctcgccggcctcggtgaagccttcgaagcgctggctgcgtcgcaccagttccaggccgagttcttcctccaggctgcgcaggcgcatggacagggtcggctgggtgacgtggcagcgcgcggcggcctggccgaagtggcgggtttcgtcgagggcgcagaggaatttcagttgcttgatgtccatcggcgcttccgtggcgggggtgtcgccgaatcttaa

SEQ ID NO: 6867 - DNA, 1437 bp, Pseudomonas aeruginosa
tcggaaaagccggggtatgataacccgccggcttcgccaaggagttatccacatgcgtcagaaacccaccgtactcgccagcgagatcgtcgcgaagagccgactgttcgctgtcgaggagttgcaactgcgcttcagcaatggcgtcgagcgcacctacgagcgtctggtcggcaagggccagggctacggtgcggtgatggtggtggccatgctcgatgccgagcacgcggtgctggtggaggaatattgcgccggggtcgacgaataccagttgtcgctgcccaagggcctggtcgagccgggcgaggacatcctcgcggcggccaaccgcgaactcaaggaggaggcgggctacggggcccggcaactggagcacatcaccgaactgtcgctgtcgccgggctacatgagccagcgcatccaggtggtgctggcgcgcgatctctacgaggagcgcctgccgggcgacgagccggaaccgatgggcgtcgatcgcatcagcctgcgcgaactgtcgagcctggcccagcacgcccagttcagcgaaggccgcgccctggccgcgctgtacctggtgcgcgacctgctcacccagcgcggcgagtaccaggcatgaggccggtgccttggggcgaattggtggcgctggtgcggcgcgccggcgaggcgatcctgccgcactggcgcgccgacgtggcggtgcgctcgaaggccgacgaatcgccggtgactgccgccgacctggccgcgcaccatatattggaggcgggattgcgggcgctggcgccggacattccggtgctttccgaagaggattgcgagataccgctgagcgagcgcggccactggcggcgctggtggctggtggacccgctggacggcaccaaggagttcatctccggtagcgaggagttcaccgtcaacgtggccctggtcgaggatggccgggtgctgttcggcctggtcggcgtgccggtgagcggccgctgctactacggtggcgccggtctcggtgcctggcgcgaggaggccgatggccgcgtgcaaccgatcagtgtgcgcctggagcccgaggaggccttcaccgtggtggccagcaagcgccatggcagcccggcccaggagcgcctgctggatggcttgagcgagcgcttcggcgacctgcggcgagccagcatcggcagttcgctgaagttctgcctgctcgccgagggcgctgccgactgctatccgcgcctgacgccaacctcgcaatgggacacggccgccgcccagggtgtgctggagggcgccggcggcgaggtgctcgacctgcatggcgcgccattcacctacgagccgcgcgaggactacctcaacggctccttcctggccctgccgcgcgctgccgagtggcgcagcgagctgatccaactggcgcgcgcgctgcactga

SEQ ID NO: 6868 - DNA, 558 bp, Pseudomonas aeruginosa
aatgatcagggtgactatgctgacgtgaatcatgactatcgagtcacgtattttcctactgaataccgcgttgcgtgggctttccacaagtgctggcggtctgccgtggggggattgacgcccatggccgggctgttggcggaggtggggcgtgggcgagtgttgcgggacttgcttgaaagtccgcgcgcagaggcgcggcgccggggcgccggggcgtccgcggaggcggcggatgacgcgtggcgctatccgcccttcgcccgatgccggcggaggagaatgaagaagggccgcgaagcggccctgggggtggtgtatcagcggtactcgatgcccgccttgcgcgtgctgactcgcgttcccgccttgccctcggtgatcgcgacgatgtccgcgagcgaaccgatcaccgcgtccttgccggtggcgcgggcgaactcgatggcggcctggaccttcggtcccatggagccggcggcgaagccgaggcgctccagttcgtccgggtgggcctgggcgatggccttctgggtcggcttgccccagtcgacgtag

SEQ ID NO: 6869 - DNA, 279 bp, Pseudomonas aeruginosa
ggcagcagttccttgatccgctcgccccaggcttccaccggctcgcccatcgatacccagacgtcggtgtggacgaagtccacgcccttcacggcttccttcggatcctcggtgagggtcagcttggcgccgctttcctcggcgaacttcttgcactgggcgacgaactcgtcgtgcggccagagcgccttcggcgcggcgatgcgtacgtccatgccgagcttggcgccgatcagcagcagggagttacccatgttgttgcgcgcgtcgcccaggtag

SEQ ID NO: 6870 - DNA, 1422 bp, Pseudomonas aeruginosa
cgcagctcgcgggtgctgtggtgcatcaggctgagcaggttacggttgtgcatgttgaaagccatgattgatctccttgtgggaagtcggtgggcggcgccctccctggggacgccgccgttcagctcgagagcgggttgtctgtcagtagtcgatcgggtcgcggatgatcgggcaggtcatgcagtggccgccgccgcgaccgcgacccagttcgctggcgctgatggtgatgacctcgacgccggccttgcgcagcagggtgttggtgtaggtgttgcggtcgtagccgaccaccacgcccggctccaggcagaccacgttgttaccgtcgtcccattgctcgcgctcggcggcgaagctgttgccgccggtctcgaccacgcgcagtttcttcaggccgagggattcggcgaccacttcgaggaaggttttctcctcgcggcggatgttcatgccgtaggggctgctcggatcggggcgcaggctgaagggcacgatttccttgaccacttccgggaagaccgtgaccaggtcgcggtcgcagaagctgaacacggtgtccaggtgcatcgcggcgcgggacttcggcaggccggcgacgatcacccgctcggcggcgcccttggcgaacagcgactgggcgacctgaccgatggcctggcgcgaggagcgctcgcccatgccgatcaggaccacgccgttgccgatcggcatcacgtcgccgccttccagggtcgaggagccgtggtccttgtccgggtcgccgtaccagatctcgaattcggcgttggcgaactcgggatggaacttgtagatggcggtggtcagcagggtttcctgtcgtcgcgccggccagtacatcgggttcagggtcacgccgccgtagatccagcacgtggtgtcacgggtgaactgggtgttcggcaacggcggcagcaggaagctggaatggcccaggtactcgcggtacatcttgaggatgtcggcgccttcgctggcgggcaggtcgtcagcggcgacgccgccgatcaggtactcggccagcttgcgcggctccaggctctccagccaggagcgcagctcgctggtcaggcccaggccgacgctgtcggcggtgatctggcgatcgaggatccacttcagcgcttccgggttctggatggtctcggtcagcagattgtgcatctcgaggacgtcgatgccgcgctcgcgcatcttggtgacgaagtcgaagtggtcgcgcttggcctggttcacccagatcacgtcgtcgaacagcaactcgtcgcagttgctcggggtcaggcgctggtgggcgagtccgggcgagcagaccatcactttgcgcagtttgccggcttcggagtggacgccaagtttggttttttccgtgctcatttcacgtctccagtggagtaa

SEQ ID NO: 6871 - DNA, 1410 bp, Pseudomonas aeruginosa
tcagagggtgaggaaaccgtcgtagaggccgtaggcagccaccagggcgccaatgacgactgcggcgaagatcagtttttcgattccggtgaagatcggctggccgacctcgtgcttggccttggcgaaaaggatcgcgccgggcgcatacagcagggcggacagcagcaggtacttcaggcccccggcgtagagcagccagaccgcgtaggccacggcgatgccggcgatgaccaggtccttgctgcgttcgcgggcatcgttctcgtaggtctcgcccttcagggtcagcagcaggccataggcggcggaccagaagtacgggatcaggatcatcgaggtggccaggagcagcatcttggtgtacgggtccatgccgtccgggtcgcccgaggtgaagaacaccaccaccaggaacacctgtacgcagatgttggtcagccacagggcgttggccggcacctggttggcgttctcgcggcgcaggaactccggcatggtgtggtccttggcggcggcgaacatgatctcggcgcacagcagcacccaggagagcagcgcgcccagcagcgagatcagcaggccgacgctgatcagcacggcgccccagtggccgaccacatgctcgagtaccagcgccatcgacgggttctgcagcttggccagttccggctgggtcatcacgcccatggacagcacgttgaccagcaccagcaggagcaggacggtgatgaagccgatcacggtggccttgccgacgtcggaacgtttttccgcgcgggaggagaagatgctcgcgccctcgatgccgatgaacacccagacggtgaccagcatcatgttgcgcacctggttcatcacgctgcccaggtccgggttgctcttgccccagatgtcggcggtgaagatgtccagcttgaaggcgaacaggcagatcaggatgaacaggaacagcggcacgaccttggccacggtggtgacggtgttgatgaacgccgcctccttgatcccgcgcagcaccaggaagtgcagggcccagagcaggaccgaggcgcagacgatcgccgcgacggtgtcgcccttgccgaagatcgggaagaagtagccgagggtgctgaacaacaggacgaagtagccgacgttgcccagccaggcgctgatccagtagccccaggccgaggagaaacccatgtagtcgccgaagccggccttggcgtaggcgtacacgccgccgtcgagttcgggcttgcggttggcgagggtctggaagacgaaagcgagggtgagcatgccgacggcggtgatcgcccatccgatcagcacggcgccgacatcggcgctggctgccatgttttgcgggagggagaagatgccccctccgatcatcgagccgacaaccagagccgttag

SEQ ID NO: 6872 - DNA, 198 bp, Pseudomonas aeruginosa
agaagcccggcgttcgccgggctcttcatttgggcttcagggtgtgaagaccgctggggggacgggatcgccgcccacccgccgcgcgtgctggcgcacgtcggcacaggtgaaggggccgccatccggttcgtggccgaagggcgcggttcgctgggcgaaccgaaagccggtgccaggggcactgcgagcgattga

SEQ ID NO: 6873 - DNA, 1026 bp, Pseudomonas aeruginosa
gcggatttttgccgaaggcccgagcgcagggcggggttttccgccgtcgttaccgttccgtcagctcatccccagccagttcggcaatgccagggataccgccgggatgtaggtcacgatgatcaggaacaccagcaggatcatcagccacggcagcgctgcgcggatggtcgcgcccagcggcatgccggtgaccgccgaggtgacgaacaggttgagcccgaccggcggcgtgatcaggccgatctccatgttcaccaccatgatgatgccgaggtggatcggatcgatgcccagctccatggcgatggggaagaagatcggcgccaggatcaggatgatcgccgaaggctccatgaagttgccggcgatcagcagcacgatgttcaccaccagcaggaacatccatggcgaaagtcccagttccgtgacccaactggcgatgctctgcggtatctgctcggtggtcagcacgtgggcgaagagcatggcgttggcgatgatgaacatcagcatgatggtcagcttgccggactccagcagcaccttcgggcattcgctcaggcgcatgtcgcggtagacgaacagtgcgacaaaggccgagtacaccgcggcgacggcggcggcctcggtgggggtgaaggcgccggaatagatgccgccgaggatgatcaccatcagcagcagcccccacagcgccttgcgcgcgctggccagccattcgcgcagactgacccttggcatggcgggcagcttcttgacccgggcgacgatgtagatcaccaccatcaggatcagtcccagcagcagccccggaaccacgccggcgatgaacagcttgcccaccgaggtctcggtggcggcggcgtagaccaccatcacgatcgatggcgggatgaggatgccgagggtgccggcgttgcagacgatcccggcgccgaacgcctgtggataacccgagcggaccatgccggcgatggcgatcgaacccactgccgccaccgttgccggagacgagccggatag

SEQ ID NO: 6874 - DNA, 1530 bp, Pseudomonas aeruginosa
actgcggccgctcggcgcgaaccagtcgcgccaggccttcggggtcggcgagatcggcgcgccgacggtcacagaccagcagttcgcccagcggcgccagggcgcgctgcagctcccagccgacctggccgttggcgccgaggagaaggatccggttcatgcgtactgcttacccacccactcgcggtaggcaccgctggttacgttggccacccagtcctggttgtccaggtaccagcgcacggtcttgcggatgccggtctcgaaggtttccgccggcttccagcccagctcgcgctccaggcgcgtggcatcgatggcgtagcggcgatcatggcccggacgatccttgacgaaggtgatctgctcgcgatagctgcggccgtcggcgcgcggctgctcctggtcgaggatggcgcagagggtctcgaccacgtcgaggttggccttttcgttccagccgccgacattgtaggtctcgcccagttgcccggcttcgaggacccggcggatggcgctgcaatggtccttgacgtagagccagtctcggatctgctggccgtcgccgtagatcggcagcggcttgccggccagggcgttgtggatcaccagtgggatgagcttttccgggaagtggtacgggccgtagttgttcgagcagttggtggtcagcaccggcagcccgtaggtgtggtgataggcccgcaccaggtggtcggaggccgccttggacgccgagtagggactgttcggctcgtagcggttgttctcggtgaaggccggatcgctcggtgccagcgagccatagacttcgtcggtggagacgtggaggaagcggaatgccgccttcgcttccggctccagcgcgccccagtaggcgcgcacttcttccagcaggcggaaggtgccgacgatgttggtctggatgaagtcctcggggccgtggatcgagcggtccacatgggattccgcggcgaagttgaggatcgcccgcggctggtgctcggcgagcaggcgggctaccagttggctatcgccgatatcgccggcaacgaaggtgtgccgggcgtcgccgtcgaggctggcgaggttctgccggttgccggcgtaggtgagcttgtcgaggctgaccaccggctcgtcatgcagggccagccagtcgagcacgaaattggcgccgatgaagccggcgctgccggtcacgagaatcgtcatgagtcataccttgttcaagcagtggttgtccgtagggctgcttcgacacgtcccgccaaggtgtaccaatcgatcgtgaagacgacgattagtacgggaaaaatggcgatcctgccaaccccagatctggtaggtgcatctgacccggcattctatgcgaagtgccatcatcgggcggcaggtaggaggataaaacaaaaaagccccgcgcgaggcggggcttttcggggattcggggcaccaggagtcaaaaaatatcataactatatgtttctgtatgatttttattttttcagtctagcagtttatctctaa

SEQ ID NO: 6875 - DNA, 489 bp, Pseudomonas aeruginosa
tgcggagctgtgggtaacttcacagcgagcttggagaggtggtgcggcgggctactcggttttcttggcactgcgaaggcgggtgacgttctcgcccgtctgcttggcaaactcgtgcggggtcacatggtcctcgcggtttgcctccagaaaccggctccaccaggtcatgatcatccggcgctcttcgaggaactcggccttgtgggtgtaggcggcgcgcacgttgttgcgttccttgtggctcatctgccgctcgatagccgtctccgaccaaagcccggactcgaccagcgcactgcacgccatggctcggaagccgtgtccgcagatatccaccttggtgtcgtagcccatcgtcctgagagcggcattcaccgtgttttcggacatcggtttccacggtttggcatcccccgcgaacaccaggtcgaacttgccggtgatcgcgtgaatctgctcaagcaaggccactgcctgtggcgataa

SEQ ID NO: 6876 - DNA, 1773 bp, Pseudomonas aeruginosa
atggagatcagcagggtctgggtgatcggatacagcggcccggcgacgaagccctgcaaggcgcggaagccgaccagagaaggcatcgactgggcgatgccgcagaggaacgaggcgagtacgaacagcagcgcggcggcgatgaacaggcgcacctcgccgacccgccgggccagccagccggtcagcggcagggcgatggcgttgctcacggcgaacgaggtgatcacccaggtgccctgttccgaactcaccccgaggttaccggagatggtcggcagggcgacgttggcgatggtggtgtcgagcacctgcatgaaagtcgccagggacaggccgatggtcgccatcaccaggctgggcggggagaagctgctgctttcgctcatgctggcgggctcaacgctgggcggtcttgccgtggtcttcggcgaggttggcttcgatcaggcgttcgatcagcttgtcggccgaggccagttgctgctggtagacatcggtggagaacagcgcttcgcgcggtggttgctgggccagggccgggccgctctggtcatgcaggtcgaccttgacgtccatcgacaggccgatgcgcagcggatgcttctgcaattcttgcggatcaatatggatgcgcaccggcacccgctggacgatcttgatccagttgccggtggcgttctgcgccggcagcagggagaacgcgctgccggtgcccacgccgaggctgtcgacggtgccgctgtagcgcacgtcgctgccgtagaggtcggagcggatttccaccggctggccgatacgcatgtgcttgagctgggtttccttgaagttggcgtcgatccagatctggtccagcgggaccacggccatcagcgcattgcccggttgcacgcgctggccgacctgtacgctgcgcttggcgacgtagccggtgaccggcgcgacgatggtcgagcgggcgtcgtccaggtaggcctggcgcagttgcgcggcggcggccttgacgtccggatgggaggtgatctgggtgtcgtcgaccagcgcgcgattggtgttcaactgctgttccgagctggtcagcgaggctttcgcgctgtccagggcgtcgcgggcgtgggccagttcctcctgggaaatggcgccgtcgtctgcgaggttcttgcgccgcttgtagtcggcctcggccttggccagcgcgaccttgcgggtggcgacctcggcgcgatagccgtcgacgttgctgaacagcccgcgcacctggcgcacggtgtgggccaggttggcctcggcgcgttggagggcgatgtcggcgtcgctgggatcgaacctgaccagttcctggcccttgcgcaccaggtcgccgtcgtcggcgccgatgctgaccacggtgccgacgatctgcggggtgatctgtaccacgttgccgttgatgtaggcgtcgtcggtgtcctcgtgccagcggccgtagaagaactcccaggccacgctggccagggtggcgagaacgatcacggcgagcaggatcagcaaccagcgcttgcgcttcgggttgccggcgggggtttcgctgttggcggtagtcatggtgggtgcctcgttcattctgccggcgctttcgcggtagcgagcgcagcggagcgggaatcgggttggaaaccgccgcccagggcctggaccagctggacggaaagatcgatctgctggctctccaggctggccagctggcgttcggcgaccagcagttgctgttgcacgctgagggcgtcgaggtag

SEQ ID NO: 6877 - DNA, 816 bp, Pseudomonas aeruginosa
ctggccttggcgtccagcgtcggctggcgcgcggcatcttgcgcctgggccgttgccgccgcctggcgcgcacgcgcctcggcgatctgcaggtcgggggtgccttgcagggcttcgccgatcagttggtcgagctgccggtcgccgagcccggtccaccagtcctggcgcggccaggccgctggcgaaagggctacgccgtccaggctcctgcccgcctggagggcgcctgccggttgcagtcgggcgttcggttccaggccttcggaagtgacgcagccggcggccagcactatcgccgaggccagcgccaatcgctgcggccagggatggagaagagggaacggcatggatcaggactcctgcaggctggcccgcgggcagccggcgtgtagcagaaccttggtcagcagatgggtcagcgtctgcaattcttccgtgctcaggcaggcgaccagctcgttcatcgccgccgaggcgataagcggaagctgctcctggaccttccgtcccgcttcgctgagatccaggcgcaggcaacggcggtcttcgggacagcgaccacgcagcagcagcccttttttctccaggcgcgccagcatgcgagtcatcgagccgctgtccaccgacagctcgcgacacagttcgaccggactgttggcacggttgagaccgacgaagatcagcaccttgaactgggcggcggttatgtccagcgcggcgaggtgcttctcgaggatgcggtccttggtcgcggcactgacgccgatgagctggccaatggagcccttgaagggaaagtcggaagcgctgtag

SEQ ID NO: 6878 - DNA, 867 bp, Pseudomonas aeruginosa
ggaacgggaaggtttcggacacgatgcgagcggcagcgggaaaacggggcggcgattatagccgccccgcaggcatcggaaagcacccgctcagcggccctgggtggcgtcgacccgcaaccagcgttcgatcaggcggaagatccgcgtcagcacgatggtgatcaccaggtacagcgcgccggccaggcagaagaacagcatcgattcgtaggtgcgggcgatgatggtccgggccatgcccatgatgtcgaacagggtcacggtgtagaccaccgcgctggccttgagcatcaggatcacttcgttgctgtaggccggcaggccgatgcgcaccgcgcgcggcaggatgatgtgccagagcgcctggcgccgcgacatgccgagggcgcgggcggcctccacctcgccgaccggcaccgagtggatcgcgccgcggaggatctcggcgatataggcggcggtgtgcagggtcatggtcagcagcgcgcaccagtacggatcgcgcaggtagggccagaaggcgctcttgcgcacttcctcgaactgcgccaggccgtagtagacgatgaacagttgcagcagcagcggcgtgccgcggaagaagaagatgtaggcgtacggcaccgcgcgcacgtaccagtgccgcgaggcgcgggcgatgcccagcggcagggccagggcgagcccggcgaccaccgcgatcgccagcagctccagggtcagcgccgcgccctggagcatcttcggcatccacttgaggatcagctcccactcgctcatagctcgttcctcacgaaaccacggccggcgcgacgttcgaggaagtgcagggcgaccatgatgacgaccgtgaggctcaggtag

SEQ ID NO: 6879 - DNA, 816 bp, Pseudomonas aeruginosa
aggcggccaccgccgggacgcgcccggcggtggcctggcttggcatcaatagatgctgaaggggaagtacttgtcgttgatcttcttgtaggtaccgtcggcgacgatttccttcagcgcggcgttgagcttctcgcgcagcgggtcgcccttgcgcacggcgataccgatcttgtcgttgtcgaacaccggttcgcccttgaactcgaactccttgccggcgtcgctcttcagccagtcgtactgcacgaacttgtcggccagcacgccgtccaggcgccccgaggagaggtcgaggtaggcgttctcctgggtgtcgtagagcttgatggtgaccacgtcggccatgttgtcttccagccaggtgccggcgatggtggcgcgctgggcgccgatcaccttgcccttcagggagtccttgtcggtcttgaagtcgacgctcttcggcgcgacgaactgcagcttgttggtgtagtagggatcggtgaagtcgactgcctgcttgcgctcgtcggtgatcgacatggacgcgacgatgaagtcgaacttcttggcgttcaacgccgggatgatgccgtcccagtcggaggtcaccacctcgcactcggtcttcatcttggcgcacagcgccttgccgatgtcgaggtcgaagccgaccgcctggccgctggcatcgatgccgttgaagggcgggtaggcgccttcggtgccgatgcgcagcttgtcggcggcgctggcgtcgagggcgaaggccagggttgcagcggcggccagcaggatcttcttatagttcttcatgcggtgttgctccgttag

SEQ ID NO: 6880 - DNA, 324 bp, Pseudomonas aeruginosa
cggtggctggacatgaactgtttgcagcgcgccgactgggggttttcgaaaacctgttgcggcgttccctgctcttctaccaggccctggtggaggaataccacctcgctggaaacctggcgggcgaagctcatttcgtgggtgaccagcagcatggtccggccctcttcggcgagcgcacggatcacgttaagcacttcctgtaccatttccgggtcgagcgccgaggtgggctcgtcgaacaggatcaccttgggttgcatggccagggtccgggcgatggccgcgcgctgctgctggccgccggaaagttgcgcgggatag

SEQ ID NO: 6881 - DNA, 486 bp, Pseudomonas aeruginosa
aggtgtccatgccgatctgtgccggtttcacccattccaccggaacgtagagcaggccgccgcccaccgggatcggcgcggtcggcaccaggatcgcgtagtgcgcgcggccgtccagttccaccgcttcggggttgggcatcagcgccagcacggcggcgccgtcgccgccgaagaaacaccacaccggactcatcgcggcgatgtcggcgtcctgcttcttgtccagcaggccgacgaaacggtcggccaggttgtacaggttgccgatcagcggggtgcgccgcagggtcaggtcgaacaggttggccagcggccgcttcaggcctagctgtacgccgaggccaagcaggtagatggctaccagcagtagcgcggtaccgagcaggtaggccagtggcgaatcgccggcgagcggctggcctatggcggcgaagccgcgaccgatcaggctggatggaccgacgaagcggttcagcaagctga

SEQ ID NO: 6882 - DNA, 783 bp, Pseudomonas aeruginosa
gctgtgcgagtcgcgttcattccagcaggccttcacggagggcgtatggcggagagaaagaccctgttgctgaccggggcgagccgcggtatcgggcatgccacggtgaagtacttcaatgccgcgggttggcgggtgttcaccgcgtcgcggcagagctgggccagcgaatgtccctgggcggacggcgaggaaaaccacatccatctggacctggaggacattcccggcgtcgaggccagcctggaactgatccgcgagaagcttggcgacggccggctccacgcgctggtggacaatgccggcatctcgcccaagggcgaaggcggcgagcgcctcggtgtgctggaaaccgactacgccacctggctgcgggtgttcaacgtcaacctgttctccaccgcgctgctggcgcgcggactgttcgccgagctgaaggcggcgcagggaacggtgatcaacgtgacctccatcgccggctcgaaggtgcatccgttcgccggggtggcctacgccacttccaaggcggcgttgtccgcgctgacccgcgagatggcccacgacttcggcccgcatggggtgcgggtgaacgccatcgcgccgggggagatcgacacctcgatcctgtcgccgggcaccgaggagatcgtcgagcgcagcatcccgctgcaccgcctcggccggccggaggagatcgcttcgctgatctacttcctctgcaccagcggcgcatcctacgtgaatggtgcggaaatccacgtcaacggcgggcagcacgtctag

SEQ ID NO: 6883 - DNA, 366 bp, Pseudomonas aeruginosa
agttggtcggagagtgctttatcgcactgtagaaattgcggggctactcgcatgccaacagtaaatttcgatgcgattctaggttcgcctgcattcacgcgatttacgcatcgcgctttttatctgctgttgctactgactaacttgggagtcccactaggccaacaccgcgtttggggtgggttaccaggctggtgggtgttccccataactgccgtactggcccttttagctgtgcagcagtatttgtccggtgagagccatctttatgcgctcgccggcattccgtatgccctgctgtacgttcatgacgctctttccacccccttggttttaccgcctgcacagcggagagcagccagatga

SEQ ID NO: 6884 - DNA, 243 bp, Pseudomonas aeruginosa
cggctctggtcgcctgccggggtgaccagcgactggcgcaggccctggccatcgatgtgctgcagcaggtcgggatcgcggccccagccggcggaaccggggtgcagtccctggagcagttgcgcttcctggatgtcggcgccggccttgagcaggctgccgtggtcgccgtgcacattgaagcgtggcgccggattggcggcgagcatgctggcgcgcagcgctacctggcagtgcggataa

SEQ ID NO: 6885 - DNA, 408 bp, Pseudomonas aeruginosa
cgcaccgggccgatgctgccggcctgcagggcggcctccacggcgaggaagtcgctgtcgaagcgccggttctggaacaccgagaggacctgcccaggccgttcacgggcgaggtcggcgaggcgccgggcttcggccagggtgacggtgaacggcttgtccaccaccacgtgcttgccggcgcgcaaggcccgttcggcgaggctggcgtgggtggcattgggcgaggcgatgaccaccaggtcgatgtcggcggcctcgatggcctcatccggatcggcgctgacccgggcttcgggcaggtcggcgtgcacccgcccagggtcgcgggagaccacgtgctccaggcacaacgccggtaccgcgcggatcagcggggcgtggaaggtcttgccggcgaagccgtag

SEQ ID NO: 6886 - DNA, 1401 bp, Pseudomonas aeruginosa
atgtcctcgcccttcgcgccaggatacggcgggcggtcgaggccgggcagctcttcgtggtacttgcggcacatcacggtgcggctcatggtcgttctcctgcagttgccgccgggcccgcgggcccggcattcacgcggccgtgccgcgtccgagttcctgttctgcgcgcttgagcagcttcttcaccggagcggcgaggcccaggcgcggcggggtggcgaggttataccagagccagtcgccctcggccacggcgcgcggagcgccttccaccgccaccagccagggctcgatggcgagctggaaatgactgaaggtatgggtcaggccgctcagttcgcggcgctcgccgagggccagggaatggcgcgcggcgagcggttcgaggccgtcgaggtcgtccagttcggggaggctccagagcccgccccagagtccgctggaaggccgccggtagagcagtatggcgccgtcgcggttggccaggatcggcatcagcgtgcgcttctgcggcaacgccttgcgcggcttgggctgcggataatcggcttcgcggccgagcaggtgcgcgcggcagccggagaccagcgggcaaagcaggcaactgggcttgctgcgcgtgcagagggtggcgccgaggtccatcatcgcctgggtgtagtggttgacccgtgcgtgcggggtgaagcgttcggcggcttcccacagcgccctggccaccttcggttcgccgggatagccgtcctgcgccaggtagcgcgccagtacgcgcttgacgttgccgtcgaggatcggtgcgcgcaggcccatcgacaggctggcgatggctccagcggtggagcggccgatgccgggcagttcggcgagttgctcgacgtcgcgggggaactcccccgcatgccgctcgaccacgatctgcgcggtcttgtgcaggttgcgcgcacggctgtagtagccgagcccggtccacaggtgcaggacttcgtcctcggccgccgcggccagtgcctcgacgtcgggcaacgctgccatgaaacggtcgaagtaaccgagcacggtgctgacctgggtctgctgcagcatgatttccgagacccacacccggtagggggtgatgccctgctgccagggcagatccttgcgaccgtgacggtcgtaccagtcgaggaccgcgccgttgaagccttcaggtgtcatttgcggttgaacagccctttgagtgcgtctttcagctccggactgaccttgtcgccgagcttctcttcgagtttttcgttgaggcgattgccggccagtttcgcggcgaccttgcccatgccttccttgtccaggcggcaggccttggcgccgagttccagcgggccgcggcagagcagcggccattcgatgccggcgtag

SEQ ID NO: 6887 - DNA, 372 bp, Pseudomonas aeruginosa
ccctgcgtttcccctgggaccgcatctacaagctggcgctggagaagcccggctacggggtgttcgtcaccgcccgcctggccgagcgcgaggacaagttcaagtgggtcggtccgatcggcccggacgactgggtgctgctggccaagggcgacagcccgatcaccctgggcagcctggacgaggcgaagaaataccggatcggcgcctacaagggcgatgccatcgccgagttcctcggcaagaacggtttcgaggccgacctggcgctacgcgaccaggaaaacgcgcagaagctggtcaagggccagatcgacctctgggccagcggcgatcccgccgggcgctacctggccaagcaggaaggcgtga

SEQ ID NO: 6888 - DNA, 777 bp, Pseudomonas aeruginosa
ccaagcgagcggtgtgaccatgctgaaagtcctgatccagaccctgatcctgggggtgttgctgggggcctccgcggcccgtgccgaattgcccgccgactacaaggtggtgctgctgaccgagaacttcccgcccttcaacatggcggtggacgacaagaacttcgcccgcgacgatggcatcgacggcatcagtgccgacatcgtccgggagatgttcaggcgcgccggcatcggctattccctgagccctgcgcttccccctgggaccgcctgtaccggttgaccctggacaagcccggctacgggctgttctccatgacctacacccccgagcgggtgccgcagttcaaatgggtcggcccgctggccgacaccagttgggtgttgctggcgccggccggcagcaagatcgccgtgaagaatctcaaggacgccgcccgctacaagctcggcgcctacaagaacgacgcggtcagccagcacctggaggcccagggcatcccggtgatcaacgccctgcgcgaccaggaaaacgtgaagaagcttaccggcgggcagatcgacctgtgggccaccaccgatccggtcggccgctacctggccaagcaggaaggcgtgtccggcctgcagacggtgctgcgtttcaacgaggccaagctctacctggcgttgaacaaggacactccggacgaggtggtggagcgcctgcaaaaggccctggagcagatgcgccaggaaggcttcgtcgacgaagccgtcgccaactacctctga

SEQ ID NO: 6889 - DNA, 618 bp, Pseudomonas aeruginosa
acttcgacgccctctacgcccaggaaatcgcccgcatgcaggcctccggcgagatcccgacgccgtcggtccagtaagcccagcgcttgcgaagaagcccgccttgcgcgggctttttcatgcctgtcggccggctcagtccatggcgaagccgagctggcgccaggcttcgtagacggtcaccgccaccgtgttggacaggttcaggctacggcagccttcgcgcatcggcaggcgcaggcgccgatcggttggcagggcgttgcgcacgtcctccggcagtccgcggctttccgggccgaagaggaaggcatcgtcgcgctggtaggccacttcgtggaaggcccgcgaccccttggtggtgaaggcgaacaggcgtggctggccgagggcctcgaggcagctctgcagatccgggtagcggcgtacgctggcgtattcgtggtagtcgaggccggcacggcgcaagcgcttgtcgtccagttcgaaaccgagcggctcgatcaggtgcagactgcatccggcgttggcgcagagcctgataatgttgccggtattcggaggtatctccggttgaaacaggatgacgtggaacatgcagggctccggagcagataa

SEQ ID NO: 6890 - DNA, 1383 bp, Pseudomonas aeruginosa
agagaggctacaaccgtgatcgattccctgaaccacctcccccgtccggacgccggcgcggacacgctcgccgagcgcttcgccgacctcgcgccgccgctcaacgcccgccaggccgccctggaaagcgcccgctgcctgtactgctacgacgcgccctgcgtcaacgcctgcccgaccgagatcgacatccccgggttcatccgcagcatcgcccaggagaatgtccagggcgcggcgcagaagatcctctcggcgaacatcctcggcggcagctgcgcccgcgtctgccccacggaaatcctctgccagcgggcctgcgtacgcaacaacgcccaggaatgcgcaccggtgctgatcggccagttgcaacgctacgccctcgaccacgccggcttcggcgaacatccgttcaagcgctcgccggccaccggcaagcgcatcgccgtggtcggcgccgggccggccgggctgtcctgcgcccaccgcctggccatgcacggccacgacgtggtgctcttcgaggcccgcgccaaggccggcggcctcaacgagtacggcatcgcccgctacaagctggtggacgacttcgcccggcgcgaagtggaattcctcctgcagatcggcggtatcgaactgcgccacggccagcgtctcggcgacaacctggcgctcggcgccctgcacgacgagtacgacgcggtgttcctcggcatcggcctggccgccagcaagcgcctcggcctggaagacgaggacgcccccggcctgctcgccgccaccgactacatccgcgagctgcggcagagcgacgacctgctcgacctgcccgtcgccgaccgttgcatcgtcatcggcgccggcaacaccgccatcgacatggcggtgcagatgagccggctcggcgcccgcgacgtcaacctggtctaccgccgtggcttcgaggaaatgggcgccaccggccatgagcaagagatcgccaaggccagccaggtgcgcctgctgacctgggcccgaccggaacgggtactgctcgacgagcatggccgggtgcgcggcatgcgcttcgcccgcacgcgcctggagaacggtcgcctgggcgacaccggcgagcacttcgaactggccgccgacgccatcttcaaggccatcggccaggccttcgaaggcgccagcctgggcgatccgctggcagcgcaactgcggcgcgacggcgagcgcatccaggtcgacggacagatgcgcaccagcatccccggcatctacgccggcggcgactgcgtggcgctcggcgaggacctcaccgtgcaggcggtgcagcacggcaaactggcggcggaagcgatccacgcccaactcatgctcaacgtggaggctgcgtga

SEQ ID NO: 6891 - DNA, 1581 bp, Pseudomonas aeruginosa
tcgacgccgagtgcgtgggctgcaacctgtgccagatcacctgtccggtggagaactgcatcgaaatggtgccgcaggacaccggcaagccctatctcaactggacccaggatccgcgcaacccctaccgcgaagcctcctgaacgcagggcggcgcccgcatccccggcggacgccgccctgccgcgcgccggcacgcttcctgcgtgccgctgcggtccgacgacgcgcaacggcgtctgtcggatcgacccgccttcgactaccattcgccgcggcccggccgacgctcccggacggccggcgccccacggagactcgcgcatgtccgcagacagcaactacagccagcaaccggtcccgctggcagcgcgcaagagcgcgctggccctgagcgtggtgatgctcggcctgaccttcttttccgccagcatgtggaccggcggcaccctcggcaccggcctgagctacgacgacttcttcctcgccgtgctgctgggcaacctgatgctcggcctgtacaccgcgatcctcggcttcatcggcgcgcgcaccggcctttccacccacctgctggcgcattactccgttcggcagcaagggctcctggctgccctcggcgttgctcggcggcacccaggtcggctggttcggcgtcggcgtagcgatgttcgccccaaatacccggtggccaaggccaccggcctcgacgtcaacctgctgatcctggtttccggagcgctgatgaccctcacggtgttcttcggcatcgccggtctgaccctgctgtcggccatcgcggtcccggcgatcgtcgttctcggcagctactcggtatggctcgcggtgcgcgacgccggcggcctggcggcgctgcagcaggtgacgccgagcgcgccgctgagcctctcgaccgcgatcgccctggtggtcggctcgttcgtcagcgccggcaccctcaccgccgacttcgtccgcttcggccgcagcgcgcgtaccgccgtggtggtgtgcctggtggcgttcttcctcggcaactcgctgatgttcatcttcggcgcggccggcgcggcggcggtgggcaagtcggacatctccgacgtgatgatcgcccagggcctgctgatcccggcgatcctggtcctcggcctgaacatctggaccaccaacgacaacgcgctgtatgcctccggcctcggcttcgccaacatcaccggcctctccagccgcttcctggcgatgctcaacggcgccctcggcaccctcgccgcgctctggctgtacaaccacttcgtcggctggctgaccttcctctccgccgccatcccgcccatcggcggggtgatcatcgccgactacctgagtcgccgccggcgctaccgccagcacccctgcgcggacatccaggcgatcaactgggcggcgatcctcgccgtcgcctgcggcaccgccgccggccactggctgccggggatagtgccggtcaacgcggtgctcggcgccgccatcgcctacctgctgctcaatcccctgctgagccgcagcccgaacaaaccagaagaggtcctccatgctgattga

SEQ ID NO: 6892 - DNA, 1374 bp, Pseudomonas aeruginosa
caacctgcgcctgcgcggccgcgaaggtctctggcaactgcgcgtcgccgatggccgtatcgccgccctggtgccgatggaacaggccgccgacgacgccggcgagcgcctggacggcgccggcggtcttgccgtgccgccgttcatcgagccgcacatccatctcgacaccacccagaccgccggccagccggagtggaaccgctccggcacgctgttcgaaggcatcgagcgctgggcccagcgcaaggccctgctcagccacgaggacgtcaagcagcgcgcctggcagaccctgaaatggcagatcgccaacggcgtgcagcacgtgcgcagccacgtcgacgtctccgacccgaccctcaccgcgctcaaggccatgctcgaggtgcgcggcgaagtggcgccctgggtcgacctgcagatcgtcgccttcccccaggagggcattctctcctaccccaacggcctggaactgctggaggagtcgctgcgcctgggagccgacgtggtgggggcgatcccgcatttcgaattcacccgcgagctgggcgtcgagtcgctgcacaaggccatcgacctggccaagcgctacgacctgccggtggacgtgcattgcgacgagatcgacgacgagcagtcgcgcttcctcgagaccctggccatgctcgcccatcgcgacggcctcggcgcacgggtcaccgccagccacaccacggcgatgcactcctacaacggcgcctacacctcgcggctgttccgcctgctgaaactgtcgggaatcaacttcgtcgccaacccgctggtgaacatccacctgcagggtcgcttcgacgactacccgaagcgccgcggcatcacccgggtcaaggaactgctcggtgccgggatcaacacctgcttcggccacgacgacgtgttcgacccctggtacccgctgggcaccgcgaacatgctgcaggtgctgcacatgggcctgcacgtgacgcagatgatgggctacgacgagatcgacggcggcctcgacctgatcacccgcaacagcgcccgcaccctcggcctgcgggaatacggcatcgaggtcggccatccggccaacctgctggtgctgccggcccgcgacggcttcgacgcggtgcgccggcaggtcccggtgcgctactcgatccgcggcggacggctgctcgccgagacggtcccggcgcagaccacggtgttcctcgaacaggcggaagcggtggacttcacccgcgccagctgagccttcgccggagccttctagcgaaggctccgctgctcagggctccaatccgattccgcgcaggaccacgctggtcaccgtctgtaccgccctttcgaactgcatgtcgctga

SEQ ID NO: 6893 - DNA, 594 bp, Pseudomonas aeruginosa
aaccgagcatccacaggtcccacagcggacgccgggtcagcagcggcagccagtcccagctatgcaacagggaaaacagccagcggctgccgcgccgaccgtcgtcgagcacgccaaccaccgcgccgctgtagggatccaggtgcacccaggtatgccggggatcgtcgaaacgcaggcgccagaccggcaggcgccgttccaggtagcccatcatgctgtgttcttcgcgcgggtagtaatagaagtcgtagcgttccaatcgttcggcctgcatcggcacgcccggcagcagcgcgcgagccgccgccagtaggcgatccgcgggtagctcgcggaggatttcgccatccgccgtcagcagcaggctgttgccgctggcgctgcgcccgagcgcatagggctcgccgtcgagcgcccgccactccagctcgcgcacccgcaacccggcggcacgcaagcgccgcaggacagcgtccgcctccagtccggcgggcagcgcccggtcccagctaccgccctggtaggccgcgaggtcgagcggcgtaccgcggccgaacaggttccacggattcatcgacatcagcccgctga

SEQ ID NO: 6894 - DNA, 444 bp, Pseudomonas aeruginosa
agatccagctcagcaccagcgcgccgaagagcaggccggcgaggtggtgccagcgctggaaaccgcccgcatagggcgagcgcgagccgctgcgataaggcttgcggaagcgccagcggagcaggccgacgaggatgccgaggacggtcgccagggtcgccagcagcgacaggccgatcaccaggttcgcccactgcccgtcgaaccagccgccgcgcagcggatagagccagtgcagccaggcgccgagccagttccaggcgcgctcccggcggctggcgtcgcgtaccacctcgccggtctgcgaggacaggtagagcagccggccctgctcgtccgcggtctgcacccgccatagcggccggtgcggatcgaggttgcgggtatgggtccaggcgtcttcctcgatccgcccttgcaactgcatcggtacttcgccgctga

SEQ ID NO: 6895 - DNA, 966 bp, Pseudomonas aeruginosa
cctcaacgacgccatcaagcgcggcaccgaccacctgctgtcgggcaagcaggccctggtgatcggctacggcgacgtgggcaagggctcctcgcagtcgctgcgccaggaaggcatgatcgtcaaggtcgcggaagtcgacccgatctgcgccatgcaggcctgcatggacggcttcgaagtcgtctcgccgtacaagaacggcatcaacgacggcaccgaggccagcatcgacgccgcgctgctgggcaagatcgacctgatcgtcaccaccaccggcaacgtcaacgtctgcgacgccaacatgctcaaggcgctgaagaagcgcgcggtggtctgcaacatcggccacttcgacaacgagatcgacaccgccttcatgcgcaagaactgggcctgggaagaggtcaagccgcaggtgcacaagatccaccgcaccggcaaggacggtttcgacgcgcacaacgacgactacctgatccttctcgccgaaggccgcctggtcaacctgggcaacgccaccggccatccgagccggatcatggacggttccttcgccaaccaggtgctggcgcagatccacctgttcgagcagaagtacgccgacctgccggccgccgagaaggccaagcgcctgagcgtcgaagtgctgccgaagaagctcgacgaggaagtggccctggagatggtcaagggcttcggcggcgtggtcacccaactgaccccgaaacaggccgagtacatcggcgtgagcgtggaaggcccgttcaagccggacacctatcgctactaagcggaccacggggcaggcgtctcggcgtccccctgttccgctggacgtccccctcttcacctgcgcgcgtcacggctcagtcgcttcgcgcgtgggcgcggtcgtgctccgatccgtggcggctccaatggctgtacgccgcccccggcgctccgtcctcgcccgcacgctga

SEQ ID NO: 6896 - DNA, 1980 bp, Pseudomonas aeruginosa
acggctacggcttccccgccgcggagggcggtcccatggcctgggccgatcgcctcggcgcggccgagctgctgcaacgcttgcgtttcctcgaacagcgccacggcgcgcgctggaagccggcgtccctggtcgagcgcctggccgccgagggcggagccttcgccgacctgcaggaggtgcgctgagatggattaccaggcccccttgcgcgacatgcgcttcgttctccatgaactgttcgatgtcggcgcgcattgcgaactgctgggcaacggcatcgatcgcgaactgatcgacggcgtgctcgaggaaggcgcgcgctacaccggccaggtggtggcgccgctcaatcgcaacagcgatgaggaaggcgcgaagctgaaggacggcgtggtgaccacccccaccggctttcgcgaagcctaccggcagtacagcgagaacggctgggcgagcatgaccggacccaccgagtacggcggccagggcttcccgcagatggtctccgcgtgcttccacgagatgctgatggccgccagcctgtccttccgcgtctattcggggctgaccgagggcgccgtgctggccctgtacaagcatggcgacgaggcgttgcggcgcgactacctaggcaagctggtgagcggcgaatgggccggcaccatgtgcctgaccgaaccccaggccggcaccgacctcgccctcctgcgcacccgcgccgaggcgcaggccgacggcagctacgcgatcagcggcagcaagatcttcatcagcggtggcgagcaggacctcaccgagaacatcgtccacctggtgctggcgcgcctggcggacgcgccggccggggtgaagggcatcagtctgttcctggtgccgaagttcgtcgccaatcccgatggctccctgggcgagcgcaacagcctggggtgcggcgccatcgagcacaagatggggatcaagggcgcctccacctgcgtgatgaacttcgacggcgccagaggctggctgctgggccaggcgaaccagggcctggcctgcatgttcacgatgatgaacgacgcgcgcttccaggtcggcctgcagggcctgggtatcgccgaacgggccttccagggcgccctcggctacgcccgcgaacgcctgcagtcgcgcgccctggtcggcccgcaggcaccggacaaggtcgccgacccgatcatcgtgcaccccgacgtgcggcgcatgctgctgacccagaagaccctggtcgaaggctgccgcatgctggcgtcctgctgcgcacgccagctcgacctggaacacggccatccggatgctgacggccggcgcgcggcgacgcgccgtgcagcgctgctgatccccatcgtcaaggccttccttaccgatgtcggccaggaagtcgccagcctcggcgtacaggtctatggcggtcacggtttcatccgcgaatggggcatggagcaattgatgcgcgacagtcgcatcacccagatatacgaaggcaccaatggcatccaggcgctcgatctggtccgccgcaagctgctcggcgaccagggcggcgaactgctggcgctgcaaggcgaactggcggtggccagcgaggcgctgcaagggcgtgctgcgctggcgccactggctgagccggtgctgcaacgcctggaggagtggcggcagctcaccggccaggtactcgaggcctgcgcccgcgatccccaggagatcggcgccacttcggtggacttcctccagtacagcgcctacgtattgctcgcggccctctggttgcaagccgcggcgcgagcccaggaagcgctggacggcggctccggcgagggcgatttctatcgggccaagctgcgcagcgccgatttctacctgcggcgcatcctgccgcgggcgagcatgcaccgcgaagccttgctcggtggcgccgactgcctgatggccctgcccgaggagcatttctcgttctga

SEQ ID NO: 6897 - DNA, 651 bp, Pseudomonas aeruginosa
tcgacgaactggcccagctcagtccgcgcaacggcctgccgagccgcttgcgcgacgccggggtggacgaggcgatgctgccgcgcctggccgccgacgcgatgctccagcagcgtctgctggtcaacaacccgcgcgaggtcggcgaggcggatgccctggcgatctatcgcgcggcatactgaatcccttctacgaggaccgggcatggcgaccgccctgcgaccgctgcgcgagcagtaccttcatttccagccgatcaccacgcgctggcacgacaacgacatctacggacacgtgaacaacgtgacctactatgcgttcttcgacacggcggtgaatacctacctgatcgagcgcggcggcctggatatccagggcggcgaagtgatcggcctggtggtcagctccagctgcgactatttcgcgccggtggccttcccccagcggatcgagatgggcctgcgggtggcgcgcctgggcaacagctcggtgcagtacgaactggccttgttcctcgaagggcagcgggaggcctgcgcggccgggcgtttcgtgcatgtcttcgtggagcgccgaagcagccgcccggtggccattccgcaggaactacgcgatgcgctggccgcgcttcagagctcggcccagtga

SEQ ID NO: 6898 - DNA, 570 bp, Pseudomonas aeruginosa
aagccccgcgttcgcggggcttttacacatcagcttcggcaagcatgccgatcaacgatgcttgtgcttgcggtgtttcttgccgcggtgaccgctgtcgttgtccttgcccaggttgttaccgaccgcgccacccgctgcgccgccgaggcctgcacctatggtcgcgccggtgctgccgcccagcttgttgccgatcaccgaaccgccggccgcgccgagcccgccacccagggcggcttcggtcttgcgcccgtccttggcggtcatcgcgccgccggccgcgccacccaggccggcgcctatggccgcaccggtgctaccgccgatggcgccgcccacgacgttgcccagggcaccgcctacgccgccgcccaccgcggtcttggtggaatcgccggcgagcgcggcttgtgcgctcagcaggccgaacgcgattaccaggagagatttacgcatcgtgcgtgcctcatcgtttcaatcgggagggaaatacggtcgttcgcacaaaggccggaccatccggcccggcctttgcctcgtagggagcggcgggttcagtcgtcgtag

SEQ ID NO: 6899 - DNA, 582 bp, Pseudomonas aeruginosa
ggcacaggcggccgagtcgctgaaggagcacgtcgccaaggtcggcctgggcaacccgaacatccaggtttcggtggaaggcgacaaggtcatcgcctcgggcgaggtggtcagccaggaggagaaagagaagatcctgctggcgctgggcaacgtcgccggcgtctcctcggtggaagacaagatcaccgtggcccaggccgctccggaggcgcgcttcgtcaccgtgaagaaaggcgacaccctgagcgccatcgccaaggccgaatacggcaatgccaacgcctacatgaagatcttcgaggccaacaagccgatgctcagccatccggacaagatctaccccggccaggtcctgcgcattcccgagtgatcccggcgtttcgccaaccccgcccgcgtggcggggttttcgtttccgcggctacggcagtccttcgagcagccgccggtagtcctcctgggcggcgaactcctcggtgtcccggacctggccacggctgtccgggtggcgtaccgccaacaggtgggcgacaccataggcgcgggcgctgcgcaggatcggcaggctgtcgtcgatga

SEQ ID NO: 6900 - DNA, 882 bp, Pseudomonas aeruginosa
gctggccggcgtgttcgcggaacagcggctcgagcacggcgtcggcttcggtgcgactcaggccgttgcgttcggcatagcgctggggcaggtgttccagccagaagtggttgtcgaagtgcaggtcgagcagggtgccgtccatgtcgagcagcacggtgtcgatggcggaccagggcagggtgggcatggcggctcttgtcgcggttcgtcgcgatcgatgcggaaatctgtcgcttcccatcaatctccgacagggataatcggaaaagccggggtatgataacccgccggcttcgccaaggagttatccacatgcgtcagaaacccaccgtactcgccagcgagatcgtcgcgaagagccgactgttcgctgtcgaggagttgcaactgcgcttcagcaatggcgtcgagcgcacctacgagcgtctggtcggcaagggccagggctacggtgcggtgatggtggtggccatgctcgatgccgagcacgcggtgctggtggaggaatattgcgccggggtcgacgaataccagttgtcgctgcccaagggcctggtcgagccgggcgaggacatcctcgcggcggccaaccgcgaactcaaggaggaggcgggctacggggcccggcaactggagcacatcaccgaactgtcgctgtcgccgggctacatgagccagcgcatccaggtggtgctggcgcgcgatctctacgaggagcgcctgccgggcgacgagccggaaccgatgggcgtcgatcgcatcagcctgcgcgaactgtcgagcctggcccagcacgcccagttcagcgaaggccgcgccctggccgcgctgtacctggtgcgcgacctgctcacccagcgcggcgagtaccaggcatga

SEQ ID NO: 6901 - DNA, 1854 bp, Pseudomonas aeruginosa
tccaactggcgcgcgcgctgcactgaaacgaaaaggcccggtctagccgggccttttccgttgtggtggcgctcagtcgagcatgtcactgaaacgcgcgtccttcttgtataccagcggctggctgaagccgggcaccgtcacctgttcggcgctgacctcgatggcatgttcgtcgatcaggtcctggccgaagttgtagatgatctccaggtcgccctgcagcgcgcgctggtcgtaggcgcgggcggtggcgcgggtctgctcgcgcttctcgacgtaggcggcgaaggccgcttggccatggcgcttgcgcagcatcttctcggcgattcgcggcgacagcaccacgccgctggcgttgttgccgccgaagcccttggagttgatgaagcacacctccagcggcttgtcctggcgcatgtcgcgattggagatgctcaggcgctgctggtggacgtcgtcggcgaccttgtcgatggtcttgatcccagggaggatgccgtacttgaaggtgcccagggcggaaatcagttgatcggcgctggcggtggccagggagtggccgacgtaggccttcaccgcggtgaccggccagccgtcgatgccgaaggcgctggccacgcggtcgaggatttccgattcggtgacccggttggccggcgtgctggagccgtgggcgtggacgaagctggcgtggcgcacggtgtccaggccgacgatctgcaccgcgctggccaccgccttggctaccgtcaggtagttgcccgggccgggggcggagatggacttcttgaaaccgtcggcgttgatgaacacgtcggttaccgcgccgtggatatccgcgcccaggcgcagggccagttcgtcgtccatcagcactacgtattggctggactcggccagggtgaagccgcagttctcgccgaacggccggctggcgcggcggaagtccacgtcgtcgcggccttcgatcaggcgcaggccttcttcggtggccagtgcgcccatggcactgtagccctcgatgcactccggcaggatcggcgcctcgctgttgccgacgatgaccacccgggcctggccgctggtgatgacgtcgatacccttctgcaggttgtagaggaaggtggcgcaggcgcctgtgatgctgccggtcatgccgacgctgccgagcacgtaggcattgatgaaatcggtgggcatgctgttgaagcccagcggcagttgcttggccgagacccggtggcccttcaggcgggattgcatcaggccgccgaaaccgttgtcgtcgagctggctcatgatgctgccggagaacaccgcgatctcgtcgggctggacgttgtcgacgatggtcttccagtcgatgccggtggagcggatcgcgtcggtcgcggcgaccaccgacatctgcaggccgcgcgggtggaagcgcgagttgtacagctcgcctggttcgaaaccggtgggcagctggccagcggacttcaccgtcagcgcacggtagctgtcgaccttgaactcgcagcgctcgtggatgctcaccagtacctcgccgtcctccgcgggagcgatcgaccagttggccggcagcggctcgggcagttgcttgggcgaggccttgaaggtcagcgtctggccttcggcaggggacagctcgaggaccttgtgccagtggacggcatccgggtcgaggtactgcggttcgatgcgccgcaccagggtagaggcgaagatgcgttcggcgtagcgccgctcgatgtcctccggggacagcggcgtgccgtcttcggccaggtagcggccgccttcggccttgaccagtttcatcatgaccgccaggccggctag

SEQ ID NO: 6902 - DNA, 801 bp, Pseudomonas aeruginosa
gcggcggaccagaagtacgggatcaggatcatcgaggtggccaggagcagcatcttggtgtacgggtccatgccgtccgggtcgcccgaggtgaagaacaccaccaccaggaacacctgtacgcagatgttggtcagccacagggcgttggccggcacctggttggcgttctcgcggcgcaggaactccggcatggtgtggtccttggcggcggcgaacatgatctcggcgcacagcagcacccaggagagcagcgcgcccagcagcgagatcagcaggccgacgctgatcagcacggcgccccagtggccgaccacatgctcgagtaccagcgccatcgacgggttctgcagcttggccagttccggctgggtcatcacgcccatggacagcacgttgaccagcaccagcaggagcaggacggtgatgaagccgatcacggtggccttgccgacgtcggaacgtttttccgcgcgggaggagaagatgctcgcgccctcgatgccgatgaacacccagacggtgaccagcatcatgttgcgcacctggttcatcacgctgcccaggtccgggttgctcttgccccagatgtcggcggtgaagatgtccagcttgaaggcgaacaggcagatcaggatgaacaggaacagcggcacgaccttggccacggtggtgacggtgttgatgaacgccgcctccttgatcccgcgcagcaccaggaagtgcagggcccagagcaggaccgaggcgcagacgatcgccgcgacggtgtcgcccttgccgaagatcgggaagaagtag

SEQ ID NO: 6903 - DNA, 468 bp, Pseudomonas aeruginosa
gtcacgatgatcaggaacaccagcaggatcatcagccacggcagcgctgcgcggatggtcgcgcccagcggcatgccggtgaccgccgaggtgacgaacaggttgagcccgaccggcggcgtgatcaggccgatctccatgttcaccaccatgatgatgccgaggtggatcggatcgatgcccagctccatggcgatggggaagaagatcggcgccaggatcaggatgatcgccgaaggctccatgaagttgccggcgatcagcagcacgatgttcaccaccagcaggaacatccatggcgaaagtcccagttccgtgacccaactggcgatgctctgcggtatctgctcggtggtcagcacgtgggcgaagagcatggcgttggcgatgatgaacatcagcatgatggtcagcttgccggactccagcagcaccttcgggcattcgctcaggcgcatgtcgcggtag

SEQ ID NO: 6904 - DNA, 231 bp, Pseudomonas aeruginosa
cccgagcggaccatgccggcgatggcgatcgaacccactgccgccaccgttgccggagacgagccggatagcgcggcgaagagcatgcaggcgagcaccgcggcgatcgccaggccgccacggatgtgtccgacgcaggcgttggcgaagtcgatcaggcgccgcgccacgccaccggtggtcatgaacgcgccggagagcaggaagaacgggatcgccagcagggtgtag

SEQ ID NO: 6905 - DNA, 201 bp, Pseudomonas aeruginosa
gcagcgcagcggcagatgctgcgtgaatcggaaaagcgcctggtcttctgcttgttggaacgctcgggaagccgtgagcaagccctgtgccagtcgggcaagggtacgcaggggagatgctgcgggcgcggatggcgaacggttggcggtaatccgccattcattcgccatcatctggcggattttcgccaggcgtgttga

SEQ ID NO: 6906 - DNA, 243 bp, Pseudomonas aeruginosa
ggttgggatagaactcggtcttcgccgagtcgatgttgcggcgcgccgcctcgacccgccagcgcgcggcaacgatgtcggcgcggcggccgagcagttccgccgggagtaccgagggcaggctcaggctggccgggttcagcggttgcgggcgctgcagttcgagaccgcgatcgggccccttgcccagcagcacggcgagggcgatgcgggcgctggcgatgtcctgctcggcggcgctga

SEQ ID NO: 6907 - DNA, 462 bp, Pseudomonas aeruginosa
tcagcgacaccagcgcggtgtccttcagcaggatcaggtacaggttgccgaggccgggcagggcgacccgccagatctgcggcaggacgatgcgccagaagatccgtccgggcgacaggccgagcgcctggccggcctcgcgatggccgcgcggaatggacaacagcgcgccgcggaacacctcggtggcgtaggcgccgaagcacaggccgagggccagggtgccggcggcgaacggcgagagtgccaggtccggcttgccgaaaaggtcgccgagggcgttcaggccgctcaccgtgccgaaatagatcatcagtacccagagcgtttccggcacgccacggacgatggtggtgtaggtgccgccgaggaagcgcagggccgcgtacttcgaagtcttcgcgatggcgccgaggaggccgagcaacagccccacgcagaccgccgccagcgacagcttga

SEQ ID NO: 6908 - DNA, 195 bp, Pseudomonas aeruginosa
ttatgtgaggttaataaaaataaattctattcggggtttgcgatgtattttattgggctaaccccgagcgatttcggtgtgacgaaattttcctcggggtttaataggtcttttctcatgggaaaccccgaatgggataaaagccacttaattttgcgcttgttgacgtactgcttggctatcgagagcatttga

SEQ ID NO: 6909 - DNA, 285 bp, Pseudomonas aeruginosa
gcacctgtcgagatattacaaaggttgctccaaatgaatgccgttacgatgactcagcagagccagaaagcaaaatttgaacaggattttttgaatcgatttggcccgttagtttcccaaagccagcttgctgatctattgggaatgactgctagagggttgagcacatttctatggcgcaaaactgaactagctaagggtattcgtgagtgtcgagttaaagttggtcggagagtgctttatcgcactgtagaaattgcggggctactcgcatgccaacagtaa

SEQ ID NO: 6910 - DNA, 291 bp, Pseudomonas aeruginosa
acgggtttagcgcggcagtgtcaacaccggcgaagaaattttttttgttttttaacgccttacgatcccctcgcggtttccgccggactgccgggcctcagttccaggcctggcgttcctcgtcgcgcagctccaccggcaggctccggccttcctcggcggagcgtcgtgccaactccagcagggccatcagcgcgcaggcctgttgcgccgacaccgggttgcgcgactggccgcggatggcggcggccagcgcctggtagtagcggctctggtcgcctgccggggtga

SEQ ID NO: 6911 - DNA, 420 bp, Pseudomonas aeruginosa
agcgtggcgccggattggcggcgagcatgctggcgcgcagcgctacctggcagtgcggataatcgagcaggacctcgaaccagtcgtcggtcagcgcgccctcgcgcagccggcgcaggtgtccgtgcacacgctgcggtacgccgaacaggcacagtgcctggtcgagcaggtgcgggccgaggtcgaaccacagcccggagccgggcaggtcgtgttcgcgccagcggtcgcggacctgcggacggaagcgctcgatggccgactcgaagtagcgcaccgggccgatgctgccggcctgcagggcggcctccacggcgaggaagtcgctgtcgaagcgccggttctggaacaccgagaggacctgcccaggccgttcacgggcgaggtcggcgaggcgccgggcttcggccagggtga

SEQ ID NO: 6912 - DNA, 546 bp, Pseudomonas aeruginosa
tcggggtgcgcgggctgtcgttctgcggcgcctgctccggtgcctgcgcctgggcgcccttgccgtccgctgccggcggggtggcggaaggagcggccggggcctggggctgggccggcttgccgatgttttcccagttgcccttgccctgcttgtcgcggaccaggtccaggctcaggccttcgacgcggatcgcgctcatctgcacgtccttgcgcagcagcggcaggacccgcaccgacaggccgagcatctgcaggtcggcgaacggcttggtcggcgtggcggcgctggcgatgctggtgtcgtgcagctccaggcccagccaggggaacaggctccagccgatgtcgcccttcaggtccagctccaggttggccttgtcgcgggcgatctggcggatttcgtccttgtagtcattgggatcgaacaggtgggtcagggcgaagcccagggccacgacgagcagtaagagtcccaggaagaacagccccaggaccttgccgaatgctttcatggacgaatcctttgtgctggcagcggtga

SEQ ID NO: 6913 - DNA, 1116 bp, Pseudomonas aeruginosa
ccacatgatggaccagatcgcccgccacggcctgatcgacctggacatcgagtgcaagggcgacctgcatatcgacgatcaccacaccgtcgaggacatcggcatcaccctcggccaggccttcgccaaggccatcggcgacaagaagggcatccgccgctacggccacgcctacgtgcccctcgacgaggcgctgtcgcgggtggtcatcgacttctccgggcggcccggcctgcagatgcacgttccctttacccgtgccagcgtcggcggcttcgacgtcgacctgttcatggaattcttccagggcttcgtcaaccacgcccaggtgaccctgcacatcgacaacctgcgcgggcacaacacccaccaccagatcgagaccgtgttcaaggccttcggccgcgcgctgcgcatggccatcgagctggacgagcggatggccgggcagatgccgtcgaccaaagggtgcctgtgatgcagacggtagccgtgatcgactacggcatgggcaacctgcactcggtggccaaggcccttgagcacgtcggtgccggccgggtgctggttagcagcgacgcggcggtgatccgcgaggccgaccgggtggtgttccccggggttggcgcgatccgcgactgcatggccgagatccgccgcctgggcttcgacgccctggtccgcgaggtcagccaggaccgcccgttcctcggcatctgcgtcggcatgcaggcattgctggagcgcaccgaggagaacgacggggtcgactgcatcggtctgttccccggccaggtgcgcttcttcggcaaggacctgcacgaagccggcgagcacctgaaggtgccgcacatgggctggaaccaggtgagccaggcggtggagcacccgttgtggcacgagattcccgaccaggcgcgcttctacttcgtgcacagctattacatcgaggccggtaacccgcgccaggtggtggggcacgggcactacggcgtcgatttcgccgccgcgctggccgaaggctcgcgtttcgccgtgcagttccacccggaaaagagccatacccacggcctgcaactgctgcagaacttcgtggcctgggacgggcgctggtag

SEQ ID NO: 6914 - DNA, 264 bp, Pseudomonas aeruginosa
gtcatggccagggcgaagagcaatacgccgatcctccagctggacgccgcgcagactcaggacgcggtactggcgatcaagcgcttcatggaggaccgcttcgaactggagctgggttccttcgaagccgaggaactgctcgatttcttcgcccgcgagttcgccccgtacttctacaacaaggccatcctcgacgtgcagtcgtacctgaaggaacggttcgaaagcatcgagagcgatgtctgggcgctggaaaagagttga

SEQ ID NO: 6915 - DNA, 786 bp, Pseudomonas aeruginosa
gtttccgcgcgcctgtccaccgaatacagacttgaacagggttcaccgatgctgatcattcccgcgatcgacttgaaagacggcgcctgcgtgcgtctgcgccagggcctgatggaagacgccacggtcttctccgacgatccggtggcgatggccgccaaatgggtcgatggcggttgccgccgcctgcacctggtggacctgaacggcgctttcgaaggcaagccggtcaacggcgaggtggtcaccgccatcgcccgtcgctacccggacctgccgatccagatcggcggcggcatccgctcgctggaaaccatcgagcattacgttcgcgccggcgtcagctacgtcatcatcggcaccaaggcggtcaagcagcctgagttcgtcggcgaggcctgccgcgccttcccgggcaaggtcatcgtcggcctggatgccaaggacggtttcgtcgccaccgacggctgggccgaggtcagcgaagtccaggtgatcgacctggctcgtcgcttcgaggccgacggggtgtccgccatcgtctacacggatatttccaaggacggcatgatgcagggctgcaacgtccaggctaccgccgcgctggccaatgccacgcggatcccggtgatcgcctccggcggcatccacaatctcggcgacatccagaagctgctggacgcccgcaccccggggatcatcggcgccatcaccggccgggcgatctacgaaggcaccctggacgtggccgaagcccaggcgctgtgcgacaacttcaaggcctga

SEQ ID NO: 6916 - DNA, 765 bp, Pseudomonas aeruginosa
cgccctggcgcgcgccgaaaccctggtcctgctgaccgagaacctggtgccgttcaacatggcggtgaacggcggcaactacgccaaggacgatggcatcagcggcatcagcaccgataccgtgcgcgccgcctgcgagcgcgcgcagatcgagtgccagctgatcctgcgcttcccctgggaccgggtctaccagcaggcgctgagcgagcccggctatggcgtgttttccaccgcccgtacgccggagcgcgaggacaagttcaagtgggtcggcccgctggcggtcaacgactgggtactgatggcccgcggcgacagcagcatccacctgaacagcctggaagacgccgcgcgctaccggatcggcggctacaagaacgacgccatcagccagcacctggtcgaccgcggcctgcaggtgcaactggcgctgcgcgacaacgagaacgtcgacaagctggccagcgggcagatcgatctctgggtcaccgccgatccgagcgggcgctacgtcgcccagcgcgagggcctcaaggaggtgaaggtggtccagcgtttccataccgccgagctgttcctggcgctgaacaaggacaccccggacgagctggtgcagaagttgcaaacggcggtcgacgcgctgcgcagcgaaggcttgttgaagcagatccgcgagcgctactgacgcctcgccggcgatgctggcaaaaggctggcctggcggcgcggcgctggttattctgcctcgctccaggcccctga

SEQ ID NO: 6917 - DNA, 1182 bp, Pseudomonas aeruginosa
caggatgacaacaatgcaaagaagcctgctcttcgcgctgctcgcaaccctgctgctggtcggcggcgcgcgcgccgaaaccgatcccgactacagcatggtcctgctcacggagaacttcccgccgtacaacatggcgatcaacggcaagaacttcgcccaggaagacaacatcgacggcatcgccgtggatatcgtccgcgagatgttcaagcgcgccggcatcaagtacagcctgaccctgcgtttcccctgggaccgcatctacaagctggcgctggagaagcccggctacggggtgttcgtcaccgcccgcctggccgagcgcgaggacaagttcaagtgggtcggtccgatcggcccggacgactgggtgctgctggccaagggcgacagcccgatcaccctgggcagcctggacgaggcgaagaaataccggatcggcgcctacaagggcgatgccatcgccgagttcctcggcaagaacggtttcgaggccgacctggcgctacgcgaccaggaaaacgcgcagaagctggtcaagggccagatcgacctctgggccagcggcgatcccgccgggcgctacctggccaagcaggaaggcgtgaccggcctgaagacggtgctgcgcttcaacagcgaccagctgtacctggcgctcaactgcgagactcccgacgaagtggtgcagaagctccaggcagccctggacggcatgcgcaaggaaggcttcgtcgaggacatcctcaacagctatctctgattcgctccgtccggccaacagggggccgggcggggaaacgcctttgccggccccgccggcaatgccatggaaggccgacgagccaggtatttcgtcctgacgcagggatgccgctagccaataacgataaccaagcgagcggtgtgaccatgctgaaagtcctgatccagaccctgatcctgggggtgttgctgggggcctccgcggcccgtgccgaattgcccgccgactacaaggtggtgctgctgaccgagaacttcccgcccttcaacatggcggtggacgacaagaacttcgcccgcgacgatggcatcgacggcatcagtgccgacatcgtccgggagatgttcaggcgcgccggcatcggctattccctgagccctgcgcttccccctgggaccgcctgtaccggttga

SEQ ID NO: 6918 - DNA, 1305 bp, Pseudomonas aeruginosa
tcggaatcctgcgggcgctcgctcggcgcggcacgcttgccggtggggcggtcggcgccgccgttgccgttggccaggtggcccctgcaggtcggcttccttgaagccctcgaagctgctccgctcctgggtcaccttggcgcgtccgacttcgatgtccggaacgatgccctgggcctggatggagcgcccgttgggggtgtagtagagcgcggtggtgagcttcagggcgcggtcgttgttcagcggcagcacggtctgcaccgagcccttgccgaagctgtcggtgcccatcaggatcgcgcgcttctggtcctgcagggcaccggcgacgatttccgccgccgaggcgctgccaccgttgatcagcaccaccagcggaaccttgtcgctgggatcggccgggtcggcgctgaagcgcagctcggagttggcgatgcggcccttggtgtagacgatcaggcccttggtgaggaaggcgtcggctacctcgacggcggactgcagcacgccgccggggttgttgcgcaggtccaggaccaggcccttgagacggcccttgttgtccttgcgcagctggttcagcgccttgaccacttcctcgccggtgttgacctggaactgggtgatgcgcaggtaggcgtagccgggttcgaggacctggctcttgacactcttgaccttgatgatggcgcgcttgagttcgacgtcgaacggtctgccgccatcgcggacgatggtcagggtgatcggggagccggccttgccgcgcatgctgtcgaccgcttcggtcatcgactggcccttggtcggcttgccgtcgatctgcacgatcaggtcgccgggctggatgccggcgcgggccgcgggggtgtcgtcgatcggcgagaccaccttgatgaagccgtcttcgctgccgacctcgatgcccaggccgccgaactcgccgctggtgctttcctgcagctcggcgaagtcctccgggccgaggtaggcggagtgcgggtcgaggttgctgagcatgcccttgatggcgttctccagcagggtcttgtcgtccactggctcgacataggcggccttcacccggtcgagaacctcggcgaacgtacgcagctcgtccaggggcagcggggcactgctaccgttggccaatggcgcggcgtcggccggggcgtcggcaccctgggccgcgcccgcgccgagcagcagggccagcgccagggtggtgggacggaagcaatgcagcatgttcagctcctaatcacgagttcggcgcctatccctgtgcgcggcaccaggtaa

SEQ ID NO: 6919 - DNA, 558 bp, Pseudomonas aeruginosa
aaaaaacgccccgcaccgcgcgctgtggggcgcttccacgtatttcagccggatggcagcggcggatgtcgtcgacgacgaaggccacgggcatcaggcgggtctgtagagcgggtaggtgaacagcagcagatgcgtcaggttcagcccgaagtggaacagcgtcgccacccacaggcggccgctccacagccaggccaacccgtagatcagcccggcgaggccggcgaacagcatcagcagcgggccgccggcgaagtgcgccaggccgaacagcgccgaggccagcgccagggcgggccaggggcccagccattggcccaggcgttgctgcaggtagccgcggaacagcgcttcctcggcaagggaaacgaagaacaggttggccaggatgaactgccagagccaggccggcgcgtggagttccggccgcagcaggccgacgccgacagccagcagaagcagcgccggcaccgccgccacgagcagcagccagtaccaggggcggccgggagcgcgggcttcgtcgcggaacaggctcggcaggcaggccagtag

SEQ ID NO: 6920 - DNA, 1557 bp, Pseudomonas aeruginosa
agcggggaaggtggcgtcgtggaaacagggcgcggcgcccggcccgctacggcggataacgtcgcaggcgttctccgccgatggcctgcagaagcggcggataaccgcgacgcggttatccgccctgcgcgggagttcgtcgttcgcggatcagccgagggtgacgatgctgcgaccggtcatttccgccggctgctccagccccatgagggtcagcatggtcggcgccacgtcggccagcacgccgccttcgcggatgctcagcttgcgcttgccgacgtagacgaagggcaccggttcgcaggtgtgcgcggtgtgcgcctggccggtggactcgtcttccatctgctcgacattgccgtggtcggcggtgatcagggcttcgccgccgaccttgtccagcgcctcgacgatacggcccatgcaggtgtccaggcactccacggccttgaccgcggcctcgaacaccccggtgtggccgaccatgtcgccgttggcgtagttgaccacgatcacgtcgtagcgctgttgctcgatggcctcgacgatacggtcggtgacttccggcgcgctcatctcgggttgcaggtcgtaggtggcgaccttcggcgaggggatcaggatgcgctcctcgccctcgtagggttcctcgcggccgccggagaagaagaaggtcacatgggcgtacttctcggtctcggcgatgcgcagctgggtcttgccatgcttggccaggtactcgccgaggacgttggtcagcggctccggcgggaaggcgcagggcgccgggatgctcgccgcgtactgggtcagcatgacgaaacctgccagctgcggggctcgttcgcgggggaactcattgaatgccggctcgacgaaggcgcggctcagctcgcgggcgcggtcggcgcggaagttcatgaagatcaccgcgtcgccatcctcgacccgcaccgcttcggcgccggccgggaccaccgcggtggccttgacgaattcgtcgctctcgccgcgggcgtaggcggcctcgagggctgccaccgaggagtcggcggtgaactcggccttgccgtcgacaatcagttcataggcggcctggacgcggtcccagcggttgtcgcggtccatcgcgaaatagcggccgatgatcgaggcgatgcggcccttgccgagcccggcgaaggtggcgtcgagacgctccagcgacggctgcgcgcttttcggcggggtatcgcggccatccaggaaggcatgcaggtagatcttgccggcgccgcgcttggcggccatctgcgccattgccaccaggtggtcttcatggctgtgtacgccgcccggggagagcaggccgaggatgtgcaccgccttgtcggcggcgacggccttgtcgaccgccgcggcgatcaccgggttttcgaagaattcgccgtcgcggatggccttggtgacgcgggtgaagtcctggtacaccacgcggcctgcgccgaggttcatgtggccgacctcggaattgcccatctggccgtcgggcaggccgacgtccatgccggagcctga

SEQ ID NO: 6921 - DNA, 645 bp, Pseudomonas aeruginosa
cgccgatccgcaaccgaatgccgctatcctcgctccctctgtcccgcccgaaccgtgcccgggccggaactggccagcttcacagaaaaggaccggcattctaaccgtgaagtttcccgcgacgccatttcctggagccgagcggggcgccgcccggcgggttcccccctggccggcgcggtctgtatactggccggcatttttacgccctggatatccgtcaccatgcaattcgtttcccgtctgatcgagttcgccaccaaccactacctgctggtcgcggcgctgctggtcctgctggtcctgctgttgctgcacgagctgcgcaagggcggcaagagcctgtcgacccgcgagctgaccgcgctggtcaatgccgaccaggcggtggtcctggatatccgtccggccaaggagttcgccagcgggcacatcgtcgacgcgctgaacatcccggccgacaagctgaacagccgcatgaccgaactggaaaagtacaagggcaagaccatcatcctggtcgacgccatgggccagcactccggtacctggggcggcgtcctgaagaaggccggcttcaacgccgccaagctgtccggcgggatcggcagctggcgcggcgacaacctgccgctggtgaagtga

SEQ ID NO: 6922 - DNA, 486 bp, Pseudomonas aeruginosa
aacaggatgacgtggaacatgcagggctccggagcagataacgggcggcattctacctccgccatcgacgatctgcggcgccagcgctggaaagtctggggtgcgctggtgcttgccgggttgttgttcgggctgatgctcggcaggttgttcggtcccgcttcgctgccgacgtctgcgccgcaactgctggcggtcggggagagcgagcagggcctggtcctgcgcttcgatcgccaggctgcggttacggcggcacgggtggagggtgccctgacgttgcgcatcgtcgcccggggcgcggcgcagcagggagacgggcgatggctgggccagccgttgcgctggcgcgtccgcgaggagggaaaggcgctgctgttgagcctggtctcgacccgccccttgcaggggcgctggcagtggtcggaggatggcgagggctggcgcctggtcgtcgaactgcaggagcgcgacggccgggaataa

SEQ ID NO: 6923 - DNA, 1698 bp, Pseudomonas aeruginosa
ggcgatcaggcatgtaggcgcgcatttcatcagggctcgggagttgcaacaccactccatgaagccggatatacggatgcagtcgtacacaggtttgaaatcaagacaaacactggcaaaccgggaggagtccatatacgcataaccgcaacgcggttatccgccggcccagccgcgcatcggcggatagcgccccgggcgttattcgccctcccgtacccgtgtagaaggcggtcgatgccggcgcctcgatggaagcgccactcaggccgccaggcggccgccggcgatcgcctcggaggccttgagcatggcccgcaacagcaccgcgcagccggcggccaggtcgtcggggctggcgttctcgatctcgttgtggctgatgccgttctcgcagggcacgaagatcatccccgccggaccgagttcggcgaggaagatcgcgtcgtggccggcgccgctgacgatgtccatctgcggcatgcccagcgcctgcgccgcctcgcgcaccgcgccgacgcatccctggtcgaagtacagcggcgggaaatcggcggtcggcaccagctcgtattgcaagccatgcttctcgcaggtagcggcgatcacctggcggacttcggcgatcatcgagtccaggcgctccggttgcagatggcggaagtccagggtcatcttcacttcgccgggtatcacgttgcgcgaaccgggataggcgtgcaggcagccgaccgtgccgcaagcatgcggctgatggccgagggccgcgcgattgaccgcctcgaccaccgccgcggcaccgaccagggcatccttgcgcaggtgcatcggcgttggcccggcgtgtgcctcgacgccgcgcagggacaggtcgaaccatttctgcccgagcgcgccgagcaccacgccgatggtcttctcctcgtcctcgaggatcggcccctgttcgatgtgcgcctcgaaataggcgcccaccggatgtccgagacaatcgcgcgctcccgcgtagccgatggcgtccagcgcctcgcctacgctgacaccgtcggcatcgcgcttggccagggtctcctccagggtgaacttcccggcgaatacgcccgagcccatcatgcagggcgcgaagcgcgagccttcctcgttggtccacaccaccacctccagcggcgcctcggtttccaccccgaggtcgttgagggtgcggatcacctcgaggccggccatcaccccgaagcagccgtcgaacttgccaccggtgggctgggtgtcgatgtggctaccggtcatcaccgggggcaagtccgggttacgcccgggacgacgggcgaagatgttgccgacccgatcgacgctgaccgtgcagccggccgcttcgcaccattgcacgaagagatcgcgggcctggcggtcgagatcgctcagggccaggcggcagaccccacccttggcggtggcgccgaggcgggcgagatccatcagcgattgccagaggcgctggccatcgatgtgtcgctgggtggattgcaggacgttccgggcagtgctcattgtcgtctcctcaggcttggagtaggtgtcggcggctcgccggccgcctgtatgcccatcagggcagcggtttggccaatgccgccgggctccgcgcacggcggccgcagaggccgtagtagagcgcgccgccgagcagcgagccggtga

SEQ ID NO: 6924 - DNA, 1611 bp, Pseudomonas aeruginosa
aagtcctcggcgcatggcgaaaaaacaatttcaagaaccggcaacgaccggtcagcctgcgaggaaagacggcatgtccctgttgatccgtggcgccaccgtggttactcacgaagagagttatcgagccgacgtgctctgtgccaacggcctcatccaggccatcggcgagaacctcgaaaccccctccggctgcgacgtcctcgacggcggtggccagtacctgatgccgggcggcatcgacccccatacccacatgcagttgcccttcatgggcacggtggccagcgaggacttcttcagcggcaccgcggccgggctggccggagggaccacctcgatcatcgacttcgtcatccccaacccgcgacagtcgctgctggaggccttccacacctggcgcggctgggcgcagaaatccgctgcggactacggcttccacgtcgccatcacctggtggagcgacgaggtcgcccgggaaatgggcgagctggtggcacagcacggggtgaacagcttcaagcacttcatggcctacaagaacgccatcatggccgccgacgataccctggtggccagcttcgagcgctgcctggagctgggcgcggtgccgacggtgcacgcggagaacggcgaactggtcttccacctgcagcagaaactcctcgcccagggcctcaccggccccgaggcgcatcctctgtcgcgtccgccgcaagtcgagggcgaggccgccagccgcgccatccgcatcgccgagacgctgggtacgccgctgtacctggtgcatatttccagccgcgaggcgctggacgagatcgcctatgcccgcgccaagggccagccggtctacggcgaggtgctggccgggcacctgctgctcgacgacagcgtctaccgccacccggactgggccaccgcggccggatacgtgatgagcccgccgttccgtcccgtcgaacaccaggaagcgctgtggcgcggcctgcagtccggcaacctgcataccaccgccaccgaccactgctgcttctgcgccgagcagaaggccatgggccgcgacgacttcagcaagattcccaatggcacggccggcatcgaggaccgcatggcgctgctgtgggacgccggggtcaacagcgggcgcctgtcgatgcacgagttcgtcgcgctgacctccaccaacaccgcgaagatcttcaacctgttcccgcgcaagggcgcgatccgcgtcggcgcggatgccgacctggtgctctgggacccgcagggcagccgcaccctctcggccgccacccatcaccagcgggtcgatttcaacatcttcgaaggtcgcaccgtgcgcggcattcccagccacaccatcagccagggcaagctgctctgggccgcaggcgacctgcgcgccgaacccggcgccggacgctacgtggagcgcccggcctacccgtcggtgtacgaagtgctcggccgccgcgccgaacgccagcgcccggtcgccgtcgagcgctgatccttcccgcaataccggaccggcccgtagaggccggacggtgccgtattgccgttgactgccccgagaagaaacctgaagagaggctacaaccgtga

SEQ ID NO: 6925 - DNA, 537 bp, Pseudomonas aeruginosa
tcggccagttgcaacgctacgccctcgaccacgccggcttcggcgaacatccgttcaagcgctcgccggccaccggcaagcgcatcgccgtggtcggcgccgggccggccgggctgtcctgcgcccaccgcctggccatgcacggccacgacgtggtgctcttcgaggcccgcgccaaggccggcggcctcaacgagtacggcatcgcccgctacaagctggtggacgacttcgcccggcgcgaagtggaattcctcctgcagatcggcggtatcgaactgcgccacggccagcgtctcggcgacaacctggcgctcggcgccctgcacgacgagtacgacgcggtgttcctcggcatcggcctggccgccagcaagcgcctcggcctggaagacgaggacgcccccggcctgctcgccgccaccgactacatccgcgagctgcggcagagcgacgacctgctcgacctgcccgtcgccgaccgttgcatcgtcatcggcgccggcaacaccgccatcgacatggcggtgcagatga

SEQ ID NO: 6926 - DNA, 1902 bp, Pseudomonas aeruginosa
cctgggcccgaccggaacgggtactgctcgacgagcatggccgggtgcgcggcatgcgcttcgcccgcacgcgcctggagaacggtcgcctgggcgacaccggcgagcacttcgaactggccgccgacgccatcttcaaggccatcggccaggccttcgaaggcgccagcctgggcgatccgctggcagcgcaactgcggcgcgacggcgagcgcatccaggtcgacggacagatgcgcaccagcatccccggcatctacgccggcggcgactgcgtggcgctcggcgaggacctcaccgtgcaggcggtgcagcacggcaaactggcggcggaagcgatccacgcccaactcatgctcaacgtggaggctgcgtgatggccgacctgtctatcgaattcgccggcatcaagtcgcccaaccccttctggctggcctccgcgccgcccaccgacaaggcctacaacgtggtccgcgcctaccaggcgggctggggcggggtggtctggaagaccctcggcgaagaccccgcggcggtcaacgtgtcgtcgcgttattccgcgcacttcggaccgaaccgccaggtgcaggggatcaacaacatcgagctgatcaccgaccgctcgctggagatcaatctgcgcgagatcgcccaggtgaagaaggactggccggaccgcgcgctgatcgtgtcgctgatggtgccctgcgtcgaggagtcgtggaaatacatcctgccgctggtggaagccaccggcgccgacggcatcgagctgaacttcggttgtccccacggcatgcccgagcgcggcatgggcgcggcggtaggccaggtaccggagtacgtggagatggtcacccgctggtgcaagacccactgctcgctgccggtgatcgtcaagctcacccccaacatcaccgacatccgccagtcggcgcgcgccgcccatcgcggcggcgccgacgcggtgtcgctgatcaacaccatcaactcgatcaccagcgtcgacctggagcgcatggtcgccctgcccgtggtcggcacccagagcacccacggcggctactgcggctcggcggtgaagccaatcgccctgaacatggtcgccgagatcgcccgcgacccgcagacccgcggcctgccgatctgtggcatcggcggtatcggcagttggcgcgacgcagcggaattcgtcgcgctcggctgcggcgcggtgcaggtatgcacggcggcgatgctgcacggcttccgtatcgtcgaggacatgcaggacggtctcgcgcgctggatggacagccatggctaccagcggctgtccgatttcagcggcggcgcggtgggcaataccaccgactggaagtacctggacatcaactaccaggtgatcgcccgcatcgaccaggacgcctgcatcggttgcggccgctgccatatcgcctgcgaggacacctcgcaccaggccatcgccagcctgccccgggccgacggtacgcaccgctacgaagtgatcgacgccgagtgcgtgggctgcaacctgtgccagatcacctgtccggtggagaactgcatcgaaatggtgccgcaggacaccggcaagccctatctcaactggacccaggatccgcgcaacccctaccgcgaagcctcctgaacgcagggcggcgcccgcatccccggcggacgccgccctgccgcgcgccggcacgcttcctgcgtgccgctgcggtccgacgacgcgcaacggcgtctgtcggatcgacccgccttcgactaccattcgccgcggcccggccgacgctcccggacggccggcgccccacggagactcgcgcatgtccgcagacagcaactacagccagcaaccggtcccgctggcagcgcgcaagagcgcgctggccctga

SEQ ID NO: 6927 - DNA, 216 bp, Pseudomonas aeruginosa
tgctcggcctgtacaccgcgatcctcggcttcatcggcgcgcgcaccggcctttccacccacctgctggcgcattactccgttcggcagcaagggctcctggctgccctcggcgttgctcggcggcacccaggtcggctggttcggcgtcggcgtagcgatgttcgccccaaatacccggtggccaaggccaccggcctcgacgtcaacctgctga

SEQ ID NO: 6928 - DNA, 1305 bp, Pseudomonas aeruginosa
gccgcagcccgaacaaaccagaagaggtcctccatgctgattgacaacctgcgcctgcgcggccgcgaaggtctctggcaactgcgcgtcgccgatggccgtatcgccgccctggtgccgatggaacaggccgccgacgacgccggcgagcgcctggacggcgccggcggtcttgccgtgccgccgttcatcgagccgcacatccatctcgacaccacccagaccgccggccagccggagtggaaccgctccggcacgctgttcgaaggcatcgagcgctgggcccagcgcaaggccctgctcagccacgaggacgtcaagcagcgcgcctggcagaccctgaaatggcagatcgccaacggcgtgcagcacgtgcgcagccacgtcgacgtctccgacccgaccctcaccgcgctcaaggccatgctcgaggtgcgcggcgaagtggcgccctgggtcgacctgcagatcgtcgccttcccccaggagggcattctctcctaccccaacggcctggaactgctggaggagtcgctgcgcctgggagccgacgtggtgggggcgatcccgcatttcgaattcacccgcgagctgggcgtcgagtcgctgcacaaggccatcgacctggccaagcgctacgacctgccggtggacgtgcattgcgacgagatcgacgacgagcagtcgcgcttcctcgagaccctggccatgctcgcccatcgcgacggcctcggcgcacgggtcaccgccagccacaccacggcgatgcactcctacaacggcgcctacacctcgcggctgttccgcctgctgaaactgtcgggaatcaacttcgtcgccaacccgctggtgaacatccacctgcagggtcgcttcgacgactacccgaagcgccgcggcatcacccgggtcaaggaactgctcggtgccgggatcaacacctgcttcggccacgacgacgtgttcgacccctggtacccgctgggcaccgcgaacatgctgcaggtgctgcacatgggcctgcacgtgacgcagatgatgggctacgacgagatcgacggcggcctcgacctgatcacccgcaacagcgcccgcaccctcggcctgcgggaatacggcatcgaggtcggccatccggccaacctgctggtgctgccggcccgcgacggcttcgacgcggtgcgccggcaggtcccggtgcgctactcgatccgcggcggacggctgctcgccgagacggtcccggcgcagaccacggtgttcctcgaacaggcggaagcggtggacttcacccgcgccagctga

SEQ ID NO: 6929 - DNA, 714 bp, Pseudomonas aeruginosa
cgaaggctccgctgctcagggctccaatccgattccgcgcaggaccacgctggtcaccgtctgtaccgccctttcgaactgcatgtcgctgagcggctggtggccgttgagcacctcgacctggtagccgaagtcggcgtagtgctgggtggaggcccagatcatgtagagcaggctgctcggttcgatcgacaggatgcgcttttcctcgacccactggcggatcttcgcctccttcatcttggcccattcgtagaggctgtcgtcgagggtggcgccgagcagcggcgcgccatgcatgatttcgttggcccagaccttggagccatgcgggcgggtacgcgagtggttcatcttcgcgcggatatagctggtcaataccacccttgggtcatcgaacatctcgaagcagagggcgtcctgcttccagacctcgagcaggccgaggaggacgtcgcggtacagctcgtccttggtgctgaagtagtagtgcaggttggagcgcggcagttcggcttcttcggcgatgttgcccatggaggtgccggcgtagcctttttcggcgaagactttttcggcggccaggagaatcttctcgacgttgcggcggcggatctcgatcttgtgtgtgcccatgtgcgatccattactgcgaattcaaccaaggctaccagcaaatccgggcgtgcggcgacgcccagtcttgccaggtag

SEQ ID NO: 6930 - DNA, 1509 bp, Pseudomonas aeruginosa
gcctgtcaggctcgaacggagcgcgctctcaggccggcctcgccggtctgtcaacgcaccaacggcgcccattcgcagacaacgaatggagagttacgcatgagcgctgtcatgacgcccgccggtttcaccgactacaaggtcgccgacatcaccctggccgcctggggccgccgcgagctgatcatcgccgaatcggaaatgcccgcactgatgggcctgcgccgcaagtatgccggccagcagccgctgaaaggcgcgaagatcctcggttgcatccacatgaccatccagaccggcgtgctgatcgagaccctggtcgcgctgggcgccgaagtccgctggtcgagctgcaacatcttctccacccaggaccaggccgccgccgccatcgccgccgccggcatcccggtgttcgcctggaagggcgagaccgaggaagagtacgaatggtgcatcgagcagaccatcctcaaggacggccagccgtgggacgccaacatggtgctggacgacggcggtgacctgaccgagatcctgcacaagaaatacccgcagatgctcgagcgcatccacggcatcaccgaagagaccaccaccggggtccaccgcctgctcgacatgctcaagaacggcgccctgaaagtcccggcgatcaacgtcaacgactcggtgaccaagagcaagaacgacaacaagtacggctgccgccatagcctcaacgacgccatcaagcgcggcaccgaccacctgctgtcgggcaagcaggccctggtgatcggctacggcgacgtgggcaagggctcctcgcagtcgctgcgccaggaaggcatgatcgtcaaggtcgcggaagtcgacccgatctgcgccatgcaggcctgcatggacggcttcgaagtcgtctcgccgtacaagaacggcatcaacgacggcaccgaggccagcatcgacgccgcgctgctgggcaagatcgacctgatcgtcaccaccaccggcaacgtcaacgtctgcgacgccaacatgctcaaggcgctgaagaagcgcgcggtggtctgcaacatcggccacttcgacaacgagatcgacaccgccttcatgcgcaagaactgggcctgggaagaggtcaagccgcaggtgcacaagatccaccgcaccggcaaggacggtttcgacgcgcacaacgacgactacctgatccttctcgccgaaggccgcctggtcaacctgggcaacgccaccggccatccgagccggatcatggacggttccttcgccaaccaggtgctggcgcagatccacctgttcgagcagaagtacgccgacctgccggccgccgagaaggccaagcgcctgagcgtcgaagtgctgccgaagaagctcgacgaggaagtggccctggagatggtcaagggcttcggcggcgtggtcacccaactgaccccgaaacaggccgagtacatcggcgtgagcgtggaaggcccgttcaagccggacacctatcgctactaa

SEQ ID NO: 6931 - DNA, 768 bp, Pseudomonas aeruginosa
ataccggataaacagatctccctgaccgatcccgatgctcgttcgatgaaaacgcgtggcaccggaatggtcggctacaacgtgcaggcagcggtcgatgcgaagcaccacctgatcgtgacgcacgaggtcacgaacgacggagtcgatcgagaccagctgagcgccatggccaagcaggcgcgagaggccatgggtgtcgaggaactctcggcggtcgcagacagagggtatttcaaaggcgaagaaatcctcgcctgtcatgaggctggaatcactgttttcgtgcccaaaacgctgacctcgggcgcgacagcggcgggccgcttcggcaaaggtgatttcatgtatgacgcagcaaagaacgagtaccgatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagttggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 6932 - DNA, 420 bp, Pseudomonas aeruginosa
caccaggtccagttcgcctttgtccagcgcctcggccggcaaggtcggggtcaggtgctggatggcgatggagattcccggcgcccgctcactcaggcggcgcatcagggcgggcatgcagatcagttcgacgtagtcggtcaccgctacggtgaagcgctgccggctgcgccccggatcgaagccctcgccgtcgcccaggctctgttcgatctgccgcagcgccgcgcggatcggcgcttccagcgccagcgcccggggcgtcggctgcatcgcacgaccggcgcggaccagcagcgggtcgtcgagcagctcgcgcaggcggttcagcgcattgcttactgccggctggctcagcgccaggcgctccgccgcgcgcgagacgttgcgttcgcgcagcagcgcgtcaaggacgcgtag

SEQ ID NO: 6933 - DNA, 1101 bp, Pseudomonas aeruginosa
tggtcgctttttgtgcggtcggactgccccaggtttcgtccaccgttcctcctgcgctcgttacaacgaggacaagaccatgagccagaacttttccttccgccaggccgcggtgatcggcgccggcaccatgggtcgcggtatcgtcatgtgcctggccaacgccggtctcgacgtgcagtggctggacagcaacccgcagatgctcaaccaggcgctcggcgccgtggccgacacctacgcgcacaacgtgcgccaggggcgcatcggcgaagaggaagcggccgcgcgccgcgcccgcatcacgccggtccagcacctcgccgcgatgcgcgaggcggacctggtgatcgaggcggtctacgagaacctggaactcaagcaatcgatcttccgcgagctggacgcggcgctgaagccctccgcggtgctggccagcaatacctcctacctggacatcgacgccatcgccgcggtcaccgcgcgtccgggtcaggtgctcggcctgcacttcttcagcccggcgcacatcatgcggctgctggagatcgtgcgcggcgcgcagaccgcgccggcggtgctggaggcggccctggcgctgggcgagcggatgggcaaggtcagcgtggtggccggcaactgccacggcttcatcggcaaccgcatgctcgaaccctacgccaccgaggcccgcctgatgctgctggaaggcgctctgccgtaccaggtggaccgggctctccaggcgttcggtttcgccatggggccgttccgcatgtacgacgtggtcggtatcgacctggagtggcgcgcccgcgagttggccggggtcggccaggaccagccggccgtgcaggtggacaaccgcctttgcgagatgggccgcttcggccagaagagcggtgccggctactaccgctacgcgccgggcagccgccaggcggagcacgataccgaggtggatgccctggtgctccgggttgccgagacgctgggctacccgcggcgcgatttcgccgacgaggaaatcctcgagcgttgcctgctggcgctggtcaacgagggcgcgaagatcctcgacgagggtatcgccgcccgtag

SEQ ID NO: 6934 - DNA, 1338 bp, Pseudomonas aeruginosa
tggccctgcccgaggagcatttctcgttctgacgggcgtctcgcccaaggagaccgatatgcaagctttcagtttcgccactaccgcgcagatcctctgcgaggccggctccgccatccgcctggcggaactctgccgcgagcgaagggcgcgccgcgtgttgatcgtgaccgacccggggatcacccggctcggcttgctggatgcgatcctgcccggcttcccgcgcctgggcctggccgtcgaggtgtacgaccaggtgctcgccgatccgcccgagtcggtggtcgaggccgcgctcgggcgggcgcggggcatggctgccgagctggtggtcggtttcggcggcggcagctccatggacgtagccaagctggtcgcgctgctcgcccacccagaagcagggcaggggctcggcgaggtcttcggggtcggcaacgcacgcgggccgcgcctgccgctgatccaggtgccgaccaccgccgggaccggctccgaggtgacgccgatcgccatcgtcaccaccggcgagaccaccaaggtgggcgtggtctcgccccacttgctgcccgacctggcgctgctcgacgccgacctgaccctcggcttgccgccggcggtcaccgcggcgaccggtatcgacgcgatggtgcatgcgatcgagagctataccagcaaactgaagaagaacccgctgtccgacctgctggcgcgggaggcgttgcgcctgctggcggccaacctggaacgcgcggtaggcgacggcggcgaccgcgaggcgcgccaggccatgctgctgggcgcctgcctggccgggcaggccttcgccaatgcgccggtggcggcggtgcatgccctggcctatccgctgggagggcatttccacattccccacggcctgagcaatgcgctggtgctaccggaggtgatccgtttcaacgctcccgctgccgctggactctatgccgagctggcgccgctgctgctgggcgaccgcttgcgtccgggcgatcgcgacgcgcttaccgtgcagctgatcgacgaactggcccagctcagtccgcgcaacggcctgccgagccgcttgcgcgacgccggggtggacgaggcgatgctgccgcgcctggccgccgacgcgatgctccagcagcgtctgctggtcaacaacccgcgcgaggtcggcgaggcggatgccctggcgatctatcgcgcggcatactgaatcccttctacgaggaccgggcatggcgaccgccctgcgaccgctgcgcgagcagtaccttcatttccagccgatcaccacgcgctggcacgacaacgacatctacggacacgtga

SEQ ID NO: 6935 - DNA, 234 bp, Pseudomonas aeruginosa
ctggcaaggacgcggaacatgggtttcctgatactctcccgccgagaaggcgaaggcatcaccctgtccctcaaggccgactacccggcggaggaactgattcggcaattgcgcgaaggcggcatccggatcctggtcaccgatatcatcggcaaccaggcccgggtcggaatcgaggcgccgcgtggcgtcctgatcgttcgcgacgagttgaaaacggcaccgaaaggctga

SEQ ID NO: 6936 - DNA, 723 bp, Pseudomonas aeruginosa
ccgctgtcgttgtccttgcccaggttgttaccgaccgcgccacccgctgcgccgccgaggcctgcacctatggtcgcgccggtgctgccgcccagcttgttgccgatcaccgaaccgccggccgcgccgagcccgccacccagggcggcttcggtcttgcgcccgtccttggcggtcatcgcgccgccggccgcgccacccaggccggcgcctatggccgcaccggtgctaccgccgatggcgccgcccacgacgttgcccagggcaccgcctacgccgccgcccaccgcggtcttggtggaatcgccggcgagcgcggcttgtgcgctcagcaggccgaacgcgattaccaggagagatttacgcatcgtgcgtgcctcatcgtttcaatcgggagggaaatacggtcgttcgcacaaaggccggaccatccggcccggcctttgcctcgtagggagcggcgggttcagtcgtcgtagtagcgacgatgatgcttgtggcgcttccacttcttgtactggccatagtgatggccgttgtcatgccggtaatagccatcgcgatagccggcgcggcggtagtagcgacggtcgcggtagtcgtcatcgtcgtcgtagcggcggttgccgtcgccataatggttgcccagcgcgccgccgccggcgccgccgagggccgcgccgatcaggccaccggtgctgccaccgatctgccggccgatga

SEQ ID NO: 6937 - DNA, 906 bp, Pseudomonas aeruginosa
gacgccgcctcctgttgcaggaggcggcgtttttcgtgggcttcagataatgcgcccgtcgcccgtggccttttccaggcgtaccgcgatgaacttcgaagtcggcgtatggctgccgacgccgacgctctccagcggcaccaggggattggtttccgggtagtaggcggctgcctggccggccgggatgtcgaaggcgagcagggtgaagcggcgtacccggcgttcgatgccatcgctccacagcgagaccaggtcgaccttgtcgcccggctggtagcccaggcggcggatatccgcctcgttggcgaataccacttcgcgctggcccttcactccgcgatagcgatcgtccaggccgtagatggtggtgttgtactggtcatgggagcgcagggtctgcaggatcaggtcgggttcgaggccgctgtcgcgcacctgtgccggcaacaggtcgcggggcagcgggttggcgacgaagttggccttgccgctggcggtgttccagcgtcgttcgccggcggagttgccgaggtagaagccaccgggatggcggacgcggcggttgaagtcggcgaaaccggggatggtgtcggcgatcagctcgcggatgcgctcgtagttggcgatcagcgcgtcccagtccaccggatggttgcccagggttgccttggcgatgccggcgatgatcgccggctccgaacgcatctgctgcgagagcggctccagttgcccgtaggatgcgtggatcatgctgaacgagtcttccaccgtgaccgcctgcgggcctccggcctggcggtcgatgtcggtgcgccccaggcagggcaggatcagtgcgtcgcggccggtggtcaggtggctgcggttgagcttggtgctgatgtgcacggtcaggtcgcatga

SEQ ID NO: 6938 - DNA, 1590 bp, Pseudomonas aeruginosa
cgccagggcggcgtgggtgcgcggactgtccggggtggcctgggcgaaattgccgcccaggccgatgaagaccttcgacttgccggcgagcatcgcggcgatcgcctcgacggcgttgtgcccattgtggcgtggcacttcgaagccgaagcgccgttccagtgcgtcgagcagcgccgccggcggccgctcgttgatgcccatggtgcggtcaccctgcacgttgctgtggccgcggaccgggcagagaccggcgcccgggcggcccaggttgccgcgcaggagttgcaggttgacgatttcctggatgatcgccaccgaatggtggtgctgggtgatgcccatcgcccagcagacgatgaccctgttcgcccgccggtacatccgcgcagcctgctcgatttccgccaggcccagcccggactggcgctccaggtgttcccagggggtggcatccagttcggccaggtaggcctcgaggccgtcggtgtgctcggcgatgaaggcgtggtcgaataccggctcgctaccctcggcctgggcttcgcgctcccaggcgaggaggaacttggcgatcccgcggatcgccgccatgtcgccgcccagtgccggacggaagaacgcggtgttcagcggcgaggacccgttagtcagcatttccagcgcgttctgcggatgctggaagcgctccaggccgcgctccttgagagggttgaagcagaccacctgggcaccgcgcttcactgcctcgcgcagcggctcgagcatgcgcgggtggttggtgccggggttctgcccaaggatgaagatcgcgtcggcgtgttcgaagtcgccgaaggtcacgctgcccttgccgaccccgacgctgcggcccagtgccacgccgctggcttcgtggcacatgttcgagcagtcggggaagttgtttgtgccgaacgcgcggacgaacaactggtagaggtaggccgcctcgttgctggcccgcccggaggtatagaactccgcctggtcggggctatccaggcgtcgcaggtgctcggcgaccagggcgaaggcggcgtcccaggtgatcggctggtagtggtcgctgagcgggtcgtagcgcatcggtccggtgaggcggccctggtattccagccagtagtcgctctgttcgcgcagggcgctgacgctgtagcgggcgaagaacgccgcgtcgacgcggcgcttggtggcttcccagttgactgccttggcaccgttctcgcagaacttcacccggccgtcttccggcgagtcgccccaggcgcagccggggcagtcgaaaccgccgttctggttggtcttgagcagggcgcggaggttcttgaacggctgtttgctgtccagccagaagtgcgccacgctgcgcagcgcgccccagccggcggcggcgccggcatagggcttgtagcggggttggagaggttgcaggctcatggcggactcactcggttgcggccggcgccgggctgtagacccgcggggcgttgtgatggggctggtggatcaggttcagttggtggcggcgcgcccattgcacggtcagggcggtgggggcggagaggctga

SEQ ID NO: 6939 - DNA, 618 bp, Pseudomonas aeruginosa
tgtccatcggcgcttccgtggcgggggtgtcgccgaatcttaacgcgaatgggcgcagtgttatggggtgacgaaggagcctggggatatttcgccggtttttgcagtctagacttggctagtcgcggatcgggattgcgccggccgcttgcaaccgtaaccgtaaagggagaaccaaagatgggtattttcgcgttcgtgaaggaagccggtgaaaagctgtgggatacgctgacggggcatgaggcacaggcggccgagtcgctgaaggagcacgtcgccaaggtcggcctgggcaacccgaacatccaggtttcggtggaaggcgacaaggtcatcgcctcgggcgaggtggtcagccaggaggagaaagagaagatcctgctggcgctgggcaacgtcgccggcgtctcctcggtggaagacaagatcaccgtggcccaggccgctccggaggcgcgcttcgtcaccgtgaagaaaggcgacaccctgagcgccatcgccaaggccgaatacggcaatgccaacgcctacatgaagatcttcgaggccaacaagccgatgctcagccatccggacaagatctaccccggccaggtcctgcgcattcccgagtga

SEQ ID NO: 6940 - DNA, 978 bp, Pseudomonas aeruginosa
cgcgtggcgctatccgcccttcgcccgatgccggcggaggagaatgaagaagggccgcgaagcggccctgggggtggtgtatcagcggtactcgatgcccgccttgcgcgtgctgactcgcgttcccgccttgccctcggtgatcgcgacgatgtccgcgagcgaaccgatcaccgcgtccttgccggtggcgcgggcgaactcgatggcggcctggaccttcggtcccatggagccggcggcgaagccgaggcgctccagttcgtccgggtgggcctgggcgatggccttctgggtcggcttgccccagtcgacgtaggccgcgtcgacgtcggtggcgatgatcaggatgtcggccaccagctcctgggccagcagcgaggagcagaggtccttgtcgatcaccgcctcgacgccgctgagcttcttcccggcctcgtcgtacatggtcgggataccgccgccgccagcgcagatgacgatggtgcctttctccagcagccacttcaccgggcggatctcgaagatccgcttcggccgcgggctgggcaccacgcggcggaacttgtcgccgtccggggcgatgctccagcccttctcggcggccaggcgctcggcttcttccctggagtagaccgggccgatcggcttggtcgggttctggaacgccggatccttaccgtccacctcgacctgggtgaggatggtagcgaacggcacttcgaacggcagcaggttgcccatttcctgttcgatcatgtagccgatcatgccctcggtttccgcgccgaggacgtccagcgggtagggcgagaccttgtcgtaggcggcaccctggagggccagcaggccgacctgggggccgttgccgtgggcgatcaccagctcgttgccgggcgccaccttggcgatctgttcggcggcgatccgcacgttttcccgctggttgtccgcggtcatgggttcgccacggcgtag

SEQ ID NO: 6941 - DNA, 1113 bp, Pseudomonas aeruginosa
cagggcattaccgcccaatgcgacgacgatacgcatatcggttacctccggaaggcggctgcgcccggccgcgtgggccggggcgcaggagcgcggtcagatgtcggcgagggtcgagacgaggatcgccttgatggtatgcatgcggttctcggcctgctcgaaggcgatgttgtagggcgactcgaagacgtcctcggtcacctcgatgccgttggccaggttcggatactgctcggcgatctgcttgccgaccttggtctcgctgttgtggaacgccggcaggcagtgcatgaacttggcccgcgggttgccggtggccttcatgatctccatgttgacctggtagggcagcagttccttgatccgctcgccccaggcttccaccggctcgcccatcgatacccagacgtcggtgtggacgaagtccacgcccttcacggcttccttcggatcctcggtgagggtcagcttggcgccgctttcctcggcgaacttcttgcactgggcgacgaactcgtcgtgcggccagagcgccttcggcgcggcgatgcgtacgtccatgccgagcttggcgccgatcagcagcagggagttacccatgttgttgcgcgcgtcgcccaggtaggcgtagctgatgtcgtgcagcggcttgtcgctgtgctcgcgcatggtcagcacgtcggcgagcatctgggtcgggtggtattcgtcggtcaggccgttgaacaccggaacgccggcgaacttcgcgagttcctcgacgatttcctgcttgaagccgcggtactcgatggcgtcgtacatccggccgagaacccgcgcggtgtccttcatgctctccttgtggccgatctgcgaggagttcgggtcgatgtaggtgacgttggcgccctggtcgtaggcggccacctcgaaggcgcagcgggtgcgagtggaggttttctcgaagatcagggcaatgttcttgcgcttcaggtgctgctgctcggtgccggtgtacttggcgcgcttgaggtcgcgggacaggtcgagcaggtaacgcagctcgcgggtgctgtggtgcatcaggctgagcaggttacggttgtgcatgttgaaagccatgattga

SEQ ID NO: 6942 - DNA, 2511 bp, Pseudomonas aeruginosa
acatcagcaggaagagcagcaggaagaggaacagaatggtcatgccttgggctcctcgtgctcggtcagcttcagcgcgtcggcagcctcgtcggccagtcccagtccggtctggcggttgcgcaggatgcgcacgaggatctcggcgaaacggatgaacaccagggcgaagccgaccggcacgatcaggccgatgtgccattggcggatgccgaagtggtcgaggtcctcggcgccgatgccggcgatgaacagggtcttcacccagtcatagctggccacgcagagcaggccggcgtagccgaggcaggccaggcaggcgatcacgccgagcacgcgctgtaccggtcgcgaggccagcttcaccagcacgtccacgccgaggtgcccggcggtgcgtacgccgtaggcgatgccgaggaagatcagccaggcgaacagggccttggtcagggcgttgctccaggtcatctcctgggccagggtgaggaccccatcgccgatggcgagcagcgtctcgttgccgccctcccagagatcggcgagatcgtagagcagcgtatagaggttattgaggactacataaacgaaggtaaccagcgtcatggcggcgaggaggaaggcgatcaggccttcctccaggcgcgcccagacgcgcgcgagcgcgtgcatgggctttccctcttcttattgggcctggttggcggcttcggcggccttgatcaggtcggcgccgatctcgccttcgaacttcttccacaccggctgcatggccttgcgccattcggcccgctgttcgggagtgagttcgatgatctcgctggtcttggcctcgacgatgcgctgcttgtcgccctggttgagcgcctcggcctgcttgttcacctccacggtgacctcgtccatggtcttggccagcacgccgcgcacgtcttccggcaggccgttccagaacttggtgttggtgatcaccatgtagtccagcacgccgtggtcggactcggtgatgtacttctgcacttcgtgcatcttctgcgagtagatgttcgaccaggggttctcggtaccgttgaccacgccggtctgcaggccctgatagacctcggcgaagctcatcttgcgcgggttggcgcgcaccgccttgaactgttcctcgagcaccttggaggcctgcacgcggaacttcaggccgcgggcgtccttcggctcgcgcaggggcttgttggcggacaactgcttcatcccgttgtgccagtagccgaggccagtgatgcccttgtcctgcatcgaggtcagcagctccttgccctgcgggctctgctggaagcggtcgaccgcctggatgttgtcgaacaggaacggcaggtcgaagatctgcaatttcttggtgtactgctcgaacttggccagcgacggcgcgatgatctgcacgtcgcccagcagcagggcttccatctccttgccgtcgccgaacagcgacgagttcgggtagacctccaccttgaccttgcccggcaggcgttcctccaccagtttcttgaacagcagcgcgccctggcccttgggcgtgtgctcggcgacgacgtgggagaacttgatgacgatcgggtcggccgcctggacgattccggcgacggtcagggaaagtgcgcagacgagcgccttcgcggtgtgcttgagcatgagacttcctctttgttcttgtctgtcttttatgaagaggacgggtgtcctctcggcgtggccgaacaagggaagtctaggcagcgcagcggcagatgctgcgtgaatcggaaaagcgcctggtcttctgcttgttggaacgctcgggaagccgtgagcaagccctgtgccagtcgggcaagggtacgcaggggagatgctgcgggcgcggatggcgaacggttggcggtaatccgccattcattcgccatcatctggcggattttcgccaggcgtgttgaacggcaggccgtgcttgcgcagcttgtcgtgcagggtcttgcgcgggataccgagggcctcggcgacgctgcgcagcgaattgtgcgggcgttccagttcggcagcgatcagcgagcgctcgaaggcctcgaccttggcgctgaggttgtgcggctcgtcggcggcgtcgggcaggactccgtcgtccaggctcaggccgagacccagggcgaagcgctcggcggcgttctgcaattcgcgcacgttgcccggccagtcgtaggccagcagccgcgccgactggccggcgtccagttcgcgtggcgtcaggccatgacgcatggcgccggcttcggcgaaatggcggaacagcagcgggatgtcttcgccgcgctcgcgcagcggtggaatgcgcaggctggcgacgttgaggcggtaatagaggtcggcgcggaagcggccctggtcggcggcctggcgcaggtcttccttggttgccgcgatgatgcggatatccagcgggatcaactggttggagccgagccgctcgactacccgttcctgtag

SEQ ID NO: 6943 - DNA, 1320 bp, Pseudomonas aeruginosa
caggcgcaacagcttgacctgcacgtccaggctcatgctctcgatctcgtcgaggaacagggtgccgccattggcgtactcgaacttgccgatgcggcgcttctgcgcgccggtgaaggcgccggcctcgtgaccgaacagttcgctttccaccaccgattcggcgagggcgccggcgttgatcgcgacgaacggtccgtcacgtcggctcgacaggtcatgcagggcccgcgcgaccacctccttgccggcgccggtttcgccaaggaccagcacgtcggcctggatcgccgccagcgagccgacctgctcgcgcaggcgctgcatgccggccgagcgtccgatcaggcgcccatgcagctcgtggcgttcggccagggccaggcgcagggtgcggttctccaggaccagccggcgcacctccagggcgcggcgcacgctgtcgagcagggcgtcgctggggaagggcttttccaggaagtcataggcgccgccgcgcatggcctggaccgccagcggcacgtcgccgtggccggtgatcaggatcaccggcaggtcggcgtcctgttcgtgcaattggcggagcagttccatgccatcgatgccgggcatgcggatgtcgctgaccaccaccccgggccagtccttgcactgcgcggtatccaactggcgcgcgtcgtccagggtcgcgaccttgagcccggcgaggtcgagcgtctggcgcagggcctggcgcaggtgcggatcgtcgtcgatcagcaggacctgggtctgggcatcgaatggcgcgaagggactcatgcgcgggtttcctcctggggcatggcggcgacgccgggaactcccggcagcaagtgcaggcgcaccacggcgccgccttcgagatggttgcccatttccaggcggccgccgagggcgcgcaataggttatcgcagatggccaggccgaggccgagccctttggcggtggtcttggtggtgaaaaagggttcgtgggcgtgggccagggcgtcctcggaaaaccccgggccgttgtcgcgcagggtcagggtcacgccgtgctggtcctggctggcgattacccacaggcgccgcggcggagctttctcggcgagcgcgtcgagggcattggtgagcaggttgccgaggatctgccgcaagcgggtctcgccggcctggacccacagcggggcgtccggcacgtcgcgcagcagttcgacgttcatcgcccgccgccggctggccaccatcgacagggcgtcctcgatcgccggctgcaactgcacgttctccggcgcccggcgcgcaccgcgggcatag

SEQ ID NO: 6944 - DNA, 960 bp, Pseudomonas aeruginosa
cgtcgggaattgccaggcgggtcgctttcatcagtacacggtctcggtcagcaggcgcttgaggtattggccgtagccgttcttggccagcggcgcggcgagtttttccagttgcgcggcgtcgatccacttctgccggtaggcgatctcttccgggcaggccaccttgagaccctggcggttctccagggtggcgatgaactggccggcctcgagcagcgaatcgtgggtgccggtatccagccaggcgtagccgcggcccatgatctccacgctgagctggccgcgctccagataggcgcggttgacgtcggtgatctccagctcgccgcgcggcgaaggcttcaggtccctggcgatgtccaccacctgctggtcgtagaaatacaggccggtgaccgcgtagttcgacttcggctccagtggcttctcttccaggctgatggccttgccgccctggtcgaactcgaccacgccgtagcgctccgggtccagcacgtggtaggcgaagacgctggcgccggtctggcgctgcgaagcgctgccgagcaactcgtggaagtcgtggccgtaatagaggttgtcgcccaggaccagcgcgctgaggtcgttgccgatgaacgactcgccgatcaggaaggcctgggccaggccgtccggcgacggttgcacggcatattgcaggtccaggccccagttcgaaccgtcgcccagcaactgctggaagcgtggggtgtcctgtggggtcgagatgatcagtatctcgcggatgcccgccagcatcagggtactgagcgggtagtagatcatcggcttgtcgtacaccggcagcaactgcttggagatggccagcgttgccgggtgcaggcgggtgcccgagcctccggcgaggatgatgcccttgcgtttcatagtggtccctgctcgctcagttcctggatcatgcgtccggcatggtag

SEQ ID NO: 6945 - DNA, 702 bp, Pseudomonas aeruginosa
ccagccgccgccaggagtaaaccactgattttcctgcccgaatgccgttcgtcctcagtgcccggaggcggccgcgccgggcttggcgccgaacggcgggcgggccagccagatgatcaccagcagggcgaggaacagccagccgagcatggtgaagtagtcgatggtggacatcatgtaggcctggctctgcaccatccggtcgagcagcgccgcgttcgcctgggtgttgccgccgagctgggcgagggtttcgtgggtggccgggtcgtagaggctgatgttttcgctgaggtaggcgtggtgttgggtggcgcggcggttccagatccaggtggtcagcgaggcggcgaagctgccgccgagggtgcgcaggaaggtggccaggccggagccatcggcgatctggtcggggggcaggtcggagagcaggatgctcaggatcggcatgaagaagaacgccacgccgagccccatgatcaactgcacgatggcgatgtgctggtagtcgacctcggtggtgaagttggcgcgcatgaagcaggtgatggccatcgccaggaacgacaggccggcgagcatgcgcaggtcgaaatggttggcgtagcggccgaccagcggcgagaggaacaccgggaggatgccgattggcgcggcggccagcccggcccaggtggcggtgtagcccatctgggtctgtag

SEQ ID NO: 6946 - DNA, 1065 bp, Pseudomonas aeruginosa
ccattgcgggagcagcaggttgatgccgaagaacgcggcatagcccagcaccagcgccagggtgccggcggcgaagttgcggtgggcgaacaggcgcaggttgacgatcggatggcggtcggtgaattcccagatgatgaagaaggccagggcgatcgccgcgatcagcgcgccgccgacgatgaagttcgactcgaaccagtccaggtcgttgcccttgtcgaggacgatctgcagggcgccgacgccgatcaccagggcgatcaggccgacgtagtccatcggcgccttcttgatcaccaccgggcgtgccttcagttgctggtagacgacgaaggcggcgaacaggccgaccggcacgttgatgaagaagatccacggccagctgtagtcgtcggtgatccagccgccgaggatcggcccggcgatcggcgccaccaccgtgaccatcgccagcagggccagggccatgccgcgcttcgccggtgggtagatggagatcagcagggtctgggtgatcggatacagcggcccggcgacgaagccctgcaaggcgcggaagccgaccagagaaggcatcgactgggcgatgccgcagaggaacgaggcgagtacgaacagcagcgcggcggcgatgaacaggcgcacctcgccgacccgccgggccagccagccggtcagcggcagggcgatggcgttgctcacggcgaacgaggtgatcacccaggtgccctgttccgaactcaccccgaggttaccggagatggtcggcagggcgacgttggcgatggtggtgtcgagcacctgcatgaaagtcgccagggacaggccgatggtcgccatcaccaggctgggcggggagaagctgctgctttcgctcatgctggcgggctcaacgctgggcggtcttgccgtggtcttcggcgaggttggcttcgatcaggcgttcgatcagcttgtcggccgaggccagttgctgctggtagacatcggtggagaacagcgcttcgcgcggtggttgctgggccagggccgggccgctctggtcatgcaggtcgaccttga

SEQ ID NO: 6947 - DNA, 1542 bp, Pseudomonas aeruginosa
tcatggtgggtgcctcgttcattctgccggcgctttcgcggtagcgagcgcagcggagcgggaatcgggttggaaaccgccgcccagggcctggaccagctggacggaaagatcgatctgctggctctccaggctggccagctggcgttcggcgaccagcagttgctgttgcacgctgagggcgtcgaggtagctgccgacgccttcgccgtagcgacgcatggccaggtcgaagttggacctggcgatatcgcgggcctggcgctggtcgatcacctgctgctccagggagcgcaacttgccgaggttatcgctgacctcgccgagggcctggaccagcgtcttgttgtactggccgacggccaggtcgtagtcggcgtcgcgttcggccaggttggcgcggcggcggccaccgtcgaagatcggcagggagatcgccggcgccacctggaagaagcggctcggcgcctgcaacacgtcgctggtgtgcagggcggcgaggccggccatcgcgccgagattgaggttgggatagaactcggtcttcgccgagtcgatgttgcggcgcgccgcctcgacccgccagcgcgcggcaacgatgtcggcgcggcggccgagcagttccgccgggagtaccgagggcaggctcaggctggccgggttcagcggttgcgggcgctgcagttcgagaccgcgatcgggccccttgcccagcagcacggcgagggcgatgcgggcgctggcgatgtcctgctcggcggcgctgagctgctggcgggcggtggccagctgggtctgcgtctgttgcagctggaccttgctgtcgagcccggcgctcatgcgcttctggctcagctcggtcatgcgctgcgagcgcttcagttcttcctcggcgagatcgcgcacggtaaaggcgtgggcgaggtcgctgtaggcgcgggcgatgctcgccgagaggccgatgcgcgcggcctggctgtcgatccgggcggcattggcctggccgagggcggcttcccaggcggcgcgctcgccgccccagaggtcgaagtcgtagttgaagccgagcgacaggtacttgatcgccgaatagcggccgccgagcggtgccggggccacgctggtcggcgcgcggatgccggagtagctggccttggcgtccagcgtcggctggcgcgcggcatcttgcgcctgggccgttgccgccgcctggcgcgcacgcgcctcggcgatctgcaggtcgggggtgccttgcagggcttcgccgatcagttggtcgagctgccggtcgccgagcccggtccaccagtcctggcgcggccaggccgctggcgaaagggctacgccgtccaggctcctgcccgcctggagggcgcctgccggttgcagtcgggcgttcggttccaggccttcggaagtgacgcagccggcggccagcactatcgccgaggccagcgccaatcgctgcggccagggatggagaagagggaacggcatggatcaggactcctgcaggctggcccgcgggcagccggcgtgtag

SEQ ID NO: 6948 - DNA, 765 bp, Pseudomonas aeruginosa
ctcgttcctcacgaaaccacggccggcgcgacgttcgaggaagtgcagggcgaccatgatgacgaccgtgaggctcaggtagatggcggccgcggtcatgtagaaggtgaagggttccttggtcgcgttggaggcgacctgcgccttgcgcatgatctcgtcgagggtgatcagcgacaccagcgcggtgtccttcagcaggatcaggtacaggttgccgaggccgggcagggcgacccgccagatctgcggcaggacgatgcgccagaagatccgtccgggcgacaggccgagcgcctggccggcctcgcgatggccgcgcggaatggacaacagcgcgccgcggaacacctcggtggcgtaggcgccgaagcacaggccgagggccagggtgccggcggcgaacggcgagagtgccaggtccggcttgccgaaaaggtcgccgagggcgttcaggccgctcaccgtgccgaaatagatcatcagtacccagagcgtttccggcacgccacggacgatggtggtgtaggtgccgccgaggaagcgcagggccgcgtacttcgaagtcttcgcgatggcgccgaggaggccgagcaacagccccacgcagaccgccgccagcgacagcttgagggtcatccaggtaccggcgagcagttggtcgccgaacccatgcaggtcgagaatcatgagaagtcaggcctgaaggcggccaccgccgggacgcgcccggcggtggcctggcttggcatcaatagatgctga

SEQ ID NO: 6949 - DNA, 1047 bp, Pseudomonas aeruginosa
agggcgggtaggcgccttcggtgccgatgcgcagcttgtcggcggcgctggcgtcgagggcgaaggccagggttgcagcggcggccagcaggatcttcttatagttcttcatgcggtgttgctccgttagcggtggctggacatgaactgtttgcagcgcgccgactgggggttttcgaaaacctgttgcggcgttccctgctcttctaccaggccctggtggaggaataccacctcgctggaaacctggcgggcgaagctcatttcgtgggtgaccagcagcatggtccggccctcttcggcgagcgcacggatcacgttaagcacttcctgtaccatttccgggtcgagcgccgaggtgggctcgtcgaacaggatcaccttgggttgcatggccagggtccgggcgatggccgcgcgctgctgctggccgccggaaagttgcgcgggatagctgtggcgcttgtcggcgatgccgaccttggccagcaggccctcggcgatctcgatcgcttcggccttgctcttgcccagtacgcgacgtggcgcctcgatcacgttgtcgaggatgctcatgtgcggccacaggttgaaattctggaagacgaaaccgagttcgctgcgcagccggttgatctgctggctgtcggcggcgaccaggtcgccgttcttgctcttcttcaggcgcagctcttcgccggagaccaggatctggccctggtgcgggttctccagcaggttgatgcagcgcaggaaggtggatttgcccgagccggacgatccgaggatggagatcacgtcgccgtcgcgggcggtgagggagatgcccttgagcacttcgaggtcgccgtagcgcttgtgcaggttacggatttccagtgcgggggtggcctcggccatggattttcctcttgttattcggattggaagggccttcctggcgaaggcaagctagcacagcgcttcaaccggagccaagcaggcggcgtgcctctggagcggggttggcggcatcttgtcgcatcgctgcagtgcgctgtcgcgtag

SEQ ID NO: 6950 - DNA, 2316 bp, Pseudomonas aeruginosa
cgctctttccacccccttggttttaccgcctgcacagcggagagcagccagatgaaaaaaacgctgctgctttgcctattcctggccgcattcttcgggggagcagcccacgctgaatcctcgggcggaatgagccagttcaccccgccgccgggcgacacttccgttgacttcctggaagaagtgttcggctccatcgtgggtaccatccactcgggtgggaatgtggaaggaggcgaaaccgaggacgtgctgggcagcatgatgtccgtgttcggtggcgccgtgatgttcctggggatgattttcatcgcttacaccacgatcaaaggcaccgtggattccgcccaggatggtgaggttcttggccggaagatgagcgatatctggattccattgcgtactgctgcaggcggcgcgttgctactgccgctcgggcatggctactcgctgatacagatcatggtgctctggctcgcgatccagggtgttggtgtgggagatgcaatctggaaccaggccgtcgaccagatcggcaaggacggcatgctgtctcgaccgctgatccccgattccaggccgctcgcggccaatatcctgaaattcgaagtctgcaccgcggcgatgaacaagcagttcgaagcctccggtcggtcgacgcgcatacaggcagtcgcatccacgcgcaaagtcgtcaacaccggtgagattgacgtcgatatcaccgacgcgattccggtctatggcggcatcaacatggtccagaaatacaacaaggcgagctacaccgtcaccgactacaaatggaaggccaacgacaattcctacatgaaccccgatgtgtgcggcgccctcacatggaagcaatcctgggaggcttcagaagggaacagcaacaccaaggtcatcaaagacccaatcctcgcggcccacgcgaaagccattcagcagatgatccaggacatccggccgacagcccagcagatcgtcgccgggcaaaagccggctccgggcgtgatcgatgccgcagccaacaaatacgagaactcgcttcgcgccgccgctaaagctgccgtctcacaaacgagtgatcgggctgcagctgacttcctcaaggccgccaaggatggtggttggctgttcgccggaacctggtacaaccacatcgtcaagatgaacgacgtgatgcagtccacgctgaacggcttgcccgcggcagaacccattgccatcgtcgacaaagagaccaaggagacactccagacctatgctgacgtgatgcttaccgctgacgaatatgccaagcaccgcgtggactcagttaggaacacctactatgccgaaaccaacatccgagagccgcgtgacggcgaaggggcctgggagtacgtcaagaagatgatgtccgcccctttcatgggcgcaatcaatcagatgacgcaaagtatcgccggatcaaatctgaatcacatgagccagatgaaaagcttcggcgatgtcatcgtgacaataggtgaggtaatgctcgcttcgatggccggtgtgagtggggctgcaaactcgctggcggccaaggtcacggtaggaagcgtattcgacgtaggggccgtgattcagttcgcctctagcctggtcacaacgtttgtgctgctgttgttctttttcggcgtgacgttgagcacttatgtacccatgatccccttcatcacctggacgacctcaatcgtgaactggttcgttctcgtcctggagtcggtcattgcggccccgctgttcgctgtcgcgcacatccatccggacggtgacgatacggtcggacgtgcaggccagggttacatgatgatcctatcgctcgtgatgcggcctgccctgatgctattcggcctagttggagggatgttgcttacccagcctatcgtcggttacatcaacgcggcctttatgtccgtggtctcggggatccaggccgattcgatgaccggcatcgtgtccttcatcgcttacgtggccatctacgtggtcataatgactaccgtagtacacatcgtgttcagcctgattcactgggtaccggacaacattctgcgctggatcggccaaggtgctaccggcggtatcgcggacgcagagcgcaccggcgatggtggacaggacgtgtttgtggccggggtcagggaaagcaagcacggggctgctggtggcctgggtggtggggcgaaacatggcaaggggccagataactctactactgggactcctggccgaggcatgccagacaacagcacgctgctgggcgggccgcccccaggaggttaa

SEQ ID NO: 6951 - DNA, 1512 bp, Pseudomonas aeruginosa
cgccttacgatcccctcgcggtttccgccggactgccgggcctcagttccaggcctggcgttcctcgtcgcgcagctccaccggcaggctccggccttcctcggcggagcgtcgtgccaactccagcagggccatcagcgcgcaggcctgttgcgccgacaccgggttgcgcgactggccgcggatggcggcggccagcgcctggtagtagcggctctggtcgcctgccggggtgaccagcgactggcgcaggccctggccatcgatgtgctgcagcaggtcgggatcgcggccccagccggcggaaccggggtgcagtccctggagcagttgcgcttcctggatgtcggcgccggccttgagcaggctgccgtggtcgccgtgcacattgaagcgtggcgccggattggcggcgagcatgctggcgcgcagcgctacctggcagtgcggataatcgagcaggacctcgaaccagtcgtcggtcagcgcgccctcgcgcagccggcgcaggtgtccgtgcacacgctgcggtacgccgaacaggcacagtgcctggtcgagcaggtgcgggccgaggtcgaaccacagcccggagccgggcaggtcgtgttcgcgccagcggtcgcggacctgcggacggaagcgctcgatggccgactcgaagtagcgcaccgggccgatgctgccggcctgcagggcggcctccacggcgaggaagtcgctgtcgaagcgccggttctggaacaccgagaggacctgcccaggccgttcacgggcgaggtcggcgaggcgccgggcttcggccagggtgacggtgaacggcttgtccaccaccacgtgcttgccggcgcgcaaggcccgttcggcgaggctggcgtgggtggcattgggcgaggcgatgaccaccaggtcgatgtcggcggcctcgatggcctcatccggatcggcgctgacccgggcttcgggcaggtcggcgtgcacccgcccagggtcgcgggagaccacgtgctccaggcacaacgccggtaccgcgcggatcagcggggcgtggaaggtcttgccggcgaagccgtagccgatcagcgcggtgcggatcggaggcaggccagagagggatggggtcatggcggcctccgtcgggcggggtgggggtcaggcggatggcggcacgtagccgtcggccttggcgtagtcctcgccggagaggaacttgtccatctcctgctggaggaacttgcggtcctcggcgttcatcatgttcaggcgacgctcgttgatcagcatggtctggtgcttctgccactcgtcccaggccttgcgcgacacgttgttgtagatgtcctcgcccttcgcgccaggatacggcgggcggtcgaggccgggcagctcttcgtggtacttgcggcacatcacggtgcggctcatggtcgttctcctgcagttgccgccgggcccgcgggcccggcattcacgcggccgtgccgcgtccgagttcctgttctgcgcgcttga

SEQ ID NO: 6952 - DNA, 1272 bp, Pseudomonas aeruginosa
cggcgtgttgccctgggcgtcactggccacggtggcgtcgacttccgccttgcgcgtggcgctggcggcatcctgggcttgcttggccttggccggcaggtagcggtcgaggtcgagcttgtcgcccttgagctgggcgcgcagcgattgcctggcgaaatcggcgatgccgaagcggccgctgaaggcggtgtcgtccagacccagcttgaggtcttcgagattcaggctgttgcggctgccggccaggcgggtgttcagctcgaacttgccgagggtgttggcatcggccatggccggcagggtcacaccgatgccggcgaggaactcgcgcaggttcatcggcgcgatcgacaggccgccgctgaacttggtgtccttgtccagctcgcgggccttcagttcgccgagggcgcgcaactggttgacgctcagcttcaggccgttccactcggcgatctgcgccgactggtcgagcagcaactggccctgggcggagaaggtggcggtcttgccttgcagcggctcgcccgaggcttcgccggagagcctggcgtcttccagttggtagcgcctgagcgcggtgtcgaagcgcaggttgccggtcagctcggtcttgacccgtaccaccggctggttggtgccgaggtaggcgttgagcttcagcggaatgctgctgccttcgcgaatggcgccggtgctcagctcgatgccctcgacgttgtactgcttgccgctggcttcgtcggtgtaggtgacgcgggcgttgttgacattgaggctgtcgatgtcgagcttgatcggggtgcgcgggctgtcgttctgcggcgcctgctccggtgcctgcgcctgggcgcccttgccgtccgctgccggcggggtggcggaaggagcggccggggcctggggctgggccggcttgccgatgttttcccagttgcccttgccctgcttgtcgcggaccaggtccaggctcaggccttcgacgcggatcgcgctcatctgcacgtccttgcgcagcagcggcaggacccgcaccgacaggccgagcatctgcaggtcggcgaacggcttggtcggcgtggcggcgctggcgatgctggtgtcgtgcagctccaggcccagccaggggaacaggctccagccgatgtcgcccttcaggtccagctccaggttggccttgtcgcgggcgatctggcggatttcgtccttgtagtcattgggatcgaacaggtgggtcagggcgaagcccagggccacgacgagcagtaa

SEQ ID NO: 6953 - DNA, 1848 bp, Pseudomonas aeruginosa
gagtcccaggaagaacagccccaggaccttgccgaatgctttcatggacgaatcctttgtgctggcagcggtgaatgtgcgggcgagtataacaacgccgttttgccaggccgaccctgcgcgcggcgaaacctcgtctcagagtgcgcgggcgacccgttcggcgagcgccaggctggcggggaggccgggcgactcgatgccgaacaggttgaccaggccgggcaggccgtgttcggcaggggtttggatgatgaagtcggcggcgggttcccccggcccgccgagcttgggccggatgccggcgtagccggcggccaggcgccgaggatcgatgccggggaagtagcgcgagatggcctgggcgaaggcggggcggagggattcgtcgacgcggtagtcgaggttgtccacgtaattcacgtcgggaccgaagcgcaactggccgccgaggtcgagggtggcgtggatgccgagcccggcggtgcgcgcctcgggcatcgggtagaccaggtggcggaacggcgagcggccgctgtaggagaaatagcgcccctggcacaggtgcagcgccggcaccaggcgcggatcgaggccttcggtgcgttgcgccagcgcctgggcgaacaggccgccggcattgaccacccagcccgcgcgcaaccggaacgcttcgccgacgctctgtccttcggcgcgccagccgccggcgtggcgctccaggcggtcgacccgggtgtccagcgccagttgtgcgccgtggcgttcggcgacggcctgcagcgattgcaggtaggcgtggctgtcgatgattcccgtgctcggcgagagcagggcggcgaccccgcggacctggggctccagcgcgcgcagcgtggtgccgtccagcggcatcaggtcgtcgaccccgcaggcgcgtgcgttggccgccagggcctggagcctctcgcgctcgttttcctccaccgccaccagcagcttgccgatgcgccggtggccgacgccgtggcgggcgcaccaggcgtacaggcgttcgcggccttccaggcagagatcggccttgagcgagccgggcgggtagtagaggccggcgtggatcacttcggaattgcgactggaggtgtggctaccgaccagccgttcgcgctccgccaccagtacgccgtggccggcttcggccaggcgcgcggcgcaggccaggccgagggcgccggcgccgactaccagtacgtcgacgtcgttcatgcgtcgctggctgcgcgctgcagcacggcgatgatcgctgcccgcgcctgcgggctgttcttccagcaactggagccggtcagggccgcgccctgggcgaggatactcgcggcgtcgcagtcgcgcagccggacgaagctgtccaggcccatctgctccaggcgttgcagcacggtcgggccgacccccttgagggcaagcagggcggcgcgttcggcggaggaaaaggacatggcgaagctccgtggcggggaccgccaccgagcatatcagaggctgtccagcggcagcccgtggcgtgccgcgagggcacgggcctccaggtgcccgtccggggcgaccaggcgcagcggcttgccggcttcggcagccaggcgccgggcctcgtcgaggaggcgtcggccgaccccgcggccgcgggtgatgccgcgcacgcaaaggtgcgacagctgccaggcgtcgtcgccgcgccgcagcagggcggcacccagcaggcggtcgttgaagcgcccggcgatcagctcgccggcggccagcccggccgcgaccagcgccgcgccgtcggcatgcggggcgaacagccagtccggcgcgtcggcgtag

SEQ ID NO: 6954 - DNA, 624 bp, Pseudomonas aeruginosa
ttacgtgcagtgttagctgtggagctggtgatggccgaacgcaaggcatccgtcgcgcgcgacaccctggagacccagatcaaggtctccatcgacctggatgggaccggcaaggcccggttcgataccggggttcccttccttgaccacatgatggaccagatcgcccgccacggcctgatcgacctggacatcgagtgcaagggcgacctgcatatcgacgatcaccacaccgtcgaggacatcggcatcaccctcggccaggccttcgccaaggccatcggcgacaagaagggcatccgccgctacggccacgcctacgtgcccctcgacgaggcgctgtcgcgggtggtcatcgacttctccgggcggcccggcctgcagatgcacgttccctttacccgtgccagcgtcggcggcttcgacgtcgacctgttcatggaattcttccagggcttcgtcaaccacgcccaggtgaccctgcacatcgacaacctgcgcgggcacaacacccaccaccagatcgagaccgtgttcaaggccttcggccgcgcgctgcgcatggccatcgagctggacgagcggatggccgggcagatgccgtcgaccaaagggtgcctgtga

SEQ ID NO: 6955 - DNA, 456 bp, Pseudomonas aeruginosa
gccaggcggtggagcacccgttgtggcacgagattcccgaccaggcgcgcttctacttcgtgcacagctattacatcgaggccggtaacccgcgccaggtggtggggcacgggcactacggcgtcgatttcgccgccgcgctggccgaaggctcgcgtttcgccgtgcagttccacccggaaaagagccatacccacggcctgcaactgctgcagaacttcgtggcctgggacgggcgctggtaggtcatggccagggcgaagagcaatacgccgatcctccagctggacgccgcgcagactcaggacgcggtactggcgatcaagcgcttcatggaggaccgcttcgaactggagctgggttccttcgaagccgaggaactgctcgatttcttcgcccgcgagttcgccccgtacttctacaacaaggccatcctcgacgtgcagtcgtacctga

SEQ ID NO: 6956 - DNA, 936 bp, Pseudomonas aeruginosa
tcgcctccggcggcatccacaatctcggcgacatccagaagctgctggacgcccgcaccccggggatcatcggcgccatcaccggccgggcgatctacgaaggcaccctggacgtggccgaagcccaggcgctgtgcgacaacttcaaggcctgaggcgaaccgcatggcactggcaaaacgcatcatcccctgcctcgacgtggacaacggccgagtggtcaagggcgtcaagttcgagaacatccgcgacgccggcgacccggtcgagatcgctcgccgctacgacgagcagggtgccgacgagatcaccttcctcgatatcaccgccagcgtcgacgggcgcgacaccaccctgcataccgtcgagcgcatggctagccaggtgttcattccgctgaccgtgggcggcggcgtacgcagcgtgcaggacatccgcaacctgttgaatgccggcgcggacaaggtctcgatcaacaccgccgcggtgttcaaccccgagttcgtcggtgaggccgccgaccgcttcggctcgcagtgcatcgtggtcgccatcgacgcgaagaaggtttccgccccgggcgaggcgccgcgctgggaaatcttcacccatggcgggcgcaagcccaccgggctggatgccgtgctctgggcgaagaagatggaagacctgggcgctggcgagattctcctgaccagcatggaccaggacggcgtgaagagcggttacgacctgggcgtgacccgcgccatcagcgaggcggtgaacgtgccggtgatcgcttccggcggcgtcggcaacctggagcacctggccgccggcatcctcgagggcaaggccgacgcggtgctcgcggcgagcatcttccacttcggcgagtacaccgtgccggaagccaaggcctacctggccagccgcggtatcgtggtgcgctga
